United States Patent 7,314,974 (EXPRESSION OF MICROBIAL PROTEINS IN PLANTS FOR PRODUCTION OF PLANTS WITH IMPROVED PROPERTIES) - sequence listing, part 14

SEQ ID NO: 40788 - DNA, 2442 bp, Bacillus halodurans
atgatgtttggtcgttttacagaacgtgcgcaaaaggtgttagcactcgcgcaagaagaagccattcggctaggccataacaacattggcacagaacatattttgcttggattaattcgtgaaggcgaaggaattgccgccaaagctctacaagcgttagggcttggaccggaaaaaatacaaaaagaagtagagacgctaattgggaaaggccaggatggtgcgaaaaccattcattatacgccacgtgccaagaaagtcattgaactatctatggatgaagcgagaaagctcggtcattcctatgttggaactgaacatattttacttggtttaattcgtgaaggcgaaggtgttgctgcccgggtattaaacaacttaggggtgagcttgaacaaagcgcgtcaacaagtattacagttgctcggaagcaacgaaacaagtagctcttctcagcaaggaggcggagcagcgaacgccaatacgccaacacttgatagtttagcaagagacttaacggccattgctcgcgaggaagggcttgatccagtcatcggccgctcgaaagaaatcgagcgcgtaatccaagtgttgagtcgccgaacaaaaaataatccagttctcattggggagcctggcgtcgggaagaccgctattgccgaaggattagctcaagcgatcattcataatgaagtaccggaaacactccgaaataaacgggtgatgacgctcgatatggggacggttgtcgcaggaacgaaataccgcggagaatttgaagatcgtttaaaaaaggtaatggatgaaattcgccaagcggggaatgtgattctgtttattgatgagctgcatacattaatcggtgcaggtggagcggaaggtgccattgatgcttccaacattttaaagccttcattagcccgcggtgagttacagtgcatcggcgccactacactagatgagtaccgaaaatacattgaaaaagacgcagcgcttgagcggcgctttcagccgattcaagtaaatgagccgtctctcgatgagtcaattcaaattttaaaaggcttgcgggatcgttatgaagcgcaccatcgtgtaacgattaccgatgaggcgattgaggaagctgtcaagttatcagatcgttacattcaagaccgtttcttgccagataaggcgattgatttgatagacgaggcagcatcaaaagtgagacttcgctcttatacagcccctcctaacttaaaggaattggaacagaaactagaggaaacacgaaaagaaaaagacgctgctgttcaaagtcaagaattcgagaaggctgcttctttacgtgattctgagcagcgaattcgcgaagaactcgaccaaatgaaaaacgactggaagcaaaagcaaggacaagagaacacacaagtggttgttgatgacattgcccaagtcgtggcgagctggacaggaattccagtatctaaattggcagaagaggaaacggaacgtctgttaaaaatggaggagattttgcataagcgtgtaattgggcaagaagaggcggttaaagccatttctaaagctgtacgtcgcgcccgcgcagggttaaaagatccgaaacgaccaattggatcgtttattttcctcggaccaacaggggtcgggaaaacggagcttgctcgtgccgtcgctgaaacattgtttggcgatgaggatgcctttatccggatcgacatgtcagaatacatggaaaagcatgcgactagccgactcgttgggtcacctccaggatatgtgggccacgatgaaggggggcaactgacagaaaaggtccgtcgtaagccttactctgtcatccttcttgatgagattgaaaaagcacatccggaagtctttaacattctgctacaagtgcttgaagacgggcgtttgacagactctaagggacggacagtagatttccgcaatacggctgtgattatgacgtccaatgttggtgcaagcaccctccgcaaaaataaatttttagggtttacgacggattcagaaggatcagaatacaaggatatgaaagacaaagtcatgaccgaattaaaaaacagcttccgtccagagtttttaaaccggattgacgaaattattgtcttccattctttggagaaaaaacatgtgcgtgaaatcatcacgctcatggctgaccagttgaagaaacgattagaggaacaaggggtttccttcgaactaacagaggctgctaaagataaaattacagacctcggctacgatcctgagtatggggctcgtcctttacgtcgggcattgcagcgggaagtggaagatcgcttgtccgaggaacttctcaaaggaacaattcaaaaaggacagcgggccattatcgatgtagaaaacggcgaattggtcgtacattcgaaagaaggggccacactgtaa

SEQ ID NO: 40789 - DNA, 1458 bp, Bacillus halodurans
atggcaagtgaagtgagagttcgttttgccccaagtccgacgggtcatttacatataggtggtgctcgctcggctttatttaattatttatttgcaaaaaatcaagggggcatgtttgtcctgcgcattgaagataccgatcaagcaagaaacgttgggcaagcgaaggaaaagctacttgatagtttaaaatggcttggtgtcgagtgggatgaaagcatcgacgttggcggtgagtacggcccatatagcagcatggaacgtttggatatttataagaaacatattgagcaattgttaaatgaaggaaaagcgtattattgttacatgaccgaagaagagctagaggctgaacgtgaagcgcaaattgctagaggcgagatgccgaagtacagcggtcgggatcgtgatttaacggaggagcagcgccgcgcctatgaagcgaaagggatcaagccggttgttcgtttccgagtaccagaaggtcaagtgattaaaatccaagatgcggttcgcggggaggtttccttcgagtctgacggaattggcgactttgtcatcgcacgtaaagatggcgtaccgatgtataacttcgcggtcgtggtcgatgaccatctaatgaaaatttcccatgtgattcgcggggaggagcacctttccaatacgcctagacaggttatgctttatgaagcattcggttgggatgtgccaaccttcgcacatgcttctctcatattaaatccgaaccggcaaaaaatgagtaagcgggatgaatccatcattcagtttgttgaacaatataaagagttaggttatatgccggaagcgattgtgaactttctcgcattgctcggttggtctccggtcggtgaggaagagattttctcccttgaagagctagcagctcaattttcgttagagcgagtatcgaaggctccagccgtctttgacacagataagctcgcatggatgaacaatcagtacattaaaaatgctgatcttgacgatgtagtggcgctcgccttacctcatttacagaaagcaggtaagcttccagagagcctttctgaagaacaggctgaatgggcaaaagcggttatttctctttatcaagagcagcttcattacggagcagaaatcgttgagcttacagagttgtttttcaagactgaaattcagtataatgatgaagcacaggaagttttaaatgaagagcaagtgccaggtgtcctaagcggattccttcaagagttggaaggtttagacacatgggatgctgttagcattaaaggtgcgatcaaagcgacacagaaagcaacaggtcaaaaagggaaaaaactatttatgccgattcgcgtggcaacgacagggcaaacacacggaccggaacttccgagtgccattaaactaatcggaaaagaaattgtcacacatagacttcgatcgttactaaactaa

SEQ ID NO: 40790 - DNA, 3543 bp, Bacillus halodurans
ttgacaggtcaactcattcagtatggacgccaccgccaacgtagaagctatgcacgaatcaatgaagttttggagctaccaaacttaatcgagattcaaacagcttcttatcaatggtttcttgatgaggggttacgtgaaatgtttcaggacatttcacccattcaagacttcaccggaaatttagttttagagtttattgattatagtctcggagaaccaaaatatccggtggatgagtcaaaagaacgtgatgtgacctatgcggcgcctttacgtgtgaaagttcgcttaattaacaaagaaactggtgaagtaaaagagcaagaagtgtttatgggggacttcccgctcatgacagacacgggaacgttcatcattaacggagcggagcgagtgatcgtttctcagcttgttcgttcacctagtgtttactatagcgagaagattgataaaaacggaaaaaaaggttacaccgcaacggtgattccaaatcgtggtgcatggttagagttagagaccgatgcaaaggatattgtctatgtgagaatcgatcgtacacggaagattcctgtaacggttcttttgcgtgcccttgggtttggttctgatcaagaaatcattgatttactaggagaagacgagtatctacgcaatacgctagaaaaagataacacagacagtgccgaaaaagcattgctggaaatctacgagcgtcttcgcccaggtgaaccacctactgtcgaaaatgcgaaaagcttactcgactctcgtttctttgacccaaaacgctatgacttagcgaatgtaggtcgctataaagtcaataaaaaattacacataaaaaaccgcctattcaatcagcgcttagcagaaacgcttattgatccagaaaccggagaagtgattgcggaagaagggtccatcatcgatcgtcgtacgttggatcgcattctcccatatttagaaaacaatgttggtttccggactgttcgcatgtctggtggtgttgtggaagaagatgaagttcgtcttcaatcggtgaaaatctatgcaccagatgatcaagatggagaacatgtcattcgtgttatcggcaacggacttgttgaaaaggaaatcaagcatattacaccggcggacatcatcgcttcgattaactacttctttaacttgttgcatagtgtcggtggaactgatgacattgatcatttaggaaaccgtcgcctccgttctgtcggtgagttgttgcaaaaccaattccgtatcggattatcgcgtatggagcgggttgttcgtgagcgtatgtctattcaagacccgaacagcattacgccgcaagcacttattaacattcgcccagtgattgcctcgattaaagagttctttggtagctcgcagctatctcaattcatggatcagacgaacccgttagcggagttaacgcataagcgtcgtctttctgcgttaggacctggtggattaacgcgtgagcgcgcagggtttgaggttcgtgacgtccactactcccactatggacggatgtgtccaatcgagacaccagagggtccaaacatcggtttgatcaactcgttatccacttatgctaaagtcaacgagttcggctttatggagacaccttatcgccgcgtagaccctgaaactgggaaggttacggcgcaaattgattacttaacggccgatgaagaagataactacgttgtggcccaggcgaacatgaagcttgccgaggacggatcgtttatcgatgaaaatattattgcccgcttccgtggtgagaatatcgttgtatctagagatcgtgtggactacatggacgtatcgccgaagcaagtcgtttcagctgcgacatcatgtatcccgttcttagaaaacgatgactctaaccgggcgcttatgggtgcgaacatgcaacgtcaggcggtaccgcttcttgtaccggaagctccaattgtcggaacagggatggagcacgtatcggcgaaagattcgggtgctgcgatcgtctctaaacaccgcggaattgtcgagcgagtaacggcgaaagaaatttgggttcgtcgtctagaagaagtggacggaaaagagatcaaaggggatcttgataaatatcgcctacagaagtttattcgctcgaaccaaggaacgagctacaaccaacgtccaatcgtaaaagaaggagacgtggtggagaagcgtgaaatccttgctgatggaccttcgatggaaaaaggtgagatggcgctcggacgtaacgttctcgtcggctttatgacttgggaagggtacaactatgaggatgcgatcattttaagtgagcgtctcgtaaaagacgatgtgtacacatcgattcacattgaggagtacgagtcggaagctcgtgacacgaagcttgggccagaagaaattacgcgggatattccaaacgtcggggaagatgcattgcgcaacttggatgaacgaggaatcattcgcgtaggggcagaagtaaaagatggcgatattctcgtcggtaaagtaacgcctaaaggtgtgacggagctgacagcggaagagcgtttacttcatgccatcttcggtgagaaagctcgtgaagtacgtgatacgtccttacgtgcgccgcatggcggagacggaatcgtccttgacgtgaaaatcttcaaccgtgaagacggtgatgaactgcctcctggtgtaaaccagctcgtccgtgtgtacattgttcagaagcgtaaaattcatgaaggggataaaatggccggtcgtcacggtaacaaaggggttatctctcggattcttccagaagaggatatgccgtatttaccagatggtacgccgattgacattatgttaaacccactaggggtaccttcacgaatgaatatcggacaagtgcttgaacttcatttaggaatggcggctagacgtcttggccttcatgtggcatcaccagtatttgacggtgctagtgaagaggacgtctgggcgacgcttgaagaagcaggaatggcgcgagacggaaaaacgatcttgtatgatggacgtacaggtgaaccgtttgataatcgtgtctccgtcggcattatgtacatgatcaagcttgctcacatggttgacgataagttgcacgcacgttcgacaggtccttactcccttgtaacgcaacagccattgggaggtaaagcgcagttcggtggtcagcgttttggtgagatggaggtatgggcattagaagcttatggtgctgcctacacccttcaagaaatccttaccgtcaaatcggatgacgtcgtaggtcgtgtgaaaacgtacgaagccatcgtaaagggagaaaacgtccctgagcctggtgttccagaatcatttaaagttcttataaaagagctacagtctctcggtatggacgtcaagatgctatcaagtactgaggaagagattgaaatgaaagagcttgatgatgaggatgaacaagcaagcgacaaattgaacttgaatattgattcaacagaatcaaatgtttaa

SEQ ID NO: 40791 - DNA, 831 bp, Bacillus halodurans
atggcaattaagaagtataaaccgaccagtgccggtcgtcgtggcatgtctacattagatttcgctgaaatcaccacggacaaaccggaaaagtcgttgcttgctccattgcataaaaaaggtggacgcaacaaccaaggaaaaatgacggttcgtcaccaaggtggcggtcataaacgtcaatatcgtatcatcgatttcaaacgcaacaaagatggaattccaggacgcgttgctacgatcgaatatgatccaaaccgttctgcaaacattgcacttatcaactatgtggacggagagaagcgttacattttagctccaaaagggttaaaagttggcatgaccattgagtctggtccagaagcggacatcaaagtaggtaacgcacttccgcttaaaaacatcccagttggtacagttatccacaacatcgagttgaagcctggaaaaggtggacagctcgtacgttctgcaggtgcagaagctcaacttcttggtaaagaaggagactacgttctcgtacgtcttaactctggtgagactcgttacatcctagcgacttgccgtgcgactattggtcaagttggaaaccttgagcatgagcttgtgaacattgggaaagctggacgttctcgctggttaggcaagcgcccaactgttcgtggatctgcgatgaaccctaacgatcacccacacggtggtggtgaaggtcgtgcaccaatcggacgtaagtcaccaatgtctccatggggcaaaccgacacttggttacaaaactcgtaagaaaaacaaagcatctgataagtacattgtacgtcgtcgtaaaaaataa

SEQ ID NO: 40792 - DNA, 849 bp, Bacillus halodurans
atgaaaggctctccgtttgagaaggtggccttatcggacgtatcgtttacgattccttcaggctcctttactgcgattatcggccatacaggttctggtaagtccacattggctcagcatttcaatggattgcttcgcccgtcaaaagggacggtccgcctcggggaactggaaatcacggctgatcagaagccgccctcgcttaaagagattcggcgtaaggtcggcctcgtctttcagtacccagagcatcaattgtttgaggaaaccgtggagaaggacatctgctttggaccgatgaattacggtgtaagtgaagcgcgggcgaaaaagcgggccaaggaactgctccatctcgtcggcttgccggacacttacttgcaagcttctccattctcgttaagcggggggcaaatgcggcgggtagccattgctggagtgctggcgatggaaccggacgtcctcgttctcgacgagccaaccgccgggttagacccagaaggtcagcggctcatcatggacatgttttatcgcctgcaccaggagaaagagctgacgacggtgctcgtcactcataatatgagcgatgctgccaagtttgccgatcaaattatcgtcatgagtcaagggaatgtcgccatgacaggtgaccgccagacggtgtttgcacgggcggacgagctggtagcccttggccttgatgttccagagacgctgcaactgctactacaggtgaaggagcgattcggcttgcacgacgtaccgccgttattttccctagaggaactagccgattttctcgccaaagagctccagcagaaagagggacagccatgttccaaaatataa

SEQ ID NO: 40793 - DNA, 1329 bp, Bacillus halodurans
atgacagaaggtattaagattgcgacaattggtgggggttcaagctatacgcctgaacttgttgaaggctttattaaacgctatgatgagctgccggtccgtgaactatggctcgtcgatattgaggaaggcaaagaaaaaatggagatcgtcgggaaccttgcgaagcgcatggtccaaaaagcaggtctaccgatcgacattcatctaacccttgatcgaagagaagcgttaaaaggagccgatttcgttacgacgcaatttcgagtgggcttgctggatgcgcgggcaaaggatgagcgaattccattaaagtatggcgtgctcgggcaagaaacgaacgggccaggcggcttgtttaaagggctgcgcacgattccggttattcttgacatttgccgtgacatggaggagctgtgtccagacgcatggcttatcaactttacgaatccagcgggcatggtgacagaagctgtattacgttatgccaatattaaaaaagtcgtcgggctatgcaatgttcccatcgggatcgaaatgggtgtcgccaaactgcttgatgtggatcactcgcgcattcgcattgactttgccggcttgaaccatatggtgtacgggctcgatgtttatttagatggtgtgagtgtaaaagacaaagtgattgagatgatcacagatccgaacaatagtagtttcgtcaaaaacatcgaagggctcggctgggagccatcctttgtcaaagcgcttggcgtcctcacatgcccataccatatgtattattacaagtcacgggaaatggtcgaaaaggatttgaaaaaggctaaggaggaaggcacgcgggcggaagtcgttcaacgcttagaaaaagaactgtttgagctgtataaggacccaaatctagacatcaagccaccacagctcgaagaacggggcggagcctattactcggacgccgctgtccgcttaatccattcgatttatacggatcgacgagatattcagcccgtgaatacgatgaatcgcggggcgatcgcaagcatcccggacgactcagcagtggaagtgagttgtgtcatcacaaaggatggaccgaagccgatcgcgatgggagatttgccagtcccggtccgcggactcgtccagcaaatcaagtcgtttgagcgggtagcagcagaagctgccgttactggcgattatgaccttactgtgctggcgatgacgatcaatccattaagtccatcggacacgatcgcgaaacaaatcgttgatgacatgcttgaggcacacaaagagcacttgccgcaatttttcaacgaagttcaagcgtaa

SEQ ID NO: 40794 - DNA, 1065 bp, Bacillus halodurans
atgaaagcccttaatttatacggcattcaagaccttcgatttgaagaaacaccggccccttccatcgagcacgatgacgacatcatcataaaggtgaaggcggttggaatatgcggctctgacctctctcgatacaaaaagctcggtccttatgttccagggatgacgtttggtcatgaatttgcaggggaagtcgtcaaaatcggccgttcggtgactggattttccataggcgatcgggtggccgcttgtcctacctatacatgtggtcaatgtcgatactgtcaattaggtgagcccacacgttgcgagcggctatctgttatcggtgcccgtcatcccggcgcttatgctgaatatgtaaagctccccgcaaagcatgtgattcccttgccaaacgttgtgaactatgatgaagcagcactgattgagccggcttccgttgtggcacatggcttttatcggacgaatataaagcctggggcatccgttgcgatcatgggagtcggaagcattggcttgttggcggttcaatgggcaaagatttttggagcgactacggtttttgccatcgacatcgacgaacaaaaactgaatgtcgctaaccagctaggtgccgatgtattaattagtagcttacagcgcccagcccataaacaaattttggagtatacgaacggcatcggggtcgatgtggcggtagaatctgcagggactccaagcacgtctgcccaagtattcgcccttcctaaaaaaggcggggaagttgtatttctcggaattccttatgctgacgtccaaatcgaacgtttttattttgagaaaattgtccgcaacgaacttcatgtctacggttcgtggaatgcgctctcctccccattccctggaaaggaatgggcgaccacaatacattatatgtcaagtgggcaactgaacgtagcaccgatgatctcgtatcgccttcctctagccaaaggtcccgagacatttcagcaaatagctaaaggggaactgaaaccgacaaaagtattgttttacccagaaaaactgtctgagaggaagtag

SEQ ID NO: 40795 - DNA, 1032 bp, Bacillus halodurans
atgaaagcattagtaaaaacacaacatggcacgggccattttgccgtgcaagagaaacccgaaccaactccagggaaacatcaagtaaaaatcaaagtaaagtacacaggcgtttgtggttcagatattcatacctatgagggccattatcctgtagccgctccagtcacacttggtcatgaattttcaggtgagatcgttgaactcggtgaaggtgtaacaggctttaacgttggcgaccgagtaacatcagaaacgacctactcgatttgcggtaaatgctcatattgcacctcgggtgactataatctttgctctcaccggaaaggacttgggaatcagcaggatggcagttttgctaaatacgtaatcgcgcgacaagagagtttgcaccatctccctgctggtgtggatgatcgctcagcagccatgacagagcccctcgcatgtacacatcatgcgattgcaaaaaccagcatcaacaaaggggacttagttgtcgttactggtcctggtccgattggtttgttagcagctcaagttgcaaaaagtcacggtggaacagtgattattacaggtctatccaatgatcaagtccgattaaaaaaagcaaaggaagtcgggatcgattacgccatcgatacacaggaagtggacataaaagagcttgtctccgagcttacagacggctatggtgcagatgtcgttttagaatgttctggcgctgtgccagccgcaaaacaagggattgatcttttacgcaagaaaggacaatatgcccaagtcggcttatttgcccagcccgagatccaatttaattttgagaaaattattcaaaaagagatttccgtcgttgggagtagaagtcaaaaacctgcggattgggagcctgccctctcacttcttaatgaaaaaaaagtaaatgccaaaacactcgtcacccatgaatacacaatttctgaatgggataaggcctatcacgcgattaaaagtggtgaggctatcaaagtattattgacacctattgattag

SEQ ID NO: 40796 - DNA, 774 bp, Bacillus halodurans
atgagtagcgatttcattcagtcgtggaccgaaggagcagtgggcgtgattcagctcaaccgtccaaaagtcgcgaatgctttaaatcgtcagatggttcaggaaatagtagagcaagcggaacgctacgatcgtgatcaagagattcgcgtcattttagtcaaggggagcgagcgggcatttgctgcaggagctgatatccgagagatggaaggtgaaactcctattcgttttgagctagccgacccttttgctgactgggatcgatttacgagaattcataaaccgatggtagctgcggtgagtggctttgccttagggggcggctttgaattggcccttcattgcgatctgattgtggcagcgaccaatgctcgttttggctttccagaagtgtcgttaggtgttttaccaggggcaggggggactcagctgctcactcgcgcggtaggacgaaagaaagcgctcgaatggatttggacgggtaagcacatatcagctcaagaggcgttgcagattgggattatcaataaaatcgttgagccagagctagtagaagaggaggcttttcgattggctcgaaccattgtcaagcaagcaccgattgccgttcgtcttattaaggaagctgttcatcaggcagaggacgtaacgttagcagatggcatgatgctcgaaaggaaaaatttttatctcgcgtttgctacaaaggatcaaaaagaaggaatgaaagcctttcttgaaaaacgtccaccgatttttaaaggagagtaa

SEQ ID NO: 40797 - DNA, 783 bp, Bacillus halodurans
atgtgcgaagagtttaaagacattatctatgaggagaagggacaagtggcttgggtcacattaaatcggccagcaacctacaatgcatttacacctgttatgaatcgagaagtgaccgttgcattaaaaaaggccaatcaatcggatgcaattcgagcgattgtgttgacggggactggaagagcgttttgttctggtgaggatttagatggggtaacggtagacacagatcacggagcgattttgcgagctcgataccatccgatgatgcaagggatgaagcaagtcgagaaaccaataatagccgccgtcaatgggacagccgcaggagcgggcatgagtttagcgttggcagcagacttccgactcgtacatgagaatgcaaaatttgttagcgctttcttaggggttgggttgatcccagactccgggtttttgtaccaacttccgcggatgattgggtatgcgaaggcgctggagctagccgtgcttggcaagccgctctcagctgaggacgcacagaggtgtgggctcgtcactgaagtctttgcagcggatgagtgggaagatggtgttgctagcttttcgatgaaattagccgctcttccgacgaaggcgatcggtttaataaaacggctcatgatcgacggcatgaacgaaggttttctcgaagtgttggaaaaagaagcgcaagcccagcggatcgcaggacaatctgctgatcatagggaagggcttgaagcatttaaacaaagccgtccccctatgtttacaggcctgtag

SEQ ID NO: 40798 - DNA, 1473 bp, Bacillus halodurans
atgaaacgggaccactatcggatggtcattaacggagaacgggtcgatagcgacgaaacctttgagacgtttaaccctgccaaaggtgagattttagcaacggttgcaaaagcaagtcgtgagcatgcagaaaaggcagttcaggcggctcgccatgctttcgatcacggcaaatggcgaaagtaccctgttggaaaacgtgctcgtgtgcttaatcaaattgccgccattatgagggagcggtttcaagagcttgtagaaatcgaagtgcttaatagtggcaaagcgatcagtgctgctcaagcacaaatcaatcaagcaatcgaagactttgagttttatgctggggcgattgtaggccatcgtggaaccgtaaacaacgtccctaatggatttctgaactacacacagaaggagccggtcggtgtttgtgcacagatcattccgtggaactacccgttgatgatggcagcatggaaagtcgctccggcactagctgcgggttgttctgttgttgttaagccggcaagcttaaccccgattacagcgattcttttaaatgaaatttgccatgaagctggtgtgccagaaggtgtggtcaatacggttgcaggggctggaagcgttgttggtgattatctagttgggcatgaagacgtaaataaagtcgcatttacaggctctactccaatcggaaaagacatcatggaaaaggcctcacacacattgaagcgtgtcacgttagagctcggcggtaaatcacctaatctagtttttgcagatgccgatatggaagcagccgttgcaggttctttatttgggatttactttaatactggtcagtcttgtgaagcgagatcgcgcctgtttgttcatgaagaaatttacgatgagtttatagaggagtttatcactcgcgcaaaaaagttacagctaggagatccatttgataaaggtacacatgtcggttcgatcattagtagagaccagcttgaaatcattgatagctatgttcgttcagcagaggaagaaggggcaacgattgccttaggtggaaaagagaggcgggtggaaggctttgaaaacggccattggtatgagccaacagtcattaccaatgtaacaccagatatgaaggcggtacaggaagaaatctttggacctgttgtggttgtcgaaacgtttcaggatgagagagaggtcattaagcgggccaatgatacgaaattcggcttaggttcagctatttggacgaaagatcaaggtcgtgctacgcgcgtggctcatcagctggaagcagggattgtcatggtgaactgtccattttcggcttttcctggtaccccttttggcggctacaaagaatcaggatttggtcgtgagctttgcgtagagactctcgatctctatatggaggataagagtatcttatcctattatggaccgaagcctattaatccattcggagtttaa

SEQ ID NO: 40799 - DNA, 849 bp, Bacillus halodurans
gtggttaaacaggtgacggtggtcggcgccggcgtgatggggagaggcattgcttatgtctttgccctcgccggctttcagaccactttaacagatatatcggaagagcaattgaatcgtgcacaacaatacgtcgaggaaacagcggaaaaaggggtagccaaagggaaagttactgaggagcaaaaagcagcgatcgtacatggcttgaacgtcacaactcatttaaaagacgctgtgaagcaggcggatcttattgttgaagccgtccctgaaaaacgagagttgaaacaggcggtgcttgaagtagccgacgagtattctccccctcatgcggtgattgcttccaacacatcgaccataagtccaactgaacttggctcttatacgaagcgatctaatcaaacggcggtgatgcacttctttaacccagttccgctcatgccgctagttgagattgtcaaaggtctagaaacgagtcaacaaacggtggacacgatccgggaagtttctgagcaaatagggaaagaaacagtggaagtcaatgagtttccgggattcgttacgagtcgaataagcgctttaatcgggaacgaagcgcttcatatgcttcaggaaggggtcgcttctgctgaagacatcgataaggctgtgagattagggttgaacttcccaatgggcccgctggaactagcagatcttgtcggattagacgctaggttaaacaacttgcgctatctgcatgaaacgttaggcgaaaaatatcgcccagcgcctcttttggaaaagctcgtgaaagcaggaaggttaggaaggaaaacaaagcaagggatctataaatatgattga

SEQ ID NO: 40800 - DNA, 1203 bp, Bacillus halodurans
atggaggaagttgtcatcatagatgcggttcgaactccgatcggtcgctataacggtgccctgcgtgacgtgcgccccgatgatttaggagccattgtgttacgtgcgttgaaggaacgaaatcctcaagtgcccatagatgaggtggaagaggttgtgtttggcaatgccaatggggcgggtgaagataatcgtaacgtagcacgtatgtcaacgttattggctggctatcctgttcaagtggcggccactacactgaaccggttatgtggctctggattagatgcggtcgcctatgctgctcggatgatagccgttggtgaaggggagattgtcattgctggtggaacggagagcatgacgcgcgctccttacgtgatggaaaaaccgggacaaagctacatgcgtggtgatcaaacactctatgacacaaccattggctggcgttttgtccaccctgtcatggaagagacgtacggcgtagactcaatgccagaaacggctgaaaatgtagccaaaacttacagtatttcgcgtctagcacaagatcactttgcctatgtgagccaaatgcgagcaaaagaggcaatggaatgtggccggttggacgaagagctcgttccagtggagatcgaggataaaaagaatgggaaatatgaggttcgtacagatgaacatccacgtccaacatcgacaatggagaagttaaacagcctatcgccgctttttgaaaatggcacggttactgcggggaatgcatcgggaatcaatgacggggcggctgcggtcttgttaatgagtcgaaaaaaagcgaacgaactcggcttgacaccgctcgcttcttatatcggggcagcgacagcaggggttgaaccacgaatcatggggattgggcctgtatatgcgacgaacaaattgttgaaccgtattggatggacggtgaatggtctggatttgatcgaattaaatgaagcattcgctgctcaggcgttagcctgcattcatgagttagggcttaaccaagaagtggtcaacgtaaatggcggtgctatagcatatggtcacccattaggcgccagtggagcgagaattttaacaacgcttctttatgaaatgagaagaaggggaagcaggaagggactcgccacgatgtgtataggtgtaggccaaggaatatctgtagcggtggagcgaatcgattaa

SEQ ID NO: 40801 - DNA, 1104 bp, Bacillus halodurans
atggcgatagaaaacaaggggattcagcgcgagctcaagcatgaggaaaatctatttcaagtgcttacacctaaaggtgaatgccagtatgagggaagcgagtttttagacaaaacgttcgttttaagcatgtacaaacagatgatcaattgtcgcgaatttgacgagaaagccttaaagttacaaaggcaaggaagaattggaacgtatgcttcttttaaagggcaggaagcatgtcaaataggaggtgcattggcattgcgcccaacggattggctctttcctacgtatcgagaccatgcagctatttctacccatggtcagccatggcaccgtatttttttgtattggatggggcatatggatggaagtctttcaccagatgacaggaatatcctccccccagctgttcctattgcaacccagatgcttcatgcggttggaacggcatgggcggataaattaaaagggaatccacatgtgagcctcgtcttttttggcgatggggcgacttcggagggagattttcatgaagctctcaactttgccggagtatatcaaacaccaacaatcttcttttgccaaaacaacggctatgccatcagtgtaccgtttgagaaacaatcggcttcaaagacgattaaacaacggtctgtagcgtacgacatgcgaggagagcgggttgatggcaatgatatttttgccgtttatctcaccgtgaaaagggccattgagcaagcacggaaaggcagagggccaacactaattgaagcggtcacaactcgatttggctctcatacgacagcggatgatgcgaagaaataccgtgatcaagaggaaatcgaacgaacttggaaggaaatgcaggacccactcacaaggttaaaagcttatatccaagcgaaaggctggctgagcgaggaggaagaagcacaaatgaaggcaaagattcgtgaaacgatcgatgaggagctttcgatggccgaacagtatccgaagccttcgatttcacaaatgtttgagcatgtgtatgaaaaccaaccatggtatgtgaaagaacaggagcaagagctagctgaactgttagggaaggagaagagatag

SEQ ID NO: 40802 - DNA, 987 bp, Bacillus halodurans
atgggttcgcaacaacaaacgatgctacaagcaattaatcagacactagatgaccttttagcaacaaatgacgatgtcatgttgttaggggaggacattggaataaatggtggtgtttttcgtgcaaccgatggcctttatgaaaagtatggaaaggacagagtggtcgatactcccttagctgaatcgggcatcattggatctgctattggtcttgcgatgaatggcaagcgcccaatcgtagaaatacaatttcttgcgttcatttatccaggatttgagcagctcatttcccatgctgctcgaatgagataccgcacgagagggcagtacaatgtaccaatggtcattcgaacaccatatggcgcagggattcgtggaccagaactgcattctgaaagtgttgaagccttttttgcccatacacctgggttaaaggtggtcgctccgagcaatccatacgatgctaagggtcttttaacagccgctacttctgaccctgaccctgtcatttttctcgaggatacgaaactatatcgagcgtttaaagaggatgtgcctaatactctgtatgaaattccgctcggtcaagcgaaagtcgttcaagagggcgaagatgtaaccgtgattgcttggggtggcatggtgcgagaagccttacaagcggcgaaggaagcagagaaagcccatggttggtcatgtgaaattattgacctacgtaccattgctccgattgatcgagaaacgatcattgaatcagtaaaaaagactggcagggccattattattcatgaggcgcacaaaacagcaggactaggcggggaaataacggcattgattaacgaagaggctctaatttatttaaaggcacccgtcaaaagaattgcagggttcgatattccggttccgcaattcctatcggaaaatcaatatctaccaacaattgaacggatgtttcgtgggattgaagagactgttagcttttaa

SEQ ID NO: 40803 - DNA, 1245 bp, Bacillus halodurans
atggttgaatttagactacctgatgtaggggaagggatgcatgagggagaaattattagctggtttgttcaagaaggagaccatgtcaaacaggatgagccggttgttgaagttcaaaccgataagatgaatgcagagttaacagccccagtatcaggtaaaataaaacgagtttattataaagtaggagaagtagcagaggtggggtcgttgttattcacaattgacgagaacctatcaacctttaaatccgaaacacatgaacgaacaaaacgagaaaacagcactgaacaaacacgtccaatctctaacattagtttgacgtcacaacaaaaagcccccgttagaaaaggattggctactccctacgtaagacagttagcgagggaaatgaatattaatttagaagacgttgtcggtacaggacctggggggagagtgttagagcaagatttacaaaacgatacgaatctacaaaaagttaaaacggtgccatcgggagtggcgaatgttcaggaaagcatcgaacgaacaggatcatctgcggaaaagcgcattcctttgaaaggaattcgtaaagcaattgcagagaagatgataaaatctgttgctacgattccacacgtgacacacgttgatgaaattgaaatggatgctttaaaggagctccgtgagcagttaaaacattacagcgaacagaaagggataaagcttacgtttctacctttttttataaaagcaattgtaagcgctttaaaagagtttgagtattttaatgcttcgattgatgaggagacaaatgaaattgtgttaaagaaagactatcacattgggattgccacagatacagaaaaggggctcattgttccagtcattcaaaatgccgatcaaaaaagcttgctagagctggcaggagaaattactcaattgtctactcaagcaagaaaaggaacgttaaatgttcagcagatgaccggaagtacatttacgattagtaatgtcggtccaatcggcggtctgcacgctaccccaatcattaactatccggaggtggccattcttgcattgcataaaatggagccgcgaaacgttgtgagagagtgggagagtgtaataaaactcatgatgaatatgtctttatcgtttgaccacaggttagtggacggggcaacagctgttcgtttcacaaatcgcatgaaagagctcattgagaatccaaacttactattaatggagttgaggtaa

SEQ ID NO: 40804 - DNA, 1422 bp, Bacillus halodurans
atggtcgtaggagaggtagcagtggaggtagatacggtcgtcgttggaggtggtccaggtggatatactgcagctattcggttaggtcagttagggaagtctgttgttcttattgaaaaaaaccagctagggggtgtctgtttaaatcggggctgtattccatcaaaagcgcttatccaaatggctgaaaagtttgatgaactcacccatttaaaagagatgggggttgaactcccaggtaagccagcttctattgacttacacaagtggcagaaatggaaacaggagattacaacaaagttaaacacaggtattcaccaattgtgccagcaaaatggggtgacggtcgtcactggagaagcgcattttctatccagtcatcgtgtcggggttgaaacgggtaacgcttttgacgtgtataaatttgaacatgcgatcgtagctacagggtcaagcccgagatctctcccttttgctgaagtcgatcacacgtacatactagattctacttcggctttagagctaacagaggtgcctcgctccttatcaattgtagggggaggttacattgggatggagcttgggctcgcttttgcgaagttaggaagtgccgtcaccattgtggagatgtctcctcatattttaccggctactgccccccatataagccgagaagtgctaaataaggcggagaagttaggggtgacgattaagtcgtctactagtgttgaacatctaacggtgaatgacggttacgtagagctcatcgttcaatcaaatggagaacaagaaacgttacaaagcgaaaaagcattgatgacagtcggaagatcgccaaatacaaaaggtctagggttagagcaggtaggtgttttttttaatgaagatgggacgttaccgattaatgaagaatgccgaacgaacattgatcatatttttgccattggagatgtaactgaggggccggcgctagcacataaggcatcaaagcaagggatcgttgctgctgaagtcattggcggcttgccgagtgcgatcgattcctcttatatcccatatgtcgtgtttactgatccacaaattgcaggggttgggctgacggctaagcaagcgcaggaacaagggcatcgtgtaaaaacagctcggttcccgttccaagcgaatggactggctttagttgctagtaagcccgatgggtttgctgaagtaatcgttgacgaggagagtcaccttctgctaggctttcatatcgttggggcagatgcctctaacttgatcggtgaaggagtattagccttagagttaggagcacgggtggaggatgttgcactaactgtccacccccatccaacatttagtgaagggtggctgggagcagcagaggctgcgttaggtcacgctatccatgtggtgaacaaataa

SEQ ID NO: 40805 - DNA, 1344 bp, Bacillus halodurans
atgggaaagtattttggaactgatggagtgcggggagtcgccaatacagagctcacgcctgagcttgcgttcaaattagggcgtatcggagggtatgtactaacaaaagacaaggaaaaccctaaggtgctcattggtcgagacactcgtatttctggtgaaatgcttgaaggggctctcgtagcgggtctgttatctattggcgtagaagttatgcgattaggagtcatctctacacctggtgtcgcttttttaacgaaagcggttagcgccagtgcaggggttatgatttcagcctcacataatccggtggctgataacgggattaaatttttcggacctgatggttttaaactccttgatgagcaggagaaggagatcgaaacgcttcttgatcaagaagatgctttaccaagacctacgggtgccgatttaggtcaagcgaatgactattttgaaggggcgcaaaaataccttcaatttttaaagcaaacggtagatgaagactttacaggtatacatattgcactcgattgtgcaaatggtgcggcgtcctcgctcgcccctcacctgtttgccgatcttgaagccgatatttcgacaatggggacatcgccaaacggaaaaaacataaatgatggtgtcggctctactcacccagaagctctcgcggcatttgttaacgcgaaaaacgccgatattggccttgcttttgatggtgacgccgatcgactcattgccgtagatgaaaaaggaaacatcgtggacggcgacaaaatcttgtatatttgtgctaagtatatgaaagaaaaagggctgttgaagcaacagacgcttgtgacaacagtaatgagtaatttaggtctctataaggcgttagaagcgttgcaaatcgatacgaagcaaaccgctgtaggtgaccgttacgtcatggaggaaatgcgtaaaggtggatacaaccttggcggagaacagtctggtcatattattttccttgatcatattacgacaggtgatggcatgctctctgcgctgcaactcgtcaatattatgaagcagacaggaaagaaactgtcagagcttgctgaggagtgggagacattcccgcaaacccttgtaaacattcgagtaacagacaaacatgctgtgacagataacgagaaggttcccgctgtgatcaaagaagtagagcaagaaatgaacggtgaaggtcgagtattagttcgtccgtcggggacagaaccgcttgtacgcatcatggttgaggcgaaaacagaagagctatgtgacgcttttgtgaataaaatagccgatgtcgtaaaggcagagctagggcaagagtaa

SEQ ID NO: 40806 - DNA, 1803 bp, Bacillus halodurans
atgtgtggaattgtaggttatattggaacggaagatgcgaaagagattttattaaaagggcttgagaagcttgaataccgtggttatgactcagcaggaatcgctgtggctacggaagaaggggtccatatttttaaagaaaagggacggattgcgaccctccgtgaagtagtggatcaaggcgtaaaaagtacggtcggaatcggacatactcgttgggcgacccacggtgaaccgagcaaggtcaatgcccacccgcatcaaagcgaatcgtctcgctttaccattgttcataatggagtcattgaaaattatgaacagttgaagcgtgactatttgcaagccgtgacattacaaagtgatacggatacggaagtggtcgttcagcttgttgagcgttttgttcatgaaggacaaagcgtggaagcagcgttccgccacaccctttccctattgaagggatcgtatgccatcgccttattagacaaaaaagacacggacacgatttatgtgggaaaaaataagagcccgcttcttgtcggtgttcaggatggggtcaatgtcgttgcgtcagatgcgatggcgatgttacaagtaacggatcaatttcttgaaattatggatgaggaaatcgtcattgtcacaaaagatgacgtgaccattaaaacgcttgatggcacagccgtcagccgtgagccttatacagcagagttagatgcgagcgacatcgaaaaggggacgtaccctcatttcatgttaaaagagattgatgagcagccgtttgtcattcgtaacattatccaaaaatatcaaaacgaagacggctctgtccgtttagacgaagacattcgtcaagcggttatggaagctgatcggatttacattatagcagccggcacgagctaccatgcaggacttgtcggcaaacagctcattgaaaactttgcaaaacaaccagtagaagtgcatattgccagtgagttcttatacaatatgccactgctgtcgaaacgcccactctttatctttatctcccaaagcggagaaacggcggattcacgaggcgttcttgtcgaagtgaagaagcttggctacaaagcactgacgatcacgaacgtgccaggctctactctttcacgtgaagcggactttacgcttcatacgcatgcaggcccagaaattgcggtggcgtccacaaaagcctatacagcacaaatggcggtactcacgttacttgcagctgacacagcgaaagcaaaaggaatcgacctcgggtttgatccaatccaagagcttagcattgtggccaacgccatggagacactatgcaaccaaaaggaaacccttgaaaagattgcccgcgattatttagcggtcactcgcaactgcttcttcattgggcgggcaacggattacttcgtttgcctcgaaggcgcgctcaagctgaaggagatttcctacattcaagcagaaggcttcgcaggcggcgaattaaaacacggcacgatcgcgctcatcgaagagggcacaccgattgtcgcccttgcaacacaagagcacgtgaacctaagcattcgcggcaatgtgaaagaagtggcggcccgcggggcattcccatgcatcatcagcatggaaggactgaacgaagaagacgacacattcgtcctcccaaaagtccacagccaccttacgccactcgtgtctgtcatcccgttgcagctgatcgcgtactacgctgcgctacaccgtggttgtgacgtagataagccacgaaaccttgcgaagagtgtgacggtggagtag

SEQ ID NO: 40807 - DNA, 909 bp, Bacillus halodurans
atgaagcctttaataggaaaagttgcattagtggcaggggcaacaagaggtgcagggagaggaattgctgttgaattaggggcggcaggggcgaccgtttatgtgacggggcgaacgacccgcgaaaggcgctccgagtacaatcgtccggaaacgattgaagaaacagctgagctcgtcacaaacgcagggggcacaggtattgctgttcctgtcgatcatcttgatccacagaaagtagaggcgttagtgtcccaaattgaacgtgagcaaggcaaactagacgtgctcgtcaacgacatttggggcggtgagctgcttactgaatggaatgcccccgtttggcagcattctctggacgatggattacggatgcttcgcctggcaatcgatacccacttgatcacgagtcactttgcgttgccacttcttctaaagagccggggtcttgtcgttgaaatgacagacgggactgctgaatataatcgggaacattacaggcaaccgctatattacgacttagccaaaacgtccgtcctccgtatggcttggggattagcccaagagctccagccacatgaatgcaccgctgttgctctaacaccaggttggatgcgctctgaaatcatgcttgatcacttcgaggttacagagcgtaattggcgtgatgcgaccataaaagagcctcacttcgtcatttctgaatcaccccgttttgtcggccgtgctgttgccgctcttgcgagtgacccaaacgtttcccgttggaacggacagtctctttcgagcggtcagcttgcgcaagcttatggattcactgatctagacggttccaagcccgattgttggcgctatcttgttgaggtccaactcaccgggaaggaagccgatgcgaccggatatcgttga

SEQ ID NO: 40808 - DNA, 2271 bp, Bacillus halodurans
atgttgactagcaatctaggatacccacgtattggcgaaaaccgcgaatggaaaaaagcacttgaatcgttctgggcaaatgacaccactgaagaacaattgctcgccacaatgaaagagcttcgcctcaatcatttacgcgtgcaacaagaacaagaggttgatctcattcctgttggtgactttaccctttatgaccatgtgctcgatatggccgtaatgttcggaattattccaaaacgattcttacaacaaggtgatacgccgacactctctacttactttgctatggcacgaggaagcaaaaacgcccaggcgtgtgaaatgacgaagtggtacaacacaaactaccattacatcgttcctgagctacatgatgctgcaccacgcttaacgaaaaacgctccacttgaggcctatttagaagcaaaaaatgaattaggcattgatggaaagcctgtcattctaggtccatactcatttgtaaagctagccaaaggctatgaagaggataagcttcaagagacgattcaatcattgctaccgctttacatccaggtcatccaggagctcgtcgatgcaggtgctcgttccattcaagtggatgagccatcccttgttacctccatttcagcacgagaaatggcgcttgttacacgtatttacgagcaaataaacgaagcgatcgccgatgcaccactcttcctacaaacgtattttgacgcggtgactttttacgaagaggtcgtctctcttccagtgaagggcattggtctagactttgttcatggtggggcgaaaaaccttgaagctctccgtacgttcggattccctgaagataaggtgcttgctgccggaatcattgatggacgcaacatttggattagcaacttacgcgagcgccatgagcttgttcatcaattagaacagcatgtagcgaaagatcgtcttgtattgcaaccatcatgcagccttctccacgtaccggttacaaccaagcgtgaggaaaaactcgacccaacgttgctaggtgtgcttgcatttgctaatgaaaaactaaccgagcttcacacattaaaacagctagccgcaggaaatgaagctgaggtgaaagaagcgcttgaggccaatgacgacgctttagccgctctcgaaaaatcaggctggcgctctggagcagcaacatctcataaccttgaaaacaaaaagcgcccacaatcctttaacgagcgccgtccgcttcaagaagaaaaatggcagcttcctcttcttccaacgacaacgatcggaagcttcccgcaaacaaaagatgtgcgtcgcacaagatcgttatggcgaaaaggggagctatcgacagtcgagtatgagcggacgatgaagtcctacattgaaaagtggatcaatatccaagaagagcttggcctcgatgtactcgttcacggagaatttgagcgcaacgacatggttgaatttttcggtgagaagttagatggctttgcattcacagccaacggttgggtgcaatcatatggctcccgctgcgtcaagccgccaatcatttatggaaatgtgagcttcaccgaaccaatgacggtagcagaaaccgtgtatgcccaatcgttaacggacaaaccggtgaaaggcatgctcacaggccctgtcacgattttaaactggtcgttcgttcgtgatgacttaccgttaactgtgattgcacatcaaatcgcggaggccctcacccatgaagtgacggcattagaagaagcgggtatcgaaatgattcaaattgacgaaccggcgattcgtgaaggtctgccattaaaagctgaagatcagcaagagtacttagactgggccgtgtccgccttccgtgcgagctgcgcccatgtgaaggcaacgacgcaaattcatacccatatgtgctacagcgaattccatgaaatgatcgaagccatcgatgatcttgatgcagacgtcatttccatcgagacatcacgaagccacggagaaatgattagcgcgtttgaaaagacgacgtatgaaaagggaattgggttaggggtctacgatattcacagccctcgcgttccttcagaagaagaaatgctaaatgtcatccgccgcgcgttaacggtcttgccagctagccttttctgggttaaccctgattgtggcttaaagactcgcgcggaaaaagaaaccgtagccgcccttaagaacatggtagctgccgcacgagctgcacgagaagagctaaaaacgaaagcttaa

SEQ ID NO: 40809 - DNA, 921 bp, Bacillus halodurans
atgacaacaacaaattatttgattgaaacgaacaatttaacgatgacctataaacatgtgcatgcggtggaccgtataaacctcaaagtaaaagaaggagagatttacgggttcctcggaccgaatggagctggcaagacaacgaccattcgtatgttgctagggctcattaaagcctctcatggatcgattaaaatatttgggaaagacctgaaacaacatcgacttgacatcttaaaaaatataggggctcttgtggaatcgccttcctattatccacatctttcgggtgaagataaccttgagacggttcgaaaaatagtgaaggtccctaaatcacgaattgctgaagtacttgagcttgtacgtctaacaaaagtagcagatcgaaaagtgcaagagtattccttgggcatgaaacagcgactagccattgctgcagcgctgttagccaatccgcgcctagtgatcttagatgagccaacaaatggattggacccggcaggaattatcgagattcgaaacctgatccttcggttacctaaagagtatgggattactgtcttactttcatctcatctcttatctgaagttgaacaagtggcctctcaagtagggattatcgcgaaaggaaagttgatttttcaggattcgattgaagaactgcgtaagaaagcaaataggaaaatatttctctcgacgagccatccagaagttgcggcaaccattttacaggagcggggaattaatgtagatacacaagctcgtggattggttatgaatgatcgctcggacgaagaaattgctcagcttgtgaaagcattcgttgaaaaagatattgatgtttaccggatttctgatgaaacttcctcactggaagagatcttcttacaactgacaaagggaggacaaacgctgtga

SEQ ID NO: 40810 - DNA, 957 bp, Bacillus halodurans
atgagctatgttctcttattgctaggctttgccttactcatcaaaggagctgatttttttgtcgatggttcatcatctatcgctcgcttgttaaacgtctcacctcttttaattgggttaacaatcgttgcctttggcacaagctctcctgaagcgaccgcgagtattatcgcggctttgaacgggaatcctgacgtggccttaggaaatgttattgggagtaatatgtttaacattacccttgtcgttgggcttaccgccctcctctcaccattaattgtgacaaacgcgacattgcgtaaggaaattccgttcacccttctcgcaagcattgcgctatacatatttattaatgaccaaatgattgaaggggcagtggaaagtacgttatcccgcagcgaagggttgatcttgttactgatcttttgcgttttcctttattacatttttgaggtggcgcgaacaagtccacgtgaacagaaaatagttcaagatttcgctatcaagccaacatggagaaaaaacatattcctctccattcttgggcttgccatgattattggcggtggcgaactcgtcattaggcatagcacggcgatcgccttttctcacggaatgagtgagacgttagtcggattaacgattgttgcgattggaacatcattacctgagttagtaacctcgttaacggctgccttgaaaaaggaaagcgagatcgcactcgggaacattgttggcagttcgatctttaacatttttttcgttctagggacagccgccaccatcaccccgatgcacgtagatagccgcgtcgttgtcgacttactgttgcttattttcctgacgttgcttctactcgtcttctcgagaacacgctacacggtcggaaaatatgaaggcctgattctcgcttccttttacattgggtatatggtctatatcatttggcgaaattaa

SEQ ID NO: 40811 - DNA, 552 bp, Bacillus halodurans
atgaagcgaattccatcgattagagagcggaacattgtgttgattggttttatgggggtagggaaaacatccgttggggaacagctggctaagcggttatttcgtgattttattgacgtcgatcaggaaattgaaaaaacatggaaaatgaagatttccgatatttttcgcttgaagggtgaagaagcgttccgtaaaattgaacgggaaatgacaattgattattgtacgaatacatcacttaaagtgatctcgttaggcggcggcgcctacatgcaagatgcgattcgcactgcgtgtctcgaccattgcatcgtcatttatttagatttgtcttggtccttatggaaggaacggttaaatgtattaatagacaatcgccccgttctacaagacaaaaaagtagaagaaatggaacagctctttacgaagcggcaaccgacctatcaaaagaatagctttcaagtagaaacagatggccgagaggtagcagagatagtatcctatctagaagaagtgatcaagttagggtgggaaatttacggatcataa

SEQ ID NO: 40812 - DNA, 2181 bp, Bacillus halodurans
atgacgatgacgattaacaaggagctccactggcaagagcgactgaaagaaaggtttccgcaactagaggtagaggatgttctttctcaaggggcttcgcttgaatcgatgcgaatgaaggcgatggatgaaatctccgccgaacagccggagtggacgtttattactgcacgtatttatttggaagagctgtacaacagcgtcaaagagcaacgagggctggcgaaaccatatacacagttttatgaactaattgaagtacttgtagacaaaggaatttatgaaaaggatctgctcaatcgttatacaaaagaggagatcaatgaactcggagagcatttgaatcaagaaaaggacgagctgtttacatacattggcttaaaaacattagcggacagataccttgcccgactatatgatcggacgttgatggaattaccacaggaacgctttatggtcattgctatgtctctcatgaaaaaagaagtaaatagccagcgtctttcgttagtgaaggaagcctattgggctctctcaaacctctatatgacagtggcgacaccgacatttgctaacgcaggaaaagcggtagggcaactctccagttgtttcattgatacagtggatgatagtttgcgaggcatttttgatagttgtactgatgctgcgaccgtcagtaaaagtggtggtgggctcgggatttacctaggaaaaattcgtgccaaaggatcgtcgattaaaaattatcaaaatgtgtcatcgggtgttttgccatggatgaaacagttaaacaatgtggcggtgagcgttgatcaactaggtcaacgacaaggagcgattgccgtttacctagacatttggcataaagacatcttttctttccttgatgcgaaactgaataacggagacgagcgtcagcgaacacacgatttgttcacggccgttagccttccagatttatttatggaggcagtggaagctagagacaattggtatttgtttgatccacacgaaatccgtcagaaaatgggcttttctcttgaggacagctatgacgagcaaaaggggagcggaacgttccgcgagcgttatgaagcgtgtgtaaacaacccagatttaagccgaacagaagtaccagcgatcgaaatcatgaaacgaattatgatttcccagcttgaaacaggaagcccattcatgtattaccgcgatgaagcaaatcgcatgaatccaaacaagcatgaaggcatggtctatggttcgaacctttgcacggaaatcattcaaaatatgagtcctacgacagttgtagaggaaaaaacagaagacggaaaaattttaattacgaagcaaccaggcgattatgtcgtgtgtaatttaagttccttgtctcttgctcgtgtagtcgaagacgatgtgcttgaaaggctcataccaattcaagtacggatgctcgataacgtgattgatgtgaaccgtatcgaggtgaagcaagcggagcaaacgaaccaaaaataccgtgcgatcggccttgggacgtacggctggcaccacctccttgcgaaaaaaggaattgcgtgggaatcggaggaagcgattcgctatgcagatgaactatacgaaacgattaactatttaaccattcaagcaagcatgaaattggcagaggaaaagggagcgtacccgatgtttggcggatcagactgggagaccggtgagtattttgagcggcgtcagtatacaactgacaagtggacagagcttgcagaacaagtaaaagaaaaaggactgcgtaacggatacttacttgcagttgctccaaatgcgacgacagcgttaattggcggaacgacggcctccattgacccgatctttcaaaagacgtatgtggaagaaaagaaaaactatcgcattccagtgacggcgccagacctttcgccagagacgacatggtattataaatctgcgtaccatattgaccaaacgtggagcattcgccaaaatggagcccgtcagcgacatgtcgatcaatcaatttcgtttaacctctatgtgtccaatacgattcgtgcgaaagaactgctggagctccacttacttgcttggaaagaaggattgaagactacgtactacctacgttccacttcaatggagatagaagattgtgaaagctgcgcaagctaa

SEQ ID NO: 40813 - DNA, 1038 bp, Bacillus halodurans
atggagcagttacagaaacgaaaaatttatgatacaaccgcatccaatgcatcaacaggcattttaaacggtaagagctcaaacgtgttaaactgggatgacgtccgcttctcgtgggcgtaccctctctataaaaatatgctcgccaacttttggacaccatttgaaatcaatatgagccatgatgccaagcagtttcctactcttacggaaacggaacaagaggcgttcaaaaaaatcattgggttgctagcgtttttagatagcgtacagaccgactattcaatgcgagcagcagaatatttaacagattccagtcttgccgccctgatgagcgttctctccttccaagaggtcgtccataaccaaagttactcatatgtcttgtccagcttagtaccgaaagcgacgcaagatgagatctttgaatattggaagcatgacgacgtattgaaggaacgcaatgaattcatcatagatggatacgagaagtttgtggacaatccaacaccgaaaacgtttctcgaatcaattgtgtatgatgttattttagagggacttaacttttattcgggctttgcgtttttctacaacttagcccgaaatcaaaagatggtatccacgtcaacgatgatcaactacattaatcgggatgagcaactacacgtctacttatttacgaacatttttaaagagttgctcgttgaatttcctgaattgaatacggaagaaaccaaaacattcgtaaaaacaacgttaatgaaagcagctgaccttgagaaagactggttccgctacattatcggagacaaaattccaggaatcaatccagaggatatggagacttacatttcgtttattgcgaataagcgagccgtacagctaggcatggagaaaccttatcctgaaattaagcacaatccgatgaaatggattcgtgcctatgaggatgttaacagcgggaagagtgatttcttcgaacaaaaatcacgccaatatgcaaaagtatcggccgataacggtttcgatgaattgtaa

SEQ ID NO: 40814 - DNA, 783 bp, Bacillus halodurans
atgaaaaaccttcatggaaaacgtgctattgttacaggggttagtcgtttaagtgggatcggagcagccatttgccgtgaatttgccaaacgaggcgctgatgtgtttttcacttattattttcactatgatcagaccttaggcgtaaagggagaaaacgatgagccaatgcgtttggcgaaggaacttgagtcacatggagttgccgtagcacacctggagctggatctatcagaagataatgcatacgtacaaatctttaacgcatttgaacagcggtttgggacaacagccgatattttggtgaacaacgcttgcgtttccgttaatgattcctatgaaacgattacaagtgagaatcttgatgcccattacgttatcaatgtgcgggctacgacattattaacctctgaattcgcgaagcgcttttcaaaggggcatggcggacgaatcatccaactaacgacagggtggtctcaagggccgatggcaaatgagctttcttatgctatcacgaagtcaaccgtggaagctttaacgtatacgttgaaaaccgagctagcaaaaaaagggatcacaatcaatgctgtaaatccaggccccaccaattctggttggatgtcagatcagttgaaacaagaattgcttcctcgctttccattcggtcgtctcggtgagccaaaggacgcagctaaccttattgccttccttgcaagcgatgatgccgaatggattacagggcaagtgattcattctgaaggcggcttccaaaataccttgtga

SEQ ID NO: 40815 - DNA, 1149 bp, Bacillus halodurans
atgaatatcaataaatttgtaacaccagagattattttcgggggtcatgcaataaggcaagcaggggatgcttgtgttcggcttggtgcgaaaaaagtgttgattgttagtgataggggcgtcgcaaatgccggatggttagaaaaagtaatggaactttgtaaagagtcacatctaccatttgccacgtttgtcggtgtgacgacagacccgaaagatcgcgaggttgaacaagggtgtcaagtgtttgtgcaacatgaatgtgatgccattattggggttggaggaggaagtgtgttagatgtagcgaaagcgatcgccatccttgcaacgaacggtggagctattagtgattatgaaggaatcgataaaataaaaaaaccccttcctccaatgattatgattatgacaactgcaggatccggttctgaagtatcgcaattttcaatcatagttgattctaatcgaaaaaagaaaatgaccattgtatcaaaaacattggttcccgatattgccattattgatccttacacactcgtgacgaaggacagtagcctaaccgctacaacggggatggatgtgctgacacatgccatcgaagcgtatgtcagtattgcggccaccccgcttacagatgtccaggccaaaaatgccctcatcttgtgtgctcaatacttgcgaccctctgttgcttccaaaacgaatacagaggcgaaggaagcgatggcaatggctagcttacaagcaggacttgctttctcaaatgccattttaggggcagcgcatgcaatatcccatgcgattggagggaagtttcccttaccgcatggagaaataaacgctattcttctcccatatgtgatggattttaattttatcgcaacacctaagcgatttttagacatagcgacatgtttaggtattgatacaaggggattgacggaacgggaagcaggaaatgctgcaatccattttgtcaaagagctgtcctttgacatcggtattcccacaagatttagagaggtagggataacacaagaaatgattcatcacattagcgaagtagcgttagaagatgcctgtatgattacgaatcctcgtgacatgaatgttgagcaagtaaagcaagtattaaaaaatgttttatag

SEQ ID NO: 40816 - DNA, 1497 bp, Bacillus halodurans
atgcaaaaaatctcaacaaacgatagcaaattaaatccaaggttagtggcgtttttaaacggtggaccaaagaagctatttattaatggggaatgggttgattcattctctggacaatcttttgaaacgatgaatccagcaaccggagaaacattagctctcgtagcagaagctgggtcagaggacatcgattttgcagtgaaagcggcaaggaaagcgttcgatgaagggccttggtctaaaatgagcgcagcggaaagaagtcgactcatatacaagctggctgatttgattgaggatcataaagaagcgttagctcagcttgagacgttagataatggtaagccaattcgtgagacggccaatgctgatattccattagtaattgaacactttcgttactttgcagggtgggcgacaaaaattgtgggccaaaccatccctgtacaaggccattattttaactacacgcgccatgaagccattggcgttgtgggccaaatcattccttggaatttcccgttattgatggctgcttggaaacttggtgccgctctagctacaggttgtacggttgtgttaaaaccggcagagcagactccactttccgccttatatttaggagaattgatcaatgaagcaggttttccaaaaggggttgtgaacattgtccctggatttgggcattcggctggaactccccttgtgaatcacccagctgtagataaagtggcttttacagggtcgactgatgtcggaaagttaattatgaaacaagcgagtgaatcattaaaaagagtaacgcttgaacttgggggcaagtcaccaaatatcattttacctgatgctgatttgtcaaaggccgttcctggctcacttatgggcattatgttcaatcaaggccaagtgtgttgcgcaggaagtcgtttatatgtacaaaagaaacagtatgatcatgtcgttgctgacctggtgtcgttaacgaacgagattcagcaaggggatggattattagaacaaacgaccatgggacctctgatttcaaatcaacaacaaagtcgagtgaaaaattacatcgatcgtggggttgaggaaggggcagaactactaacaggtgggaacattccgtatgatcaagggtattttgtcgccccaaccatttttgctgacgtggatcattccatgacgatcgccaaggaggaaatttttggtccagttgtagccgcaatgccgtttgatagcatagacgacctaattgataaagccaacgattctgattatggactagctgccggtgtttggacacaggatattaaaaaagcacactacattgcccaccgaatcaaggcagggaccatttgggtgaattgctacaatgtattcgatgccgcgagcccgtttggtggttacaaacaatcggggattggccgggaaatggggagctatgcattagaaaattatactgaagtgaaaagtgtttgggtgaatatggattaa

SEQ ID NO: 40817 - DNA, 1146 bp, Bacillus halodurans
atgagagagaaaaaatttgcaacaaaatcggttcactttacagaaaaagaaataagcaaaaaccgtagtaaatctaagcccatttatcaaacatctgccttcgtgtttcaagacttagatgatatggaaagcttctaccgaggggaaaaggagtatttgtacacaaggtatgggaatccaaacagtgatgaccttggcaaaggggtggcttctttagagcaggcagaggatggcgtagccacatcagcaggaatgtcagccattttagttgcactcctagctttacttgaaaaaggagatcacttgatcgccgcgaatgatttgtatggtgggacttaccaactgttggcggaggagcttccgaagctaggaatcgatgtcagctttgttccatttcaagagcgtgaagtggtgaaacgtgcgattcgaaaagaaacgaaagtgctctattcagagacagtcaccaatccattgctacgggtggaagatattcatcaggtcgttgaattaggaaaggaacacggcctttcaactgttatcgataatacgtttgccacaccttactttgttcaacctttaacatgtggtgtagatgtagtcgtccatagtgcaaccaaatatattggcgggcatagtgatgtgacagcgggtgtcgtcgtaggatctgcagaaatcattcagcaagttcggcaaaaagtcgcgactttgggttgcaacttaagcccatttgaagcgtggctcgcttcgagaggattaaaaacattggcattaagaatggaacgacaaggggaaaatgctcaagctctcgccacattttttgcggaccatccaggggtttcccaagtgttctacccgacgactgtctcgaaacgcggcaatggggcaatagtgacgatccgcctagccgaaaaggtagaggcagcaaccttttttgaatcattagactgggtgaaaattgcaccaacattagcaggtgttgaaacaaccgtgtcttatccgattcaaacgtctcatcgaacagtgccagagtcgcttcgacaagagttaggaatcgacaagcaactagtaagaatttcggttggtattgaagatattgaagacatcatggccgcgttcgataaggccattaaaaaagctggctcttaa

SEQ ID NO: 40818 - DNA, 2421 bp, Bacillus halodurans
atgaaaaatcaaaaagaattaacgttggatattcaggggatgacatgtgccgcttgctctaatcgaatcgaaaagggcttacaacggatggatggcgttcaagaggcaaatgtaaacttaacgcttgaacgatcgacggtagtgtatgatccagagaaggttcagccagagcaggttattgaaaaagtagagcagctcgggtacaaagtggtaatcgacagagtggaatttgacgtggttggaatgacgtgtgctgcttgtgctaaccgaattgaaaagaagctgaatcgtcttgaaggggtccacaaagcggttgttaaccttgcgcttgaaacggctacggtcgaatacagaccggaaagtgtatcaccgtctgatttggaacaggcgatcgagcagataggttacacactaaagcgcaaaacaggtgacgctgaagaaggagatgtacgggaacgtgaattacaaaaacagaagcgccgcttttggatttcagcggttttaacgttgcctctcctttggtcgatggtgacacattttgaattcacatcgttcatttggatgcctcatctattcatggatccatgggttcagttgttgcttgcgacacccgttcagttttatataggggctccgttttacgttggggcgtataaagcccttcgccataagagcgcgaacatggatgtactcgttgccctcggtacatcggctgcttatttttacagcatgtatctcggctatgattggttgtatgggacgcgggaggggatgatgccggaattatattttgaagcatcagcgattatcattacccttattgttcttggaaaatactttgaagcaagagcgaagggccgtacgagtgaggcgattcgtaagcttcttggcttgcaggcgaaaacagcccgcgtcattcgagaggggaaagaggagcaaattccgttggaagaagtgaaaacgggggatctccttctcgtcaaaccaggcgaaaaaattcccgtcgatggagaagtggtggaaggctactctgccgtggatgagtcaatgcttaccggggagagcatcccagtcgaaaaagatgttggcgatcaagtcatcggtgctaccgttaatcataacgggtcacttcgtattcgagccacgcgagtcggaaaagatacggccctcgcgcaaattgtgaaagtggtcgaggaagcgcaaggctcaaaggcagatattcaacgtgcggtcgataaagtctctagtatttttgttcctgtcgttgttgccatttccgtccttacgtttctcgtatggtatatggtgattgatccaggcaacgtcacaagtgcactcattccgacgatttccattttggttatcgcgtgcccttgtgctctagggcttgcaacgccgacatccattatggctggttcgggtagatccgcagagttaggtgtgctgtttaaaggcggtgaacatcttgaacatacgcagcgaattgatacagttgttctcgataaaacgggaacggtgacggaaggaaaaccgtcgcttactgatttcgtcacgtacggatcagctgacgagaaggaaatggccaccatgcttcatgctgcagaacggcgatctgaacacccattagcgacagcgattgtggacgggatgaaacagctaggcgtggatcgcttggaggctgactcgttttctgcgattccgggacatggcgttgaagcgatggttgctggaaggaacgtgctcgttggaacgagaaagctcatggccgagcatcaggttgattataaagaagcgctttcgagtgccgaagcgcgagaagcccgaggagaaacggtgatgttcatggctgttgacggcattctaacagctcatgtggccgtagccgatcagttgaagtcatcttctaaaaaggccatcgaacggttgaaggcgcttggattggacattgtcatgttaacaggggataatgaacggacggcccgtgctgttgcgaatgatgttggaattgaacaggtgattgctgaagttttaccgaaggataagagtgaacaaatccgtaagctacagaaacaaggacgaacggtcgccatggttggcgacggattaaatgatgccccggcattagcaacggccgatgtagggatggcgatcggttcagcgaccgacatacccatcgaggccgctgatttgaccttgcttggggatgacttgcatcgggttgcagatgcagtcctcatgagccaaaaaacgatgcgaaacattaagcaaaatttattttttgctttcgtctataatacgtctgcaattccgattgctgctgccggtttattagcaccatgggtagcgggagccgcaatggcgttcagctctgtttccgtcgtcttgaatgcattacgtctgcagcgtttccaaattaaataa

SEQ ID NO: 40819 - DNA, 1635 bp, Bacillus halodurans
atggcaaaagatattaagtttagcgaagacgcacgtcgctctatgcttcgtggtgtagataaacttgctgacgcagtaaaagtaacgctaggaccaaaaggtcgtaacgtcgttcttgaaaagaaattcggttctccacttattacaaatgacggtgtaaccatcgcaaaggaaatcgaattagaagatgcgtttgaaaacatgggtgcaaagcttgttgcagaagtggcaagcaagacaaatgacattgctggggacggtacaacaacagcaacggtccttgcacaagcgatgattcgcgaaggcttgaaaaacgtcacgtctggcgcgaacccaatggtgattcgtaaaggaatcgaaaaagcgactcaagtagccgttgaagaactttctaaaatctctaagccaatcgaaggcaaagattcaatcgctcaagttgcggcgatttcttctgctgacgatgaagtagggaaaatcattgctgaagcaatggagcgcgtaggcaacgacggcgttattacgattgaagagtctaaaggattctctacagagctagaagtggttgaaggtatgcaatttgaccgcggctatgcgtctccttacatggtgacagactctgacaagatggaagcggttcttgacaacccttatgtcttgatcacagataagaagatttctaacatccaagaagtattaccagttcttgagcaagttgtacaacaaggcaagccaatccttatcattgctgaggatgtagaaggtgaagctcttgcaacacttgtggtgaacaaacttcgtggaacatttaacgcagtagcggttaaagctcctggattcggtgatcgtcgtaaagcaatgcttgaagacattgcgatccttactggcggtgaagtgatcacagaagacctagggcttgacttgaaatctgcgaacatcacacagcttggtcgcgcaagtaaagtcgttgtaacgaaagagaacacaacgattgttgaaggtgctggcgaaagcgataaaatcgcagctcgcgttaatcaaatcaaagcacaaatcgaagaaacaacatctgacttcgataaagaaaaacttcaagagcgcttagcgaagcttgctggtggcgtcgctgttcttaaagtcggtgcagctactgaaactgaaatgaaagagcgcaaacttcgcattgaagacgcgttgaactctactcgcgcggctgtagaagaaggaatcgttgctggtggtggtactgcccttgtgaacgtgattaaagcagtctctagcatcggtgcagaaggtgacgaagcaacaggtgtgaacatcgttcttcgtgcccttgaagagccagttcgtcaaattgctcacaacgcaggtcttgaaggctctgtgatcgtcgagcgcctcaagaaagaagaagctggcttcggtttcaacgcagcaactggtgaatgggtgaacatggttgaagctggtatcgttgacccaacgaaagtaactcgttcagcgcttcagcacgcagcatctgtatccgctatgttcctcacaacagaagcggtgatcgctgataagcctgaggagaacgagggcggcggcggaatgcctgacatgggcggaatgggtggcatgggcggcatgatgtaa

SEQ ID NO: 40820 - DNA, 1434 bp, Bacillus halodurans
atgtcaaagcactcatttccagaaggatttttatgggggggagcgattgcagcgaatcaggcggaaggcgcttatcttgaagacgggaagggattaacgcttgttgatttacttccgactggtcaaaagcgttgggatgttatgttagggaagctggactcgtttacgccattggaaggagagttttatccttcccacgaagcgattgatttttatcatcgttatcaagaagatgttgcccttttagctgaaatgggctttaaagcattccgactttccatctcatgggcgcgtatttttcctaacggagatgatccagaaccgaatgaaaaaggactgcaattttatgacgatctcttcgatgaactattaaaatacaacattcaacctgttgtcactatggcccatttcgatgtacccgttcatttgattgaatcgtatggagggtggcggagccgaaagcttgtcggtttatttgaaacgtatgcgaaaacgattctttctcgttacaaagataaggtgaaatattggatgacctttaatgagatcaatatgcttctccacttgccatttgtcggagctggtctcgtattcaaagaaggtgagaataaaaagcagatccaatatcaagcggcccaccatcaactagttgcaagcagcttagccgtaaaagcttgtcatgaattgattcctgatgcgaaaatcggatgcatgcttgccgctggagccacctacccatacacgtgtcacccgaacgatgtctttgaggcgatgacgaaagaccgagagtcgtttttcttcattgatgttcagtcacgaggggaataccctggctatgcgaagcgttttttccgtgatcataacatcgtcattgatatggaggaaggagatgaagcgcttcttaagaaccataccgtcgattatatcggctttagctattatgcaagccgagtgacaagcacagatccagaagtattgaaaaacataacatctggcaacgtgtttggttcggtggagaatccatatctagaaaaatcggagtggggctggaccattgatccgaaagggttccgcacgaccgcaaaccagctttatgatcgctatcaaaagccattgtttgtcgtcgaaaatggtcttggagccgttgatgacgtcacccttgaaggcgaaatcaatgacgagtatcggatcgactatttaagaaagcatatcgctgaaatggctgaagcgattgccgatggtgtggacattatcggctacacaagctgggggccgatcgacgttgtgagcgcatcgactggtgagatgaaaaagcgttacgggtatatttatgtggatcgtgacaatgaaggaaaaggttcgttgaaacgaatgaaaaagaaaagcttccattggtataaaaaagtgattgaaacgaatggggaaaaacgataa

SEQ ID NO: 40821 - DNA, 1719 bp, Bacillus halodurans
atggggaacgaaagattaaaagcaccagaaggtccaccgagtgatgtagagcgcataaaagaagaaagtaattatttgcgcggcacgctgaaggaatcaatgctcgagccgattagtgccggaatatccgatgatgataaccggttgatgaaacatcacggtagttatttgcaagatgaccgagaccttcgcaatgagcggcaaaaacaaaagcttgaaccggcgtaccagttcatgttgcgtgttcggatgccgggcggagtggcaacgcctgaacagtggcttgtcatggatgaacttgctcagaaatatggaaatggcactatgaagctaacaacaagagaaacgtttcaattgcatggcattttaaagtggaacatgaaaaaaacgattcaggccatccactcagctttgttggatacaatcgcggcatgtggtgatgtgaaccgaaatgtcatgtgtacctcaaatccgtatcaatcggagatccatcaggaagtatatgaatggtcaaagaaattgagtgatgatttgcttccgcgtacacgcgcgtaccatgaaatttggcttgatgaagaaaaagtggcaggcacgccagaagcagaagaagttgaaccgatgtacggaccgctttatcttcctcggaaattcaaaattggtattgctgttccaccatccaatgacattgacgtcttttctcaagatctcggctttatcgcgattgtggaagatgacaagcttgtcggtttcaatgtggcgattggcggcggtatggggatgacgcacggggataaagcgacatacccgcagctcgctaaagtgattggcttctgtaaacctgaacaaatatacgatgtcgcggaaaaaattattacgattcagcgtgattacggtaatcgctcggtccgaaaaaatgcccgtttcaagtatacggtagaccgtctcggtttagagaccgtcaagaatgagctggaaaaccgccttggctggagccttgatgaggcgaagccgtatcatttcgatcataacggcgaccgctatggctgggtcaaaggtgtgaaaggaagatggcactttacattatttgtggagggcggtcgtgtcactgattatgcagattacaaattaatgaccggcttgcgcgagatcgcgaaaatccatactggtgatattcgcctcacgtccaaccaaaacttgattattgctaatgttactagccagaagaagaaaaagatcaatgagctaatcgagcagtacggtctgacggacggtaagcattatacagcactccgtcgcagctcgattgcctgtgttgcgcttccgacatgcggactggcaatggcggaagcagagcggtatttgccgaagctaatcgacaaaattgacgaaatcatcgaagaaaacggcctgaagaatgaagagattacgatccgtatgacagggtgcccgaacggctgtgcccgccatgcgctaggcgaaattggctttattggaaaagcgccgggtaagtacaatatgtaccttggagctgcttttgatggcagccgtctaagtaaaatgtaccgtgaaaatattggagaagaagaaattttaaaagaacttcgcgaaattctcccacgttatgcgaaagagcgtaaagaaggggagcattttggagattttgtcatccgagctggaatcatcaaagaaacgacggatggaacaaattttcatgattaa

SEQ ID NO: 40822 - DNA, 2232 bp, Bacillus halodurans
ttggaagagatgattcagtttttccgtgaaaaacaaaaacaacaagggaaggaagctaggtacgatacaaggtgtccgttttgcagtgtccaatgctctatgacactaactgaggaaaagctagtggcaacgagccgctttaaagcaatcccaaataaacaggaccctacatctgaaggtaggctttgtattaagggagttcatgcccatcaacatacggttcatcgtgaacgcattcgccagccgttggtcaagacaggcggtgcgtttgtggaaacatcttgggaggtagcccttgggcttatcgcagaacgattcaagcgtctgcaaaaaagctatggacaagatgctgtaggtgtctttggcggaggctctcttacgaatgaagaagcctacctattagggaagtttgctagattagccttagggacacgttacattgattacaatggacgttactgcatgagctcagcggccgcggctgccaatttgacgtttggtgtggatcgcggcctcacaaatgaactgcgggaagtcgaggatgccgagtgcatcgtgttagcagggacaaatcttgcagaatgccaacctacactaatgccgtatctccgccgggcgaaaaagaacggagcgtttattatcgttctcgatcctcgggaaacggggacaacgaaaatcgcgaacttgcatttgaaaccaaagcccggcaccgatggggcgattgctgcggggatgttgaaagtattgatcgaggaggaactgatcgatcgtacgtttattgaagcacgaacgaatggatttgaacaagtggagtcggagctgcaagagatagcattggcggagcttgctcttgcagcaggcgttccagaggagcaaattcgtgaagcagcgattcgttttggcgaagcacaaacaggcatgatctttacggcacgcggggtagaacagcaagcaactggaaccgctgatgtcagacaattcctccacattttattggcgactgggaagatcggtcgctatgcttgtggctatggtgctgtaacgggtcaaggaaatgggcaaggtggtcgagagcatgggcaaaaagcggatcagcttccagggtatcgttccatcgaatcgcctgaagatcgagcctatattgcgtcggtatggaatgtcgaggaaaaggatatcccgcgaaaaggcgtttctgcgtttgaattgtttcaaaagattgaccagcaggacgttcgcggaatgtttattatggggtctaacccagtcctctcaagtcctcatgaaaacttagtgaagcgagcattgtctcgattggatgtactagttgtagtcgatatgtttatctcagaaacagcagagtatgctgatatcattttgccgacaacctcttatttagaagatgaaggtacgatgacaaactttgaagggcgtgtggtccatcgtccaggttcaaaaccgccttttggaaaagcgaagcatgactggcaaattctctgtgaattagccgaggcgttagaccgctctcatggctttcaattttcctcccccgaggagattttcaatgagctttgccttgcctctaaagggggaaaagcggattacagcggactctcctatgagaaaatcaaaggggaaggtgtcctttggccatgtcctacaaaagagcatgaaggaacgggccgattgttcgaagaccgcttttatacagaggatggacgggcgcagtttggttctgtgcactgcccagtcgattcggaaaacgatgagtaccccatattgctcacaacgggccgtgttcttactcaatacttgtcgggcacacaaacgaggcggagcgatgcgttattgttcaaagagcccgaaccattcgttcttctccatccagaaacagcctcttcttatcaaattcaagatgaggattgggtaatggttcgttctccttatggcgaggcaaaattgaaagcaaggcagtcagaaggaattcgcgaagatactgtgttcgtgccgttccattgggctggttctgtatcgatcaaccatgttgtcgcaccagagcttgatccaacatcacgcatgcctgcctttaagcgaacgaaggtgaaattaaagaaaataattgaagaaaaaggcgagagttggtattctggacaaaagaacgatagacaggagtctgagaataccgatgacatactcgatccagtccattcaggtggggttgccaaaaaccgttga

SEQ ID NO: 40823 - DNA, 1098 bp, Bacillus halodurans
atggcgtcgattgtatcggtgagcagctatccgcccccttatttattgaaacaagagacaacgactgaatttgcgaaggagctgtttcaagaagattttcgtgacattgagcgcttattaaaatcattttcgaacgggcaaatcgaagagcgacagtttgctgttcctctcgattggtttcgtcaggatcattctctacaagaaaaaaatgatacctacataaagctggcaacgatgtttagtgtagaggtcgttcgtcagtgtctccaatcgaacgtttttttgaaaaagccagtagcggaggaggaaatcgatacgattgtctttgtgtcgagctctgggatggctaccccaagcattgaagcgagaatgatgaatgagctaccattctctcctcatacgaaacgggtcccaatgtggggactcggttgtgccggtggagctgctgggatgagccgggcctatgaatattgccgcgcgtttccgcgagcgaatgtactcgtcgtttgtgtcgagctttgcagtctcacgtttcaacgccaagatcggacgaaaagcaatttaattggagcatcccttttttctgatggtgttgcgtgtgccctagtgagcggcgatgaatctgacgttcttgggaggatgaaaatgccaacgcggccattaatcctaggctcctcttctacactcatgccagattcggaacaagtgatgggctgggatgtgaaggatacaggcctccatgtcgtgttttcccgagatattccgaacattattcgccactggctcaggcctaatgtggagcgctttttggagacgtatcgactgtccttggaacaaattgaggcttttatcgcccacccaggaggacgaaaggtgttggaagcttatgaagaagcgttatccttttcagacgagatgacggagtattcccgtgacattttacgccatcatggtaacatgtcatcccctacggtattgtacgttcttgaaaaatttatgaaggatacgagagatcctggacaatatggattaatggcagcactagggccagggttctgctctgaattagtgcttatgcaatgggaggcggttcattga

SEQ ID NO: 40824 - DNA, 1302 bp, Bacillus halodurans
atgattgaacggtatactcgtcctgagatgggagcaatttggacagaagaaaatcgctatcaggcatggctagaagtagagattgttgcctgtgaagcatgggcggagcttggagagattccgaaagaggacgtaaagaaaatccgcgaacatgccagctttgatgtggagcgaattttggaaattgagcaggaaactcgccacgatgtggtggcgtttacccgtgcagtatccgaaacgctaggagaagagagaaaatgggttcattatgggttaacgtcaacagatgtcgtagatacagcgctatcctacttgctgaagcaagcaaatgaaattattgaggccgatcttgtcagatttcttgacatcttaaaagagaaggcattagagcacaagtatacggtaatgatgggacggacacatggcgttcacgcagagcctactacgttcgggttaaagctcgctctctggtatgaagaaatgaagcgcaaccttgagcgttttcgtcttgcagcagaaggcgttcgtgttggtaagctttcaggagcggtcggaacgtacgcaaacattgatccatttgtagagcagtatgtttgcgaaaagctaggtcttgagcgggctccaatttcaacgcaaacacttcaacgggatcgccatgcagaatatatggcgacgttggcccttatcgccacttcgattgagaagttcgctgttgaaattcgcgggttgcaaaaatctgaaacgagagaagtagaggaatattttgcgaagggacaaaaagggtcatcggctatgccacacaagcgcaatccgattggatctgaaaatatgacagggatcgcccgtgtcgtccgcggccatatgcttgcggcctatgaaaatgttcccctttggcatgagcgggacatttcccattcctctgctgaacggatcattttaccagatgcgacgattgctattaattacatgttaaaccgattcggaaacatcgtgaaaaacttaaccgtattccctgaaaacatgaagcgtaatatgacacgtacgtatggtcttatctactcgcaaagagtgttgctttctttgatcgacaaagggatggtacgggaagaagcatacgatcttgtccaaccgaaggcaatggaagcgtgggaaaaaggcgttcagttccgtgaattggttgagcaagaggaacggattacgtctgttttatcacctgaagaaatagaagcatgctttgactacaaccaccatttaaaacatgtggacacgatctttgagcgtctcggcttaacaaacgaataa

SEQ ID NO: 40825 - DNA, 2244 bp, Bacillus halodurans
gtgtttggtggtgttacgaacgtgcaacggaaaatcatagaaaaaatgttggcaggattgaatgacagacaacgagaagcggtgaagcacacagaagggcccctgctactaatggcaggagccggaagtggaaagacaagagtactaacgcaccggattgcctatttattacgtgaaaaaggggttgccccgtggaacgtattagcgattacgtttacaaataaagcggctcgggagatgaaagaccgggtcgctcagcttgttggaccgatcgcagatgatatttggatctccacgttccactctatgtgcgttcgcatcctacgccgcgacatcgatcggatcggctatagtcgtaactttacgattttagattccaccgatcaattgtcagtgatcaagcaaattttaaaaaacaacaacatcgattcgaagaaatttgaaccgcgtagcattttaggtacgatcagcggcgctaaaaatgaattgaagacacctgaacaatttatgggcattgcaaaaggaccttatgaggaaacggcagcagaagtatatgtcgagtaccaaaagcaactaaagaaaaaccaagcgctcgattttgacgacctcatcatgaagacaactagtctcttcaaaaaagttccagaggtacttgagtactaccagcggaagtttcagtatattctagtggatgagtaccaagatacaaaccgagcccaatatatgctcgtgaagatgcttggggatcgccataaaaatgtgtgtgttgtcggggattcggatcagtcgatctataaatggcgcggggccgatatcgccaacattctttcatttgaagaggattaccaagacgcagaggtcattttacttgaacaaaactaccgttccacgaagacaatcttagaagcagccaaccgcgtcatcgaaaacaatgtgaagcggaagccgaaaaacctctggacggaaaatgagcaaggggcgaagattggcttttataaagctgatacggagcaaggagaagcccagtttgtcgtagaaaaaattcgtgaagcgattcaggatggtgcctcttataaagacattgccatcctttaccgaacaaatgctcagtcccgtgtcatggaggaaatgctcattaaatcgaacattgactacaatattgtcggcgggactaagttctacgatcgaaaagaaattaaggatgtgctcgcgtatttacgtctcgtggctaaccctgatgacgacattagcttgcagcgcatcatcaatgttccgaagcggggaatcggagcgacgaccgttgataaaattgctgcttatgcggagcgacaagggatctcgatgtttgccgctctaaaggagattgagcaaatcggtgtcacctcccgtgcggtaagcaaattagttgagtttactgagcagcttggtcattgggtgcaaatgcaagaatatttgtcagtcactgaactagtggaggagctgcttgagcggacaggctatcgcgacatgttgcaaaacgaaaaaacactcgaagcccaaagccgacttgagaacattgatgaatttttgtccgtaacccaagagtttgaaaaatcgagtgacgataaatcgctcattgcctttttaaccgatttagcactcatttcggacatcgataagcttgatgatgaggacgatggagccaagccaaccgatgccgttgtgctcatgaccctccattcagccaaaggactcgaatttccgatcgtctttttaatcggactggaggaaggcatctttccacatagccgttctctttttgaagatgatgaaatggaggaggagcgtcgtttagcctatgttgggattactcgtgccgaaaagcagctttatctaaccagtgcccagctgcgaacgatttacggacgaacaaatgccaacccgccgtcccgttttatcgacgaaattccagaagattgcctcgaatttttgaatgaaccgcaagaagaacttccgtggatgaagacatcacgaccggtgacaaaagcgaaacaaccatctcgttctgtgccgcaaatgacaacgacgggaggcgaacaatttgcatggaccgttggggacaaagcggagcataaaaagtggggaattggcacggtcgtaagcatgaagggggaaggcgactccctggagcttgacattgcattcccgccgccgaccggcatcaaacgactatttgcaaagtttgcaccgattacgaaagcgtaa

SEQ ID NO: 40826 - DNA, 867 bp, Bacillus halodurans
atggaaaatatagtggaattaattaatgtcacaaaaacattcaaagatttttcaattaataagatggatttacaagtgaaaaaagggtttgttacgggattcattggcgcaaatggggcagggaagtcgacaacgataaaaatgatgatgaatctactaaaaccagatgacggagaggttaagcttttcggaatggactacacgacacatgagaaggcgatcaaggagcgcattggatttgtatacgatggtaatgtattttttgaaggactaaacttaaaagatatcaagcatattgttggaccagcgtacaaacggtgggatgatacattgttttatcaatatgtggataaattcgaattgccacttaataaggcaataaaaacattttcaaaaggaatgcaaatgaaggcatcattggcaatcgcattatcacatcatgcagagttgatcatcatggatgagccaacagcagggctagaccccatttttagacgagaactgttggatattctacaggaattaatgattgataatgatcgtaccattttcttttctacgcatattacaacagatttagatcgtatcgcagactatatcgcttttatgcaggggggaaatttagtttttaaccagtccattcacgacatagatgaaaattatgcgctcgtaaaaggaggattggatcttttggataaagacactgaaaaagcctttgttcatgttcggcgcgcatcaactggatttgaagctttaacgaataacttatcagctgtgaaaaatatatttggagacaccgttatcattgaacgagcaactctggaagatattatgtattacatgaaaggaggcgtacattatgtttaa

SEQ ID NO: 40827 - DNA, 1521 bp, Bacillus halodurans
atggtgtataaacgtccaaatgaagaaggtgctgtcgtctcgtttaagaagaggtatgacaactacgtgaatggagaatggacaccgcctgtgaaaggtcaatattttgaaaatgtcactccggttacaggcgaagtcttttgtgaagtcgctcgttccacagccgaggacattgacctagcccttgacgccgcccacgcagcgaaagagcaatggggaaaaacgtcacctgccgagcgagcaaatctattaaataaaatagccgatcggatggaggaaaacttagaaaaactcgccgttgcggagacgtgggagaacgggaaacccgtccgtgaaacgttaaatgccgacattccactcgcgatcgaccattttcgctattttgctggcgcgattcgtgcccaagaaggtacgttgagccaaattgacaacgatacggtcgcgtaccattttcatgaaccgcttggtgttgtcggtcaaattatcccctggaacttcccgatcttaatggcgacatggaagctggcacctgccttagctgccggcaactgcgtcatcttaaagcctgcagaacagacgccggcttcgatttttgtcttgcttgaattaattgaagatctactgccaaaaggggttgtcaacattgtgaacggcttcggagtggaagcaggaaaaccgctcgcttcctcgagtcgtgtcgccaaggtggcatttacaggggaaacgacaaccggccgcttaatcatgcaatatgcgtcggaaaacttgattccggtcacacttgaacttggcggtaaatcaccgaatattttctttgatgacgtgatggcaaaagacgacgcctttttaaataaagcgatcgaagggttcgtcctgtttgccttgaaccaaggagaagtttgcacatgcccgtctcgcgccctcatccaagagtcgatctacgatacatttatggagcgtgctttggctcgggtacaagcgattaaacaaggcaatccgctagatcctaacacgatgattggcgctcaagcctcacaggagcagcttgaaaaaattctttcgtacttagccatcggtaaggaggaaggcgccgaggtactcgctggcggtgaacgcaatcatttgccaggtgaattggcgaacggctactatgttagtccaactgtgtttaaaggtacgaatgatatgcgcgtcttccaagaggaaatcttcgggccggtcgtttctgtgacgacgtttaaggatgcggaggaagcattagcgattgcgaatgacaccctttacggactcggggcaggtgtttggacgcgggacatgaataaagcctaccgatttgggcgggagattcaagcgggacgcgtatggacgaactgctatcacgcctaccctgcccacgccgcttttggagggtacaaaaagtccggtattggccgagaaacacacctgatgatgctgagccactatcaacaaacgaaaaatctgctcgtcagctacagtgaagacgcattaggatttttctaa

SEQ ID NO: 40828 - DNA, 2406 bp, Bacillus halodurans
atgcagaagggcaagagaacgttttccatacaaacgatcggggaagaaggtatccactttacgaacgaaacgggcacgcttgatgttagcgtctttgtgctagaggagcacctctttcgtgtgttatttcgaaaacatcatacgttaacagtgcaggcgacatggttagttgcaccgggaatggaggatattccgtatgaggggagggatcgtcttgatttaactcctttttccctcccaggtttcagctatgaacgttctgagaatgagggtacggtctctattcatacagagcgattaaaagcttatattcaactcgaaggctttaaggtgacgtggtttgaaaagaaggatggcgtttggactgaggttgcagctgatcggaacacgcaggcgtataactttgacggttccctcggtcgtggaatctttcattatatgaagcggggtcaagaggatcgttattatgggctaggtgaaaaaacagggagtttgaatcggcacgggagacggtatcggatgatgaatctcgatccgatggggtacgatccgatttatactgatccactgtataagcatattcctttttatttaacgcgtacgaaggaaaaaagctggtacggactattttacgataatacggctacatctacatttgacatgggaaatgagcttgataattaccatggcttttatcgattctaccatgcggaagagggagatctagactactatatgatcgttggcgccgatgcagctgaagtggtcgagacattttcatggcttacgggaaaaacgacgatgttgcctaaatggagcctcggctattctggttcaacgatgacctacacagacgcagaaaatgcccaagaacagctatatcaatttctcgacgactgtaaaacgtatgacatcccatgtgattcgttccaattatcatcaggctatacgtccattggcgaaaagcgctacgtgtttaattggaatcgcagcaaatttcctgatccgaagcagtttatcgctgatttccatgagcaagggataaggctttgtgccaacattaaaccatgccttttacaggatcatccactctatgaacagttaaaagaaaaggggatgttcattaacgatgaggatgggcaggaggaggaagttgttcaatttttggatgatgtcggggcgtacttagacttcaccaatcctgagacgatcgactggtggaaacggaatgtgacagagcagctattagaatttggcattgactcgacgtggaacgataacaatgagtatgaaatttggaagccagatgcgaaggcccatgggtttggcaaaccaatcgacattggcaagatccgaccgattcaaccgttactcatgatgaaagcctcttttgaagcgcaactggagtttgatacgaagaaacgtccttatctcatttcccgctctggctgtccaggtatgcagcgctactgccaaacatggacgggggataaccggacgagttgggattccttaaagtacaacattaaaacaggcttaggcttgagtttgtcaggaatttatcatgttggtcatgatgttggcgggtttgccggtgagaagccagatccggaattattcatacgttggattcaaaacggaatctttcatccgcggttcacgattcactcatggaacgaagataagagtgtgaatgtgccatggatgtatccagaaatcgtcaagccgattagtgacttgatgagatttagggtgacactcataccatacctttatcaattaatgtatgaatcgtaccaagcctataaacctatcataaggccgacgttttatcagttcccgaaagatgaacgtacgtttacggaaaatgatgattttatggttggcgatcatttgctagtcgcatctgtagtagaaaaaggtgttcatcaaagggatgtctatttgcccgagaacggcaaagggtggtatgacttccattctgaaaggacgtatgaaggcggacaaacgatcaccttgcctgccccattcaatcaaacaccgttattagtagaggcaggagcaattattccgatcaatgatcatgaggtgacatttgaaacaaagaatgaggaagcaagaggattcctttgctaccctcatttgaccgaaggaaacgaggtgtttcgtttatatgaagatgatggtgaaacgaatgattacaaggacggcgtatacactttcgtaacggtcaaaatggattgtacgaaggaagagattcgtgtgcacatcgagaaggaaggaacgttccccttaccttacgaaaaggtaagagtctattttccgaaaggggagcaacgaacgatttatgtgaatggatctgaggtatgtacaaacgccagacagaaaatagaagtttccatttaa

SEQ ID NO: 40829 - DNA, 855 bp, Bacillus halodurans
atggagttatcatttcaagttgatttaacaaataaggtcgctgttgtgacaggtggaagtggtgtgcttggacgagaattttgtttagcgctggccaaatgtggggcgaaggtggccgttatcggaagaacggacgacaagctaaaagctatagtgaacgagataatagtcaatggcggggaagccatcgctattagtgctgatgttctggccaagacagacatggaacgagcacgggagcaggttcgaacggaattaggtacgtgcgatcttttgattaatggcgctggaggaaatcatccgaaaggaacgacgcagctcgattatttgcgagaggctgacttacatgggattgatcaagacgtccgtacgttctttgacctagatgccgatgggattcgccatgtgtttgagttgaactttttagggacattgatcccttgccaagtgttcagtcaagatatgctcggcaaggaaggggcaagcattgtcaacatatcttcaatgaacgcctttacccctctgacacgaattcctgcctacagtggagccaaggccgctgtcagtaactttacccaatggttagcggttcacttttcgaaagttggaatccgtgtcaatgcgatcgcgccaggattttttttaaccgagcaaaactattcgttattagtaaaggacgatggcacttacacggatcgagcgaataaaattttgagtcagacgcctgctgaacgattcggaaagccagaagaactgattagtacactgttatggctcgtggattcctcgactagctttgtcaatggagtgatcgtaccggtggacggcggtttctctgcttattcaggggtgtaa

SEQ ID NO: 40830 - DNA, 1737 bp, Bacillus halodurans
atggaaaaacaacaacaaaccagtttgaaaccatttttctcgctcattttatccacaaacattccgaaggttgccttaacgttcgggcttattggtagcctgattacaacactcgtaggactcacgattccgctacttacgcgggaaatggtcgatggcttttcgctagaatcactcaatacgctcctcattgccgcgattatcgtcgtgtttattttacaagcagtgcttgacggtctgtccatgtacgcacttgcctatgttggacaaaaaattgttgcccgtctcagagaacgaatgtggttcaaactgcttcgcttgcccgttaactattttgataaaaacacaagtggtcaaacagtcagccgggttgtgaatgatactgggattgtaaaagatttgatctctcaacattttcctcaatttgttggcggaatcattacgattatcggggccgtgatcatcttatttattatggattggaaaatgaccttgttaatgtttattgctgtcccaatcaccgtcgccgtgatggttcccctcgggatgcgaatgtcaaaaatttctcgtggtttgcaggatgaaacggcgaactttacgggaaatgtgcagcaaacgctaagtgaaatacgtttaatgaaagcatccaatgccgaacaaactgaagaaaagaaagggttaactgggatcgagaagctgttttcctttggattaagggaagggaaaatttttgctttgatcgcaccgcttatgtatctcgtcgttatggtcgtgatcgtcattattatcgggtatggcggtattcgggtagcagaaggaacgatgacgacaggatcgcttgttgctttcttgctttatctgttccaaatcattttcccgattacgtcatttacgatgttttttacccaattgcaaaaggcaaagggagcaaccgagcgaattatcgagatcttagacatcgaggaggagaatgggcaacaagggctcgaaatggacatttcaaacaaggccattcacgtaaaaaacgtctcctttgcctacaatgaagaggagcccgtcatccaaaaggtttcctttgatgtagaaccagggacgatggtggcttttgctggtccgagtggcggcgggaaaacgacgatgttcggcttgctggaacgcttttacgagccaacctctggggaaattctcataggggatacctccatacaagagctttccatgtactcttggcgcaaacaaatcggctacgtgtctcaggacagtccgatgatggtcggaacgatccgagaaaacttgtgctatggattagaggatcgtgacgatatcgacgacgatcggctttgggaagtcgcgaagatggcctacgcggatcaattcataagcgagtttccgaaaggacttgatacggaagtcggtgaacgtggtgtcaagctctccggcgggcagcgtcaacgaatcgcgattgctcgagcgtttttgcgagatccaaaaatattaatgatggatgaagcaactgcgagcttggatagtcaatcggaaggcatcgtgcaacaagcattgacccgccttatggaaggacggacaacgtttgtgatcgcccaccggctatcgacgatcgtcaatgccgataaaatcatctttattgaaaaaggccaaatcaccggaatcggcacccatcaagagctcgtccaaacccatgatctctatcgcgagtttgccgagcagcaattaacgtaa

SEQ ID NO: 40831 - DNA, 999 bp, Bacillus halodurans
atgaatgtttcaaaagctcgaattacggcgatcgggtcgtatgttcctgaacgtcgattgacaaatgacgacttagagaagatggttgatacgaatgatgaatggatcgtgaaacgtacaggcattcgtgagcgtcgaattgctgcggacgatgagttcacaagcgatatcggttataaagctgttcaagatttaatcgcacgctatgaaaaatcggtcgatgatgtggatatgatcattgtttgtacttttactcccgactttaaaacgccaagtgcggcctcattgattcaggcaaagttaggcattcaaaacacgggtgctattgacttaaatgcagcatgtgcagggtttacgtacggtcttcatatggcaaacggacttatttcttcagggttacatcgtaaaatcttagtgattggtgcagagacgatttccaaggtgactgattacaccgaccgtacgacatgcattttgtttggtgatggagctggggctgttcttgtcgaatatgatgagaatgagccgagttttgtgtctttcaacctaggctcggaaggagagcgggctaataagctttattgcacaggtcttgcggagcaaatgaatggggaagagctagtaaacacagggaatctcgttcaaagtgggcgagaggtttataaatgggcggtcaatacagtcccggctggcatgaaagctgttttggaaaaggcagctatgaaaagaaatgagattgattggtttgttcctcacagcgctaatttacggatgatcgagtcgatttgcgataagagcggcattcctctcgaacaaacattatatagtctcgtccaatacggtaatacatcatcagcgacgattccccttgcattagacattggggtccgcgaaggaaaactgaaacacggagacaacgtccttctttatggctttggtgggggattggcccatgctggtctcattttgcgttggacggtgccaactgagaagaactaa

SEQ ID NO: 40832 - DNA, 981 bp, Bacillus halodurans
gtgaagaccgttaagttcccagctcaaatgacggagaaaaaactagtggatttattcaagcaaatgtggttgatccgctattttgaagaaaaagtggatgaattttttgcgaaaggaatgattcacggaacgactcatttagccgttggacaagaagcttctgctgtcggttccattgcggtgctggaggagagagacaaattgacgagtacccatcgtggccatggtcattgcattgccaaaggagctgatgtaaaccggatgatggcagagctgttcggtcgagagacaggctattgtaaaggaaaaggtggctcgatgcacattgctgatgtagagcgaggaaacttaggagcaaacggaattgtaggtggtggcttttccattgctacaggtgcggccttaacgtcaaaaatgaaaaaggaaggctatgtcgttctatgtttttttggcgacggggcatcaaacgaaggaagctttcatgaagcggtgaatcttgcttcgatttggaagctccctgtcgtgtttatttgtgaaaacaatcaatacggtatgtcggggtctgtgaaagagatgatcaacattgaacacatttccgatcgagcagcaggctacggaatccctggaatggttgtggatggcaatgatgtgttcgcggtcatgaacgttgtcgggcgagccgtagatcgagcacgtcgcggggagggaccgacgatcgttgaagcaaaaacgtatcggtggaaaggacattccaaaagcgatgcgaaaaaataccgcacacgtgaagaggagaaggaatggcgggagaaagacccaattgccaggttgcgcgcaacgttagtgaaggaaggtatcgtgacagaagaggaggcagattccattcaagaagaggcgaaacaaaagatagaagactcggttcagtttgcgagaaacagcccagagccagaaattgaatcgttgttggaagatgtctacgcctag

SEQ ID NO: 40833 - DNA, 984 bp, Bacillus halodurans
atgcgagagattacgtatttggaagctattcgggaagccatgacgttggaaatgagaaagaacgaggacgtctttattttaggagaagatattggcgtgtatggaggagcgttcggcgtgacgcgggggatgatcgaggagtttggatcagaacgggttcggaatactccgatctcagaagcagcgatttctggtacggccatcggagcagcgctcacaggcatgaggccaattttagagctgcaattttccgattttattacgattgccatggataatatggtgaatcaagcggccaagctgcgctatatgtacggtgggaaggccaaagttcccatggtgttaagaaccccagctgggtcaggaactggagcggcggcacaacattcacaaagtttggaggcgtggatgacccatattccaggactgaaggtcgttcaacctgccaccgcgtatgatgcgaaggggcttttgaaggcagccattgatgataataacccggtcatcttttatgaacataaactatgttatcgaacgaaatgtcacgttccagaagaggaatattccattccacttggtaaggcagatgtgaagcggaaaggaacagatgtaacggtagtagccactgccgtaatggttcataaagcgttggaggcggcagtagagttagagaaagaaggaatctcggtcgaagtcatagatccacggacgttagtacctttggatgaagaaaccatcatccgatcggtaaaaaagacgagtcgactgatcgttgtccacgaagcggtaaagcgaggtggattcggtggagaaattgccagcatcatcgctgagagtgaagcgtttgattatttagatgcaccgatcaaacgattgggaggtaagcctgtgccaattccatataatccgacgctggagcgtgccgccatcccacaagtgccggatattattgaagccgttaaagaaacattgaattggagttaa

SEQ ID NO: 40834 - DNA, 1311 bp, Bacillus halodurans
atggccaaagagatttttatgccaaaactgagcagcacgatgcaagaagggacgttgctccaatggtttaaagaagaaggggatcgtgttgaagtcggtgaaccgttatttgagattatgaccgataagatcaacattgaggtggaggcttatgaggaagggacactgttgaaacgatattatggggaagatgatgaaatccctgtgaaccatgtgattggctacattggcacgccagacgagtcggtgccaactgaacctcctggagcatcggaaattacggcatcatccacagatgaagcgggtgaccatcgcactacggccgtaaaaaaggctccttcgtctgaccgagagaacgttcgcgctacgcctgcagcaaggagaatcgcgaaagaaaaaagaattgatttgcggcaggtagaaggctctggtccagaggggcgggtgcaggcggtcgatgttgctacgtttaagaagaaaggccaaaaggcgacccctttagcgaaaaaggtagcagaggtgaaaggggttgctcttgaaaaggttcaaggttctggcccctacggaaaagtgtaccgagaagatgtggaacacgctcaagccgcttcgccagtagaggataaagggaatcgagtcaaactaagtgggttacgtaaggtcgtggcaaaacggatggtggatagcgccttctctgccccgcatgtgacgattacaaccgaaattgatatgtcgagtacaatcaagatccgttcacaactgttagggatgattgaacaagagacaggctaccgtttgtcctatacagaaattgtgatgaaggcggttgctcacgcgctaatgagtcaccctaccattaatgcctctttctttgagaatgaaatcgtctaccatgaagacgtgcatatcggtttagccgtagctgttgaaggaggattggtcgtcccagtcgttaaacatgtagacaaaaaaggattggcccaattaacaaacgagtgtaaaacagtagctatggcagctagagacaatcgactttcacaagaaatgatgagcggtggcacgtttacgatcagcaatttaggaatgtatgcaattgacgtctttacaccagttatcaatcaaccggaatccgcgattttaggtgttggtagaattcaagaaaagccggtagggatagacggccagattgagcttcgcccgatgatgactgctagtttatcattcgatcatcgtgtcattgatggagctccggcggcggcctttttaacagacgtgaaatccatgctagagcagccatttcaactattgatgtaa

SEQ ID NO: 40835 - DNA, 1389 bp, Bacillus halodurans
gtgaagagctatgacattgtggtgatcggaggaggacctggaggttatgtggctgcgataaaagcggcgaaattaggaaagaaagtcgcgcttgtggaagcaaaagatcttggaggtacgtgcttaaatcgcggctgtatcccttctaaaacattactccatcaaggagagatcatagagaaaatcaagcaggcgaaggaatggggaattgaaacaggggctgtcacgttatctttgccgaaaatgcttgcgcgaaaaaatgaaatcatacaaaagcttcgagcggggattcatttcttactgaagcaaggtaagattgatgtttactttggttatggggaaatagagcgagatcgttcagtcaagatcaaaatgaaagaaacagcagaaatcgtcagtgtaaggacagaaaatatgattgtggcgactggaactgagccaaccattccccctgttcctggattagcagaggcggttgttgacacgagtgatacgatttttgaactcgattcgattccccaatcgattgtcattattggcgggggtgtgatcggtgtggagattgcctgcattttttctagtttgcaagtcgatgtaacgatcgtcgaaatgggcaagcgaatattgccacaagaggatgaggaagcagctaaagtattggcaaaagctttggcagcaaaaggtgtccatcttttgacaaacacgaaagtaacagcggtgctccaaggtgataaacagaaggtggagattgaaacgagcaccggagaccgagactggctggagggggagcggattttgctggcggttggacgcacaccaaatctttcagtggttaaggagctaggattgggcatggcaggtccgtttcttaaagtggatgatcagatgaggacgagtgatccatcgatttacgcgatcggtgatgtgattggtggctggcagctagcccacgtggcaagtgctgaaggacttgttgcagccgctaacgctagcggaaaggtggaaatcattaatcgtcaagtcatcccgcgctgtatttatacacaaccggagatcgcgagtgtcggcttgacagagcaagaggcgaaagagaagggctattcatataaagttgtaaaagtcgatcttcgagcaaatggtaaagcgatggctttaggggaaacgactggattcgtcaaaatgattgccgaccctaattatggggaaattttaggggttacgatggtcggtccccatgtgacagagatgataggagaaccggctgctttcatccatttagaagggacggttgacgaattaaaagcgatgattcatccacacccgacagtgtcggaggctctttatgaagctgctgctagctggctcggacaaggggtccaccaaccataa

SEQ ID NO: 40836 - DNA, 1356 bp, Bacillus halodurans
gtgactagcaacgatctcttagcgaaaagtaaaaagcacttatggctccccttcacccaaatgagtgactacgaaaaagaccccctcattatcgaaagcggaaacggcgtttatttaaaggatattgaagggaacacctatttagacggatactcttccctatggcttaacgttcatggtcatcggaaaaaggaaatcgatgaagcgattgaaaagcagcttcagttgattgctcactcgacgctactcggagcagctaatatcccttcgatccaacttgcggaaaaattagttgagctcgctcctgaagcgatcacacgggtgttttactccgatagcggcgctgaagctgtagaaattgcggtaaaaatggcttatcaatactggcaaaatcgtggatacgaaaacaagaaatcatttgttacattaagcaacggctaccatggggatacggtcggtacaatgagtgtcgggtccattgaactctaccacaaggtatatacctcgctcctatttgatgccattgttatcccatttccagcctctaaggaggagcaaaccgaatcagacctttgccgtgaaagccttaagcaactccgtgagctttttgaagcgaagcacgaagaaattgccggcataacagtggaagcacttattcaaggtgcaggtggtatgaatctcatgcccaaaggctatttaaaaggggtcgaacagttgtgcaaggagtttcatattttactcattgttgatgaagtcgccaccggctttggtcgcacggggaaaatgtttgccgttgagcacgaaaacgtccagcctgatatcatgaccgtcgcaaaagggattacgggtggctacctcccaattgcagctacccttacacaagaacatatttacgaagcgttttacggagagtatacagatttaaaaacattttttcacggccattcctatacaggaaaccagcttggttgtgccgccgcattagctaatcttgaaatctttgaaaaagagaacatcatccaacaagtggaagaaaaagccttgtttttagaagagcagcttaaacacgttgctgagcttgaatttgtcggtgccgtccgacaattagggcttatgtgcggaattcaactcgttcagcataaacgaacaagcgagccattcccctgggaacaacgtgtcgcttaccgatccacattaaaaatgcgagccctcgggatgcttacgcgacctcttggagatgttatcgttttaatgcctcctcttgcagcaacgaatgaccaattaaagcaaatggtcgatattatgaaggaaggaatcatggaagcggcgactgaatgtttagagcaacaagtttag

SEQ ID NO: 40837 - DNA, 3120 bp, Bacillus halodurans
atgttttatcaactggaaaagctgcaaaaccgaatcaatgaactagcctcgtatcggtatcgtgatgtaaagccgctggacagcttttatatgtatgaaccagagcaaggcaaagagagcgttgttcctacacactacccaaagcaaacgtttcacgtgaacgatacgtggtcagggcgaaataaatatgtatggttgaatacctctctccatctcccagaagcatggagtgataagcggtgtgtattatttctcgatgttggacggacgggaggcggaaacaattcgggctttgaagcgttgctgtttgtgaataagcagccgtttcaaggggtggacagcaaccaccaagaagtgcttctcccaaaggaaggcggaaaccgtctcgaaattgatgtgatgatgtggtctggccttgaaggaggcgggactcctaggacgcagtactatcgtttcaaacaagcgtggtacggttggcttgatcaaaaggtggatgcattttattttcaagcgaaggccattcttgaagcgattggtcagcttgacgttcacgatgctacgagagtggcgatgctgtcacgtttgaatcaagcatttgcttcaatcaactggacacagcctgggaacgaacaattttatgattctgtttacgaggctcttgaacgtttagagagagacatggagcacctcccgaaacattcggatgttcacatccatgccatcggccattcccatattgatctcgcatggctctggcaaacgaagcatacgaaggaaaaggccaaacgaaccttttcaaccgttttgcgtttaatggacttgtaccccgactatgtgtatctacaaagccagccccagctttaccaatggatgaaagaagaggagcctaagctgtatgaagccatcaagcaaaaggtggacgacggtcaatgggaagtggaaggggggatgtgggtcgaagctgactgcaacattccttcaggtgaatcccttgtacgtcaactgttatatggtaagcggtttttcaaaaaggagtttcataaggagagcaaaattctctggttgccagatgtgttcggctatagttgggcgcttccacaaattttaaaaaaatcgggcatcgatacgttcatgacgacgaaaattagctggaaccaatataatcgaatgccgaatgatacgttttattggcgtggactggacgggacggagatcttaactcattttattacaaccccagagccgggaaggccaaaagactcgtggttttatacgtacaatggccttatgagtgcggagacaattaaagggacttgggaaaaataccgtgataaagcagtgaatcaggatttacttttagcgtacggctacggagatggtggtggcggtgtgaaccgggaaatgttagagatgaaacgccagcttgaccaagtcccaggggtaccacatgtgaaatcaacccatgtgaaagagtattttcatcagttgcatgagaatgtagcaaataccgcagagtatgtccatacatgggatggagaattgtacttagaataccatcgcggaacctacacaagccaagccaaaatgaaaaaaaagaaccggcagctagagttttcctatcgagacgcggaaattctcgcggtgactgcgagcgcagaaaaggggtgggatgcgtatcctgggtcttcgcttgaaaaaggatggaagcttcttttgctcaaccagtttcatgacattatccccggttcgtcgattaaagaagtgtatgaagatgcagcaaaggattacaccgaggcggcagccatccaaaagcaagttgttactacacaagaaaagcgaatggtgaatgataaacgagaaaagtggacattttttcatccataccaatatgatacaccgattcttgtaacgattcctaagggaacagacgagcgtttcgtggatcaaacaggccatgggctttcatctcagcaaaccgcaaataacgaaacacttgtcttacttgagaaaagcattccgtttgcctatcaaacaattagtagagcaacgatggtagcagaagaagtgcagatgcttagtcaggtaaattttgaggagcggaggtgggaaactccgtggtatcaattggaatggaacgatgaaggccagtttattaggatgtatgataaactagggaaaagagaatggctcgcccaaggcaagctagggaatgtgttcaaacgttttgaagataagccccttgcccatgatgcttgggatattgatttgttctatcaagaaaagtcatccaccgtttctagctttcaaggctgtgagctgatcgaaaacggcccgctacgaacaacagttttatttagatggaaagaggacggtgtagtgatcaagcaagcgatacggtgctaccgtcatacggcgagaattgattttgcaacagaggtggactggcaagcgaggcaacaactactaaaggttgaattcccagtcgatatccgtacaaatgaagcgatatacgatattcaattcggcaatcttaagcgtccgacccattggaacacctcatgggatatggcgcgatttgaaacggtcggtcataaatgggctgcgatcgctgaagcagactatggcatcagcttgctgaatgatagcaaatacggctattcgatcaaggacaatgtgctttccctctctttacttaaaggggctatataccctgacccagaagccgatataggcaaccatcaatttacgtatgcattatacccgtttcaagggccagcttttaaacgggacgttgagcgggaagccacttatcttcagtcagcgatcatcgcggtgccaggagaagcggagatgccgtttgaccagccgttattcaccgtttcttctgatcaagtgatcgtggatgcaatcaaaaaatcggaagacggaacgtccgtcattattcggcttcatgaaatggaaggggcacgggctacagtcaagcttgattgtcgttatgaagcaaagcagtggagggaagtaaatttaatcgagtctgaggcgctgtctgaatggtccacacgaccggtggaactcacttttactccttatgaaattaaaacaattgaactgacgttatga

SEQ ID NO: 40838 - DNA, 1182 bp, Bacillus halodurans
ttgaagcgagatcaacattttgaaacaagagcgattcatacaggctataagcctaacgagcattttgacagcttaaccccaccgatttatcaaacctcaacgtttacgtttgcttccatggagcaaggaggtaatcgttttgctggggaggaagctggctatgtttattcaaggttaggcaatccgaccgttcagattcttgaacagcggatagcagagctagaaggaggagaagctgccctggccttcggttcagggatggccgcagtctctgccattcttgttggcttgacgaaagcaaacgaccatatccttgtctcaaatggtgtgtacgggtgtacgttcggtttgctcactatgctgaaagaaaaatacaacattgacgcaacgttttcgccaatggactcagttgaggaaatcttagcaaacattcaagataacacgacgtgtatttatgtggaaacaccgatcaatccaacgatgcagttaatcgaccttgagcttgtcgtgagggtagcaaaagaaaaagggataaaagtaattgtcgataatacatttgccactccgtacttacagcaaccgatcgcattaggatgtgatttcgttgtccacagtgcgacgaaatacattggcgggcatggcgacgttgtggcaggcgtattaattggcgacaaagaaacgattcaactgattcgaaaaacaacgcaaaaagatatgggtggcgtcatttctccgtttgatgcatggttattgctacgggggttaaagacgttagcggtccgaatggatcgtcactgtgaaaacgctgaaaaactagcggaaaaactaaaggaacacccgaaggtaagcacggttctctatccaggtgattttgagcaccctgatcattcgatcgttgcaaagcaaatgaaaaaagggggcgggctactctcatttgagataaaaggaacagaggcagacatagcgaaagttgttaatcagcttaagctcattcgaattgccgttagtttaggtgatgcggaaacattaattcaacaccccgcgacgatgacacatgccgtcgttcctgaaaaaagacggacccaaatggggatctctaaaaaattgctacggatgtctgctggtcttgaagcttggcaagacgtgtgggcagatttagagcaagcattaaatcagttgtag

SEQ ID NO: 40839 - DNA, 900 bp, Bacillus halodurans
atgtatccgaaacatgaaccgattgacacgcaccaaaaatgtgatgacattcctgttcatttccctcctcaatctcagccgtggcacccaggacttgaatatttaatggagcctaggccaatctcagaaaacccccatcggccccacagtcataagctccttgatcgagtggctattattactggtggagatagtgggatcgggcgcgctgttgcttatgccttcgctaaggaaggggcagatcttgtcatttcgtacttatcggagcatgaggacgcgatcgaaacaaaaaaacgggtagaggagatcggacgagattgtttgctcgtgcctggtgaccttcaacatgaacaaatgtccgttaaagtcgtggaaaaaacgatcgaacgttttggcaagcttgatgtacttgtcaataatcatgctgttcaatttagacaaacgagtctattggacataacagaagagcagcttgacattacatttcgtacgaatatctacgcctatttttttatgacgaaagctgccctcccccatttgaaaaaaggtagtgcaattattaatacaacctccgtcacttcctatcttggtcactcacagcttatcgattatgctgccacaaaaggagcggttacgactttcacccgtgccctgtctggatctctagccgaccaagaaattcgtgtaaacggcgtcgccccaggaccgatttggacaccgctcatcccatcttcataccctgctcattcgattcctacgttcggatcggacactccactaagccgaccggggcagccgtttgaagttgcaccaagcttcgtctttcttgcatcggatgactctaaatatttgacaggacaaattttgcatccaaatggggggcgagtcacgggctcttaa

SEQ ID NO: 40840 - DNA, 633 bp, Bacillus halodurans
ttggcggtgttgggggctacaggcgctggaaaatcaacgttgctacaattgatcctccgattatatgatcctacggctggagcgattaggatcgatggcaaggatgtgcaagatatcggaatcagtcgacttcgccaagaaattggctatgttcctcaagaagtgttacttttctctggatccgttcgtgacaatcttgcgtttggaaaagaggacgctacccaagaggatattaagcaggcggctaaggcagctcaaatccatgagacgatcatggcaatgccgaatcaattggatacgaagattgggcaaaaagggatcaacctatcaggcggacagaagcagcgcatgtcgatcgccagggcgctcgtacgtaagcccgcgattttacttttcgatgactgtacgagtgccctcgatgtgaaaacagaatcagaattgttacgagagctagcttcctatcagtcgaccgttttaatcgtgacacaaaaattgagcacggccattgaggcggatgccatccttcttttagaggacggcaaggtggcggctcacggtcaacacgaggagcttctacgaacatcaagtctctatcaaaggctgtatgaatcccaatatggaaagagggcgtaa

SEQ ID NO: 40841 - DNA, 1836 bp, Bacillus halodurans
atggccaaccctttgaccgaaccgtttcgctatcggaaaattccaattaacgaaacagaaggcagtgaaaagaaaaaagtccgaccagcccaggcgtcaaaaacgcttcggcgcatctggacgtatttggtcaactatcgaggacgacttttgctcgtttttttggccgtgctattaagctcggtgttaggactactcggcccgtttgtaattgggatggcaatcgaccattatcttgtggaaggggatacgtctagtctgttcaaggtgatgatcggacttctcgcaatttatgccgtttattccctttccatgtggttacaacaagtgtggatgatcgggattgctcaacagaccgtatactcgattcgctccgatttgtttcaccatttccacaggttgccgatcccgttcttcgataaaaagcagcacggggaattgatgagccggatgacgaatgacatcgagaacattagcaatacgctcaatagctccgtcatcaaaattttctcaagtgtgctgacattagtagggatcatgatcgtgatgctatggctaagtccgcttatgaccgtaatcacgatgacagtcgtccctctgatggtgtttgggttaaagtggattacccgcagaacagcggtgttttttaaacagcagcaaaaagcgctaggtgacttgaatggttacattgaagagacggtatccggacagtctgtaattcaagcattttcccgtgaaggggcggcgatcgctaccttttccgaaaaaaaccgagagctaaaaacgacaagcttttgggcgcaaacgtatacaggattcattccgaaagtaatgaacgtcctcaattcattaaattttgccgtgattgctggagttgggggcattctcgcgatgagaggttcgatcacgatcgggatcatcgtcatttttgctgaatatgcacgtcaatttacccgaccactcaatgatttggcgaaccagttcaacatgctccttgccgcgattgctggggctgagcgggtgtttgacattctcgatgagcaagaggagcggcatcacgatcaaacgaagcaagtaaaaagcataaaaggcgaagtttcgttcgagcaggtatcattttcatatgaacagaagaccaccttaaacaatctttcgtttcatgtgaacccaggggagacggttgcccttatcggcccaacaggagcaggtaagaccactatcatccgcctcttgtctcgcttttatgaatgggatggaggggcgatttatgtcgatggtgaagatgtgacgacatgggacagagaaagctaccgccgtcatctcgcctttgtcctacaagagagctttctctttcaagggacgatccgggaaaatattcgctacggccggctagaggcaaccgatgaggaagtagaagcggcggcgaaaatggcaaacgcccactcctttattatgaggctccctgaccagtacgacacagtccttgattcagatgggagcggaattagccaaggacaaaagcagcttctctccattgcccgagcaatgatcgcaaatccgtcgattctcattctcgatgaggcgacaagcaatattgatacgatcacggagttaaacattcaagaagcgctacaccggttaatgaacggacgaacaagttttgttatcgctcataggctcaacacgattcaacacgcagatgtcattctcgtcctcgagaagggaacgcttgtggaacaaggatctcacgaagaactgatggcgaaaaaaggcgtctattacgacatgatcgaccgtgggcaacagacattagcagaaggagaggtcattcgatga

SEQ ID NO: 40842 - DNA, 1395 bp, Bacillus halodurans
atggatcgtaaagaaacagcgaaacttatggaaaacgtaatgaccgagctttcggagaaggaaggattcctcggcattgaagatgatgagaagcgaaagcgaatcgtcttatcggcgcaagaaattttaacgacaacggacaaaatcattaagagctacatacgggtctctacagaacatggaatcatgcggattccagcctaccgggtccagcataacaacattagcggcttttataaagggggcatccgctttagcgagtttgtctctgaggaagaagtagaaaatttagcgattctcatgacactgaaaaatgcgctccaccgtttaccttttggtggtgcaaaaggtggcgtccatgtagacccgagaaaatactcggaaaaggaattaaacctgattagtaaaaaatatgtacagcgcttcgcaagagacctggggccgaaccatgacattccagcccctgacctcggaacaaatgagcaagttattgattggatggttggagaatttaaaacgattcacccaggtcaagcgtatctcggctcatttacaggaaaaagtgttgaaaatggaggggcacgtggcaggcgagaagccaccggaaaaggaacttttttaagttatatttggctcttaagtcaatggtacgatgaacatgtctctggtaacggaatcaaccgaacgaagcagtgggagaccatatcaaatctaaagcaacaagccgataatagcgatccaattcgtgtggcggtgcaagggttcgggaatgtggggagcgtggcagccctcgaagcctatcaatgttcagaaatcgcccaccgggttgtggctgtctccgatcggtatacgacgctttacaatgagaaggggctcgatgttcgtgccttggcagcttatacgatcggcggtaaggatttaccgaaaaacagtgaagagctagcggcagctggggtggaagcatcggttttaccagtggatgccgttctaacgtgtgagacggacgtgctcattttagcggcgattgaaaaccaaattcatgaacgaaatatgaagcaagtgaacgcccgcgtcctagtggaaggagcgaatgccccgatttcgacagaggctgatgactatttcgaagcagcgggcacagtggtcatccctgatattcttgccaatgccggtggggtcatcgtctcttaccttgaatggaagcagagccggattacggagctttattctgaggatgatattttagatgaaatgggaacgcagatgaaggaaacgctaaaatccgtctatgagcgctatttttcctcggtcgggcatacgctgcgttttacgtgctttacgctagcacttgaacggctaacgagcttgctgtataagcacggaaagctctattaa

SEQ ID NO: 40843 - DNA, 921 bp, Bacillus halodurans
atgatttatacagtgacgttaaacccctcaattgattacatcgtccaagtggaaaactttcagcaaggagtcgtcaaccgttcagagcgtgataggaaacagcctggtggtaaaggcatcaatgtctcccgcgtattgaagcgtctcggacatgagacaaaggcacttggatttttaggtgggtttacaggagcttatgtaagaaacgccctcgaaaaagaagagattggtctctcctttattgaggtggaaggcgatacaagaattaacgtcaagatcaagggtaagcaggaaacagaattaaatggcaccgctcccctgattaagaaagaacatgttcaagctttgcttgagcagctaacagaattagaaaaaggggatgtgctcgttcttgctggtagtgtcccacaagcgatgccacagacaatttaccgctcgatgacacaaattgccaaagagcgaggcgcttttgtggctgtggatacgagtggagaggcattacacgaagtattggcagcaaagccttcgttcataaagcccaatcatcatgagctttcagaactcgtttcaaagccaattgcttcgattgaggatgccatcccccatgttcagcgactcatcggtgaaggcatcgaatccattctcgtgtcatttgcaggggatggggcattgtttgcctcagcggaagggatgtttcatgtgaacgttccgtctggggaggtgcgaaattcggtcggggccggtgattcggtcgtggcgggatttttggcagcattacaagagggaaagtcccttgaagatgcagtgccattcgcagttgctgctggtagtgcgacagcattctccgatgggttttgtacaagagaggaagtcgaacggctgcaacagcaacttcaacgaacgataaaaaaggaagggtga

SEQ ID NO: 40844 - DNA, 1359 bp, Bacillus halodurans
atgaaggaaaaagttcaaatgcagcggagatattttcatacgaacgaaacaaaagagctttcatttcgcatgaacatgttaaaaaaactaaaaaaagcgctcctagactatgaaaacgaattgcttgccgccttaaaagaagatttaaataaatcgacgtcagaggcgtttttaacggagcttggccccctttatcacgagatcacgtttatgttaaagcatttaccgacttggatgaagcgaaaaaaagtgaaaacaccgctgacccacgttggctcaaaagggtacatccattatgagccttatggggtcgtgctcattatcgccccatggaactaccccttgcagctagcgattaatccgctgattggtgctattgcagcaggaaattgtgcaatcgtgaagccatctgaattaacacctgctacttctggcgtcatcaccaaaatgatcgaaaacacattccctgaagaatacgtttgttcagtggaagggggagtggaaacgagtcaagcccttttagcggagaagatggactatatctttttcacaggaagtgtcggtgttgggaaacatgtaatgaaagctgcttctcgtcatttaacgcctgtcactttagagcttggtggcaaaagcccagcgattgtgtgcgaagacgcgcagatcgctgtgacggcgaaaagaatagcatgggggaaatttttgaatgcgggacaaacgtgtgttgccccagattatgtcctcgtacatgactcaaaaaaagaggactttttaaaggcgctgcaaacagaaataaaaacgctttttcaacgtaagatcgacagaggcgactatccaacgatcgtcagtgatcgtcattttgcgcgactcatccgatttttgcaagatggagatgtggtcatcggtgggcagcatgagcgcaataaacggttcatagccccaaccgttttaacgaatgtttcatgggaaagtccagtaatggaggatgaaatattcggccctatcctaccggtgttttccttttctgaactagatgaagtgattgaaaaagtgcgtgagaggccgcatccccttgccctttatctgtttactgaatcaaaggaaacagaggagaaactaatccattctctttcctttggtggcggatgtattaatgatacagtcatgcatttagcaaccccgtatttaccgtttggcggcgttggtgagagtggaatgggtgcataccatggagaagagagcttctacacgttctctcatcggaaaagtgtgttaaagcaaccaacaagtgtggatctcccgattcgatacaaagagagtaagctgtcattgaaaatgctgcgcaagcttttccaataa

SEQ ID NO: 40845 - DNA, 1680 bp, Bacillus halodurans
atgtatcaagaatggtggaggaaagcagttgtttatcaaatttatccgaaaagcttcaatgatacgacagggaacggtgtcggtgatttggagggcataattcagaagcttgattatttgaaaacacttggagttgatgtcatctggctgactccgatttatgcttcaccacaaaaggataacggctacgatattagcgactactattcgattcatccagaatatgggacaatggaagactttgaacgattgctcactgaggttcatgatcgaaaaatgaaggtaattatggatatcgtcgttaatcatacatcgacagagcacgaatggtttaaacaatcggcacaatcaaaggataacccgtaccgtgatttttacatttggaaagacccggtgtatggtcttgaaccgaacaactggcaatcaaaatttggcggttccgcctggaagtttgattcgaaaacagaccagtattatttgcatctgtttgacgtatcgcaggctgatctaaactgggaaaatgaagaagtacgcaaccgagtgtatgagatgatggatttttggtttacaaaaggtgtggatggctttcgtcttgatgttattaacctcatttcgaaggatcaagcctttccaaacgatgacggctctgttcctccgggagacggtagacgcttttacacggatggcccacgtgcccatgaatttatgaacgagatgaatcgcaaagtcttttcgaaatacgatgcgatgacggtcggagaaatgtcatcaacgactttagagcattgtattcaatatacgagacctgaaaacaaagagctgagcatgacgtttaactttcaccatttgaaggtcgattatccgaatggtgaaaaatgggcgatcggtgacatggacttttttgccctgaaagaaattttatctaagtggcaagttggtatgcataaaggcggcggttggaacgcgctgttttggtgtaatcacgatcaaccacgagtcgtgagccgttacggaaatgacgggaagtaccatgaaaaatcggcgaaaatgttagcaacaacgattcacatgatgcagggaactccttatatttatcaaggagaagagtttggaatgaccgatccgaaatttgatcggattgatcagtaccgtgatgtagaaacgctcaactattatgacattttaaaagaacaaggactatcagaagaagaggtcatggagatcattaaacgaaaatcccgtgacaattctcggacacctgttcaatgggatgatagtccacatgccgggttcacgtcaggaaccccatggattgatgtggcgtctaactatcgatcaatcaatgcgaaaaaggcattggcggataaacaatcgatcttttatcattataaaaaactgattgagcttaggaagacatatgacattgtaacgtatggggactatgaattactcttacctgaggacccgcgtgtgtttgcgtatgttcggcgctatcaggacgaaaccttactcgtcgtcaatcatttttttgctggagaagtaacgattcaggttccagaggatgtgacggccgagaagcatcaggtcgatgtccttctggccaattatcatgacccttctcgtgagtttcagcagttagtcttgcgtccgtatgagtctgttgtttattatatgaaatag

SEQ ID NO: 40846 - DNA, 804 bp, Bacillus halodurans
atgaaacaacatcatatgttaatcattggggctggacgaatggcagaagcaatcttttcagggatcttaaaacgagaggaaaacccttttcaaatcacggtgagtaacgataaggacgtggcccggttagaaaaactaaaaaagacgtatcccgtcaaaacaacgaccgattggacagcggtggtagaaacagcagatgtcattttactcgcctgccctcccgctgctcacgagaatgtgctaaaaaaactatctcctatttgcaatggacagctcgtgataacggtggctgctggtattggcccaacggacttggagacccaccttccgaaaggaacacccactgcatggattatgccaaatacggcggcaagtgttggggaatcaatgtccatctactgtttcggtcaacatgtaaaagagagagacaaacagcttatctcatttatccttgatgcgatcggaatgtctgaacagctcaccgaatcacaaattcatcaccttaccgcaattacgggaagcgctccggcttttctttactttctcgctgaagcgttggagcaatcagcccaatcctatggagtggcccctgaaaaagctcgagaacttgtcattggtatgatcacaggaagtgcgaagatgctggaggagtataaagatccaacacaacttcgtgaacaagtgacaacccctgggggagctacggctgccggattacaatcattgcttcacgatgacttccaaggtgcgttacaacgagcggtgcaagcgactaatggaagagctcaggaaagagccaactag

SEQ ID NO: 40847 - DNA, 2208 bp, Bacillus halodurans
atggacacaaataacacaggaaaatgcccattccatcacggcgccactactagtcctaaatcaagtggtactacaaataacgactggtggccaaacgcgttaaacttaaatattcttcgtcagcatgacaaaaaatcaaacccaatgggagaagaatttgattatgctgaagaattttcgaagctagattatgatgctcttaaacaagacgtgcgcgacctaatgagagacagtcaagattggtggcctgctgactttggtcattatggtccattctttatccgtatgtcttggcacgctgcaggtacttaccgtataggtgatggccgaggtggtggcggaactggtaaccaacgctttgcccctcttaatagctggcctgacaacggcaaccttgataaagcccgccgattactatggccaattaaacaaaaatacggcaacaagatttcttgggctgacttacttgtattagcaggtaatgtagccattgaagatatgggtggaccggtgattggcttcggagctggacgcgaagacatttggcaccctgaagaggatatttactgggggagcgaaaaagagtggttaacgggtgataaacgttactcaggtgatcgtgagcttgagaatccacttgcagctgttgagatggggcttatttacgttaaccctgaaggtccagacggtaaaccagatcctataaaagccgctcatgacattcgcgagacatttggccggatgggaatgaacgatgaagaaacggttgcccttatcgctggtggacatacatttggtaaggctcacggtgcaggaaatccagatcatgttggtccagagccagaagctgctccgattgaagcacaaggcttaggctggcaaaacacatacggctctggcaaaggtcgcgacacgatcactagtggccttgaaggcgcttggactgcgaatccgacacagtgggataatggtttctttgatctattgtttggatatgaatggtggcttactaaaagtccagcaggtgcatatcaatggcaagctgttgatcctgatgaaaaggatttagcaccagatgcagaggacccatcagttaaagtcccaacggtcatgcttactacggaccttgccttgcgtcacgatccagaatacgaaaaaatctctcgtcgttttcataagaatccagatgagtttgcagatgcctttgctcgtgcatggttcaaattacttcaccgcgacatggggccaaaagcaagataccttggtccggaagttccagcagaggactttatctggcaagatcctgtaccgaccgttgattatgaattaactgatgcagaagtagaagagcttaaagcaaaaatcttagattctggacttactgttagcgaattagtgacaacggcttgggcttcagctagtacgttccgtaattcagataagcgtggtggagctaatggtgcccgtatccgtcttgctccacaaaaagattgggaagtgaatcagccagagcagcttgaaaaagtcctttcagtactagaaaacattcaaagtcaactagacaaaaaagtcagcatcgctgatttgattgtactaggtggtagtgctgcagtagagaaagcggcaaaagaggctggctttgatgtaactgttccttttgctcctggacgaggcgatgcaacacaagagcaaacagatgtagaaggatttgctgtattagagcctgtctctgatggtttccgtaactaccagaagaaagaatacagtgtaagccctgaagaactcttaattgacaaagctcaattgctcgatctaactgcaccagaaatgactgcacttattggcggaatgcgcgctctaggggctaactatggcggcacacagcatggtgtatttactgattgtgtcggtacactcacaaacgatttctttgtaaacttacttgatatgggaattgagtggaaacctgtagattacaacctatatgaaggtcgagaccgtaagacaggagaagtcgtacgcactgcaacaagagtggatctcgtattcggctcaaactctattctacgtgcgattgccgaagtttacgcacaagacgataacaaaggaaagtttgtcgaagactttatcgcagcttgggttaaggtcatgaatgctgatcgcttcgatcttaaactaaacaaaaaagctcaattaacaagtaaataa

SEQ ID NO: 40848 - DNA, 1326 bp, Bacillus halodurans
atgtcacttaaagtggttgtcatcggtggaggttccagctatacccccgaaattattgaaggattgatcacacggtatgatcagatacctgttcgtgaaattgttcttgttgacatcgaagccggggcaaaaaaagtcgcgattatcgaagctctatctaggagaatgatcgaaaattcaggttatccgatccatgttcacagctcatttgacctacgggcatccttagaaggcgcaaattttgtgacgacacaaatccgtgtcggtggactggaagcaagggaaaaggatgagcgcattccgttaaagcacggattgatcgggcaggaaacgaatggagctggtggagtctttaaagcgtttcgcacaatccctgttttgcttgaaattgcccaagcgattcacgacatttgtccccaagcttggatgatcaattttactaacccagcgggaattgtgacagaggccttactgcaccatagtccacacaaaaaagttgttggtgtatgcaatatcccatttaatatgaggactggaattgccgaaatgttttcctgccctgtcgaacaagtggagattgagtttattggcatgaatcattttgtgttcggaaaaagggtgtttattcacggcgaagaccggacgaccgaagcattagcgaaactaacggaagacaaggtcgattactctccagcaaacattgtctctcttgggtggtctaaggcgtttgtcacagcgctccagctgctgccaaacccttatcatttatattatttccaaacagaggaggtgttaaaaaaggatctcgatgcttttagaaacaatggaacgagggctgaaatcgtcaagcaagtagaagattcgctttttctgacgtaccaaaatccatcattatcagaaaaaccgaaagagcttgagcagcgcggtggcgcctattatagtgaagcggcgtgcaacttaatggaaagtctctatacgaacaaacaggacattcagactgtgaacacacttaataacggaagtatccgagatttaccggatgatgcggtcgttgagattaatgctgtcattacaaaagacggcccaagaccgcttgcgattggaaagattccaccacatattaaagggttaatcgggcacatgaaaacgttcgaacagcttgttatcaaagctgccctatccggtgattattacgacgcttacaatgccctcatcatgaatcctcttgtcgctgacgaaaaaaaggcaaagatcgtcctagacgaattgctagatgctcataaagagcacttaccccaattttatcgtaagggagctgttatttaa

SEQ ID NO: 40849 - DNA, 1800 bp, Bacillus halodurans
atgaggtttcgtaaacgaatggggaaactgctcatatggatcgtcactgttttactagtggtcacatggatgccagctgatcaggttgtaggtgcagctgaaacgtcggacgaccaatacaaaattgtcgcctactatccttcatggggagcttatggccgtgattaccaagtgtgggacattgatgcgtctaagattagtcatataaactatgccttcgcaaatatttgctgggacgggagacatggaaatccagatccggcaggtcctaatccgcaaacatggtcgtgtcaagatgaaaatggagtgattgatgttccaaatggttcgattgttatgggagatccttggattgatgcacaaaagtcaaacccaggtgatacatgggacgagccacttcgtgggaattttaagcagctgaacaaattaaaagaggagcatcctcatttaaaaacgttgatttcagtcggtgggtggacatggtctaaccgtttctctgacatggcggcaacgaaagagacgagagaaaacttcgcgaattcagccgtcgagtttattcgtaaatacgggtttgacggtgtcgacgttgattgggagtatccagtgagtggaggtcttcccggaaatagccgtcgtccagaggataaagaaaatcacgtcctgctcttacaagaggtgcgagacaaattagatgaggcggggcaggaggacggcaaagactatttattgacgatcgcttcaggtgctagccctggatatgtggaaaacaataagctcaatgaaattgctgagattgttgattggatcaacatcatgacctatgattttaacggtggctggcaaaacattagcggtcataacgccccgctttactatgatccagctactgcaaatacggagttgccgacgccagaacattttaatgttgaaagcgctgttgaagggcacttacaagctggggtgccagaacataaactcgtattaggcatgcctttttacggtaggggatggagcaactgcgatggggccaatcaaggcgagtatcagcgctgcgctcctccgcgtgaaggaacatgggaaaacggtgtcttcgatttttctgatcttgaggatcattatattaacaagaatggctaccagcggtattggaacgatgtagcgaaggttcctttcttatataatgcaacaaatggtaactttatcacctatgatgatgaagagtctttccgatacaagaccgattttattaaatctaataatctagcaggctccatgttttgggatgtgagcggtgatcgtaacggaacgctacttacggcattagcggatcagcttggctttactccacatgaagggcaagaaccagaagagccttcttcagcaccgactaacattcaggcgactgaggttacgtcaacaactgttacccttacgtggcaggcaccgaccgaagagccaacgcaatactcggtagcctacgattcaaaagaaaaaacgaccactcatacaacgattacgatcgaggatttgcagcctgaaacgacgtatacgtttgtcgtttctgctgaacataaagacggaatccgtcatgcgggtcaagctctccaagtcacaacgaaatctgaaactggcggtgacgggtgtactgctccgacatggcaggcaaacaatgtgtatacaggcggagaccaagttcagcatggagggaagctgtatgaagcgaaatggtggacgacaggtgaagagccgggaacaacaggtgagtggggcgtgtggaagcttattggcgattgtgaataa

SEQ ID NO: 40850 - DNA, 1284 bp, Bacillus halodurans
atgagccaaacagatatgaacgtttttgaacaattggaatcggaagttcgaagttattgccgtagctttccaaccgttttcaccaaagcaaaaggttataaaatgtgggacgaagccgggaaagagtacattgattttttctctggggcaggcgccttaaactacggacataatgatgagaaaatgaaaaaagcgcttgtggactacattatggatgacggaattacccattctctcgatatggccacaacgccaaagggaaagtttttacagaaatttcatgatgtcattttaaaaccgagaaaccttgattataaagtgatgttccctggacctactgggacaaataccgtagaaagtgcgttaaagcttgcgcgaaaagtgactggccgtacggatattattagctttactaacggatttcatggcatgacgatcggttccttgtctgtgactgggaactcattcaagcgaaaaggggccggaatccctctcacgaacgtagtgactatgccttatgacaattttgtcagtgaaagccttgatacactcgattacttggagcgctttttagaggatggcggttcaggtgttgaaattcctgctgcgatgatccttgaaacggttcaaggagaaggcggaattaatgccgctcgtacagaatggttgcagcgagtagagaagatttgcaaacgctggggaattctcctcattattgatgacgttcaagctggagtgggacgcactggcacgttctttagctttgaagacgcggggattacacctgacatcgtatgtttgtcaaaatcaatcggtggctttgggcttccgttagcgattaccctcttccgacctgagctagacatttgggcaccaggtgaacacaacggaacgttccgtggaaataaccacgcgtttgtcacagcgaccgaagccttgtcttattgggaagatgattccttcgaaaaagacattcaagaaaaatcagcaacgatctctgatttccttgttaagctcgtaacggaataccctgaaataaaaggggaagtaaaaggaaaagggtttatggtcggaatcgcgtctgatgtagaaggctttgcttcaaaagtgacggaagaagcattttcccgcggtctcataatggagacttcaggtccgaacgatgaagtgtttaagctattcccgccactcaccatcgatgatgaagggttagaaaaagggttagctatcattgaagaaagcatcaaagctcttgtcgaaaccaaagagcttgtcatgcaataa

SEQ ID NO: 40851 - DNA, 759 bp, Bacillus halodurans
ttggatttacagctgaaggataaagttgtactcgtaacaggtgggtcaaagggaatcggaaaggggatcgcccaagcgtttgtagaggagggagcaaaagttgcaatcgtagctcgagatgcgcacgggcttcaagaggcaaaacgtcagttaggaaatgttttgacgattcaagcggatgtgactgacaagaacgagcgagaaaaagtatttagccaattacttgagacttatggaacgattgatatcctcgtaaacaacgcaggggggagtaacggtggcctcatttcggaaacggagctttccttatttgaggaggcctttagcctgaattatttctctgctgttcacttcagtcaattagcgttacctgtcatgaaagcaaagcaatctggagccattattaacatttcatctatttttggcagagaatcagggggaaaagcaacctataatagcgcaaaggcagcgatgatttccttcacgaaatcgcttgccgatgaagtgattcgtgatggcattcgtgtaaacggaattgcccctggttccatcttacacccaaccggaaactggcaaaaacggctagaagaaaaccgagaaaaaatggagcaatttatcgatcaaaatatcccagccggacggttcggaaccgtagaagagatcgccaacgtggccgtatttttagcatcggagaaagcaagttgggtcgtcggtgctacccttaatgtggatggaggacaatcctactctaatttttaa

SEQ ID NO: 40852 - DNA, 750 bp, Bacillus halodurans
atggaacgaaaagtggccctcgtaacaggaagcagccgcggaattggtaaagaaattgctttgcgtttagctgatcgtggctatgatctcgtcattaattatgcgagaagcagaaaagctgcggaagaaacggcagcggaaatcgaacaaaaaggcgtaaaagcattgattgtaaaagcaaatgtgggaaagcgggataaaattgaagagctatttgcccaaattgatgatacatatggtcgtttagatgtttttgtaaacaatgccgcttcaggagttctacgcccgctcatggaattagaggaaagtcattgggattggacgatggacatcaacagcaaagccctgttgttctgtgctcaggaagctgctaagcgaatggagaaaaacggcggtgggaaaattgttagcttaagctcgttaggggcgattcgctatttgaaaaactacacgacagtcggggtgtcaaaagctgctgtagaggcgcttacccgttacctcgcagtagaacttgcgccaaaaaacattgtcgtcaatgcagtttcgggtggtgccgttgatacggatgcgctcacgcatttcccgaatcgtgacgagctattagaagatgcagctaaacgcacacccgcaggcaaaattgttgagccaagtgacttagcgaatgcagttcttttcctcctctcagaggaagcgtccatgattcgcggacaaacattaattgttgatggcggaatttctttgctcacataa

SEQ ID NO: 40853 - DNA, 1755 bp, Bacillus halodurans
gtggtaacactggagagcatacgtcgatatttattgtttgtccgtccttattggaaacagatttttatcacgattattattggtttattgaaatttggcattccgttattgattccgctactcgtagcatacatcattgatggaatcatttttgctgaacaaatgacgaacgaggagaaattctcggctctatttacagtcatgggcgggatcttttttattttcatcgttttgcgcccaccgattgagtactatcgccaatattttgcccaatggatcggcaataaaattctttatgatattcgtgaccatttgtttacacacattcaaaagctaagccttcgcttttactcaaatcgaaaagtgggggaaatcatctcccgagtcatccatgatgtggagcagacaaagacctttgtcatgacaggattaatgaacatttggctcgatatgttcacaatcattattgctctagcgattatgttttcgatgaacgcgtggctgacgttagtggcgattgccatgtttccgttttacggattttcgattaagtatttttacgcgaagcttcgtcatttaacaagggtaaggtctcaagcgctcgcggatgttcagggacatctgcatgagcgggtccaagggatgagcgtcattcgtagctttgccctcgaagattacgaacagacgcaatttgccaagcgaaatggcacatttttaaatcgggcgatcgatcatacgaaatggaacgcgaaaacttttgctgtagttaacactgtgacagacatcgccccactactcgtgatttttgtagctgcctgttttgtcattaacggggaattagaagtcggggcaatgaccgcgtttgtcttgtacatggaacgtctctacaacccgctccgccgcttggtcaactcgtcgacgacactaacgcaatcgatcgcgtcaatggatcgagtctttgagttcattgatgaaaaatacgatattgtcgacaaagaaggggctgtgaagcttgaggaagtccacggagatgtgaccttcgaccatgtgtccttttcatatgaaaaagaagaaacacctgcgctgaaagacgtacactttcacgtaaagcgaggagagaccgtcgcatttgtcgggatgagtggcggcgggaaaagtacactcatcagcttaattcctcgtttttacgatgtaagcagtggacgaattttgatcgatggtcatgacattcgtgactatcaagtgcgcagcttacgggatcaaattgggatggtgctgcaagaaaatattcttttcagtgattctgtgcggatgaacattttaatggggaaacctgacgctacggaagaggaagtcatcgcggccgcaaaagcagccaatgctcatgactttattatgaatctgccgaacggctacgatactgaagtgggagaacggggcgtgaagctgtcaggggggcagaagcaacgggtcgcgatcgcgcgagtgttcttgaaaaacccgccgattctcatttttgatgaagcaacatcggcccttgatctagagagtgaacattacattcaggaagcgatggaaaagcttgcgaaaaaccgtacgacctttatcgtcgcccatcggctgtcaacgattacccatgccgatcgaattatcgtggttgaaaatggtgagattgtcgagagtggcacccatgatgaacttatgtcctgtaatggcgtgtacaaaaagctgtttgaggtccagaacttagattaa

SEQ ID NO: 40854 - DNA, 1314 bp, Bacillus halodurans
atgaatcgttctcgatcagaatcattgtttcaaaaagcacaatccttgattgtcgggggtgtgaacagcccctcccgttcgttcaaagcagtaggcggtggagcgcctgtttttatggaaaaggcaaaaggcgcttacttttgggatgtagacggaaatcaatatattgactacttggccgcttatggcccaattattacaggacacgctcatccccatattacgaacgcgattcagcgagcagcggaaaacggagtgctctacggaacaccgacaaagctagaaaaccagtttgctagcatgctccaacaagcgattccttccttagaaaaagttcgttttgtgaactctggaacagaggctgttatgacgaccatccgtgtagcaagagcatatacaggccgcgataaaatcattaaatttgctggctgttaccacggccattccgatttggttctcgttgctgcagggtctggaccttctacgttaggaacacccgattctgctggtgtcacgaaaaacattgccgaagaagttatcaccgttccttttaatcagcttgattccttaaaggaggcgctcgaccattggggtgaagaagtggcagccgttttagttgaaccaatcgtcggcaattttgggattgttgaacctcatgaagggttcctcgaaggtgtgaatgagcttgctcacaatgctggtgctttggtcatatatgatgaggtgatcactgcttttcgtttcatgtatgaaggcgcgcaaaactatgttggggtcgagcctgacatgacagccttaggaaaaattatcggtggcggcttgccgattggtgcctatggcgggcgcatcgatattatggagaaagtggctccccttggaccagcataccaagcaggaacgatggcaggaaatccagcttcaatgagcgccggaatcgcttgcctggaagttcttcaagaagaaggcttatatgatgagttggaccggaaaggggcaattcttgaaaaagggattaaagcccatgcggaagcccacggcatcacgatttccatcaaccggcttaaaggagcgctcacggtttattttaccgatgagacagtcacttgctacgagcaagcagaacgatcagacggcgaaaagttctcactctttttcaaagagatgctaaaccaaggaataaacctagctccttcaaagtatgaagcatggtttttaacgattgctcatactgatgaggatattgaaaagacccttcaggcagtcgatcatgccttttcagtgatggctgccaaaggctatcatttaaaaaggtga

SEQ ID NO: 40855 - DNA, 1332 bp, Bacillus halodurans
gtgagtcaatcgattcagacacaagaggaagatttgaaaagcttgttgacgagacgggaacgaatcgttccgagaggggtcgtaaataacattcagacgtttgccaaagaggccaaaggggcgatcgtgatcgatgtagaagggaagtcgtacattgattttgctggagcgattgggacaattaatgtcggtcatagtcatccgaaagtcgtacaagccgttcagcagcaggccgaccaattcattcataccggctttaacgtgatgatgtatgaatcgtatattgagctggcagagcgattagctgctttagccccaggttcgttcgaaaaaaaagtattgttgcaaaatagcggagcggaagctgtagagaatgcggtaaaaatggcgcgcaagtatacggggcgccaagggattgtctcgttttctcgtggattccatggacggacgcttatgacgatgacgatgacgagcaaggtgaagccttataaatttggcttcggtccatttgctcctgaggtgtataaagcgccatatccgtacgaatatcgccgacctgaagggatgtctgaagacgcttatcacgcgtatgttttacaagaattcatccagtttatgaatgtagaagtggcccccgaatcggttgcggcagttgtgatggagcctgttcagggagaaggtggctttatcgtcccgagcaagtcttttgttcaaggggtttatcgctattgtaaggagcacgggattctctttattgctgatgaaattcaaacaggttttgctcgaacaggtcactactttgcgagcgaacattttgagatagagcctgacttattaacagtgtccaagtcgctcggagccggcgtacctattagcggggtgattggtcgccgagaagtgttggatgaagcaagtcctggggagctcgggggaacatatagcgggagtccgttaggctgcgcggcagcattagcggtgctcgacatcatcgaggaagaaggcctcaacgaacgggcgcgaaaacttggtcaagtcgttatggacaagatggcacagcttcaagagcaatatgagtgcattggtcatattcgcggacttggcgccatgtgtgcgatggaagtcgtaaaggatcgacacacgaaagagcctgataaagaattaacggccaagatcgtttccgaagcggggaaccgtggcctgttgttattaagcgctggccaatatggaaatgtcctccgtttcctcatgccgattgtcattacagatgaacagttaaacaacgggtttgccattttagaagaagcgttagcaacagctatagtgaataggtaa

SEQ ID NO: 40856 - DNA, 1407 bp, Bacillus halodurans
atggatctctatattaatggagagtggatgaggagcggaaaaacattagatgtgaccaatccggcgacgggtgaagtgattgataccgttccctttgctggaaagaaagaggcagagctcgccgtatccgctgcatatgaagcttttccgcagtggtcaagccaaacagcctcagagcggagccgctatttaatgagatggtttcagctcattgatgaacaacaagacgagattggcgaaatcatgacgaaggagcaagggaagccgcttcgtgaagcgattggagaagtccaatatgccaactcgtttattcaatggtatgccgaggaagcaaagcgtatttacggtgacacgatccctgcttcggctataaacaaacggattcttgtgcaaaaacaaccagtaggtgtgatcgcagccatcacgccatggaactttcctgccgcaatgatcacaagaaaagtagcgccagctttagcggccggttgtaccgctatagtaaagccagcagagcaaacgccgttaacggccttaaagctagcccaattggcggaggaagcggggattcctgctggcgtccttaatgtcattaccgggaatgcccaagacattggtgaggcttggcttgaggattcacgggtgcgaaaaatcacgtttaccggctcaacagaagttgggaagctcttaatgcgcggggcagctcagacagtaaaaaaaatatcgcttgagcttggaggtcacgccccgtttattatcatggatgatgccaacttagaggaagccgttgaccaagtgatagcctcgaaatttcgcaatgctggtcaaacgtgtgtatgtgccaaccgaatttacgttgcccgggaaatagccgaagcttttacagaaaagtttgccgcaaaagtgaacgaactaaaggttggaaatggactggaggaaggtgtcacgattggcccattaattgataaagctgccgtggaaaaggtagaagctcatattcatgatgcccttaaaaaaggaggacaggttactgttggcggccggtggacgaatcattttttcgagcctacgatcattactggtgcgacagacgagatgctctgcatgaatgaagagacgttcggtcccctcgccccggttgcaacgtttgacacggaggaagaagtgatcgaacgagcaaaccatacaccgtacggattggcagcttacgtcttcaccgaaaatattggcagagcgatccgtttaagcgaaaagctcgaatacgggattgttggggtgaatgacgggatgccttcagtggctcaagctccgttcggtggctggaaagaaagtggcctcggacgtgaaggtggaaaatacggaatcgaagaataccttgaggtcaaatatgtatcggtcgcgttcaaatga

SEQ ID NO: 40857 - DNA, 918 bp, Bacillus halodurans
atggaaattgtaaaagcaacaaatgtgacgaaaagatttggggcattcaccgcattaaatcgtataaatcttgaagtacagcggggagagatttatggttttatcggaccaaatggtgctggtaaatcgacaacaattcgtatattgcttgggattttaaaggcttctgaaggagaggcgaaaatttttggcaaggatgtatggagtgacgctgtagaaatccataagcaccttgcatacgttccgggggatgtgagcctttggcctaacttaacaggaggagaagtcatcgatttgtttatgaagctgcgtggttcagtggacaagaaacgccgcgatcactttattgagagattcaaacttgatccttcgaagaaatgtcgaacgtattcaaaagggaatcggcaaaaggtggctttagtcgcggcgtttgcgtcaggggcagatctctatattttagatgaaccgacctctggtcttgatccgctcatggaacgggtgtttcaagaatgtgtgttagaggcgaaagaagcaggaaaaagcgttcttctttccagccatattttatctgaggttgagagattgtgtgataaggtggggattattcgtcaaggtgaaatgattgaaacgggaacattagatgaactccgccacttaacaagaaccactttagtcgtgaagacgaaacaaccgattccagctttacaagaacaaaaaggtgtccatgatcttgccgaaaaaaatgggggcttttctttccaagttgatgccgaatctttggatgaagtgatgaaatatgtgagtcagtacggattaattacacttgaaagcgcgcctcctacgttagaggatttattcatgcgccattatgagggggcaggccaaagtccaacatcgcaagctggaggtgaggggtaa

SEQ ID NO: 40858 - DNA, 1458 bp, Bacillus halodurans
atgtttaacatccaagatttaaataaacagtacattgatggagaatggagggatggaaaaagccctcgggtacttcgtgatcgaaatccgtacaatcaagaagtattagctgaatttcaaattgcaacggattcagatgttgacgcggcttaccatgcagctttaaaagcacagaatgaatgggccactgtgaatccatatagaaagcgagagattcttgaacgggccgttacctacatcgaagaacatgaagaggaaatcgttgcaatcattatcgacgaattaggtggcacacgtttaaaagcggcttttgaaatcggacttgtaaaaaacatgatcaaggaagcctccacctttcctctaagaatggaaggaaagattttaccttccacggaaaatgggaaggaaaatcgactgtatcgtgtcccagctggggtcgtgggtgttattagtccttttaattttcctttctttttatctgttaaatcggtggcaccggctttaggggctggaaatggtgttgtgttaaagccacatgaagaaacgccgattaccggaggaacgttgattgccaaaatttttgaagaggccggtgttccaaaggggctcttaaatgtcgtcgtgactgaaattgatgaaattggcaacgcttttgttgagcatccgattcctagaatcatttcatttacaggctcgacgaatgtcggtagccacatcggtcaactcgcggtaaagcatttcaagaagccgctgttggagctaggtggcaacagtgcctttcttattttcgctgatgcggatcttgactatgcggttcaagctgcaacatttagtcgttttactcatcaaggccaaatatgtatgtcggccaaccgaatcttcgtccaaagagatgtatatgatgagtttgttgagcgctacgtaaccaaagtcgcttcgcttaaagtaggggatccaagggaccctgaaacagtcatcggtcctgttatgaacagcaggcaagcagaaacacttaaacaagcaattgagagcggaatagcggcaggtgcaaagcctgttttacatggagctattagtggaaatatggtcgaacctaccattttaatcgatgcctcgccggagatggcgattgctcaagaagaactctttggtcctgtcgtttgcgtcattccgtttgatacggaagaggaagcggttgaaatggctaacgatacaaaatacgggcttagtggcgcgattcatactgcgaatgtggaacgtggcgttgaaatcgctaagcgtattcaaacaggaatgattcatgtaaatgacattacgatcaatgacgagccgattgttgcttttggcggggaaaaacattctgggctgggacgattgaacggtgagtggagcttagaagaatttacgacattaaaatgggtatcagttcactatagtcaacgggttttcccatattaa

SEQ ID NO: 40859 - DNA, 1878 bp, Bacillus halodurans
atggagagaaaagagtttaaagcggaatcgaaacggctgttagaaatgatggttaactccatttactcgcaaaaggaaattttcttgcgagagctcatttcaaatgcgagtgatgcgattgataaaatttactacagagcattaagcgatgattcgatcacgtttaacaaggatgattattttattaaagtaacggctaacaaagaggatcggacgttaacggtaagtgatacgggaattgggatgacgaaagaggagcttgaaagcaacctcggaacgattgctaaaagtgggtcgcttgcctttaaaaccgagaacgaaagtaaagacggacatgacattattggtcagtttggggttggcttttactcagcatttatggtcgcagataaggttaccgttacaacgaaagcattaggagaggaaagcggctatcagtgggaatctaccggtgcggatggttatacgattctaccgattgctaaagagtcagtcggaacagagattaggttaaagctcaaggaaaattcggaggatgaatcgtacgatgagttcctagaagagtaccgacttacgagcattattaagaagtattctgacttcatccgctatccgatcaaaatggatgtaacgaagcgtgagcttaaggaaggtaccgaggacgaatatgaggacgtcattgaggaacaaacgattaacagcatggtgccaatttggcggaaaaataaaaacgagcttaaagacgaggactacactaacttttatcatgaaaaacggtacggctttgaccaaccgttaaagcatatccatattagcgttgatggggctgttcgatataacgcgattcttttcattccagaaaacattccatttgattattacacgaaagaatttgaaaagggcctcgagctttattcgaacggtgtgctcattatggagaaatgccctgacctccttccagattattatagctttgtgaaaggaatggtcgactctgaggatctatcgctcaacatttcacgtgaaatgcttcagcacgaccggcagttaaagttaattgcgaaaaatattaaaaacaagattacgagccatttaaagacgttattaaaggacgaacgggagaaattcgagcaattctaccgttcatttggtcgccaattaaaatatggggtgtacagtgattttggtgccaataaagaggacttacaagatttgctccttttctactcttcgacggagaagaaaatggtcactttagacgaatatgtgtctcgcatgaaagaagaccagccgtacatttactatgcgacaggggaatcctatgctcggattgagaaattgccgcaaacggaaatggtcgcagataagggatatgaaattttatatttcacagaagatgtggatgagtttgcgattaaaatgttagctagctataaagaaaaagaattccgttctgtctcaagtggtgacttaggattcgaagatgacgagcagaaggatactgccgctgacacggacgaacagaaagagctgtttgaacatatgaaaaccattttagacggcaaagtgaaagatgttcgagcctccaaacgattgaaatcccatcctgtgtgccttactgcagagggggaagtatcaattgaaatggagaaggtactccgagcgatgcctgataatcaaaacgttcaagcagaaaaagtgttagaaatcaatgtgaaccatgacgtgttcgatgtattgaaggcatcatttgagtcagataaagataaagtcgatttatatacgaagcttttgtacaatcaggcactactcattgaaggattaccagtggaagatccggtcgccttctcaaatgatatttgcaaggtgatggcataa

SEQ ID NO: 40860 - DNA, 528 bp, Bacillus halodurans
atggccgaacaatcactgttgtacgatgaaatggaaagcccgattggttgcctttcaatcgtctcaacagatcaaggtgtatgtacaattttatttggctccctcgaatccaatcaagtgacattaaatgtttggctaaaaaaacataggcttccatgccaactgttaaaagacgaagaggctattcgtccagtgattgcccagctcctggagtattttgacggcaagcgacactcttttgatgtgccgctagacttatatggaaccccgttccaaaaacgggtttggcaagcacttcaaaccatttcttatggcgagacgcgctcctataaagagatcgcccaacacataggtgcaccaaaagcagtaagggccatcggcggtgctaataaccaaaatccgattccaatcatcattccgtgccatcgcgtcattggtagcaacggcgcaatggtcggatatggcgggggattggagaaaaaagagtggctgctcagcattgaaggagcttatgagaaaattagttaa

SEQ ID NO: 40861 - DNA, 1305 bp, Bacillus halodurans
atgaagaaaaacgatgaaacttctcgtaacctcattgggcttgatcaacagcactttatccatcccacctcttccatgcaacaacagcagcagcacgggcctgcccatatttttgtacgtgggaaaggtgtttacttgtatgaccatgatggaaaagcataccttgatggcatgtcatcattatggaacgtcaatgtagggcacggacggagagaacttggagaggtcgctaaaaaacaaatggacacgctcgcgttctcatcctgctttgccacctttagcaataagcctgcaattgaattagcagcaaagctggctcgcgtgtcgcctccttccttgcgcgccaccttttttacgtcgggcggatcagaagcaaacgatacggcgttcaagttagctagacactattggaaagtaaaagaccagccgaaaaaaagaaaaatcattgcccgcatgaagtcctatcacggggtcgccatgggagccacgagcgctaccggattgaaaccgtttcgcgattttgctccctcgcttgctccggacttcctacatgtcgaccatatgtcaatagaagcgttgcgagcattgattgatcgagagggacctgagacgatcgcggcctttgtttgtgaaccgattcaaggagcgggcggtgttcatgtggcgcccgattcgtacttgtgtgacattcgtagcatttgcgatgaatacgaactgttgttcattgcagatgaagtcattaccggcttcggacgaacgggagcctattttggttgcgatcatgccaacattagccctgatatgatgtgcatcgccaaagggattacgagcggatatgcaccgctcggtggtgtgatgctgtcaaaatcattgcacgaacagctaacggcacattcccacggtacgcttttacatggctatacgtatagcggccatccaacgtcttgtgctgttgcccttaagaacattcagataatcgaggaagagaacttgatcgaccatgcagcaaccatgggggaaaagctgcttctcggcttccgtaccattcaagagcaatattccgagattcatgacgctcgaggtagaggattgatggccgcactcgcgttttctcataacggaaaaaacgaacccctcgcaccaaaggttgtgcaagcggctgatcagcgtggtctgattttgcgcgccgttacctttgatcaacaagacgtgctcgtctgtgccccacctctgatcatcaatgaagaagaactgaatcaattgctatccattctcgagtcctccgtgcaggctgtcgtctcatga

SEQ ID NO: 40862 - DNA, 1188 bp, Bacillus halodurans
atgaagacgtttgagcaagcgaagatgatgaaaaggttgccggagcaattttttgctaaattggtcgagcaagtacaagaagtaaaaaaagatcacgatgatattattaatcttggtcaaggaagtccagatttaccgacaccggaacatattgtggagaagctgcaggaggcagcggaaaatcctttgtaccatcgctatgcacctttttcaggttatccgtttctaaaagaagcggtgtctaagtattatgaacgagaatatggtgtatcggtcgatccaaaaacagaagtggccgtattaggtggggcgaagacgggtcttgtagaagtgagtcaatgttttttaaacccaggtgacatggctctcgttccagaccccggctatcccgattattggtcggggatcgccatcgcagggggaagcatgtacggaatgccgttaaaaaaggagctagggttccatccagacctaagagggattccagcacctgtactatatgaagcgaagctcatgtttttgaactacccgaacaatccgactggagcagttgctacagaggagctgtttgctgaggcaattgagttagcagaggaatatgatatttgcgtcgttcacgattttgcttactctgccatcggtttcgatgggcaaaagccgcttagttttttacaagtagaaggagcgaaaaacgtcgggatagaaatgatcaccttgtcgaaaaattacaacatggcaggctggcgaatcggttttgcggttggaaatccgagtgttataaaagcaattgagacattacaggatcactatttttgcagtttatttggcggcattcaggcagcggctgctcatgcgctgttgagcgatcaatcgaacgtcacgacccttgtacaaacttatgaggagcggcgaaatgccctcgtgaaagcagcccgtgcgatcggctgggatgttgaggcaccgaaaggatcattttttgcttggtttccagtaccatcaggctttacatcagaggagtttgctacttatttgctaaaaaaggcccgcgtcgttgttgctcctgggaaaggattcggggagcatggggaaggctatgttcgcgttgctttgttagctgatattgctaagcttgaggaggcgatggggcgagtgggaaaacttgatgttttctctaataagcgaggatga

SEQ ID NO: 40863 - DNA, 846 bp, Bacillus halodurans
ttgctaccaatcaatgaaaatttaaaaggaaaagtagctgtcattacaggtggaagtggggtgctctgccgggcgatggcttatgaattagggagacaaggtgtgaaggtagctattctcaatcgaaatcgtgatacaggaaacgaagtagctgaaacgattcgagaagcagggggagatgcgcttgccatctcttgcgatgtgttagaggtagaccaagtgaaagcagctgaaaaacagatcagaaaggaatttggtgcttgcgacattctcattaacggggcaggaggcaatcaccctgatgggacaacagacgaagagattgttcgtatggaaaacgtggcaaaaaaaacgaagacgttttttgatttgacggtcgaagggtttcagcgcgtgtttgaactgaatttaattagcgcgatggtaagctcacaagtgtttgcaaaaggaatgacccatcggaaaggggctgttatcatcaacatgtcctcgatgagtgggcccactccgatgacaaaggttcctgcctacagtgcagcaaaagcaggaattgataattttacgaagtggttagcggtgcatatggtggaggttggcattcgcgtgaacgcgatcgcgcctggtttttttctcacagaccaaaacaaaaaactgctgcttcaggatgacggctcatggacagagcgttcaaaaaaaatcctttctcatacgccaatgaggcgatttggaaagcctgaagatttactaggtacggtcatttggctagcagatgagacgatgtctggatttgtaactggtgtaaccgtaccagtcgatggtgggtttatggcgtattcgggcgtgtag

SEQ ID NO: 40864 - DNA, 1062 bp, Bacillus halodurans
atgaagaaaattaccttatcggtcattcctggagatggcgttggtaaagaaattatgccccatgcccttcgtgtgctagatgcggtcgccgaggttcatggtggtcttacctttgaaaaggtcgaatacccgtggagctgcgagtattatttggaacatggtgagatgatgccagaggacggacttgtccagcttactgaaagtgatgctgtattcctaggcgcggtcggtaacccacaactcgtgcccgaccatgtttcattatgggggctgttaatcgcgatacgccgcggctttcagcagtcgttgaatattcgccatgcgaagcaaattcgtggaattgatccaccgattaaacatgctaatcagtttgatctgctcgttgtacgagaaaatagtgagggagaatatagcgaggtggggggacggattcatcaaggggacgatgaagttgtcgttcaaaatgcaatctttacaaagaaagcgacgaaacgagcgattgactatgcgtttcagctagcggccacccggggaaaacgagtgacgagtgcgacaaaatcgaacggaatcgtcttttcgatgccgttttgggataacgtctttcaagaggtaggaaagcaatacccagatatcgagcaacagtcggttcatattgatgcgttaaccgcttttcttgtcacaaagcctgctgaatttgatgtgattgtagcgagtaatctttttggtgatatcttgaccgatgtgagcgcagcgataatggggagtatcggaattggacctgctgcgaatttaaatgtggaaggaacatacccgtctatgtttgagcctgtacacggatcagcaccagatattgtcggaaaaggaatggccaatccgatcggacaaatatggacggggaaaatgatgctcgatcactttggtgaagaagagcttgggaaaacgttattagacattgttgaagatgtaacggaagcgggaattaagactcctgatattggtgggcgagcaacaacaggagaagttgctgacgcgatcattgaacgggtaaaatcattaacgtag

SEQ ID NO: 40865 - DNA, 2448 bp, Bacillus halodurans
atgagtctatccgttcaggagttccgccagcaattcagcgataaattaatgacgacctttgggaaaaaggttgagaaggccaccccttttgaggcctttcaaacagtgggcctcattttgcgagagctccttaatcgaaaatggcaggatacgaaaggaacgtaccgaagcaactcacaaaaacaagtgtattacttctcaatggaatttttactcggacgcttaatgataaccaaccttttgaactcaggcttgttggaaacttgcaaacaagggcttgaagagcttggttttaacttggaagaagttctcggccaagagcaggatcctggattaggcaatggtgacctcggtcggttagccgcttgctttcttgattccctagcctctttggagctgccgggccacggctgcgggattcgctataaatacggcctatttcaacaaaaaatcgtcgacggcaaccaagtggaattaccagattattggcttaaaaatgaatatgtgtgggagacaaaaaggctggaccaaacagtggaggttcattttggtggtgaaatcgaaaccgtggaagagagtggccgcctgacgtttaaacatcatcactatgaaaaagtactagcggtcccgtatgatattccggtatcagggtatcagaaccatacggtgaacacccttaggctttggagcgcagaatcgacaaccaatgactttcacttttattcaattgatcgaaaagactattaccactacttagattataagcgttcggttgaacagatttccgagtttctctatccagatgactcttcgtatgaaggccgcctgcttcgcttgaaacagcaatactttctcgtgtcggctggcttgcagtgcattttgcgggaatttaaaaactcttatccatcggtcgatcttttacctgaaaaaatagcgattcaaatcaatgatacccacccgagtcttgtcatccctgagctcatgcgattgcttttggatcaagaacaactttcgtgggaaaaagcatgggagcttacgacacgcacggttgcttatacgaatcatacaacgatgagcgaagcgttagaaacatggccagttgatatggttaaaacgttattgccacggatttacatgatcattcacgagattaacgagcgcttttgtcgccatctttggcttgcccatccgacgctacgggacgaaattaaacatatggcgatcatttcttacgggcaaattcatatggctcatttagctattgtcggtagctatagcgtaaacggcgtcgccaaacttcacacagacattttaaaaaatagtgtgatgaagccgttctatacggtcttcccggaaaaattcaacaataaaacgaacggaattacccaccggcgttggctattgatggccaatccacccctcgcgtcacttattaccgaagcgatcggagaaacgtgggtccgtgaaccgaagcaattgatcaccttgcttaaatatgccggtgacgcggcatttcaagagaaaattgctggagtgaaacaggcaaataaaacagcattggccaaatacattcaagagagaacaggcatccgcgtcgatgatcgctcaatctttgatgtgcacattaaacggcttcatggctataaaaggcagctgttaaatgtttttcacattcttcatttgtatgaaatgatccgcgataatccgaacatggatatggttccacggacgtttattttcggtgccaaagctgctccagggtaccactttgcgaaaaaggtcattaagctgattacgacgactgccgcaaaaatcgcagcagatccaatcgttagagagaagatcagagtggtatttctcgaaaactataacgtatcattagcggaacagattatccctgctacagatgtaagtgagcaaatttcaacggcgagcaaagaagcttctggcacaggtaacatgaaattcatgttgaatggcgcgatcacgattgggacattagatggtgcgaatgtagaaattcgtgaaatggtcgggccggataatattttcacattcggattaacggctgaagatgtgctcgcctatcagctttcacgcatgtatcgctcacgggatgtatacaacggtgatcaacggattcgccgcgtgatggatcagctcgtcaacggctcgttatccaatgacgacgtggagtttaaagacatttactataccctcctttcaaataatgatgagtatttcgtgctgaaagattttgattcatacgtggaagctcaagacttgcttgagcaagcctatcgtcaaccgacagagtggttgaaaaagagcattacgaacatcgctcattccggaaaattttcaagtgatcgaacgatctctgaatatgcaagtgagatttgggacattcaccctgtcacgatttcctcgaccacccaatcgcggtaa

SEQ ID NO: 40866 - DNA, 1431 bp, Bacillus halodurans
gtgaatgtgttacacgtcgcttcagaatgcaacccttttttcaaaacagggggacttgccgacgttctcggttcgctcccaaaagctcttataaaacaagggatcaatgtttccgtcatcctaccaaaatatggacacctctctgacgaatggcagaaccaattaacgttaaaaaaatcgttcacggtctccgtcacatggcgaaatcaatattgtggactggagcagtttgtagatcaaggagtgacctactacttcatcgataacgaatattactttaagcgggaacgcctttacggctatctcgatgaggctgaacggttcacattttttaatcatgctgttcttagctctttaccgttccttgatgaatcacctgatttaattcattgccatgattggcagtcaggtcttattcctgcctatatgaaaacgggttccgtcgaaaatcccgtaccgacggtgttcacaatccataaccttcgctatcaaggagcctttccccctgatgtttttcgcgaattgcttcactttgcgccagagcactttgctggattagagatggacggtgcgatcaattttttgaagggagcactcgtccattctgaccgggttacaacggtaagcccaacatatgctcaggaaatacaaacccctgcctttggcgaaggcttgcacggattgcttcatcaagaacgaggaaaaacaagaggtattttaaatgggattgacctggaggatttcgatccaaaaaccgatccgcatgttacgtatccttataagcacaatcaaatggaaaaacggaaaaacaaacaggtcatccaacgtctgtttgaattgccagagcgcaaggacattcctcttattgcgatggtcagccgtctcgtagaagagaaaggggtccctcttctcacccaaattgcaggtgaacttgtgacaacggaaaatgtgcagctcgccattctcggtacaggcgatccttctttagaggaccaactgcatcatctagcttctttgcatccacatcaaatttcatttaaatgtgtgtttgcggagccgctcgcgcgtaagctttatgcaggggctgatttattcatcatgccgtcccgattcgaaccgtgcggacttagccaaatgatttcccttcgctacgaaacggttccaattgttcgtgaaacaggagggttatatgacacgattcaatcctataatgaagaaataggcgaaggaaatggattcagttttactcattataacgcccatgatttcttgtatacaatcaagcgagccctccgtttttatcgtacggaaaaagagtgggaaaaccttttgcttaacatctacagctcggaagtaggatgggacgtttccgccaaacaatatacagcgctttatgaagaaatactagggaaaaggaaggtggaggcatga

SEQ ID NO: 40867 - DNA, 1107 bp, Bacillus halodurans
atgaaatcacttatgggtgttgttaacctcgatcacgatcaagacctgttgcacgagcttacgtattttcgcagcgtagcaggtgtcccgtttggcggacgctaccggatgattgattttgttctttccaatatggtgaatagcggtatccaagatatcgccgtgtttgcccgaaataaatatcgctcccttatggatcacttaggaacaggtgctccatgggatttaaatcgaaaacgaggtggattatttatccttcctcctgattggaatgatcctaccgacatttcgaaaggagatttacgtcactttcataaccatcgtgatttctttcatcgcggaaacgccgatcacgtccttgttagtggaagtcaattcatctcgaaggttgattacgaggatgccttcaaaagacaccaagaaacgaaagcggatgtgaccgttttatataaaaaagtggatcagcttgaaccagaggatcggtatcgaatgaagcttgagtttgattcgtttggaaatgtgaaaagtatcaccaatgacgaaatgaattcgaatctttatatgcaaatgtacattattcgcaaagaattactcttggagcttttaaatcactgcatagggtaccacaagcaagatctgtttgtagacggtattatgagcaatcttaatgagctcgcaattcgcgcgtatgaatataaaggctatctctcaatcatttcttctgttgctagctactacaaacatagcatggaccttttaaagccagaaatctaccaatcgctctttttagctggttcccctatctatacaaaaattaaagatgaaccgccagcaaagtatgtgaacggctcagaagtatcgaactctttagttgcaaacggctgcgtcattgaaggtcatgttgaaaactcgatcttgtttcgcggcgtgtatgtggctaaaggggtatcgattaaaaactcgatcattatgcagcgttgttacattcatgaggatacccacctagaccatgtcatccttgataaagatatccttatatcaccgaaccgacaatttgctggagcccctgaacagccgtttgtcattgccaaacgtaaagccatgtaa

SEQ ID NO: 40868 - DNA, 1152 bp, Bacillus halodurans
atgaaaaaagaaattgtaggaatgctccttgcaggaggagaaggaaagaggcttggtcaactgactagaaagttagcaaagccagctgtctattttggggggaaatatcgaattatcgatttcccattgagcaattgcacgaactcaggtatcgatacggttggtgttcttacccaatacgaaccgctcgccttaaacggtcacattggaatcgggagtccttgggatttagatcgacgtcatggaggagtgaccgttctccctccctacatcgaaaaacaaggaggctcttggtacaaaggtaccgctgacgccatctaccaaaacagatactacattgagcagtatgatcctgaatatgtcctcattttatcaggggatcacatttacaaaatggactacgaccgcatgattagccatcataaaaaacttggggctgatgctacgatttcagtcattgaagtcccatgggaagaagcgagtcgttttggcattatgaatacaaatgaggaaatgacgattacccaatttgaagaaaaaccgaccacaccgataagcaacctcgcttcaatgggcatttatatttttaattggtctgtactaaaatcttatctgatccaagatgcgaagcaagcaaactcgagccatgactttggaaaagatattataccgaaaatgcttgcaaaagatttaaagcttgtcgcctacccgtttgaaggttattggaaagatgttggaacaatcaaaagttattgggaagctaatatggacttactggatgaacattcttctctgatgttaaatgatccgtcttggcggatttactcggtcaatcgtaaccagccacctcaatatatttcgacgagagcctacgttagatgctcactcgtgaatgaagggtgcgtcgtccatggaaatgtagagcaatccattttgtttcctggtgtccatatcggtgcaaactcctcagtcttcgaatctgtgttaatgccaaatgtaaaagtgggagaaaatgtcgttcttcggcgaacaattattatggaaggagcgtgcatcccatcaggtactcacttagctccaagcgatccagatgatattctcgtcatcgataaagatactgaattttccccttcaattgcagcaaatcaatga

SEQ ID NO: 40869 - DNA, 1494 bp, Bacillus halodurans
atgacaaaaaaatacattttagcgctggatcaaggaacaacaagttcacgggcgatcttatttaatgaagcaggggaaattatcgggattgaacagaaagaatttcagcaaatttttcctaagcctggctgggtcgagcatgatgcaaacgaaatttgggcatcggtcctgtcggtcatcgccggtgttttattaaaaacaaatgtagaagcgaaagaaattgccgccattggcattaccaaccaacgggaaacggcagtagtatgggaaaaagagtccggacgtccaatttacaatgcccttgtatggcaatctagacaaacggctggtatttgcgaacgcctaagagcggaagggtttagtgaaatggtcacggaaaagacaggtcttctcatcgatccgtatttctcaggtacgaaagtgcggtggattctcgatcatgtggacggagcacaagaacgagctgaacgaggagagttgttgttcggtacgattgatacgtggctcatttggaagttgagcggaggaaaggctcatgtgaccgattattccaatgcgtcgcgaacgttgctctacaatatttatgagcagtgctgggatgacgaactgttaaagatgctaaatgtaccacgggcgatgcttcctgatgtacgtccttcatcggaggtgtatgccgagacggtatcctaccatttcttcggggaggaaattccgattgcaggcgccgcaggagaccagcaagctgcattgtttgggcaggcgtgctttgaaaagggaatggcgaaaaatacgtatggtacaggatgcttcatgctaatgaatactggaaaccaaggggtgaagtcaaagcatgggttgttgacgaccatcgcctggggcctcgacggaaaagtggagtatgccttagagggaagtatttttgtcgctggctccgcgatccaatggctgcgagacggtctcagaatgatgaaatcggcgaaggaatcggaaggctatgcaacgaaggtcacatccgctgatggggtctatgttgtgccagcatttgtgggccttggaacaccgtattgggattcggatgtaagaggcgccgtcttcggtctgacaagaggaacgtcaaaagagcatttcattcgtgccacactggagtctttagcgtatcaaacaaaagatgtcttgcaggcaatggaagctgattcaggtatttcattaaaaacgcttcgtgtcgatggtggagcggtggctaataacttccttatgcagttccaaagtgatctgctaggggtgtcggtggaacgaccgacagttcaagaaacaacagcactcggagcagcttatttagctggtttggctgtcggtttctggacatcaaaagaagaaattacgaacaactggaacctagaacagaaattctctgccgaaatggaagaaacggatcgagcaaaactatatgaaggttggcaaaaggctgttcgcgccgcacaagcttttaaataa

SEQ ID NO: 40870 - DNA, 1662 bp, Bacillus halodurans
atgttttcagcaaagaaaagagataaatgtattggcgagatgagtgaaaagcaactggaccttctagtcattggaggggggattacaggtgcaggaattgcccttgatgcgcaagtgcgaggaattcagaccggtcttgtggaaatgaatgatttcgcatctggaacttcaagccgttcaacaaaacttgtccatggcggtttacgctatttgaagcaatttgaaattaagcttgtggctgaggtggggaaagagcgtgcaattgtttatgaaaatgccccacatgtaacgactcccgagtggatgttactgccgatttttaaagatggtacgttcggcaaattttccacatcgttagggttgaaagtctatgattatttagccgatgtgcgaaaagatgagcggagatacatgctaaatgaaaagcaaacacttgaaaaagagccgcttctcagaaaagaaaatttaaaaggtggcggaatctatgtcgagtatcgaacagatgacgcgcgtttaacgttagagattatgaaagaagctgttgcaagaggggcagtcgcccttaactatatgaaagtggaatcattcatatatgaccaaggcaaagtggtaggcgttgttgcgaaagatcgattaacagataccactcatacaatttatgcgaaaaaagtagtcaacgcagcaggtccatgggtggatacgctaagagaaaaggaccgttcaaagcatgggaaatatttaaaactatcaaaaggtgtccatcttgtcgtagatcaatctcgttttccgttacgacaagccgtctattttgatacggaatcggatgggcgaatgatttttgccattcctagagaaggaaagacttacattggcacgaccgatacgttttatgataaagatatcgcttccccgcgtatgaccgtggaggatcgtgactatattcttgctgcggcgaactacatgtttcctagcttaaaccttacagctgacgatgtagagtctagctgggcaggattacgtcctctcatccacgaagaaggaaaaaaggcatctgaaatttctcgtaaagatgaaatcttcttttccgatagcggactcatttccattgcaggcggaaagctaaccggctatcgaaaaatggcggagcgaactgtagatgccgttgcacagggattaaatgtgaacgaaccatgcacgacagcagctatccgcttatcgggtgggctagcggaaggtgcgcaaggattcccgcgctttttagacgaagcgagccggaaaggggcaaaactgggctttgacgctgatgaagtgagacgtcttgcaaagctgtacggttcaaatgttgatcatgtgcttaactatgcttatgaaggaaaagaagaggcagaacattatggacttccagcgttgttgcttgggcaactacagtatggagtggaacaggaaatggtcgctacccctttagacttttttgtccggcgtacaggtgccctgttctttaatatctcgctggttcatcaatggaaagaggctgttcttcgttggatggcggaagagttttcttggacggaagaagagaagactcgatttcaaaatgaattagagactgagctaaaaatggctgtcgatccactgtttcaagtagagccaacaacggtgtaa

SEQ ID NO: 40871 - DNA, 1737 bp, Bacillus halodurans
atgagttggagacagcgttatgaaaaatggaaaggctttaatgagcttgaattagagctaaaacaatcgttggaagccattggtggggacgaacagcagcttgaagactgcttttataaaaacttagagttcgggacaggtggaatgcgcggagaaattggaccaggtccgaaccgaatgaatacatatacaattcgtaaagcttctgaaggctttgcccgttacttgcttgagcaaggggaacatgtaaaagcgcagggggtcgtcattgcctatgattcccggcataaatcacctgagttcgcacgtgaagcggcattgacgattgggaagcacggaattaaagcatacttatttgaagaattacgtccaacacctgaactatcgtttgctgttagaaagctaggagcagcaggtggtattgtgatcacagcaagtcataatccacccgagtataacggctttaaagtatatggttcagatggatgtcagcttccacctgagccggctaatcgactcgtcaaatttgttaacgaaatagaagacgagcttgtgattcctgttggggatgaacgcgagctaaaggaaaatggaacgctggaaatgatcggtgaagaggtggacgtagcttatcacgaggctttaaagacgattattgtcaatccagagctgcttgaagcatcagctaaagatgttcgtattgtgttcactccactacacggaacagctaatctcccagttcgacgtgtgctggaagcggtcggctttgaaaatgtaacggttgttaaagagcaggagctacctgatccacagttttcaacggttaaagcgccaaatccagaggagcatgcagcgtttgccttggcgattgagtacggcaaaaagacagaagcagatgtgttgatcgcaaccgatcctgatgcggatcgcgtcggtgtagcagtacaaaatcaagccggtgaatacattgttctgacggggaaccaaacagggggattgatgcttcattaccttctttcacaaaagaaggaaaaagggcaactcccagttaacggcatcgcgttaaagacgattgtgacatctgagtttggccgcgccattgcggaggatttcggtatccctatggtagatacattaactggtttcaaatttattggtgaaaagataaaggaatacgagcaatctggcgagcatcaatttttattcggttatgaagaaagctatggctacttaattggggactttgtacgtgataaagatgcagtacaagcgtgcttattagcggccgaaatgacagcttactacaagtcgcgtgggatgaccctttatgatggtttattagagctgtttgatcgttatgggtattaccgtgaaggattgacatctatcacattgaaaggaaaagtcggcgttgaaaaaattcaacacgtgttaagccaattccgtcaatcgcccccgaaacaagtgaatgaccaacaagtggtcgtgattgaagactatcaaacaaaagaaaaagtgtcggtcaaagaacgaactgtagaagcaatcacgttaccaacatcaaacgttttaaaatatatgcttgaagatggctcgtggttttgtctccgtccatcaggaacagagccaaagcttaaaatttattacggtgtaaaaacggaagctttagagaaaagcgaagccgcattagatgcggtaaagcgcgacgtagaagagatcgtgcactcgtatttgtaa

SEQ ID NO: 40872 - DNA, 1188 bp, Bacillus halodurans
atggaagttgcttacaaagaggatctgctcacatcttttgcggaagcgttttctattgatcgtttgactgatgtacgggtgttttttgccccaggacgtgtcaatttaatcggagagcataccgattataacgggggatacgtgttcccaggtgcattaacgaatgggacgtatatggtgatcaagctgcgagacgacggggaataccacctaagaagcgccaactttgatacatccgttgtctttagaaactctgacttacgatttgatccaaaggatgactggggcaattatccgaagggcattattgccgagttggcaaagcttggagtggatcttccaggggctactatttatttttatggaaatatcccgaacggagcaggtttatcatcgtcggcatcaatcggaatggtcacggcctatggacttacacaatgctccggtatagacattgatcgagtaacactcgctaagctatgtcaacggatggaaaatgattttatcggagtaagtacaggcttaatggaccaatttgctgttggaatgggaaagaaagatcacgcgttgtttttgaatacgagctcgttagaatatgaccaagtccccctcattctgaaagggtataaacttgtcattacgaactctaataaacgaagagggctagcagactcaaagtataacgaacgtcggcgagaatgtgaaattggcttagagcagctgagaaagaaacaaacgaatctaagccatttgggtgaagtgacagaggaaatgttcgctgaattaggtcctgtcattgaggatgaactgatctatcgccgcgttcgccatgttgtaacagaggatgcgcgggtactagccgctgtttctgcacttaaagcaggagagttgcaaacgtttggtgagttgatgaaagcctcacatctgtcgcttcgtgaggattatgatgtaacgggagttgagcttgacacgttattcgaccttcaagcaagtgcacctgggtgtatcggaacgagaatgacaggggctggatttggcggctgtacggtaagcattgttcatgaggaagagattactgcttttcagactgtcgtttctaaagggtatgagaaaaaaattggctacaagccaaccttttatgtgaccgagttaggtgacggtgtgaacgaatggaaaggaggcgcttaa

SEQ ID NO: 40873 - DNA, 1746 bp, Bacillus halodurans
atggacacatttaaacggttggctcaattttattggccgtatcgacgctatttttattggtcgctgtttgcgatgggtgtgatgacactaatgacggtcctctatccaatcattttgcaatttacgattgacaacgctgtcattggtgggaggtacgaccttattccatggcttgctctagctttgattatcgtcatgggatttaaaggggtgatggtgtacattcatcaatatttaggtgacttatttggtgtgaccgctgtctatcgattgcggaattctttgtatgaaaagctgcaatatcttccgtttcgttactatgataatgcgaagacgggtgatttaatgtctcgtttgacgggagatgtggagacatttcgttttttcctttcctttggatttgcccaattcattcaatttattttactcgtaagcttcagtatgggtgtaatgttatactattccgttccattaacattggcgacaatgtgtacccttccttttttagcgattgttgttgccaaatttgatcgccgggttcatccaggatttcgtgacattcgcaagtcgcttgccaaactaaacacgaaagttcaagaaaatgtgagtgggatgaataccgtaaaggctctttctcaagaagatgaggaggtttctcgcttcgaagaccgaaatgtcgattatcggcagaagcatttagatattgcgagagtatggggaaattattttccgctcatggagtttatcgggaacctttctgcggtctttttgctttcttttggtggatatctcgtcattacaggtagcatgcagaccggacaacttgttgcattttttagtttagtctggtacatcatcggaccgatcatgaacttaggttttattattaacacgttttcccaatcgaaagcgagtggagaacgcctgcttgaaattctcgatgaagaaaatcgagtggatgaaggaaaagatgaacgcactagtctacaaggttctgttacgttccgagatgtctgtttgaactaccgaggagctgaaacacccgctctgcaaaatgtgtcattcgaagcccctgctgggaagacaatcgggctcgtaggggcaacaggatcgggcaaaacgagtattgtccagttagttaatcgattttatgaacgaacgagcggagagattttaatcgatgggaagccgattgaatcttatcctctagagacgctccgttcacaaatcggtgtcgtcctacaggagtctttcctcttttcgtcgacgattcgagataacattgcctatgggcgtcctgatgtatcgatgaaagaaattattgctgcagctaggcgtgcccaagcccatgattttatcgcggaactaccagatggctatgatacagtgctcggtgaacggggacttggcctgtcaggggggcagaaacagcggattgccattgcacgtgcgattctaatgaatccgagcattttaattttggacgatgccacaagtgctgttgatatgaaaaccgagcacaaaatccaagcggcctttcgtgaagtgatgaaaggcagaacgacgtttatcattgctcatcggatttcttctgttaagcaagctgatgagattctcgttcttgatgggggcaaggtatgtgagcgcggaacccatcacacattgctacaaaataaaaagggactctatcgacgaatctatgatattcaaagcaaagatcaagaatatgtgttgcagcacgcatag

SEQ ID NO: 40874 - DNA, 1806 bp, Bacillus halodurans
atgtcagaaggaaaacgtagagctcgctttcattatgcgagcgatcaagtgattgagaaaccatttaactgggcacagatgatgcgcttgcttacgtatatgaagccgtatgcagcatcactgcttccgaaaacggttgttgcgatgctgatcgtgaccgcagttcggctgttcgtgccgatcatcattggtgtgttagcgattgatcatgcgattgctgcaggggatctgaacgtcatgtatcagttggcagctcttgttttagggttgtatagtatttcatatgtggcaaacgtgttccgaattcgctggatgaatgagatcggacagcatgtgatttatgatattcgcgctgatctgtttaatcatatccaacgtctctcccaccgtttttttgatcaacgttcggcagggtccattcttgtccgagtcgtcaatgatgtgaactcgttgcaggatctatttacgaacggggttatcaacttattgatggatatcgtcattctgctcggaattatcgtgattttgttctcgttaagtccagagctggcgattttaatcttaatcgtcctgccgattatgtttttcatatcaacgaagctacggagaaacattcgcagatcgtggcagacggtgcgtctccgtcaatcaaagctcaattctcatttaaatgaaagcattcaaggcattcgtgtcactcaagccttttcacaagaaaaagaaaatatgcgtttttttcgtgacatcaacgaggaaaactttcaatcttggaaagacgccacgagaatgaatgcattattcaggccgtttgtggagatggcgagtgcgatcggggccgttgtcctcatttggtatggggtgagcttgatccagtcggaggtactaacggttggggtgttcgtctcctttgcattctacttagggatgttctgggagccaatctcaaggcttgggcaagtatacaaccaactgcttgtcgggatggcttcgtccgaacggatttttgaatttttagatgaaaagccgtcggttccagaaaaagagaatgcggtcaccttacatgagatgcgtggtcatgtgacgtttgagcaggtggaattttcgtatgatgacaaacggaaggcattaaatgacatcagtttcgaaataaaagcagggcaaaccattgcccttgtaggtcatacaggttcagggaaatcaacgattgtcaatttaattagccgcttctatgacccaacggccggtgtcatcaaaattgacggtgtggacttgcgtgacattcagctgaatagccttcgaacaaatgtgagctttgtgttgcaagatacgttcattttcgccggcacaattatggaaaacattcggttcggccggccgacagcgaccgacgaagaagtaaaggccgcagcagaagcgatcggggcaaatgattttattgaacgcttgccaaacggatacgacaccgaagtggaggaaaaaggaaatgtcctttcggttggtgaacggcagctactttcctttgctcgtgcactattagccgatccaaaaattttgattttagatgaggcgaccgcaagcattgatactgaaaccgaattgaaaattcaagctggtttaaagaaactacttcacgatcggacggccattatgattgcccatcggttgtcgaccattcgtgatgccgatcaaatcatcgtgctcgagcaaggggatattattgagcagggaacacatagtgaattaatggacgctcgtggaacgtattacggtctagtaaaagcacaatatgaagcgtcggctggctag

SEQ ID NO: 40875 - DNA, 1146 bp, Bacillus halodurans
atgaactttgagttgacgaaagagcaacaaatggtgcgagacatggttcgcgattttgcggagaacgaaattgcacctaacgcaattcattacgataagacggctcagtttcctgaggatgtttttaagaaaatgggggagcttggcctgttaggtatccctttccctgaagagtatggtggatcaggaggcgataccatttcttatgccttagcggtagaagaggtggggagagcatgtggaggaactgggctcagctatgctgctgctgtatctctcggcgcaagtcccatctattattttggaacggagcgacaaaagcaagaacatttagtgccccttgcgaccggtgaatcgctcggttcttttggattgaccgaaccgaacgctggctcagatgcaggtggaacgaggacgaaggccgtcctagagggagatgaatacgtaataaatggcgagaaatgctggatcaccaatgctggttatgcgcggacggtgatcgtaacggcagtaacaggcaaagatgaacgtggcaagccggtaatttctgctctcatcgtgccgacaggaattgaagggttcaccatttcttgcaattacgacaaaatgggcgtcagggcgtcgaatacgtgcgaacttgtactagaggatgttcgcgttccaaaagagaatttattaggagatccaacgaaaggattcaagcaatttttatatacccttgatggagggcgaatttccattggcgcgttagcggtagggatcgctcaagctgctttcgatcgagcgctcgcctatgccaacgaacggaagcaatttggtcaaaaaatatcaagctttcaagcgattcaatttaagctagcagacatggcgatggaaattgaactagcgcgcaatatggtgctgaaggctgcctggttaaaagatcaaaagaaaccgtttacaaaagaaggggcttatgcgaaattatacgcgtcagaaacagcgatgcgcacagccaatcaagcgatccaaattcatgggggctacggctacatgcaagagtatgaggtggagcgaatgcttcgcgatgccaaactactcgaaattggcgaaggaacgtcagaaattcaacgaatggtcattgcaagacagctaggatgtcgctaa

SEQ ID NO: 40876 - DNA, 1641 bp, Bacillus halodurans
atgtcagagcgattacaagtaaccgttggagcgttgttagaaaaggtggctaaaagacaaccgacccatgaggcgcttgtttacccagaccgagggttacgctattcatatgaccagtttcttagcaaatgccaacaagcagcaaaaggattgatgaagctaggcattgaacggggagagcatgtcgccatatgggcaacgaatgtgcctgaatgggtgatcacccaatttgcgacgggaacaatgggagccgttctcgtgacagttaatacgaattatcgaacgagtgagctcgaatacttgttgaagcagtcagacgctacgactctccttttaattgacggctatcgcgatgcatcatatgtagaaatgctttatgaaattctcccagaacttaaaacgtcagagccaggggcgtgttattcgaaaaaactgcctcatctgagacgcgtcattcatttaggggaagagcgatatccaggaatgtatacgtgggaggatgtgctgaacctagggaccgaggtaaccaatgacgagttggctgagcggagcgcctccctggaccctgatgatgtgataaatatgcaatatacgtctgggacgacgggatttcctaaaggagtcatgctcacacacaacaacatcgtcaacaatgcccgaaacattgccgaatgtatgaagctgacgaacgaagatcggctctgcattccagttccgttttttcattgctttggctgtgtccttggcacgctcgcatgtgtgtcggttggcgccacgatggtaccagttcaagagtttaatcctacacgtgtgctgcaagcggttgaagcggaaaaatgcaccggattacatggggtaccgacaatgtttattgcagaattaaacgacgaagattttatgaactataatttatcccatttgcggacaggaattatggcgggttcgaattgtccaattgaagtgatgaaagccgctatcgaaaaaatggggatgtctgatattacgattgcttacgggcagacggaaacgtcaccagtaataacccagacacgggttgatgatccgatcgaactccgcgtgcaaaccgtaggccgtcccttaccgaatgtagaagtgaaaattgtggagcctggcacagaaaaggaagtggcaccaggggtccaaggggaattgtgcacccgaggctatcatgtgatgaaaggctactataaaaaccaacaagctacgcgagaagtgatcaaagaagatggctggcttcatacaggggatttagccgttatggacgaggctggctattgccgaattactggcaggttaaaagatatgattattcgcggtggggaaaacatttacccaagggaaattgaagagttcttataccagcatcctgatattctcgatgcccaagtggtcggagtccctgacgaaaaatacggggaagcagtatcggcatggattaaattgaagcctggtgtgagcgtgacgtcagaagaaattcgtgatttttgccaagggaaggtggctcattacaaaatcccacgctatatagaatttgttgatgattatccgatgacagcttctgggaaagttcaaaaatttaaattgcgacaaatggcagaacagatttttcaaaaagggtga

SEQ ID NO: 40877 - DNA, 1359 bp, Bacillus halodurans
atgtttaaaaaggtgcttattgccaatcgaggtgagattgcggttcgcatcatccggacgtgtcaaaagttaaacattcgcaccgttgctatttattcagaggcggatgtagattctcttcatgtcaaacatgcagatgaagcttttctcattgggaagcctcctgttgccgaaagctacttaaaggtagacacgattttagaagtggcaaagcaagcaggcgtggacgccattcatccaggctacgggttgttatcggaaaacgctcgttttgctagggcatgtgttgaagcaggaatatcgttcattggtccctcacctgaagtcattgaaagaatggggagcaaaattgctgcaagaaccgcgatgcaaactgcgggtgttcccgtcattccgggttccgatgtggcgctagccgatgaagaggaagcagtacatcttgctcgcaagtttggttatccagtcatgcttaaagcctctgcaggcggtggtggtatcggcatgcagctcgtcagaaatgatgaggaaatgagaaaagcattcgctggcaatcaaaaacgggcgacaagctttttcggagatgggacgatgtttttagaaaaggcggttgaaaacccgcggcacattgaagtgcaaatcgccgcagaccatcatggccacgtcgttcatttatgggaacgggattgttcgatccaacgccgccatcaaaaagtagtcgaggaagcaccgtcaccgttcgtagacgaggcactcagggaaaaaatcggtcagctcgctgtcaaggctgcaaaagcgattgattataggaacctcggaacggtggaatgtctcgtagacggggagaagaacatttactttttagagatgaacacccgtctgcaagtagagcatcccgtgacagaggaaattaccggaatcgatctcgtggaatggcaactattgattgcagcaggtgaacaactaccctacgcccaacatgagattccattgcaagggcacgcgattgaagtgcggatctatgcagaagacccagtgaccttttttccgtcaccagggatgattaaacgatttacgctgccggaaggggaagggattcgtcacgagtatgccatttcagaagggtataaagtgacaccgttttacgacccgatggttgcgaaattgattgtatcagcagacacgcggggagaagccattcagcgactaggcagagcactcaagcaatatgagatcgaaggaatcaaaacgaatattccgatgctaaagcaagtgatcaaccatccagtgtttcaagcaggagaagcaacaacggcatttgtaaccaatcatcttaaagtgaaaacagggaggaatccataa

SEQ ID NO: 40878 - DNA, 912 bp, Bacillus halodurans
ttgaactcgagtaaaaaagtatccattcgggaagtaggaccgcgggatggcctgcaaaatgagtcaacatggatcgatacagagcagaaaatcgagtggatcaatcatttaagtcgcacgggacttccttacatcgaagtgagctccttcgttcatccaaaatggattcccgctttagcggatgcagaggaggtgcttgctcgtattgaccgagtggacggtgtcacatatgcggccctagtaccgaatgaaaaagggttggagcgagcccttcgagcgggggtagatgaggtagccatcttcatgtcagcgacggaaacgcacaatcgaaaaaatataaacaaatcaatcgctgacacgctacctgttttaaaaaatgtaactcgaatcgcaaaacaggaaggaaagtcagtacgtggctatttatcgaccgtatttggttgcccctatgaagggacgacagagcaaacgaaattgctgcaaacggtagaagcgcttatgacgatggggatagatgaattatcacttggcgatacgattggagttgctaccccgaacttggtggaagcggtcgtcagagaagtgacaaagctcgtcccaaccgaaaaaatggctcttcatctccatgatacgaaaggaatggcgattgcgaatatcgcgtgcggtttgcgcacaggggttagaaagtttgacagctcggttggtggtttaggtggctgtccatatgccccaggagcagcggggaatgtggcaacggaagatttgctttacctacttcatggtctcggctacgaaacagacgtttccttgaatgaaatcatgaaggcagctgcctatatccaagagaagctcgacaaaccgttgccaagtcataacttgcaatcgtttttagcaaaggagggatcggtgtga

SEQ ID NO: 40879 - DNA, 1947 bp, Bacillus halodurans
gtgacagcgcctgtctggtttccatcggatgcttacaaagagcaaacgagattgtatcaatggatgaaaatgctcggctattcgtcctatgacgatttttatcaacgttcgatcgacgacattgcttggttttggcgggaagtggagcgggagctagacattccatggatgaagccttatgatcatgtccttgcaatggagaaagggcctgcctggcctgaatggtttatcggtggcaaattaaatgtgacggaagcagccgtggaaaaatgggcgaatgatccaaagaccgcaaataaaacggcgatcgtctgggaaggggaagaaggaaagacttccttgctatcgtttgcagcccttgatgaggcggtgaaacgtgcagcccatggcttaaaacagcatggagtcaaaaaaggagatgtgttcgccttatacatgccgatgattcctgagacggtgattgccatgctggctgttgccaagctcggagcaatcttcacgccgattttttctggttatggtgcagaggcgatcgctacgagactacgcgcttctggagcgaaatggctcataacagtagatggctgttaccggcgaggcaagctgattgatatgaggcaagaggcggagaaagcacttgctgacgcgccgaatgtccaatcaattgtcgttgtggagcgggtcggcacgttaacatcttatggtgccaacgatatacgctggactgagcttatgacctatgctccgctccaagaaacggcagcgatgaattcggcagatcccttaatgcttatttatacttccgggacaactggacggccaaaaggagcggttcatacgcatagtggcttcccaattaaagcggcgttcgatgcaggaattggcatggatttacgaaaagaggacacgcttttttggctgacagatatgggatggatgatgggcccgtttcttgtgtttgctggtttgatcaatggggcaaccatcgtcctttacgacggtgctcctgactatccgaatcatgaccgactttggcagcttgtcgaacaaaagcaagtaagtcatttaggtatttctccgacattaattcgcgccatgatgaagtacgggacggaacgaatggctgagcatgatttgtcttgcttaaaggtgattggctctacgggggagccgtggaaccctgagccatggcattggctgtttgaacacgtcggaaataaacaggtacctatctttaattactccggagggacggaaatatcaggtgggattttagggaatgtactcgttcgaccgattggtccgataacgtttaactcagcgattccagggatggcagctgctgtttataatgaaagtggtgaaaaagtaaccgcggaagtgggggagcttgtcctaacaaagccttgggtcgggatgactaacggcttttggcaggagcctgaacggtttctcgaaacgtactggtcacgttggagcaatacgtgggttcatggagattgggtcactcttgacgcggatggattttggacgataaccggtcgatcagatgatattttaaatgtagctggcaaacgacttggaccggcagaagttgagtctgtcctagtcggtcatcaggccgtcattgaggctggaaccattggggtaccagatgatgtgaagggtgaagtgccaatctgttttgttgtcattgccccaagtttttctgagagcgactcattaagacacgaattgatccagcttgtcgggacaaagcttggaaaagcattgaagccaaaggcagtgtattttgtttccgatttaccgaagacacgaaatgcaaaggtgatgcgccgtgcgatacgggcggcctttttgcaaaaggaggcaggagatttatcctcacttgaaaaccctcatgtattaaaagaaatcgaaaggttaggaacaaagcaatcctcatag

SEQ ID NO: 40880 - DNA, 1752 bp, Bacillus halodurans
atgttacgagttcttggtcaattatcttggttctttaaagaagaatggaagcgctacacgattgcgcttgttctcttattaattgttggcattaccgatcttgcaccagcatggattttagggctggccattgacgactttcaaatgggtcaattatcggttcaatcaggtctctattatggaggaatacttactttaatcatggtcatcagttacggtctaacctttgtatggatgtccaaactgtttggtggtgcctttgtcattgagaggaagctacgcagtaaattcatgcgtcatttattcaagatggacccgactttctatgaacggcagcgaacgggtgacttaatggcacgaggaacgaacgatttaaaggcggtatctaatacagctgggtttggcatattgacattgatcgattcaagtgtgtttatgtttacgatcttgattgccatgtgcgtgttgattgattggaagcttaccattgccgctgtcctaccgttgccgttaatggcgattatcattacggtgctagggaaaaaaattcatggccgctttatgatggcacaagatgcgtttggctctttaaacgataaagtgcttgaatcggttgggggattacgagtcatccgtgcgttcagtaaggagcgagcagatgaagaccattttcgcgaaatgagcgagaatgtctatcaaaaaaacatccttgtagcgaaaaccgatgcgctatttgaaccagccgtcaacataatcgttggaatgagctatattatcgggttaggatttggctcctacttagtgttccagcaacaaattactctcggccaattggtgacgtttaatgtctatcttgggatgttaatatggccaatgtttgcgattggggaactaatcaacattatgcagcgaggcagcgcttcccttgacagaatagacgaaacgttgcgagagcgggaggatgtcccgaatcctgagcagccaactaacacgaccgattttcaagatattcgctttcaacagttgtcctttaagtaccctggctcaaaaggaacgcaattgaagcaagtatcgtttcaagtgaatagaggtgagacgctcggaattgtgggccgaacgggcagcgggaaaacaacacttgtgaaacaactattaaaatattatccgatccatgaaggggaagtgtcgttaacggatacagctcttcgtgatatggaaaaacaacatgtccgcaagtggattggttacgttccacaagatcatattcttttctcaaaaacggtgaaggaaaacattttatttggaaagcaggatgcgatggaagaagagctacaaaaagcgattcgtctttcagcatttgatcaagatttaagctttctaccagacgggttagagacgctcgtcggtgaaaaaggggtggctctttccgggggacaaaagcagcgaatttcaattgctcgcgccctcatcgctgatcctgacattttgatcttagatgattcattgtcagcggttgatgcgaaaacagaggcgaaaataattggcaatattcgcaaggaacgtgcaggtaaaacaacagtcattacgacgcatcgtatttctgctgtagagcacgcagaccgaattctcgtattagacgaaggccgcgtgatcgaagaagggactcaccaacagctgctccaaaaagacggttggtacgcagagcaagcgcgaaggcaagcgcttgatccagtagagggggtgagcccatga

SEQ ID NO: 40881 - DNA, 2025 bp, Bacillus halodurans
atgaccgcaggaaaacgactgtatcagtatgcattaacgagtaaaaagacgattttgtttgcgttggctttgttaacggtcagcgtggcggctggattaacaggtccatttattgcgatgactatcattgaccgccatattacgggtatcgaggagccatggtatgaaacgaccgaacaagcaaaagccgtcgaatacaatgggacatggtacattcgcgagacgtacatgccagacgatgcaccgagagagcatgaggtgcaaattgcgcaagttggcttgacattcgtgtttacagaagagccgctcccaatggatggggcgaaatcgtacaatgatggcgtgctccgagtaacagtaggagatgacatgtatgagacggaagcagtgccgcttacgactcaagaggttatggcattttttacaccagaaattcgcccgattgtccagttgctgttgttttattttgggctgatggttgtcgcatccttctttcaatacggtcaacgcttttacttgcaaaaggccgccaatcgtatcattcaacggttgcggatcgatctgtttaatcatttgtcgcgtcttcctgtacgcttttttgacaacatgccagcagggaaggtcgtctcacgaattaccaatgacacggaagccattcgggagctctatgtcgcagttttagctaatttttttacgagtattatttacatgattgggatctatattgcgatgtttttgttagacgttcgccttgccttcatttgtctcggcttaatcccgattcttgtgttgtggattgtgctttaccgaaagtacgcatcggcgatcaatcatcgaattcgctcgaaaattagtgaaatcaatgcatccatgaacgaaaacattcaagggatgagcatcatacaagcgtttgttcgggaaaaagattctgctgacacgtttgatcgtctgaatgactctcattaccgtgaccaagtgaagctgctacgcttgaatgcccttaccggtcataacctttcatgggtgttacgaaacctcgtattcgttggacttatttggtcgatcgctggaacgtcgctaggtgctggtagtgcgctaacacttggtgttctctatgcatttgtcgattatgtgaaccgactgtttgagccagttaatcgaatcgtccatcaactgccgaaccttgagcaagcgcgagtggccggggagcgagtatttgagttaatggataaagaggggacagaggtgagcgatgaaacgatccctcgtcctaaaggagatgtcgtgttcgacaatgttagctttgcgtataaagagaacgagaaggttttgaaaaacttaacgttccatgccaagcctgggcaaacgattggtttagtcggtcatacaggttcaggaaaaagctcgatcatgaacttgcttttccgattttacgacagtgacgaggggcaaattcggattgatgggcaagacattaaggagatctcgccacaggccttgcgtcagcatatggggattgtgctacaagagccgtatttatttacaggaacggtcgcatcgaacctatcgttgtccaatcctgctattacgcgagaggcgatggaggaagcgctacgattagtagacggagagcatgtatttgctgatttggagcaagggttagatgaagaagtgaaagaaaaaggaagcaccctctccagcggtcagcgccagttgattagcttcgctcgtgcccttgtggcagacccagccattttagtgttggatgaggcgacttccaatattgactcagagacggaggcgattattcagcgcgggctggaggcgctaaagcgcggcagaacgacatttgtcattgcccatcgactatcaacgatcaaaaatgcggatcaaatcctcgttcttgataaaggaaagatcattgagtcaggtactcatgatgagctaatggagcaagagggtgcttatgcacaaatgtactatttgcaaaaccaagagaagagtactgcaagcacagctggttaa

SEQ ID NO: 40882 - DNA, 900 bp, Bacillus halodurans
atgagtttaacaattgatggggtaaccaaaaagtttggcacctttacggctgtgaataatttacacgtgtctgttccgaagggagagatgttcggaatgcttggagcaaacggtgccggtaagacgacaacgtttcgtatgatccttgggttgcttgaaccgacagaaggaacaattcattggcgagaacaacctttaacttataaccagacgaactgcatcggctatttaccggaagagcgaggattatatccaaagcttaccgtcaaagatcagctcaagtaccttggacggctaaaagggatgaaaactcaagacattcaaaaagaaatgaaaatgtggttggagcgatttgaagtacctgaatatgaacataagcgagtcgaacagctttcaaaaggtaatcaacaaaaaattcaattcattgcgtctgtccttcatcggccagagttactcattttagatgaaccgttctctggattggaccctgtcaatgtagaactactgaaaaaagccgtcattgacttgaaaaaagaaggaacgacaattttattctcgagtcatcgaatggagcacgtggaggaattgtgccagcatctatgcattttgcatcggggttcaccagtcgtcgaaggaaatttgaagaatatcaaaagaagctttggtaagaaaaacgttatcattcaaggggagtttgcgcttgaacccctcgtcgacattccaggtgtcctacgccatcaagagacaagtgcaggtgcaaaatttcagatagcaaatgaagaaacagcaaagcttctttttcaagcagtagcgacagcagggttcgtgcaaaaattcgaattagaggaaccgagcctgcatgacatttttgtagagaaggtagggacgcgatatgaataa

SEQ ID NO: 40883 - DNA, 1086 bp, Bacillus halodurans
gtgaagcgagcatacaattttaatgctggtccatcagctttaccgacggaggttcttgaaaaagcacaaagcgagttgttggactttgaaaacacgggcatgtcggtaatggagttaagccatcgaagcaaagagtacgaaaacgttcatcatacagcagctcagttattacgtgatttattaaacatccctgaagattatgatgttctgtttttacaaggaggggccagcctccaatttgcgatgattccactgaattttttagatgagggaaaggttgccaactatattctaaccggttcttggtctgaaaaagcattaaaagaagcgaagtttatcggaaaaactgctatcgctggttcaacaaaggaatcaaactatacgtttatccccgatatatcatcgcttcagtacaatgagcatgacagctatgttcatttgacatcaaacaatacgattttcggcacgcaatggcacacatatccatccgttagccatgcacctcttattgtggatatgtctagtgatattttatcacggccgcttccagtcaaaaattttgatctgatttacgctggagcgcaaaagaatctcggtccatctggtgtaacagtcgttattattcgcaaggaattgctaaagcgaaacgttgatcacgtcccaaccatgctccgttatcaaacacatgcggagaaacagtcgctatacaacacgccaccaacctttggtatttatatgttaaaagaagtacttcaatggttgaaaaacatcggtggaaccgagcagattgctgaacgaaatcagacaaaagccaacctcatctatggtgcgattgatgaaagcgaacagttctacaaagggcatgcgactaaagagagccgatctttaatgaacgtgacctttacactgcctaccgaagagctgacccaacagtttttatcagaagcaaaagaaaaagggtttgtcggcttaaatggacatcgttcagtcggtggatgtcgcgcttccatttataatggcgtaccagtagaagcctgtgaagcgttggctgacttcatgcattcgttttatcaaacgcaccgctag

SEQ ID NO: 40884 - DNA, 744 bp, Bacillus halodurans
atggaagaaagagtcgttgtggaaggattaactggagggtatcgcccgaacaaaccagtgcttcacgatcttcatttaaaaatccgtgctaatgaacttgtcggattgattggattaaatggggcggggaagagcaccacaattaaacatattctcggtctcatggaaccacataaagggtctgttatgattaatggaaatacaatcacgacagatcgtgaaacctatcgtcgctctcttgcgtacataccagaaacaccaattttatatgaggaactcacgttgtgggaacatatggagcttactgcacttgcttacggaattgagcggaaggcctttgaggaacgatctaagttgctgttagatgagttccgaatgacaaaaatgaaacattggtatccgagtcatttttcaaaggggatgcggcaaaaggtaatgatcatttgcgcctttttaattgatcctccagtgtacattgtcgatgaacctattgttggattggacccgatcggtattcagtcatttttacaattgcttgcaacaaaaaagaaaaacggtgcagcggtgttaatgtctactcatattttggcgacagctgaacggtattgtgatcgatttattatattaaatagaggtcgaatcgttcttgaagggacattggagtcaatgagagccgaattgaacatgccagatgccacgcttgatgatatttatatcgagatgacaaaggaagagagccaatga

SEQ ID NO: 40885 - DNA, 1035 bp, Bacillus halodurans
atgtctaattcatttaatgatacgtttttaaaagcatgtaaaggagaagtacacgaccatgtacctgtttggtatatgcgtcaggcggggaggtcgcaaccagaataccgaaagatcaaagagaaatattcattatttgaaattacgaagcagccagagctatgcgcatacgtcacgaaactcccagtggatcaatataacaacgatgcggctattttatataaagatattatgacaccccttccgtttatcggcgtggatgtggagattaagacaggaaaaggacctgtcattgacaacccgattcaatcgtatgcagatgttgagagactaggcaccattcagccagaggaagatgtgccatacgtacttgacacgattaaactgttgcgagaacaattaaccgttcccctcattagttttgctggagcaccgtttacccttgctagctatatgatcgaaggcggtccttcaaaaagttacaataagacgaaagcgtttatgtacgcagagccgaaagcttggcacttattaatggacaagctcggtgaaatgacaattacgtatgtgaaggcgcaaattgcagccggagcgcaagcgattcaaatttttgattcgtgggttggcacgctcaacgttcaagattatcgcgtatttgtgaaaccagtaatggagcgtacctttagcgaattgcaaaaagaaaaggtgccgctcatcatgtttggtgttggcgctagccatctcgtcaacgagtggaacgacttaccgttagatgttgtcgggcttgattggcgtttgcaaattaaggaagcacgggaattgggggtcacaaaaacggtgcaagggaatttggaccctgcgatcttgttggctccttgggaagtcattgaagcacgagctaaggagattttagatcaagggctggaaacgccgaactttatttttaaccttgggcacggtgttttccctgaagttgaaccagatacgttaaaacggttaactgcgtttgtccatgaatatagcgcaaacaactaa

SEQ ID NO: 40886 - DNA, 933 bp, Bacillus halodurans
atgacaaagaaaaagatagggttgctcgtcatggcctacggaaccccgcgaacgaaagaagaaattgagccatattatacccacattcgccatgggcggaagccatcacaagaattgctagatgacctcactgaacgatacgaggcgatcggtggcgtgagcccgctcgcgaaaataaccgatgatcaagcgattgcgttggaacaaaagctgaatgagctctatgatgacattgagtttaaatcttatttaggtttaaagcatatcgatccgtttattgaggatgctgttgagcaaatgaaagaggatggcgtgcaagaagctgttagtatcgtgcttgcgcctcacttctcgacatttagcgtgaaatcgtacaacgggcgtgctcatgaagaatcaaaaaaaattggcggaccaagaattcaaagtgtcgaaagctggtacgatgagcctctcttcattcaatattgggttgatcaggtgaatgacacgatggccaaaattgaagataaggataaggcctgtgtcatcttctctgcccatagcttaccggagaaaatagtagactatggggatccttacccacagcagttgaaagaaacagccgatttaatcgcgaagggagcagggattactaactatgcggtcggctggcaaagtgaagggaatacaccagagccttggctaggaccggatgtccaagacttaacgagagacttatatgaaacccatggctatacgtctatgatttattgcccagttggctttgttgcagatcatcttgaggttttatatgacaatgattatgaatgtaaagtcgtaaccgatgaactcggcattgattattatcgtccagagatgccaaatgctaagccggaatttatcgattgtttagcgacggtgattcaaaaaaaattagctgagaaagagtga

SEQ ID NO: 40887 - DNA, 1404 bp, Bacillus halodurans
gtgacgacgaataaccatcgggtggcggtgattggtggtgggatgaccgggctcgctgctgcttgggctcttcagaaagcaagaaaacaaatgccaatagaatatgaactcattgaagcaagcgctcagcttggagggaaaatccaaacggatgtaaccgaaggcttcgtcattgaacgcgggccggattcctatttagcgcgaaaagaaagcatgacgagacttgcgagggaagtcggactcgagggagaactagttcgtaacgatactggacaggcctacattttaaaggatgaccagctttatccaataccaggtggagccattatgggaattccaactgagattggaccgtttatccgctcccggcttttttcctctattgggaagctaagggcagctcaagacttagtcatcccttcttttactcatgagaatgaggatgtttccctcggttactttttccgtaagcgactaggagatgaagtagttgaccagttaattgaaccgcttctgtccggtatctacgcaggggatttggatacgcttagcttacaagcaaccttccctcagtttcaacagcttgaagctaaatatggtagcctcattcgtggaataaaggcttcaaaggggaagcaaagtcaatcacaggtcgggaaaaagcaaggaatgttcttaacatttcgccgcgggttgcaatcgtttatagagacgattgagcagcacctcgatgagaaggcgattcgtaaaaaaacggaagtccgtttttgtgagcgggaagggaagcggtaccggttaacgtttaacgatgggaccgttcagacgtatgatcatgtcattttaacaactccaccctacgtaaccggacgtctccttgagccatatgtggacgtagactacatgcgagaaatgaaagccacgacggtggcgacggtggcgatggcatttaaatccgaggatcttcacattccatatgaggggactggattcgtcgtgccgcggaaaagtcgctacgaaattacggcctgtacgtggacgcacaaaaaatggcgtcatacaacgcctgaaggccatgcgctcgtacgatgctatgtaggcaagccaggatctgaatccattgtacatgaaacggatgaggcaattgttgaacaggtgcaaaaagacctcgaccaaatcatgacagtcaaaagagagccgctgttttacaaggtgacgcgttggaaaaaagcaatgccgcaatatgaagttggccatcgctacaaactcgaaaaagtaagacaggaactaaaaaaagcaatgcccgggattattcttgccggagcaggatttgatggcattggtttaccagactgtattgaccaaggggaagcagctgttgcaacagtcttggaagaaattttgtaa

SEQ ID NO: 40888 - DNA, 1530 bp, Bacillus halodurans
ttgagatgcgatggagaggtcatcattgttggtagtggaattgctgcaatgatgagcgcatacctgcttcgaaagtcttttcatgtgatcatgatcacaaagtctgatgtttttgcgagcaattcatttcttgcgcaaggggggatcgccgccccaatcgcagaaggggatgattggcaggcccacacggccgatacgtggaaggcaggggccgcacatggcgatgaaacatcgattgaaatgatgacaaaacatgcggtgaacatgatcgaattgcttgatgatctaggcgtctcgtttgatcgtgaagaaagtggcgggtactcgctaggattagaaggtgcccacggtacaaggagaatcgtccacgtcaatggggcggagacaggaaaagcggtcatgcgtgctttatggaaggcgataaaaaatgaaatcacactgttagaccgtacatgtgtgtatcggtttataaaaaataaggatgagattattggtgtggagacagaccaagggagtctctttgctcctgtaacgattgtggcgaccggaggatgtggacaaatgtattcggtcacatcgaacggaaaagaggcaacgggagatgggatcgccctcgcgtatcgcagtggtgcggccatttcagatgtagaattcattcaatttcatccaaccgtttataccggcaatgaaaaggagaaggggctactcatttcagaagccgttcggggggaaggcggtcagctgataacttctgctggtgagaggttgcaatcattaaaatcacgggacgttgtaagccgtgagatttttaggcaagagagggaaggtcatacagtccatttagatttaacggggattagcgattttgaaaggaaattcccggccctttataagggatttaacaaatcagatagaagaacattgaagccgcgagtcacaccaggcgctcattttttaaatggtggaatttcggttgatgcgtgggggcaaacgtcgttgtctagactctatgctgttggagaagtggcatgcaccggtgtgcacggtgccaacaggttggcaagcaactcattgcttgaagggctcgtatttgctcatcaagcagctactcacattcaacagacgtttcaaccactgacagctggattgttcgtagaaagagataaagcggaaccacgttcgttcaagttgccaacccgagaagacttacagaaaaagatgatgcgttatgttggaattgaacgtcatgcgagatcgctatggtatatgaataattggtttcagccgttcttagacactgctcactataatgggccatggccagagcgggacatgtttgagcaggcaaacatgacattgctcgccagcctcattacacgttcggcggccatacggactgaaagtcgaggggggcatttccgtgcagactacccgaacggtctggataagtttcaacaactcatcatcgaatggcaaaatggagcccatatgaaaaggcagcgtccgacgataaaggagttgagtcgatga

SEQ ID NO: 40889 - DNA, 516 bp, Bacillus halodurans
atggattttaaacagcatattacaattgtagaaaactttccaaaagaaggcattcgatttaaagatattacaacattgatgcaaaacggcgaagtgtacaagcgagcaattgacgaaatggcacgatttgcaaaggaaaaggaagtggatctggtcgttggacccgaagctcgaggatttgtggttggctgtccaattgcctatgcgattggcaaagggtttgttcctgtaagaaaggctggaaaattgccacgcgaagtcatttctgtggattacggactagagtacggaaaggatcgtttaacgattcatcgagatgccattcagaaaggtcaacgcgtgttaattgccgatgatttgcttgcaaccggcgggacgatcgaggcgaccgttcaaatggtagagcaacttggcggtgaagttgtcgggattgcgttcatgatagagcttggttatttaaatggccgtgataaattggtaacgtacgatgtgttctcacttacaacatatgaataa

SEQ ID NO: 40890 - DNA, 1254 bp, Bacillus halodurans
atgattaaagttggtgtgatcggatttggcaccgttgggcaaggtgttgtcgagagtctagttcaattggagcgaggattaaggaaagaagttactctcgaaatgttgcttgtgaccaatcggagaaagcatgaacatagtgaacagtacgcccttgtaacagacgattgggagacatttgctgctcgttattatgatgtggtatttgaggcggctggtggaattgagccagtgtatgattatgtccgcttctttttgaaaaaaggcgtacccgtcgtgaccgcaaacaaaaaactcgttgctgaaagaggagaggaactggaacgactagcggccgaaaacgacacgtacctttgttacgaagcagcggtagctggaggaatcccgatcttaaatgccattaaaggtacgctagcgacgacttcctttacatcggtagcggggattttaaatggaacgacaaactatattttaacagggatgattgagcaaaaccgtccgtttcaagacatgctggaggaagcgcaggccaaagggtatgcagaggctgatccaacggacgacattgaaggatatgatgcatggtataaaatccgaatattagcacgactttgttttgggatttggccaaaccgtgacgacatttcgcgaagcggactacatgacgtgctcgactggcacgtcgaattaggtcaatcactagggctcacgttaaagcttgacggtagagcctctgtaaaaaataacaccattattgggtctgttgcacctgccttttttacaaacgatcatccatttagtacagtctatggcgttacgaacgctgttgtcttggaagggaaagcgatcgagcgactgctgttcactggacctggtgcagggaaggaggcgacggccaacagcatggtcgaagattacttgttccatgaacgatacaaaggagaacgtcaaccgatgctcataaaagaaaaagagcaaaacaggatcgcgaacgtccttgtcatggttgctgctcatgaaaaaaaggaagcagaaaaggtggtagagcacttaccgtgtcaacggatcaatacatttgcggcggacgaaggcgaagcgtggtggctgaaggtatatgaggatgttatcccattcatttcgaagcagctaggattaagtctctatcgtgtttatggggcgtttgaaaaacagctagttacgacaaatatgcatcacccttcgtcaatcgatgaaacgcttgaacaaaaggcttag

SEQ ID NO: 40891 - DNA, 1602 bp, Bacillus halodurans
atgaaagatcaaaatcaagatcccaataagcgatctgacaatgaaacagatgaaacgttaacgaacagacagggtcatcctgtcacgaacaaccagcatgttcgaacagtgggagatcgggggccaactactttagagaattatgattttcttgagaaaattagccattttgaccgagaacgtattccagagcgtgtcgttcatgccagaggggcgggggcacacggttattttgaaagctatggtacatatggggatgaacccatttcgaagtatactcgtgcgaaagtgttcacggaaaaaggcaagcaaacaccggtttttgttcgtttttcctcggtcattcacggtgggcattcaccagagacattacgagaccctaggggatttgcggtgaagttttataccgaagatggtaactgggatttagtagggaacaacttaaaaatcttctttatccgtgatccgttgaaatttcctgatttggttcatgcgttcaagccagatccggttacgaatgtacaagatggagaacggatctttgattttatttcacaaacaccagaggccatgcacatgatcacattcttgttctcaccgtggggcatacctgctaactatcgaatgatgcaaggatctggcgtaaacacctacaaatgggtaaatgaagaggggaatgcggttctcgttaaataccattgggaaccgaagcaaggaatcaaaaatttaacgcagaaggaagcagaggccattcaagcgaaaaactttaaccatgcaactttggatttgtacgaagcgattgaggacggagattatccagagtgggaattgtatgtgcaaattatgagtgatgatgcccatccagagcttgattttgatccgctagatcccacgaaattgtggtataaagatcaattcccatgggtacccgttggcagaatggtgttaaataaaaatcctgaaaactactttgcagaggtggaacaagccgcctttgggacgggtgtactcgtcgatggccttgatttctcagacgataagctattgcagggccgaacgttttcttattctgatacacaacggtatcgggtaggggcaaattatttacagttacctatcaatgccccaaaaaaacgggtagcaacgaatcagcgagatggacaaatggaataccatgtggacataggaccaaagcaaaacccccatgtaaactatgagccatctttattaaatgggctaaaagaagcaaagcaagatggccaggaccataccccgtatgttgaaggtgaactgcaacgggcgagcatcgataggcaaaacgattatggacaggcaggtgaaacctatcgccggttgtcagactgggagcgagatgatcttattttgaatcttgtgaacacactcgcaccttgtcatgaagatattcaaaagcaaatgattgatcactttagccaatgtgaccctgagtatggacgaagggtgaaggaagggttagagaaacaaaagggagcagatactcataggcagccacaaggcggtgcagatggggatgcggcgatgcatgcggcagaagctctgggacatccttcagatccttattaa

SEQ ID NO: 40892 - DNA, 780 bp, Bacillus halodurans
gtgagaaaaacattttttagactatgcttcgaattgagtagtcatcctgtcctgtcatctatgctacaagcatttactacttctaaagcgagccgttggttaattccttcgtttgtaagagtttataacatcaatgggcaggaagcagaaaaaccacttcatacttatcaatcgcttcaagaggtatttacaagaacgttaacggaaaactgtcgtccaattgatttatcacctaaaagcattgtcagcccagttgatggcgttttagctgagcaaggaactctatcagacgaggcgaactttgtcgtgaaaaatcagacctatacactggaggaaatgttaggtggaaaagaaaaagctaagctctatcgagaggggacgtacttgcttttttatttaagtccaagtcattatcacagaattcatagtccagtaaacggcacaatcaaagagcaatggacattagggaataaatcggctcctgtaaataatctcggattgcgttatgggaaacggccactatcaaggaactatcgtttgctcaccgagttagaggcagaagaggggcgctgtatcgtggccaaaatcggggcccttaacgtgaacagtattgtaccgactcatcaatcagagcatgtagacaaaggggaggagatcggctattttgcctttggttcatccgttatgctgttttttgaaaaaggaacgattcaattggatcatcagcctcgagctgttgaggtaaagatgggggaaaaggtagggagctggctacgctaa

SEQ ID NO: 40893 - DNA, 837 bp, Bacillus halodurans
atgaaaaagctttttggtcttttggggcaccctgtcggtcattcattatcaccgctcatgcataaccaaatgtttcaattgttagatttcgatggttattaccatgcattcgacgtggagccgtctcagttagagaaagctgtagaaggggctcgggcgttacaaatgcaaggcttcaatgtgacaatcccgcataaggtgacaattatggattatctcgacatggtcgatgaagaagcgcaagaaattggagctgtaaatacggtagtaatgaaagacgggcaattgttcggttctaatacagatgggcaagggtacttagagtctttgatggatgttgtgacaactccttttccgacacaagatgtgttgattattggtgcaggtggtgccgctcgagcgatcgggacggtgcttaaacgggagaaggttcgatccattacgatcgcgaatcgaacgttggcaaaagccgaggaatttagcggagtccttgaatcgagtgagacaagctgttcagctctttccctaaaagaagctgaacaacaactagaacgtttctcggttattattaacactacatctgtcgggatgagcccccgtgtcgacgatatgcctttgtcccttgaacgtttatcaagggagacggttgttagcgatttaatctataatccacttgaaacgaaatttttacgtgaagccaaacaaaaaggcgcaaaaacggtagatgggttagggatgtttgtcaatcaaggggcgcttgctttcgaattatggacaggtttacgccctgatcgtgaaaaaatgagacgctgtgttttagaacagctaggaggataa

SEQ ID NO: 40894 - DNA, 828 bp, Bacillus halodurans
atgaaaatcgggtttatcgggacaggaagtatgggaacaattctcattgaatcatttctcgaatcatccgccttaacagccgaacagatagtgataacaaatcgcacacaggaaaaggcagatgcgttggctcgtcggtatcccgggctatcggtagttgatcgcccagaggaggtcgttcagcagactgactgcttttttgtttgtgtaaaaccgatgcagttccaccgcgtgttaatggacatacgtccccattgttcggcaaacaaactgctcgtctcgatcacaagtccaatctcaatcgcccaattagagaactctgtcgattgcaaagtggcccgagccattccgagcatcttaaatcgggcttgcgctggttcaacacttgttagcttcagtgagcgttgtcttgaagaggatcggtcgttcctttgcggcttattgggcaccatttcagagccattattgattgaagaaaaaattacacgggtatcttcagatatcgtaagttgtgggcccgcattttttagttatttaacgcaacgtttcattgaggcagcggttcggcaaacagcgatttccgaagaagacgcgacggcgttagcgaccgaaatgttaattgggattgggaaattgttagatcaggaattatatactttaccgtcgttacaaaaacgggtatgtgtacctggaggtattactggggaagggatccgcgtgttagaggaagacgtgggtcatatgtttgatcgcctgtttcagaaaacccatcaaaaatattatcacgaacaggagaaaatttcgtctcagcttacgttaaagggttga

SEQ ID NO: 40895 - DNA, 1845 bp, Bacillus halodurans
atgagcaaaatcattggtattgaccttggaacaacaaactcatgtgtagccgttatggagggtggcgaagcgacggttattccgaatccagaaggaaaccgtactaccccttctgttgtggcatttaaagatggggaacgccaagtaggggaagtggcaaagcgacaagcgatcacgaaccctaacaccgtgatttcaatcaagcgtcacatggggacgaaccacaaagaaaacattgaaggaaaagaatatacaccgcaagaaatctctgcgattattttgcaaaaattaaaatctgacgctgaagcctatctcggtgaagaagtaacgaaagcagttattacggttccagcttatttcaacgactcacagcgccaagcgacaaaggatgcagggaaaatcgctggattagaagtagagcggattgtcaacgagccaacagcagctgctcttgcctatggtcttgacaaagaagacgatcaaacgattcttgtctacgacctcggtggtggtacgtttgacgtttccattctcgaattaggtgatggattttttgaagtaaaggccacttcaggggacaataagcttggtggggatgactttgaccaagtgatcattgaccatttgatcgcagaatttaaaaaggaaaatggcattgatctatcacaggataaaatggcgatgcaacgtttaaaggatgctgctgagaaagcgaaaaaggatttatctggtgtgacgtcaacacaaatttcattgccgttcattacagcggatgcaacaggaccaaagcaccttgaactaacccttactcgcgcgaagtttgaagagctttcttcacacttagtagaaagaacgcttgggcctacacgtcaagcattacaagattcaggcctttctgcaagtgaaattgataaagttgttctcgttggaggatctacacgtattcctgccgttcaggaagcgattaagaaccttacaggaaaagaaccacataaaggggtaaatccagacgaagtcgttgccctcggtgcagcggttcaagcaggggttctaacaggagatgttaaagatgtcgtacttctcgacgtaaccccgctttcacttggaattgaaacaatgggaggcgtgtttacgaagcttattgagcgtaatacgacaatccctactagcaaatcgcaaatcttttcaacggctgccgacaaccagccttctgttgatatccacgttcttcaaggagagcgggaaatggctgccgacaacaagacgctcggtcgcttccaactaacagatattccgccggcaccacgtggggtaccgcaaatcgaagttacatttgatattgatgcgaacgggattgtaaacgttaaagcgaaagacctcggcacaaacaaagaacagtccattacgattacatcttcttccggtttaacagatgaagaaatcgatcagatggtcaaggacgcagaagcgaacgctgaggctgataagaaacgccgcgaagaagtagagctacggaatgaagcggatcagctcgtctttacaaccgagaaaacgttaaaagatctcggtgataatgtagatgaggctgagaagacgaaagccgaggaagcaaaagagaagctgaaaaaagcgatcgaagcgaacaatattgatgagattcgcacagcgaaagaagagcttcaacaagtcgttcaagcgttaacgacaaaactatatgagcaagcggctcaacaagcacagcaagcccaatcggctgaaggggatcaaggcacagctgaaaaagggcaggatgacaacgttgtggatgcagattatgaagaagtcaatgaggaagataaaaagtaa

SEQ ID NO: 40896 - DNA, 1113 bp, Bacillus halodurans
atgagcaaacgggattactatgaagtccttggtgttgatcgtaacgcgtccgcggatgaagtgaaaaaagcgtaccgtaaattggcacgtaaataccatcctgacgtgaacaaggcacccgatgcagaggataaatttaaggaagtaaaagaagcgttcgatacactaagtgatccgcagaaaaaagcccattatgaccaatttggccatacggatccgaaccaaggatttggcggtggcggtgctggtgacttcggtggttttagtgacatttttgatatgttctttggtggcggcgggggtagacgcaatccgaatgcacctcgtcaaggtgcggatctgcaatatacgatgacccttgaatttaaggaagctgttttcggtaaagaaacgacgattgaaatcccgcgggaagagacctgtcatacgtgttcaggctctggtgcaaagcctgggacgaagccggaatcttgtccgcattgcggtggctccggtcagcttaatattgagcaaaatacgccgtttggccgcgtcgttaatcgccgagtttgtcaccattgtgagggaacaggaaaatatattaagcataaatgtgcaacatgcggaggaaaaggaaaagtacgtaaacggaaaaaaatcaatgtcaaagtaccggcaggcattgatcacggtcaacaaataaggctctctggccaaggggaagctggagttaacggaggacctgctggagatttatatattgtgtttaatgtgaagccccatgagttttttgagcgtgatggcgatgacatttattgtgaaatgccgttaacctttgtccaagtagccctaggcgatgagattgaagtcccaacattgaatgggaaagttaagctaaaaatcccagcagggacgcaaacgggtacgagttttcgcttgcgcggaaaaggagttccgaacgtacacggtcgcgggcaaggagatcagcatgttcaagttcgcgtcattacgccgaagcagctctctgaaaaagaaaaagagctacttcgtgagtttgcacaaatgtcaggcggtcgccccgacgagcaagacgattccttttttgcaaaagtgaagcgagcgtttaaagggtaa

SEQ ID NO: 40897 - DNA, 1317 bp, Bacillus halodurans
atgaaatcagctaattttgctcgttttcaaataaagaagtttttactagaagcattaagcgataaagggattacccatccgacagaaattcaggagcggctcatcccggcgatccgaaatggaaaagacgtgattggccaatcacagactggaacaggaaaaacgctcgcctttttgctgccaattgtggatcggattgagggggagcgtgaggaagtacaagctgtgattactgcaccgacaagggaattagctgggcaaatttttgaagagctccaagccttgttacggcatgtgcctcacgatgaagagattcgagcgaagctaattgttggaggaaccgatcgaagtcgcactttagagaagttaagggtacagccacagatcgtggtcggtactccaggtcgaatttcagatcttgtccatgagcaagcgctgaatgtctacacagcgacaatgcttgtcgtggatgaagcagatcaaatgcttgatatgggatttatcgaagatgtggacaaggtagctgctcggatggcggaaaacttgcaaatgatggttttctcggccacaattccagaaaagcttaagccttttttaaaaaaatatatgaatgaaccgcgccacgttcatgtacagccaaaacaggcgacagcaaacctcatcgagcatcggattgtgccgcttcgtcatagggataagctcgaaatcacaacagaagtggcgagtgttttaaacccgtttttagcgatcgtttttacgaatacaaaagagcaagcggatgagttggccgatgcgatgctggcggcagggcttaacgtggaacggctccatggggggctccagcctagacagcgaaagcaagtgatgaaacgagttaaaaattatgaagtgcaatatttagtggcgacagacctagcggcaagagggattgatattaaaggagtgtcccacatcattaattattcgttgccgaaagatttggatttctatgtccatcgcgtggggcggactgcacgtgctggtgctgacggaattgcgttaaccatttttgcgccagaggacgaacaagcggtgcataagttaatgaagcgagggattcaatttacgtactatgaccttaaaaaaggggaatggcaaaagttagacaagcctccacttggtgtaccgggtgaaaagcggcgaaaagaggataaaggtctcgaggcaccgatagtgaaaaaggcgaagaaagtgaagcctggttataaaaagaaggcacgtcttgcacaagcagaccagcagcggagacaacgccggttgaatcgaaaaaagaaatag

SEQ ID NO: 40898 - DNA, 753 bp, Bacillus halodurans
atgaatccagttgtaaaagtcgacaatctatctgttttttacgaacaacatcaagcgattaaaaacattcgttttcaagctgggccgggacagatgattggaattttaggtccaaatggagctgggaaatcaacgttaatgaaagcgattctaggattggaaagatatacaggtacggtgaaagtattggacaaacacgtaaggcatgtgcgaaaacaaatcgcttacgtcccacagcgaaatgcaattgattgggattttcctgttttagttgaagatgtggtgatgatgggacgctttgcccatatcccttggttcaagcgtgctggtaaaaatgataaacgactcgtggaagaatctcttaagaaagtagggatggaggagtaccgtagccggcaaattggggaattgtcagggggacaacagcaacgcgtgtttattgctcgagcattagctcaggaatccgaactattttttttggatgagccgtttgttggcattgatgtgacatcagagtcgatcatcctgtcattacttcaagaattgcgtgaccgtggaaagacaatttttgttgttcatcatgatttaagtaaagtggaaaaatactttgatcaagtattgatgctaaacaaagaattaattgcatacggtcccgtagcggatgtctatacgccagagatggtggctaaaacttatcaaggtaatcttgccacgttttcaaagaaagatgaagtcatggtggtgaacgtctaa

SEQ ID NO: 40899 - DNA, 750 bp, Bacillus halodurans
atgaaaggggtaattctagcaggagggcgaggcacgcgtttaaagccattaacggatcaaataccgaaaccgatgcttccgatagctggtgtgccgtgcttggcccatgggctcgcccaccttgctgcccatgggattcgtgatatcgtcatgctcgtccattatctgaatcatcaaatgaaagcatattttcaagatggctccaagtacggtatgcgaatcacgtatgttcaagaagacgcccctctcggaacagctgggagcttgaaagcagcggagcgttatttagatgaaccatttgtcgtgatgagcggcgatgtgttaactacgatttcaatacaggaggccatcgttttccataagcgtcaaaacagtcttatgacaatgttgacgaagcgggtgaaaaacggacaaaactatggcgttgttcaaaccggtccaaaccatcgagtagttgcgtttcgagaaaagcctacggaagacaagacaagagaggttttggtgaatacgggtttgtacgtcatggacccttttgttctctcttacattccaaaaggcagtgccgttgatctaggaaaagacgtcatcccataccttgtagacaggaagctggatatatttgctttagaagggggcggctattggcgagacattggctcgtttcatgattatttacaggcaaataacgatgtaaatagtggaagcgttccttcgtttgtaggacgaccgtcgcttctttctcgtgattag

SEQ ID NO: 40900 - DNA, 1416 bp, Bacillus halodurans
atgacagactatcgtgtagagcgagatttaattggtgaaaagaaagtaccgaaagaggcatattatggaattcaaacgatgagagcgagggaaaacttccccattacagggtatccccctcatgaggaattgattcgcgcctttggctttgtcaaaaaggctgctgcgatggcgaatcgggatgtaggggtgttgccagctaacattgtcgatgcgatcattaccgcagcagacgaagtgatcgaaggaacgttcaacgatcaatttatcgttgatgcgatccaaggtggtgcaggtacttcttttaatatgaatgcaaatgaagtgattgccaatcgtgcgattgaaatccttggaggagagaagggggaatacctccgcgtaagcccaaatactcacgtgaacatggcgcaatcgacaaacgatgctttcccgacagctattcatattgcctgtctttatttagccaaaggattaattcaatcactagaagacctgattgcagccattaaggaaaaggaacaacagtttgacgatgtgttaaaaatggggcgaacccatttacaggatgcagttccgatacggatgggacaagaatttggcgcttaccgccgcgtgctcactcgtgatttgggacgaatccgcagctcaattgatcatatgcatgaaattaatatgggggcgacagcagtagggacaggacttaacgcaaagcctgaatatatggaaaaagtggttgcctatttaagtgacattactgaatttccgttccgccatgcagcagatttagtggacgcgacgcaaaatacggatgcttacacagaattatcgagtgcgctgaaaattttggcgatcaatttatcaaaaatggcgaatgacatccgcttgatgagctctgggccacgcacggggttaaatgaaatcaaccttccaccgcgtcaaccagggtcgtcgatcatgccaggaaaggtaaatccagtaatggctgaagtgatcaaccaaatttcgttccaagtcatcggcaatgaccatacgattagcttagcgtcagaagctgggcagcttgaactaaacgttatggagccggttctcgtctttaacttacttcaatcgttatcgatcctgcaaaacgggatgaaggtgttccgtcagcacgcgattgaaggaatgacggccaacgtagagcgctgcaaagaaatggtggagagcagtgttgggatcattactgcgatcaacccccatgtaggatatgaaacagcctctcgaatcgcaaaggaagcgatccaaacagggcgtccagtacgagaaatttgtctagaacgagggattttaacagaagaggaactaaacgaaattttggatccgaaagaaatgacgaagcctggtattgctggggcaaggttcatttacggataa

SEQ ID NO: 40901 - DNA, 1389 bp, Bacillus halodurans
gtgaacacacgaattgagcgagatacgctaggagaaatgcacgttccacaagacaaattatggggggcacaaacgcagcgaagctatgagaatttccatattgggacagaaaaaatgccgatggaaattatttatgcctttgccttgctaaaaaaagcagcagcaaacgtcaacaaaaagcttggacaactgtctgccgaaaaagcagatgccattacctgggctgcaaatgaagtgctagctggcaaacacgatgatcatttcccgcttttcgtttggcaaaccggtagcggcacgcagtcgaacatgaacatgaatgaagtccttgcccgcaggggaaaccagcttctgcaagaaaaagggctagatgttacaattcacccgaacgatgacgtgaaccgatcgcaaagctccaacgacacatttcctaccgccatgcatattgcggcttataataaactggacgatcacttactgcctacactccaaatgttcaaacaaacactccaccaaaaagcaaagcaatttgatgatgtgattaaattaggacgaacacacttacaggatgcgacccccttaaccctcggccaagaaattagtggctgggctcggatgctcgaaaagaccgagcaaatgatccgtgagagcatgatttatttgcaggaattagctatcggtggtacggctgtcggtacaggggttaacgcccatcccaagttcggagaaatggtggccgccgatatcgcaaatgaaaccgggaaacctttcaaatcagccgctaataaatttcacgcgctcacaagtcatgacgaactagtacacactcacggcgccctaaaagcgcttgctgccgatttgtttaaaattgcgaatgatattcgttggcttgcaagtgggcctaggggcggactaggagaactgatcattcctgctaatgagccgggaagctcaattatgccaggaaaggtcaatccaacacagagcgaggcattaacaatgatcacgtcgcaagtaatcggaaatgatgccacgatcgcttttgctgcaagtcaagggaactttgaactgaacgtatttaagccggtcattatttacaatttccttcagtccacaacgctgttaactgatggactccggacgttccatgacaaatgcttaatcggccttgaggcaaacgaaacgatcattaaaaagcatttaaatgagtcactcatgctcgtgacagcactcaaccctcacatcggttatgagaacgcagcaaaaattgcgaaaaaagcacatgccgaaggcttaactcttaaagaagccgcgatgcaaagcggcttgctaaccgaagaggagtttgaaaaaatggtcgatccggcaaaaatggttcacccacaaggctaa

SEQ ID NO: 40902 - DNA, 540 bp, Bacillus halodurans
gtgagtgaaagcaaatgggcgttagccacttttgctggaggctgcttctggtgtatggtttccccatttgaggaagagccagggattcatcaagtggtttctggttatacagggggacatacagaaaatccaacgtacaaagaagtatgctcagagacgacaggtcactatgaagcggtgcaaatttcctttgaccctgaagtttttccatatgaaaagctgctcgaaatctattggacacaaatcgatccgaccgatccaggcggacaatttcacgatcgaggcgattcatatcgaacagcgattttttatcatgatgagcagcaaaaacaagcagcagacgcatcaaaacaaaaacttgaggaaagcggtaaattcaacgctcctattgtcacccgtatcctccctgccaaaccgttctatccggcagaggaatatcatcaaaagtaccataagaagaacccattccattacaaaatgtacagacacggctctgggcgcgaagcctttattaaacaacattggggggaatcgcgatga

SEQ ID NO: 40903 - DNA, 696 bp, Bacillus halodurans
gtggaccaatcaatccaagtgaatataaacgaagtcaatcaagccttggagcgtaaagatagcctcgatgtgattaagtgggcgtacaaaacatatggagataagctcgtgtacgcctgtagcatgggggcggaaggaatggttctaatcgatcttattagtaaagtgaggcccgacgctccagtcatttttctcgatacagattttcatttttcagaaacatatgaattgattgaacgggtcaaggagcggtacccgaagcttcagctgaagttagtgaagccggaacttacacctgaggagcaagcagaaacatacggtgatcgcctgtgggaacgtcaaccagacctttgctgtaagttgcggaagctcgtcccgttggagaaggaacttgcccaatacgacgcatggatgtcagggctacgccgagatcaatcaccgactcgaacaaatactcaatttgtgaatgaggatcgccgctttggttcaacgaaaatttgtcctttaatccattggaccagtgaggaaatttggatgtatatcgagcttcatcaattaccgtataatgaccttcatgataagcagtatccaagtatcggctgcgagtattgcacgcgtcctgtaaaagaaggagaagatgaacgagcaggtcgctggtccaacacatcaaaaacagagtgtggattgcaccaataa

SEQ ID NO: 40904 - DNA, 1146 bp, Bacillus halodurans
atgtcattaagtcaaccacatggaggaacgttggtccaacgttttcatccagaagcaaatgtagaaagtgtagaaaaatcaattgagctcgatgccttttcattgtctgatttggaactaattggaataggggcgttcagccctttgacaggttttctaacagagaaagattacagatcagttgttgaatcgatgcgacttgaaaatgggacggtctggagcattccaattgcattgcctgtgacagaagaaaaagctgccaccttgtccgttggggatgtcgtcaagcttgatcatcaaggcgaaacctacggcctattaactatcgaggatatttaccaaccagataaagaattggaggctgaaaatgtttaccggacgaccgaccttgcccaccctggggtgaagaagttatttgatcgtccaaacgtctatattggtggtccaattacgttaacgaaacgggtggagcggacgaaattctcaagttactatcttgatccaaaggaaacgagagccgtttttgcagaaaaaggctggaaacgtgtggtcgggttccagacgagaaaccccgtgcaccgtgcccacgaatatattcaaaaaacagcccttgaaattgtggacggtcttttcttaaaccctcttgttggggaaacaaaagcggacgatataccagctgatgttcgaatggaaagctacgaagtattgttagaaaaatattatccgcaagaccgtgtatttttagcggtattccctgcagcgatgcgctatgctggaccaagggaagcggtcttccacgctcttgttcgcaaaaactatggctgcacccactttattgtagggcgtgaccatgcaggagtaggcgattattacggaacgtatgacgcgcagcttattttccatcatttcacaagagaagaactaggcattacaccactctttttcgaacatagcttttactgcaaggcatgcggaaacatggcttctacaaaaacttgtccacatggtaaagagcatcacgtcattttatctgggacgaaggttcgtgaaatgctcgcaaacggtgtgacaccaccgcctgaatttagccgccctgaggttgtgaacgtattgatcaaagggatgcaaaaaaaagtagaagtttaa

SEQ ID NO: 40905 - DNA, 609 bp, Bacillus halodurans
atgggaacgtccaatcagccgcacattgtgtggcatgaagcgagtgtgtctaaagaagaacggcaaaagcgaaatcgtctaaaaagttgtgttgtttggttcactggtctttctggttcggggaaatccacgcttgccaatgccttagatcgaaagctttttgaagaagggattcatagttatgtattagacggggataacattcgtcacggtttgaatgcgggactaggctttagtgaagaggatcggaaggagaacattcgccggattggagaagtggccaaattgttcgtggacgctggagttgtcacatcaacagccttcatttcaccatttcgcgaagatcgtgacaatgttcgagggattttagatgatggagagttcatcgaggtgtatgtgcgctgtccgctcgaaacttgtgaaaaacgtgatccgaaagggctctataagaaagcaagaagcggtgatattccggaatttactggtatcagttcaccgtatgaagagcccgtcaatccagagctcatcattgatacggatcagttagcggtcgaggaagcggttgaaaaaatttatgcctatctacatgcacaagaaagtggaaaataa

SEQ ID NO: 40906 - DNA, 1371 bp, Bacillus halodurans
atgaaagtaacgaagtttggtggaacatccgttgcgagtgcagagcaaattcgcaaggtggctacgattgtagcagatgatgtggagcgtaaaattgtcgtcgtttcagctcctgggaagcggcattcaagcgatacaaaggtgacggatttgttaattcgtttaggagaaacgtacttagaaaagggatatgcgaatgaggagctagaggcggttttacgacggtatgaagaaattgctaaagggttggagctcggccaagagatcattgatcaaattgcgaacgatttacacacaaggctaacctttaaccaaagcaaccccggtgcatttatggatcaactcaaggcaagcggggaggacaacaacgcgaagttaattgctgcctatttgcaaaccaaaggaatgaatgcagtctatgtaagcccaaaggaggccggcctgttggtcagtgatgaacctggaaacgcccaagtgttacctgaggcgtatgaccatttaaaaaagcttcgtgaacgtgacgaaatgatcgtattcccaggtttttttggtttttctccagacggagctctcgtcacatttccgcgaggaggctcggacattactggagcgattttggccgctggggtgaaagcggaactgtatgagaattttacagacgtggattccgtgtttgctgcgaacccaaatgtcgttgaaagtccggcgcaaattcggcgcatgacttatagagaaatgcgggagctttcctatgcgggcttttccgtctttcatgatgaagcgttaattccagcatttcggcaaaagattcccgtttgtgtgaaaaacacgaacaatcctagctcaccaggaacaatgattctagcagagcgagagtactttttaaatcctgtcatcgggattgcggcagataaagggtttgcgactatttatgttcgcaaatatttaatgaaccgtgaaatagggttcgggcgtcggctgttgcaaattattgaagatgaaggcctttcatatgagcatatcccgtcaggaattgatgatgcctcggtcattcttcggcaggagcaactgacggatgaaatcgagcatcggatattagcacgaataaaagaggagctttgtgtcgacgatgtgtttgttgaaaaggattttgctatggtgatgatcgttggtgaaggaatgcataacactgtcggcatttcagcacgagccacggctgcgcttgctagagctcatgtcaacattgaaatgattaaccaaggatcgtctgaggttagtttagtgcttggcatacacgagaaagacgccgatgcggccgtccgtgaattgtatgaagaatttttcggtggtgccgaggaaacggttcaataa

SEQ ID NO: 40907 - DNA, 825 bp, Bacillus halodurans
ttgaaaatggaagctagacagaaacagaacagcttcactagtaaaatgcaaaaaatcgtgaatcatcgggcgtttacgtttacggtgatcgcgttaattctttttaatgcccttatcgttggaatcgaaacctatccacgtatttatgctgatcataaatggttattctatcgaatagatcttgttcttctctggatcttcacgattgaaattgcgatgcgctttttagcttcgaatccgaaatcagctttttttcgaagttcatggaattggtttgatttcttaattgtagccgcaggtcatatatttgcaggtgctcaatttgtgacggttctccgtattttacgggttctcagggtactacgggccatctcagttgttccatcgttgcgcaggttagttgatgcgttggtgatgacgatcccggcgttaggaaacatcttaatcttgatgagcattttcttctatatttttgccgttatcgggacgatgttatttcagcatgtgtcgcctgaatatttcggtaatttacagcttagtttgttaacattgttccaagtggtcacgctagagtcatgggcgagcggcgtcatgcgaccaatttttgccgaagttccgtggtcttggctttattttgtcagctttgtcttaatcggtacgtttatcatctttaacttgtttatcggtgtaatcgtcaataacgttgaaaaagcagagttaacggacaatgaggaagatggtgaagccgatgggttaaaacaagaaatctcagccttaagaaaagacgtagccgagctaaaaagcttgcttaaacaatcgaaatga

SEQ ID NO: 40908 - DNA, 840 bp, Bacillus halodurans
atgctacaagatcataagatcacctttttaggggctggttctatggccgagtccatcattgccgggcttttgtctaaaaagctccttctcccttcccaagtgatcgccacaaacctatgtgatgaagcaaagctaacaaaactcgaagatcgttatgggatttgcaccacgcaaaatcgccaagaagctgtacgccaaggaacgatcatatttctagcgatgaagccaaaaaacattgaagaggcgattgaagaaattcgcggcgaaataacagagaaacagctgtttatttccgtactcgcgggcacaacgacctcctacatcgaaacgttgcttgcacatgaggtacctgttgtccgaacgatgccaaatacatcagcaaaagtcggggcatccgccacaggattgtgcggtggccggtatgctaacgcctctcatgtaaagctagcgacccttatatttacggccatcggtacagtgacagaagtaacggaggataaacttgacgctgtcacgggacttgccggtagcggtcccgcctacttttattacatggtagaagcaatggagcgagcggcggtacaatctgggcttacagaaagcgaagcgaaagccttcatctcccagacgcttattgggactggcaaacgacttgagcaaacatcgaaaacggcagaggaattatataaggaagtgatgagcccaggggggaccacagaggcaggtcttcgcgttctcgaacagcagcaaatgcagcaagcaatcgaagaagctatcactgcagccataaatcgttcacgtgaactcggttccaccccttcattggaaattaaaaagtag

SEQ ID NO: 40909 - DNA, 1251 bp, Bacillus halodurans
atgagtgaattgattgaaaaagcaaaacaggcccaacaagcgagtaaacaattggctatattgacaactgaagaaaaaaaccgtgcgctaaaacaaattgcagatcagcttttggtagaacgcacatacttaatcgaagaaaatcaaaaagatatcgaagctggtcaacgtgcgggaatcagtcaaacgttactcgaccgtttattactaacggatgaacgggttcaagcaatggcggaaggtgtagagcaagtgatcgcgttagatgatccaatcggggatcaaatcgatgagtttactcgtccaaatggcttgaacattcggcaggtccgtgtcccactcggggtcattgggatgatttacgaagcccgtcctaatgtcacagtggatgcctccgttctttgcttaaaatcagggaacgctgtccttctgcgcggtagttcttctgcactccattccaacaaagcgctcgtctctgtcattcatcgcggactggaagctgcaaatgtgattccaaaggacgccgttcaacttttagaagacacgtcccgggaaacagcgaaagagatgtttaagctaaatgactatttggatgttctcattccacgtggtggggcaaatttaattcagtcagttgtaaaagaagcctcggtccctgtattagaaacaggtgttggaaactgtcatgtgtatatcgacgaatctgctgacccagaaatggcagttgcgattgcagtcaacgcgaaaacacagcgcccttctgtctgcaatgcagcagaaacaattttagtacacagcgcatgggcaaaggaacatgtaagcaaattaatagaagagttgcgtataaaagaagtacaaattgcaggagatgaacaaataaaagccgtcgcgccattcgtaaaaccggcagatgagtccgattggggaactgaatatttagacttgcaggtggcaatgaaaatcgtcaactctgtggatgaagccatcgctcacattgatcgctacggttcaaagcattcggaagccatcgtaagtgaaacggatgccaacgtacgtaagtttttaaccaatgtcgatgctacaacagtctatcataacgcctccacccgttttaccgatggctttgaatttgggtttggagcagaaatcggcatcagtacacaaaagctacatgctcgtgggccaatgggtttacgcgccctgacatcaagcaaatatgtggtgcatggtacaggacaaatcaaaaagtag

SEQ ID NO: 40910 - DNA, 780 bp, Bacillus halodurans
atgagaaagaaaacaatctttattacgggtgcttccagtggactaggacgacagcttgccattgacttttcgtgggaagagacggtgttatgtttgtttgcccgttctcaagaacgtttagaaaatgtccagcgaattgttgtcgaaaacggaggcgaagcccatatttatcccgtagatttggctgatccacagtcgatagatcgctcgtttgcagaagccatcagcgccgttggtgtggttgatgtactaataaataacgccggttatggtgtgtttgaacctttctgtgatagtcagatggatgagaatgaacggatgtttcgtgtcaatgtattcggcttgatgcgagcaacagccgctgtcttaccgacgatgcgtgaacaaggaagcggtcatattattaacattgcgtcccaagctggaaagattgctacagccaaatcagctatttactctgcaacaaagcatgccgttttaggatttacaaacagcctgagaatggagttgaaagggacagggattcatgtctcagctgtgaatccaggaccgatccaaacgccattttttgatcaagcagacaaggaaggcgcatatacttctaaagttcagcgaatcatgctcgatccagaagatgtatcagaaaaaattgtgcaattaacgaaaaagccaaagcgcgaattaaacctaccttggtggatgaacattggagctactgcttatcaggttgcgccccgtctattggagcttttagcagggaagcaatttcgtcaaaagtaa

SEQ ID NO: 40911 - DNA, 732 bp, Bacillus halodurans
atgacaaagcggatcgttttagtaacaggagcggcacaagggattggtactgagatcgcggcagcgtttgcagcggctggagatcgggtcattcttgcagatgtcaatgttgataaagggcatgaagcggctgaacgaatcacgcaaaatggagaggcgcgatttatacattgcgacgtaaaaaacattagtgagattaaccatttgttcgctcaaatcagaggcgaggaaggtagtcttgatgtcctcataaacaatgctgggatttccatctggaaaaacctctttgacgtcacagaggaagcatgggatgaagtgattcacacgaacgtaaggagtgtatttttctgttctcaacaggcagcacggctcatgaaagaaggtggagcgattattaatattgcctccactcgcgcgttcatgtccgagcctgattccgagatgtacgctgcagcgaaaggaggagtcattgctttaacccacgctttggccgcctctcttcagccttataatatacgtgtaaactccattagtcccggttggatccatacgggaaaaagggaggagcttcgtccaattgatcataagcagcatttttctaatcgggttggaaccccagcagatattgcctctgcgtgcttatttttggcgagtaacgaacaacaatttatcaacggtgaaaatctaatcattgatggaggaatgacgaagaaaatgatttatgaaccataa

SEQ ID NO: 40912 - DNA, 864 bp, Bacillus halodurans
atgaccaaacaatacccatcaagtcaaccaccgcaacatcagatgaaacaaccgggcattgagcaagagatgaaccctcgtccagtttttgatcgggcagattaccgagggagcggaaaattgtcaggaaaggtagctctcattacaggaggggatagtgggattggccgggcagttgcagttgcctttgccaaggaaggtgccaaagtcgctatttcttacttagatgaacacggggacgcgaatgaaacaaagcagtatgtggaacagattggcggagtgtgccacttgcttccaggggatgtgggtgaagaggctatctgtcaacaaatcgttcaagagactgttaaccaatttggacgtttggacattgtcgtcaataacgcagcagaacagcatccacaagcagggcttgaagcgatcgattccactcagttagaacaaacgttccgcacgaatgtattttcctttttttacacaacgaaagcggcccttcctcacttgcagcaaggggcttccatcattaatacaacgtccatcacagcctatcaaggaagtaaggacttaattgattatgcgtccaccaaaggagcgatcgttgcccttactcgttccttgtcagaatcgatcgttggacaagggattagagttaatggtgtcgcgccaggaccaatttggaccccgctcattccagcaagctttgacgcacaaaaagtggcacagtttggcagtgatacaccgatgaagcgtgcggggcagcctgaagaattagccgctgcctacgtttatttggcatcagatgactcatcatatgtcagcggtcaggttcttcatgtaaatggtggagttattgtcaatggataa

SEQ ID NO: 40913 - DNA, 1320 bp, Bacillus halodurans
atgttttttcacggaacgagtcgtgtcaatggaaagggtcatctagaaatcggaggtgtggacacggtcgaattggccaatctgtatggaaccccattgtttgtttacgatgtggcactcattcgtgaacgagcaaaagatttcaaacaagcctttgcagatgaaggagttcaggctcaagtggcgtatgcgagcaaggcgtttagctgtattgctatgtttcagcttgctgaagagctaggcctaagtcttgatgtcgtttctggcggtgagctgtacaccgcgcagcaagctggagtatcgatggaacgaattcattttcacgggaacaataaaagccgtgcagagattgagatggcggtagaagcgggaattggctgctttgtcgttgataatttttatgaacttgacctgttagcagacatttgtgagcaaaagcgggcgactgcaaatattttattgcggattacgccgggggttgaagctcatactcatgactacatctcaactggtcaagaggattcaaagtttggttttgatcttgtgagcggccaagccacgcttgcggttaaaaaagcgttagctgtcgactccattcatttgctcggtgttcatagccacattggatcgcaaatctttgaaacaactggatttgtcatggctgtcgaaaaaatatttgaacatttagttacatggcgagaagaccatggattcgaaccatcggtgttaaacttgggaggcgggttcggcatccgttacattgaaggtgataccccgcgtccagtcggtgattatgttaaagaaatgatccgcgcggtaaagcagcaaattgcagaacatgaaatgtcgatgccggaaatttggatcgagcctggtcgttcgcttgtcggcgatgcagggacgacgctgtacacgatcgggtcaagaaaagaaattccgaatgttcgccattacttgtccgtcgatggcggcatgagcgacaatttgcgcccagccctctatcaagctgaatatgaaggggcgctcgccaaccgtgtgaacgagcagccggtagggatgttttcggttgctgggaagtgctgtgaaagtggcgatatgctcatttgggatttaccattaccagaggcaaaccacgaagacattttagccgtcttttgtacaggagcctacggctactccatggcgaacaattacaaccggattccgcgcccacctgtcgttttcgttgaggatggcgacgcccagcttgttattcagcgagagcgatacgaagacttagtgcgtctcgatatgccactagtaaaaaaggtgaaagtatag

SEQ ID NO: 40914 - DNA, 1986 bp, Bacillus halodurans
atgctcctattatctctcattgccttgacatcaaacttttgttggtggggattttttgtagtaactggaatcaaagtactcttttatccatttgacttgatcatctcaactacttgctttgcggctgtgtggtttcgacgctattttacgatccaaagaaaaacggataagcttgttgaccagctgaaaagagcgaacaaaacgaaggatgattttctcgccaatacctcgcacgaattgcgaaaccccctccatagcattcttaacctatccgaagggattttagagagggagaaacgctcgttaaacgaaaaaagtgtggctgacttaaaaatcgtgttatctgttgggcgccgaatgtcgttcatgctcaacgatttgctcgacgcgatgagtcttaaggagaatacaccccgacttatgctccaacacctatccattcatacaattgcaaacggtgtattagagatgtttcgatttatggtagaaggaaagcctatacgtctcaacaatcaaattcctgaaaacatcccaaatgtacttgcggatgaaagtcgggtcattcaaatcctgttcaacctcgtgcacaatgcggtgaaattcacgcgagagggggaaatttctctcgaagcttatgtaaaagacgatcgtgtctatatcgccattcgcgatacgggcatcgggatggacaaagacgccttgaagcgagtattcgatccgtatgaacaagtacggtcagaggagacgatggtggaaggaggcttcggtcttggacttagcattagtcaaaagctcgtcgagttacacggaggaatattaacagtccgttcaacgccaggtcaagggtcggtcttcacatttagtttgcagatatcgaagcaaacaggattggcagacgataatcaccttctcgtacagtcagatcgagagaatgaactagcagctgctacgctttcgaagccaaccatttctccagtggcctatcgtcctagaatccttgtagtagatgatgaaccagtaaacttgaaagtcattgcatccattctcgcaaatgaggcatacgaggtaaaaaccgtcataagtggagaagaagcgattgccgttttggatacaaaggaatgggatttggttgtcgctgatgtgatgatgccaaaaatgtcaggttatgaattaacaaaaaacattcgtcaacggttcacgcttaccgagcttccgattcttcttatcacagcaagaagccgtccagaggatattgaaaatggcttcagggctggagcaaatgactacttaacgaagccagttaacctcttagaattaagggctcggataaaagcattaacagaagcgaaacaatcgattcgggatcaattgcgaatggaaggagcgtggctacaggcacaaattcaaccacatttcttatttaatacattaaatgcgatcctggctttaagcgaaatcgacattaaacggatgcaaaaactactcgaagtttttgcggactttctaaaaaataaattcacattcacaaacttggatgagttagcaccaatagaaattgaattaagcactgtccaatcatacttatatattgaaaaggagcgattcgctcaacgattaaatgttcggtgggaagtggaggattgcaaggctctcatgattccgttgttcacgatccaacccttagttgaaaatgcagtcaaacacggactcaatcgatccagtgggggcgaaattacaatcaaaataaagaacgaggacacatacgtaaaagtgacggttaccgataacggtgttggcatggatgaaaatatagttcaacatctcctgacagagcgcccttctgctcgatcagggatcggcctccgcaacactgacatgcgactaaaacggcattacggcaaaggcttgcacattgaaagtaaacttggcgtagggacgtccgtatcctttctcgttcaaaagcaaatggtacaagctgacgtttag

SEQ ID NO: 40915 - DNA, 1404 bp, Bacillus halodurans
atgaactattcgttggctgtcgacattggcgcttctagtggaaggctaatcgttggagagtgtaacaaaaaaatccaattaaccgaaattcatcgttttgaaaaccaaatcattgagaaaaacggacagttttgttgggacgtggacgctctattttcagagattaaaacaggactcaaaaagtgtcgcgaggctgggattgagcctgtatcgatgggaatcgatacatgggcggtcgattttgtcctccttgatgagcacgacaagccgttaaccgacgccgtttcctaccgagatcctcgcactgatggcgtgatggaagaggttatcgagcagtttatgaaggagcgtttatacttagaaacgggaattcaatttcaacagttcaatacgatttatcagctgtatgctttaaagaaacaacatcctgacatttttaaaaaagcaaagtcgtttttaatgattcctgattattttcactttttgcttacaggaaaaaaagcgaatgaatatacaaatgcgacgacgactcagctcgttaatgcgtttacaaaaaaatgggacaaagacattatcgaagcgttagggttcaaccccgatatgtttcaagaaatcaaattaccaacagaatcccttggaaagttgaaaagtgaatgggtagaagaggttggttttgaccttgaggtgatcttgccagctactcatgatacgggctcagctgttgttgccgttccgaaagtggcggacaccatttatcttagctcgggaacgtggtcactcattggagtagagaattcgtttccaatttgtgtaacaaaagcgttagattataatttcacaaatgaaggtggaatgaactaccagttccgttttctaaaaaacattatgggtctttggatgattcaagaggtgaggcggaactacgacaaccgttactcatttgctcaattagttgagctttctaaagggatttcgtttaaatctactgttgatgtaaatgatcctcgattcttaaagcctaccaacatgatcaaagaaattcaacgctattgtcaagaaaccggtcaacaagctccggagctccccggtgaagtagcaaagtgcgtgtttgaaagcctcgcagaaagctatacgagcgcagtcgctgaaatcgaagacatttttgaaaaagattttaaatctatcaacgtcatcggtggtggttgtcgtaatgaattacttaaccagctcattgctgatcgaacgaaaaaagatgtatttgcaggcccgattgaggcaacggccattggaaatctcgtagcccagtggatggcgctaggcgaaatcgaatcgatacagcaggcgcgaaagctgatttatgactctttcgacgtgaaacggtacgtttcggcagatagggaatag

SEQ ID NO: 40916 - DNA, 1113 bp, Bacillus halodurans
atgcgattacctaatcatggcgctaacccaaaaacactcgctacccaaatggggacaagtttgactggggaggccattgattttagtgtcaatacgaacccgttcggcccgcccccacagttactagcttacttgaggaaacagctagatcaaggactgtttacccaatacccagaccaagaggcaagcgagttagcccgtgcgattgccataaaagaacatgtacctccttccagtgtgcttgtagcgaatggagccgcgcaaatcatttatacgattgcccagctatggcataagcagcgagtggccattgttgaacctacgttttcagagtatgaagaggcgtgcttggcaaatgattgttcggtcgaacggattatgctaccacctccatggtctcttgatctagaccgtatgaccgctgtgctcaagcggacagacctcctgtttatatgccatccgaacaatccaacgggtgtcgcctatcgtaaagagcagctcatcgaactgttagagcttgcaaagcagtttggaacgactcttgtcattgacgaagcgttttatgactttatggaagttccgattacgtttaccgctcaagcggctgcaaacgaagggatcatcgtcgttcgttcgatgacgaaaatgtttacaattcccggactaaggcttggatatgccatttcagctcctagtgtcatagaaaagttgaaaagcaaaattccgccttggagtgtaaacggattggcggataaggctgggcagttttgtttgcgggagacaatgtttgtccgcgattcagcgcaaagaattgctgcagccagggcagagatgcaagcaggcttcaggcatcttggatttgacgtttctccatcggtagtcaattttttcgtcatatctgatccgagagagtcgattgggatgctggcgatgcttaagggattacttgaccgcggatttgtccttcgccatacggaaaattttcctgggcttgacggccgatatcttcgcgtggccgttaaagatcaagatacgaaccggaagttgctacaggcagtaaaagattgggtggaaggtgagacgtcatgtttgtcttcatttcaggagcggtga

SEQ ID NO: 40917 - DNA, 1476 bp, Bacillus halodurans
atgaatttggaacaagaattacataaatggtttggataccattcgttccgctcaggacaaaaagaagtgatagaagcgctagtggaggggaacgatgtgtttgcgatgcttccgacaggtactgggaagtccatttgttatcaattaccggcgcgaataacagaaggggtaacgctcgtcatttcaccactgctttcactaatggaagatcaagtgcagcaactgaaatcgaacggctggaaagacgtggcggcgcttagtagctttctgtcaaaaggagctaaggagcgaattattaaacagcttcatctgtacaagctgttgtttctctctcctgaaatggtgcagcaccctgtcgttttcaagcggttaaagcaagtgaaggtgtcgtattttgttgtggatgaagcccattgtatttcccaatggggacatgattttcgtccagacttccttcgcctctcagacgtgaaacaccagcttgggaatccaccatgtttggcgttgacagcaacggctaccccagctgttcagcaagacatcttaacccaattatcgattgatgaggcagttacgattgttcatagtgtggacaggccaaacatatccatttcggtagagcaaacaccgaccgtaaaggataagcttgaagtaattcgggggattattgagcgacatagcggggcggggattatttatttttcaagccgtttatggagtgagcaaatcgctagggagcttatgttgaatgtcaagaaacgagtggccttttatcatggggggatgagcaacgaggatcgaatcttgatccaacagcaatttatggcgggagagcttgatttgatttgcagtacgagtgcatttggaatgggcattaacaagcaagatattcgctttgtgattcattaccattacccgcagcagatcgcctcatatgtccaggaaatcggtagagccggtcgtgatggacttgcgagtagcgcctatgtgctgttttcggaggaggataagggattagctcgttcgctcatgacacatgatcacccgtcaaaggatgaaatcattcaaatgattcaagattgtcaaacaactgaagtgccttcatatggcggggatgtagcgacggcacacagattcgtccgcttcttgcttgagaggtttaagaaaaggaaccggaccgttgatgatttcgtatccattgtggaatcccactttcaacagcgcgagcgaataaaggcaaaagaactatacttagtcgaagaatggttacagacaaaggaatgccgccgggaaaggcttctgtcatttttttcagaacaactgacaagccggcctgtacggtgctgtgataattgtggtttaaaagaccagccaggtgagcaagcctctgccatcatagcagtggatcaaacagtgccgcattggcgcgagcgtctagccttattgtgccatcaatcgaaaggagggcggggatga

SEQ ID NO: 40918 - DNA, 1266 bp, Bacillus halodurans
atggaagataaagacaagcggtcggggaaaacaacagacgtgcttgcttctacgcaaacagtgattaaaaaggcgcttgataaattaggttatccagatgaaatgtatgagttgatgaaagaaccgattcgcatgttaacggttagaattccggtgcgaatggatgacggttcaacaaagatatttactggctatcgggcccagcataacgatgcggtaggcccaacaaaaggcggtgttcgcttccatccaaatgtgacggaaaaagaagtgaaagcgctttctatttggatgagcttaaaagcaggaattgtcgaccttccgtacggaggaggaaaaggcggaattgtctgcgacccgcgggacatgtcgttccgtgaactagaaagactcagtcgcggctatgtgcgggcgattagtcaaattgtcggtccgacgaaggacattccggcaccagatgtttttacaaactcacagatcatggcatggatgcttgatgaatatagccgaatacgtgaatttgattcaccgggctttattacagggaaaccaattgtccttggaggctcacacggacgggagtctgctacggctaaaggggttaccatttgcattcgtgaggcagcgaagaaaaaaggtatcgatcttcaagatgcaagggtcgtgatccaaggcttcggaaacgcaggaagcttcttagcaaaattcatgcacgatgcaggagcaaaggtgattggaatttcggatgcttatggagctcttcacgatccagacggccttgacattgactatttgctcgatcgcagggacagctttggtacagttacaaagctcttcaaaaatacgatctcaaatgaagagctattagagttagattgcgatattcttgtaccggctgcgatagaaaatcaaattacggaaaaaaatgcgcataacattaaggcacaaatcgtggtcgaagctgcaaatggtccgacgacgattgaagcgacggaaattttaacaaaccgcgatattcttctcgtaccagacgtactcgcaagcgcaggtggcgttaccgtctcctactttgaatgggtgcaaaacaaccaagggtattattggacggaagaagaggtggaaggaaagttagaagctgttatggttcacgcttttgataacatctataagctggcgaaaggacggaaggtggatatgcgtctagcagcgtatatggtcggcgtaaggaaaatggccgaagcatctcgcttccgtggctgggtataa

SEQ ID NO: 40919 - DNA, 1137 bp, Bacillus halodurans
atgaatcgtaaagaattagaaacagctttagtacaaatcggaaatcgaatggatgatcgaacaggtgcgatcaacacgcctgtttacttttcgaccgcctatcgtcactccggaattggcgaatccactggctatgactatgcacggacagggaatcccacgagagaagtgcttgaaaaggcgattgctacgttagaaaacggagatcaagggtttgcctgtagttccggtatggcagctatccaaacggtgttttctctttttcaatcaggggatgaaattattgcttcccaagatttgtatggaggaacgtaccgcttgtttgaaggtggctggaaaaagtgggggctttctttctcctatgctgatccgcgaaatcttgcagcgttagaacagcaaataacagaaaaaacgagggcgctgtttattgaaacccctacgaatccactcatgcaagaagcaaatattcgtgagcttgccgcccttgctaataaacatgggttgctgctgatcgtcgataatacgttctatacgccacttttacaacaaccattaaacgaagggacccatatcgtcatccatagtgcgtcaaaatacttaggcggacacaatgatgtcatcgctggattgattgttgccaaaggacaagagctatgtgagcagatcgcctattaccataacggaattggcggaacgctctcagcctttgattcatggttgctcattcgtgggatgaaaactcttgctctacgaatggagcagcatcaaaacaatgcgagggctatagcgtcttacttagaaaagcatgaaggagtaacggatgttctttatcctggacggggtgggatgctttccttccgcatccaatcggagagctgggttaacccgtttttacaatcgttgaagctcatttcatttgcagagagcctagggggagtcgagagcttaatgacctatccggcgacgcaaacccatgccgatattccagaggatgtgcggatcgctaacggtgtatgtaatcgcttgttgcgattctcagttgggatcgaacatgtgggtgatttgattgccgacctcgatcaagcgttcaaccgtgtcatcgagcagtcagcggtgaaaggaagtgaagcacagtga

SEQ ID NO: 40920 - DNA, 1173 bp, Bacillus halodurans
gtgagcgaacagtacagcttgcaaacaaaactacttcataatgagcataaggttgaccaggcaactggtgcggtaagcgtaccaatccaacacgcttctacgtttcatcagtttgactttgatacgtttggaacgtatgactatagccgttcgggtaatccgacacgggatgctctcgaagcggcgattgctgagcttgagggaggcaatcatggatttgcgtttgcttctgggatggctgccatctccacagcgtttatgcttctatcaaagggcgatcatgttgttttaacgaaagatgtgtacggtgggacatttcgccttgtaacggaagttttaacccgacttggaattgaacatacatttgttgatatgacaaacttggcagaagtggcggcggccatcagaccaaatacccgtgtcctttatatggagacgccatccaatccaacgttgaacattaccgacattcgcggggtcgtttcgctggcaaaagaacacgaatgtctcacatttcttgacaacacctttttaacaccagctttgcagcgaccgctagaacttggtgtcgatgttgtcctccatagtgcgacgaagtttattggaggtcacagtgatgttgtcgcagggctggcggtgacgaagaatgaagaactcggaaaaaagctcgcctttttacaaaactcgttcggcgctattttaggagttcaagacgtatggctcgttctccgaggtctgaaaacacttcatgtgcggatggagcacggagagaaaggagctcagcagatcgccgaatggcttcaaggcgttccggaagtgaagcgggtctactaccctggtttaaaagatcacccaggacacgaattgcaaaaaaggcaggcggaagggtttggcgctgtgctatcgtttgagctagaaaatgaagaggcggttcgaaggttcgtggaacatgtaaagctccctgtttttgctgtcagtttaggagcggtagaatcgatcttgtcttaccccgccaaaatgtcccatgccgcgatgccgaaagaggagcgggaggcaagaggcattcgtgatggattgcttagactttcagtcgggttagaaaaaccggaagaactaatggctgactttaaagcggcatttgctcacgttcgaggaaaggtggaacatctatga

SEQ ID NO: 40921 - DNA, 1038 bp, Bacillus halodurans
gtgaaaaacgtagctgtcattggagctgggagctggggaaccgccctttcccttgtattggcggacaatggacatcatgtaacccttgtggcaaggagagaggaaatcgcacgagaaatcaacgaacgtcatacaaatgagacgtatttgccttccattgagatcccgagttcgatcgtcgccacctgctcaatggaggagatcatcgacgttgagattatcgttctcgtcgtgccgacaaaagcgatccgtcaagcggttcgttcattgaatgatgtattgaaatggccagtgacaatcgtacatgcaagcaaagggattgaacctggctctcatttacgaatttctgagatgatcgaagaagaattagagccaacattgttaaaagaggtggtcgtgttgtcagggccctctcatgcggaggaagtgagcttacgacagccgacgacagtgaccgtttcatcaaagtctctttccacgacaaaacaaattcaagatttgtttatgaatcaacagtttcgcgtctatacgaatgaggatctgatcggagtggagatcggcggagcattaaaaaatattatcgctctcgcttgtggtttaacgaatggtcttgggtatggtgataatacgaaagccgcgattatgacgagaggacttgcggaaatcggacggcttggagtgaagttaggggcaagcccgctcacatttgcaggattatcaggtttaggtgatttgatcgtgacgtgcacgagcatacatagtcgaaattggcgcgctggacaaatgctaggaaaaggaaaatctccagctgaagtagaagaaagtatgggcatggtcgtcgaaggaattcggacgacgcaagctgcccatgaattagcgcaaaagctccaaatcgaaatgccgatcacctcagctctctattctgttctttttgaagggaagaagccagagcacgcagcagatgaattaatgggacgggtgaagaaacatgaaatggaaaatcttcacgatgtcgtaagtgatcagaagaacgattga

SEQ ID NO: 40922 - DNA, 567 bp, Bacillus halodurans
ttgagcaaggtagaccatgaaaaaattcaacaagccgtcgtgatgatcttagaagcgattggagaagatccagctcgtgaagggttggaagatacgccgaaacgagtagcaaaaatgtacgaagaagtgtttgcagggttgaaccaagatcctaaagaacactttgcgacaatcttcggagaggatcatgaagagctcgtgttagtgaaagacattccgttcttctccatgtgtgaacaccatctcgttccatttttcgggaaggctcacgttggctatatcccaaaaggtggaaaagtgacagggttaagcaaattggcaagggcggtagaagccgttgcgagacgtcctcagcttcaagagcggattacatcgaccgttgcagatgcgcttgtggaaacgctcgagcctcacggtgtgattgtcgttgttgaagcggagcatatgtgcatgacgatgcgtggggttaaaaagcccggtgcggccacagtgacttcggcggtgcgaggaacgtttgctaacgatgcagcagcacgggcagaagtactttcgttaattaaaggctag

SEQ ID NO: 40923 - DNA, 972 bp, Bacillus halodurans
atgaaactagcagacatatatgcacattttcaggaagatatttttacgatcgagcgcgaactagaagaggcggttcaggctagacatgatattctacggaaggcctctgtccatttgttaaaggctggtggcaagcggattcgtccagtgtttgtgctgctggcaggtaagtttggcacatatgatgtcaacgtattaaagcatattgccgttcctttagaacttattcatatggcttctctcgttcatgatgacgtgatcgatgacgctgacttaaggcgaggaaaaaaaacgatcaagtctcagtgggacaatcggattgccatgtatactggtgattacatgtttgcgaaagccgtacaaacggcaacctatttcgatgatccaaacattcatcaaatcatttcaaatgctatcaacgagatgtgcctcggtgaagttgagcaaatccgtgaccaatacaacccgaatcaacatttgcgcatttatttccgaagaattaaaagaaaaaccgctctgttaatagcagtaagctgtcaattaggagcgctagctgcgaaggcagatccagcgattgtgcaaaagctatattacttcggttattacgtagggatgtcctttcaaattactgatgatgttcttgacttcgtcggtacggaagagcagctagggaagccggcaggaagtgatttactgcaaggaaatgtgaccctacccgctttgtacgctctccaccacgatatgcacgccaaacgattgattgaacaggtgttggctgatcgaggcaacaactcggttcatatggaagaggtcattgccgcgattgtgtcatctggaggcatcgattacgctctatcgatcagcgatctttatttgaaaaaagccatgcgaatgcttgatcatctacccgatgatgagccgaaacaatttttacaagaaatcgccaattatattggcagacgaaaattttaa

SEQ ID NO: 40924 - DNA, 444 bp, Bacillus halodurans
atggaacgtacatatttaatgatcaaacctgatggagttcagcgcaatttgattggagagattgtttctcgctttgaaaagaaagggtttacattaatcggcgcgaaattgatgacggttacaaaagagcaagctgaaacacattatgccgagcataaagagcgtccattctttggggaattggtcgattttattacgtccggtccggtttttgcaatggtttgggaaggggaaaacgtgattgcaaccgcacggaaaatgatgggtgcaacgaaccctgccgatgccgagccaggaacgattcgtggagattttggggtccaagtagcgatgaatgtcattcacggctcagactcaccagaaagtgctaaacgtgaaattgatattttctttgattcttcagagcttaatgaatatgacaaggtcgtcaatcgctgggtataa

SEQ ID NO: 40925 - DNA, 1173 bp, Bacillus halodurans
atgaggtatttgacagcaggggaatcacacggtccccaattaacgactattattgaaggtgcgccagcccaactagagctggtagccgatgacattaatgtcgatttagctcgtcgacaaggtggtcacggccgtgggagacgaatgcaaattgaaaaagatcaggtgcaaatcgtaggtggtatccgtcacggtaaaacgacgggtgcaccgattgcccttgttgtagaaaataaagattggaagcactggacgaaaatcatgggcgcagaacctcttactggcgacgaggagaaagagatcaagcgaaaaatcactcgtcctcgtccaggacacgctgacttaaatggcgctattaaatatggtcatcgcgatatgcgaaatgtccttgaacggtcctccgctcgggaaacaactgttcgagtagcagcaggagccgttgcgaaaaaaatcttgcgcacatttggaattgaagtgggaagccatgtgttagaaattggcggagtcaaggcggaaaaaacttcgtacgatcaattgtcgaacctaaaagagcttgcggaagcttcacctgtgcgttgtcttgacaaagaggctgagcaagaaatgatagcggcgatcgaccaagcgaaagaaaatggtgactcgatcggcggtgtcgtagaagtgatcgtcgaaggtgtaccaattggacttggaagccatgttcattatgatcgaaagctcgatgcgaaaattgccgcagcggtgatgagcatcaatgcttttaaaggtgtcgagtttggaatcggcttcgaggcggcctcaaagccaggtagtgaggttcatgatgaaattgcatgggatgaagagagaggctactaccggaaatcgaacaacctcggcgggtttgagggaggaatgacgaacgggatgccgatcgttgtccgcggggtgatgaagccgatcccaaccctttacaagcctcttcaaagtgttgacattgcgacgaaggaaccttttgctgcaagcatcgaacgttcagatagctgcgcggtgccagcagcagccgttgtagcggaagcggtcgtcgcttgggaagtggccaatgcccttctggaaaggtttggcgcggatcaagtagaagagattgaaaaaaacattcgagaattcaatgaaaaggcgaggttgttttaa

SEQ ID NO: 40926 - DNA, 969 bp, Bacillus halodurans
gtgaccgatgatcaagtggcagacctttatttggataccgtgaaatcaagcctgcataatcttgcccctttgcatgccgtcgtcttgccgaacggagaagagacgaaatcttttgataactattatgcgttgcaaaccgctgccctagagtatggacttgatcgaaagtcaatgattatcgcccttggcggaggggtaattggtgatttagctggttttgttgcggcgacctacatgcgcggaattgcttacgttcaagtgccaacgacgcttcttgcccatgatagcagtgtaggagggaaggtggctattaatcatcctcttggtaaaaacatgattggtgcgtttcatcaaccggaggcggttctttacgatccacaggtgtttgccaccttaccggagcgagagtggcgttctggttttgcagaagtggtgaagcacggattaattaaggatgccgcgttttatgcatggttacagaagtatattaacgatttttctcggattcaaggagaaatagccgaggagcttctgctccgttcgattcaagtaaaggccaatatcgtggcagcagatgaaaaagaaaaaggggaacgagccttattaaacctcgggcatacactcggacatgcgattgaagcggagctcggctacggaaaaatcactcacggcgaagcggttgttatcgggattatcttcgccatgaaactgagtgaaaaagtgtaccatcaatcgctaccgatccaagacctagaaaaatggctcaaatttcttggctatgaaacgaggattccaaaagggcttgatacaggtgccctcatcggaacgatgaaaaaggacaaaaaggtagagcgtggagtgatccgttttgtcttgcttgaggaagtgggtcatgctgtcatcaaagaggtagatgaacagctcatccgagagctattgaatgttgaaatagaggaggagacaacatga

SEQ ID NO: 40927 - DNA, 657 bp, Bacillus halodurans
ttgcaaccgatgcttaaatattgcggaaaccggtcgctggaagatgttcaagcagctgccacttcaaaagccgattatttagggtttgtgtttgctaaaagcaagcggcaagtgacggtaaatgaggtgacacgttggcttgatcaggtcaatgtaaacgggaaaaagctagtcgccctatttgtcaatgagccgattgatcaaatcgtaaatgtagtgaagcaaggcccatttgatgtgattcaatgtcacggtacggaaaaccgagactacatcatgacgttaaaggagcgaatcgacctccctgtgtggaaggcgatccaccattcaggtcaagggctgcagatgatgagagctctagaaggggttgtcgaagctttcgtcgttgatgcaaaggtcgaaggtcagtgggggggcacgggtcagtcatttgactggcacgtagtccctctctatttacaggaaggcaagagacagcaggttcctgtatttattgcagggggaatcaatccacataatgtggagctgcttcttccttatggaccatgtgggattgatatttcaagtggaatcgaggaaaatggacaaaagagttcggcgaaaatttgtcaaattgaaaagaaggtgttaggcgatgacagtcacatatccagatga

SEQ ID NO: 40928 - DNA, 1110 bp, Bacillus halodurans
ttgaaaatcaagccgcaaattatcgggttgcctccatataagcctggaaagccgatggaagatgtgaagcgagagctcggattagagactgtcgtcaagctcgcttcaaatgaaaacccgtttggtgcatcgccgaaagtagcggaagcgattcaggaagcgttacatcatacggcgatttatcctgatggctatgcgcgaacattgcgggataaagttgctcattatgtaggggtagcaccggaagagcttattttcggaaatggctccgatgaagtcattcaaattttatgtcgtgcgtttttgaatgaacaaaccaatactgttatggcagaaccgaccttttctcaatataagttaaacgccgtcattgaaggagcagagcttcgcgaagttccactaaaagatggtgtccatgatttggatgggatgcttgaggtgatcgatgaaaacacgcggattgtctgggtatgcaacccgaacaatccgaccggtacgtacgttagcgctgaggcgtttcagtcgtttttagccaaagttcctgaggatgtgctcgtcgtttctgatgaggcgtatgtggaatatgtgactgcagatgattatcctgacacagttccgatgattcgtacgtacaaaaacctagtcgtgttgcgcacattttccaaagtgttcggtctagccgctttacgtatcggatatggcgtagccaatcaagcactcattgaaaaaattgaacctgttcgcccaccttttaacaacagcacgttttcgcaagtggcagctgtcgccgctttagaagacgaagctttcgttcaatcgtcggtggaaaaaaacaacgaagggatggagcagctaaccgaatggtgctcacgtatgggacttgattatttcccttcgcagaccaactttttgcttattcatgttaatcgttccagtgatgacgtgtttaatgcgatgttgaaaaaaggatacattattcgttctggacgggcgttaggttatccagcctggattcgtataacgattggctcaaaagaacaaaacgacggctgtctcgcagcactagctgatgttttagcagaggaattgacaacgcaacacctgtcgtaa

SEQ ID NO: 40929 - DNA, 1296 bp, Bacillus halodurans
atggaaaacaaaacagtaatccctcatgcgaaagggctaaaaggtacgattaaggttccgggagataaatcgatttcccaccgtgcggtcatgtttggcgcactcgccaaagggacaacaacggtagaagggtttctaccaggggctgattgcttaagtacgatttcttgcttccaaaaattaggggtatcgatcgagcaagctgaagagcgagtcactgtaaagggaaaaggctgggatggtctacgggagccaagcgatattttagatgtgggcaattcagggacgacgacaaggttaatcctcggtattttatctactcttccgtttcattcagttatcattggcgatgaatcgattggcaaacggccaatgaaacgagtcacagagccattaaaatcaatgggcgctcaaattgacgggcgcgaccatgggaacttaacaccactttcgattcgcgggggacagctaaaagggattgattttcactcgcccgttgcgagcgcacaaatgaaatcggcgatccttttagctggtttgcgagcggaagggaaaacgagtgtaactgagccggcgaaaacccgggatcatacggagcgaatgcttgaagcattcggagtcaacatcgaaaaagatgggctgaccgtgtcaattgagggaggacaaatgttaacgggacagcatgtcgttgtacctggtgatatttcttctgctgcctttttcctcgtagctggtgcgatggtgccacatagtcgtatcacgttaacgaatgtaggaatcaacccgacgcgagcaggcattctcgaagtgctcaaacagatgggagcaacgttggcgatggagaatgaacgtgtgcaaggcggtgagccagtggcggatttgacgattgaaacgtcagtgctacaaggagttgaaatcgggggtgatatcattccgcggttaattgacgagattccaatcattgctgtcttggccacccaagcgtctgggcgaacggtcattaaagatgcggaggagttaaaagtaaaagaaacaaaccgaattgatacggtcgttagtgaacttacaaagctcggggcatcgatccatgcgaccgacgatggaatgatcatcgaggggccaacgccattaaaaggaggagtgactgtctcgagccatggcgatcatcgcatcggcatggccatggcgatcgccgctttgcttgcggagaagccggtaacagttgaggggacagaagcgattgcggtttcttacccgtccttttttgatcacctagatcgattaaaatcggaataa

SEQ ID NO: 40930 - DNA, 795 bp, Bacillus halodurans
atgattaaagtagcggttgctggaccgagaggaaaaatggggcgagaggccgttaaaatgattcatgaagcggacacgttggagctcgtcgctgtcgttgactccaaacacgatgggatgttagttcgacagctagatgggcttccaccaagtgacgcacccgtctacaatgagctggagcgatgcttaacatcacaaacaatagatgtccttgtcgatttgacaacacctgcgcacggaaagcgtcatatggagatcgcgctcgatcacggcgttcgtccagttgtcggaacgactggttttaccgatgaagacataacgaatttgcgaaaaaaagcagaagaaaaaggaatcggagcgatcatcgcccctaactttgcaataggagcgattttaatgatgaagtttgcccaaacggcagcaaaatatttaccagatgttgagattatcgaaatgcaccacgatcgtaagctagacgcgccatcaggaacggcccttaaaaccgctcagctgattagtgaagtgcgcaaagcgaagcagcaagggcaccctgacgaaacagaagagcttaaaggagcacgcggtgcagactttgaagggatgtccatccacagtgttcgtttgcctggcttggttgcccaccaagaagttttatttggcggggttggtcaaacgttaaaaatccgtcacgattcgatgaaccgagagtcgtttatgccaggcgtgaagctttcaattgagacggttatgggaattgatacgttggtttatggccttgaaaatattatcgagtag

SEQ ID NO: 40931 - DNA, 1128 bp, Bacillus halodurans
atgaaacgaaaaattggaattagttgttatcctacagtaggtgggtcaggtgttgtggcgacagagcttggaaagctgttagcggaaaaagggcatgaagtccacttcatcacgtcaagcgttccatttcgccttgagccagtcaatccaaatatttattttcatgaagtagaagtgaaccaatactcagtgtttaaatacccgccctatgacctgacactatcgagtaaaatggctgaagtggcgaagagacaagagctggatcttctccatgttcattacgctgtaccgcacgccatttgtgccattttagcaaaacaaatggtcggggattcgcttaaggttgtcacgacattacatggaacggacataaccgtactagggtatgatcctgcattagcggaaattattaaatttggaattgaaaagtcagatttggtgacagcggtatctgatgatcttgtgaagcaaaccaaaacgctactacataccgagaaaccgatcgaaaccgtttataattttgtcgatccacgagagtattatcgtaaggatgtttcagaattaaaagcaacatacggaattggcgaagacgaaaaggtggtcgttcatgtatcgaatttccggcgtgtcaaaagggtccccgacattattcgctgcttcagaatcatccgtgagcacgtgaaagcgaaattgctattaattggagacggacctgacgctacattagcctgtcatttaattaaagagttagacttaaaggatgacgtgctcatgctcggtaaccagaagcatattcctgagttgatgtcccttagcgatgtcatgctgctcttaagtgaaaaagaaagcttcggactagttgcgttggaagcaatggcttgcggggttcccgtgatcggagccaacataggtggtatcccggaagtgattgtagatgaagaaacagggtatatttgtgaaatcggtgatattcaaggagtcgctcagaaagccattgagctattaacgaataaacgaagacatgagatgtttgctgaggcaagcatcaacagggctgcgactgttttttcgtctgagcaaattgtgcggcaatatgaagatttatacgagcagcttttatccgaataa

SEQ ID NO: 40932 - DNA, 1188 bp, Bacillus halodurans
atggagttagctaagcgagtttctaccttgacaccgtcatcaacattggcgattacagcaaaggcaaaagagttaaaggagcaagggcacgatgtgatcggattaggagcaggggagccggattttaatactcctcaatacattattgatgctgcggtacgatccatggaagaagggcatacgaaatacaccccatctggaggcttaccaaagttaaaggaagctattattgaaaagtttaagcaagatcaagggcttacatatacagcgaaggaaattttcgtcggtacaggggcgaagcacgttctctatacactgttccaagcgttgttaaatgaaggtgatgaagtgattatcccatctccttactgggtgagctatccagagcaagtgaagcttgctggaggggaacctgtgttcgtggaagggaaagaatcgaacgactttaagttaacaccagctcagcttgagcctgttcttacagaccgaacgaaggcgattattattaattcaccgagtaatccaacaggctctttatatacgcaagaggagttagcagcgttaggggaagtgtgccttaagcataatgtccttatcatctcagatgaaatttatgaaaagcttgtatatgatggagcaaaacatacatcggttgcggaaatttccccacaattaaaggaaaacacagtcgtaattaacggtgtttccaaatctcactcgatgacaggctggcggatcgggtacgcggcaggaccggaggcgctcattcaagcgatgaccaatctcgcgagccacagtacatccaatccaacgaccagcgctcaatatggtgcgattgccgcttacactgaggatgatggatctgtcgagaagatgcgagtggcgttcgaggagcgacttcacacgatttacgataagcttgtggcgattcctggtgtatcgtgcgtaaaacctaagggagcattttatttattcccgaatgtagaggaagctgcagcattaacaggtcacgaaacggttgacgactttgtgaaagtcttgttagaggaagaaaaagtcgccctcgtacctggctcagggttcggtgcacctgacaatgttcgtttatcctatgcaacgtcactggagctattagaagcagcgatcgaccgaattttccgcttcgtcgaagcgaaacgcagcaaataa

SEQ ID NO: 40933 - DNA, 852 bp, Bacillus halodurans
ttgaaacagtatactgtatcactagactggttatcggagcaccttgagggggtaaaggtcgtcgattgtcgcttttccttacaggattctgcagatggtttacgccgttatcaggacggacatatacaaggggcggtttattttgacctcgtgcacgatttgtcaggcacggtccaagaccatggtgggagacaccctctcccagaggtggatacgtttttagaaaaagtagaggcggcaggtattgatcatgagacgacagtggttgcctacgatgatgagggaggaccattcgcttcacgcttttggtggctgcttcgctatctcggccacgagaatgtctatgttttagatggctcgttctccgaatggcaagcggtgggttatcccgtggatcgaaatatccctatgtatgcaaaaacaacgatggatgttaaagtgaagccggagcgcctcgcgacctatacgtacgtaaaacagaacctgtccgacccagctgttcatctaattgatgcaagagagcctgcacgctttcttggaaaggtggagccgattgataagaagaaaggccacataccgaacgctaaaaatcgtttttggcaggacggcttgaacgggaagaagcgaaagagcgcaaaggagcaggcggagagatttgctgatcttccgaaagaggatgaggtcattgtctattgcgggtcaggtgtaacagcttgtccgaatgtattaacccttgaggagctcgggtataaacgtgtacgcttatacgtcggtagctggagcgattggatttcgcacgatgaaagtgaaattgctacgggtgaggaaggggaaagaacacgtgacaagtga

SEQ ID NO: 40934 - DNA, 1197 bp, Bacillus halodurans
atgaatcctcatatgatgatgaacgacaaagcacttggaacgaaagctgtatgggctggagaacgatcctttttagcccatggggcaacacaggtaccggtcgtccatagcgtatcttttgggtatgatgatgtggatgaatggtatgaagtagcaacaggtaaaaaagatgggcacatttacggtcgcaatacaaatccaactgttcaggcgtttgaagaaaaagtgcgggagctggagtttgcagaggctgccacaagctttgccacgggtatggcggcgatctcaaattcgttattgaccgtattaaagccaggagatcgtgtcgtctcgataaaagatacgtatggtgggacgaataaaattttttcagagtttttaccccgtttaaagatagaagtgacgctttgcgaaacaggagatcatgaagccctcgaaagggaaatcaccaaaggttgcactcttgtatatttagaaacaccaacgaatccgacagttaaaattaccgatctggaacgaatcacgtcatttgctcacgagcataatgcgctcgtgtttgttgataacacctttgcgacaccgatcaatcaaaatccactgcttactggagccgatttagtcgttcatagcgcaacaaagtttcttggcggtcatgcggatgctttaggcggtgttgcttgcggaaacaaagagcttgtatcggccatttaccattaccgagaaattaatggcgcaacccttgacccgatggcagcttatttgctgttaagagggatgaagacgttaaagctccgcgttgaaaagcagcaagaaaacgcaatgaaagtggcgagatttcttaccgaacatgacaaagtgagagctgtctactacccaggattagaaacccatcctcaccatgaggttgccaagcgacaaatgcgcggttttggcggtatgctgagctttgcgttaaaaggagagatggaagctgtgcggaaattcctcccagctttaacttacgctaatcgggcagccaaccttggagcagttgaaacgacggtcggccctgctcgaacgacaagtcatgtagagaacacgccagaagaacgggcagcactcggaattcctgaaggattggtccggtattcagctggaattgaagatgccgttgatcttatagaggatttgtcccaagctcttgactcgattacttaa

SEQ ID NO: 40935 - DNA, 1029 bp, Bacillus halodurans
atgacacaaaaagttgctttaattgggttcggcggtgtggcacaagggttcattcaaattttaagagagcggggcgaggagctcccagagcatatacaagtcgtttcgatcacggattggcgacggggggcggtacacgatccgaatggacttgatttggatttcattgcgaaaataatagaaaccgatgggacgtttgagcattatcctgaacggtctggcgtcataaagggatggaatagctttgaaacgattcagcaaacgaatgcagacaccattgtggaagtgaccttcaccgatgtgttaaccggacagccggccattgatcactgcaaggaagctctgcgtctcggtaagcatgtcgtgacgacaaacaaagggcccatcgctgttgcctatcaagagttaaaggagcttgccgatgcaaacggcgttcagctgctgtatgaaggaacggtgatgagtggcaccccggccctaaggctacctgaacatacattaattggtaacaacattcaggaggttaaaggcattctgaacggaacgaccaactacattttaacagaaatggaacgaggaaaaacgtttgagcaagctttgcaagacgcacaaacgctcggatatgctgaagcagacccgacgagcgacgttgaaggatacgatgttctttacaaagtagttatcctcgcaaatgtaatgatgggcattcctctgaagccatcagatgtggagcgtgtagggatttcccacttgacgcctcgtgatataaaggatgctcattcagcgggagaacggtggaagcttatcggtcgagtgaaaaaagagggggagcggacgatggcaaccgttaggcctgagcgtttgccgctcaccgatcctctcgccaatattaacggcgcgatcaatgcgattacgtatgaatgtgacatttctgggccgatcactttgattggagctggagctggagtgaaagaaacaggctttgccttattaatcgacttattgcatgtgaacagattaggggagtga

SEQ ID NO: 40936 - DNA, 1449 bp, Bacillus halodurans
atgcatacacaagtcgtacaagagagaatgctcattagcgatcaatggcagcacggccagcaatcaatagaggtgatagaccccggaacgaatcacgtcatcgctactgttccagcggcaacggaagccgatgcgaaggcggcgatcgaagcggcaaaagaaggagcggaaatagcacgtcaaatgccgatccatgagcgcgcagctattttgaaaagaacagcagaaattgtgacacgggatcgtgagctttttgcgcaaactattgcgaaggaagggagtaaaacgatccgtgaagcaagaagcgaagtaagacgttgcattgaaacgctcacattaagcggcgaagaagccaaacgattgcacggtgaaacgatccccttttcacaaatgcctggtcatgaaaggcgtgttggctacttttaccgttttccgatcggaatcatcgtggccattacgccgtttaatgatccacttaatttagtcgctcataaaatcggaccagcgattgcagctggcaacagtttgattattaaaccgtcaagtttcaccccgttaagtgcccttcgtctcgtgaaagcattggaggaggcaggattaccgaaaaaaattgtgcaagtgatcacaggacacggatcggtgatcggtcctaccttgacgaagcatagagatgttcgcttgatctcctttacaggtggctatgagacaggtgaaaaaattgcccgctcggctggtgtcaaaaagcttgcaatggagctcgggtccaattcgccgacgattgttttacaagatgctgagctaatggaggctgttgcttcttgtgtatccggtgcgttttgtgccgcagggcaaaattgtatcggcgttcaacggatctacgtggaacaatcggtatttaactcgtttatccaatcgtttgttgctcaaacaaagcaattacgacttggtgataaacaatcggaggagaccgatatagggccgatgatctcggaaaaggaagcgaaacgaattgagcgctgggttgaggaagcgaaggaggaaggagctcgggttcttacgggcggacggcgaaccggagcctacttcgagccaactgttttaacgaatgtaagcccaagttcccgattagcgaaggaagaagcctttgcccccattgtgatcattgagggtgtccattcacttacagaagcaatagcccgcgcgaatgatgtggattttggcttacaagcaggtttgtttacgaacaatttaacggctgctttttcggcaattgaaaagcttgaagtgggtggaatcatggtaaacgattcgagtgatgtacgaattgatgcgatgccatttggtggaataaagaagtcaggactcgggagagaaggggttcgctatgcgatcgaggaaatgacggagcagaaggtagtcgcttttcatttgcccgaacataaaatataa

SEQ ID NO: 40937 - DNA, 888 bp, Bacillus halodurans
atgaatatcggacggattgttacagcgatggtcacaccgttcaacgaacaggaccaagtgaacctagaagcgacctgtcaacttgtaaatgaattaattgccaatgggagcgatgcccttgtcgttggtggaaccactggcgaatcgcccacgttaacgacagatgaaaaaatggcccttttccacaccgtagtggaagccgcaggtggccgagttcccgtcatcgcaggaacaggctccaacaatacgagggcttcgattgagctgagtaaaaaagtagaagatttaggtgtggacggtatcatgctcgtgaccccttactacaacaagccatctcaggaaggcttatttcaacactttaaagccatttccgaatccacttccttaccaatcatgctttacaacattcccggaagaagcggtgtcaacttggatgcggaaacgacgctacgcctcgctgaactaagaaatattgtttcgattaaagaagcaagcggcaatcttgatcagattgctgaaattattgaacattctcctgcagactttagcgtctacagtggggatgattcattgacattaccgctcttatcgatcggcgggacaggagtcgtctctgttgcttcgcacattatcggtaatgaaatgcaggaaatggtgcaattatttttgtcaggacaagtagagcgggcagcagcgatccatcggaaactactaccgctcatgaaaactttatttatgacacccaacccaacggcagtgaaagctgctcttgaactaaaagggcttcctgttgggcatgtacgccttcccctcgttccgctaacggctgaagaacagcggcaattagagctagcgatcaacccacagttcaatatgtttgttagctaa

SEQ ID NO: 40938 - DNA, 1014 bp, Bacillus halodurans
atgaaaacagtggaacagacaagtccaacaatgacaagtgagaaggcgaggtggatttatcaaaaaatggtggagatcagaatgtttgaggatcgagtccatgacattttttctaaaggagagattccaggatttgttcatctgtatgcaggtgaagaagcgattgctgttggtctatgcgctcatttagatcacaacgattacattacgagcacacaccgggggcacggtcactgtattgcaaaagggtgtgaactggatgggatgatggctgagatttacggtaaaagcacaggcctttgtaaaggaaaaggaggttccatgcatatcgccgatttagatcgagggatgctcggagctaatggaattgttggtggcggctttacccttgcagccggggctgccttaacagcgaaatttaaacagaccggaggagtcgccgtctgcttttttggagatggggcgaacaaccaaggtacgtttcatgaagggattaacttagccgcaatatgggatttacccgtcgtattcgtcgcggaaaataacggttatggagaagcgacacctttccattatgcttctgcttgtgaacagattactgatcgcgcaaaaggttacaacataccaggtgtcaaagtggacggcaaagatgtggtcgctgtctatgaggttgcacgtgaagcagttgagcgagcccgtcgaggagaagggccgacgttaattgaatgtataacttaccgcaactacggtcattttgaaggcgatgcacaaacgtacaaaacaggtagagagaaagaggagcacacggaagaacgggatgccattacacttttcgaaaagtatgcgctaagcaataatctcctgacggaagaagcgatccaaacggtacgacacgaggtggaacagtcggtcgatcgagcagtagattttgcaaacgcgagtgactatccacaaccagaagagctgttaactgatgtgtatgtttcttacgatcacgaagggaggaacggataa

SEQ ID NO: 40939 - DNA, 1035 bp, Bacillus halodurans
atgacaagaaaaatcagcatgtcgaatgctattaatgaagccatgcaattagcgatgcgtcaagatgaacatgtcatcttattaggagaagatgtggcaggtggtgcagaggtggatcatttgcaagacgatgaagcatggggcggcgtctttggggtaacgaaggggctcgtacaggaatttggtagagaccgcgttcttgatacaccgatctctgaggcaggctatgttggggcagcaatggccgctgcggcaacagggttacggccgatcgctgaattaatgtttaatgactttattggcagttgtttagatcaagtgctgaaccaaggggctaagctaaggtatatgtttggtggtaaagcgcaagtacctgtaacgattcgcacgatgcatggggctggatttcgcgcggcggcgcaacattcgcaaagcctttatgcaatgttcacggcgatgccaggcattaaagtcgtcgttccttctactccttatgacgcgaaaggcttgctgctttctgctattgaagacaatgaccctgttatcttttttgaagataagacgctttataacacaatgggtgaggttcctgagggacattataccattccgctcggaaaggcagatataaagagaaggggggatgatctatcggtcgtggcgatcggcaagcaagtccacacagctttaacagctgctgatctgcttgcaaagaaaggaattgaagttgaagtgatagacccgcgaagtttatcaccgctagattctgagacgatcttaacgtcagtagaaaaaacgaatcgactcatcgtcatcgatgaagcgaatccaaggtgtagcatggctaccgacattgctgctcttgtggctgatgaaggatttgatttcttggatgcaccgattaagagaattacagcacctcatacgccagtaccgttctcacctccattagaggatctatacttgccgactccggaaaatgtcattcaggccgtatcagaactattaggaaattcatcattacaaagcgtatag

SEQ ID NO: 40940 - DNA, 1233 bp, Bacillus halodurans
atggctgttgaagtagtcatgccaaagttaggtatgtcgatgaaagaaggaaccatctcggtttggaataaaaaagagggggacatggtcgcaaaaggcgaagcgatcgtgagcattcaatcggaaaaaattgagacagagatcgaggcaccggcagatggtactttacttaaagttgttgtgcaggaggatcaaagcgttcctcctggcacagtcattggttatattggagaaccaaatgaacagttagatcaatccaaatcacttgaaaaacagcaggccgactctcatgctgaaaaagcgacggaaggagccgtttttgacgtggaaaagccttcttctaaaggagccacagtgagtagttcgcctgttgcaagaaagatggccctaaaggcagggattaatctagagaacatagtaggaacaggaccagggggaaggattacgaaggctgatgtggaaaaagccattgctgagcagagggtggaaccaagtgaagcgaaacgatcgaattcggacgttacagagaaggggatgcaagacggggccaaaatcacacctgcgtcggccatgagacaggtgatcgctacgcggatgcacggtagtttaatgcaatcagctcagctgacgatgaatatgaaagcggatgtaacggaccttatggctttacgagaggaagtaaaccacactgttcaaacacgatacgggatgaaattaacggtaactgacttcattgcccgtgctgtcgtactcgcgttacaagaacattcaaacatgaacagcgcctacattgatgagcatatcgttacttatgaatatgtccatcttgggatggctgtctcactaactcaaggcttagttgtcccggtcgttcaacatgctgaagccttatctgtggttgagctttcaaagcagattaaatcgttgtcagagcaagctcgtacaggaaaactccaaagtgatcaattgacaggttccacatttacggtcaccaaccttggtgtctacggtgtcgatcactttacgccgattttaaacccgcctgaggctggtattttaggggtgggggcggcaacggatgcacccgtttttcaaggtggcgattggcaaacgagagccatgctaccgcttagcttaacgttcgatcatcgaatcgttgacggggcacctgctgccgaatttctacaaacgataaaacaatttttagaaaaacccactcacctacttttgtag

SEQ ID NO: 40941 - DNA, 1380 bp, Bacillus halodurans
atggatagagttgcgatcgttggaggaggaccagccgggtatgtggcggcaattacagccgcccaccggggaaagcaagtaactttaattgagcaaaaaaaattaggtggcacgtgcttaaatgaagggtgtatgcctacgaaatcattgttagaaagtgcagccacctatgataaagtgaaacacgcaagtgattatggcattaagggaccagtagatgaaatgcgtatcgagtggggacaagtacaggctcgtaaaaatcaaattgtccaccagcttgtgaaagggatcgattatttactaaagaagcataaaatagagcttctggaaggcacggcttcgtttcaatcggcacatgaattacttgtgcaaacagaacgaggtcaacaaacaatcgaagcaaatcgaattatcatcgcgacaggttctgaaccgactccgttaccttttgctccttttgacagggaatgggttatcagtagtgaacaagcaatgtcgttacctatccagcctgaatctatgatcattgtagggggcggggtgattggttgtgaatttgcaagtatttatggacggatgggaacgaaagtgacgatcattgaaatggctgatcggttgctgtttggtgaggatcacgatatttgtaaggttttaatggaggagctcaaacgacaaggggttgaaatctatccatcgacggtcatcaaagaaatgcagcgtgaccgcaagcaggttgttgttgaacgagatggtcaagtggaggttttaactggtgattatgtgcttgttgccataggaagaaagccgcgtttacaagagataggattagagagaattggagttgattttacttcacgaggtataacggtcaatgaacacatgcagacgacgatcccacatatttacgcatgtggtgacgtaatcggagggattcagcttgcccacgtagcgtttcatgagggaagcgtcgctgctaagcatttgtgcggcgaacctattcaagtgagatatgaggcagttcctcgttgtatttacacatcacctgaaattgcaacggtcggcttgacggagacacaagcgcgggaaaactatggacacgttcgaattggtgaatatccgtttgctgccaacgggaaggcgcttattgtgaatgaaacgataggaaaagtaaaagttgtggtcgagcctgagtacgaggcgatcgtcgggttaacgatcgttggaccccatgccacggaattaattgctcaaggaacgctcatggtacacaatgaattaacgcttgatagtttagagtcgtttatcgctgctcacccaaccgtatcggaagctgtacatgaagctgtgctgcaagcattaggccaggcggttcatgtctaa

SEQ ID NO: 40942 - DNA, 2295 bp, Bacillus halodurans
gtgaactcattaaaggttgctgtcacaggtattggaattttaacaagcattggacacaacaaagaggaagtttttcagaatatgcttgacaatcaaacaggaattggaccgattcagtcattcgacgtacaagaatttattagccaaattggggccgagattagctccttccagccatctgatcattttacacctgaggaacagaaagggttagatcgttgcgctcagtatgctgttgtttctattaaggaagccttggaggaggcaagagtagatcagacagtagaaaaaacgattggcttagcctttggaacatgcaatggtggcctgaattcactggaagaacagagagctttacaggaattagacctagaaaaaacacgaaattatcttttttaccaacaaggagatgctgtagctaaatatttcggtttaactggaccagtcatcacgttaaacactgcttgtgccgcaagtggaaatgcaattggatatgcgtgtgacatgattcgccacgggtttgctgatgtcatgatcgcaggtggatcggattcaatgtccacttctgtatatgcgggctttaatgctttaaaggctctaaatgatcaaccatgttctccttataatgaacaatatggattaagtcttggagaaggttctgcttttcttgttttggaaccattagaaaaagcgttagcaagggacgcaaaggtgtatacggtcgtagaaggttatggtttgagcagtgatgcctatcatgagactgctcctcagccggagggacaaggcattcgaaaagcggttgaaatggccattgaacaagggaatatttccaaagatgaaattgattacattaatacacatggaaccggaacaaaagcaaatgatcctgcagaattgcgagggctacgtgcttacttcggcaagcaattcgacaacatttacgttagctcaagtaaagcgtattttggtcacaatctaggagcggctgcagcaattgagtacgcgacgacattgctggcattagaacaaggtcttctccctgcaacacttcacttttcgcaggcgagggaaggctgcaatcatcagaaattagtgacaaacgaaatgaaatcatataaaccaaagtattttttatgtaacaactcagcctttggtggacacaattcttcaattctatcaaaaaatgtataccatccagcgttctcaccagctacgatcaccacctctagtgctgaggagaagaagcgaattggcgtttatggctatggaaccattcataggttggccgatcatgatggaacacttctatctaacttacatcaagattcacctactacatttcaactagatttttcccttaaagaatataatcgttcattatacgaaagacggatgaacccactaactcaatatagcattgcagcatgcgatttagctttaaagaacacttccctttccaacatagacaatgaacaaattgggcttgtttatggaacttctcgtggcagcttaaaaagtgcggaaaaatacttaggttctattttagagcgcggagctggaaatgcaagtagtgtctactttccagatatggtgttgaactcaacagcaggaaagcttgccaagaagtttggtattaaaggttttagctcttctcatagctcaggtggtatagatggactacaagcgatcctatatgggatgactagcattcttgatgggaagcaatcaaccgtgctagtgggagccggagatgagcggtctggattatctgatgagattgatcgagcaatgaacttacagaatagttcttatgagatcggtgaaggaagtacttttctcttgttagcagatacaaaagttgctgaagagaaaggtctagatccgattgctacaatcgaaggcttcggtcaagcgttttctggccaaaatgatatggatcaaacgattcaacatgctgtggagcaatgtttgcaaaatgcaaacctttctgaggatgagatcgatttcatcttttaccataacaacaatgtgacagacatcgatgcgtttcttcaattaaaggaacgcctagggcatatccctgtttatacattgaaccatctttgcggttatatggaatcaaatggatcgctttttcacgcacaagtggcactagagctgcttgctttaccaaaagaagaacaacagtctatgattcatgcttttggttggccgaaaaacgatctgagaacagggcttattatcactacatcgattaacgggaattctatggccatggccattagaaaataa

SEQ ID NO: 40943 - DNA, 744 bp, Bacillus halodurans
atgttattacgtgataaagtagccattgtaacaggtgctacaaggggaatcggaaaagagattgtaaaaacttttgttgaacagggagcttttgtctatggcatctacgcgtctaatcatgaagctgcaagggaaatcgaaaaaacccttaaccaaggggaaaaatgcgtttcttatgttagcggctctgtagatgaccagctctttatccattcacttttcaagtcggttgtagacaagcacaatcggctggatatattagtaaacaatgcaggaattacgagagatcaatttctttttcaaatggacgatcagtcttggcaacaagttctacaggtgaattttgggggaacatatacgtgttgtcatgctgcgttaccttatatggaaaggaaaaaacaaggaaagatcgtcaatgtcgtgtctgtgaccggtgttgttggaagggaagcacaaacaaattatggggcatcaaagggtgccattatcggcctgacgcgattactagcacgtaaatactctgaaaaaggaatctcaattaacgcgatcgctcctggcatgattgaaacggagatgattaaacaagtcccggaggaaaaactaaaaaactttttaaggttcaccaatgcgaaaaaacttggttctacaaaagaggtggcgcgtaacgttctctatttatcaagtgatctcagtgactatgtaacggatactgtattaaaagttgacggaggttttttacgatag

SEQ ID NO: 40944 - DNA, 714 bp, Bacillus halodurans
atgaacattttggtctctaacggggaagagcatgtgaaccaaacaatcgcctcattttttcatcagagaggcgatcggccgattctcttatttacagagaaagaaaagcatctagaatatgtcgcaggacacccagaacaggaagccgtgctttgcacgacctatgaagaagaaacattagcggcaatggtaaaagaagcgtttgaagaagaggcgatcgatgtgcttgtgcacggtaatgagatggtaaatgaagctgagcttctagaaagagatccctcttcacttaatgaagtagtgcagaaggcactatatcatctattccttttaaataaagttgtcgttcgggatatggtcaaacgaaaacaaggaaaaataatttttcctttattctatgatcctctctactacgctgggtatgcgagttctcctattttaaaccaagccaagctttccttaatgaaatgtatgtctcgtgagctgggagcctttaaaatcaatgtgaattccatcacatttggttattacaacgatcaatttacccgtgaggaaaagaaagcgacaaaaagtcaggtcgaaattttctgtttaaagccgaaacttcctgaaattgaagagtacgtacattccatcggtttattggttgatccatctgcaagtttaatagggggggagaaccttcatgttggtgcaggaattgaaaccggaatctaa

SEQ ID NO: 40945 - DNA, 1110 bp, Bacillus halodurans
atgttggtgcaggaattgaaaccggaatctaaggcgactgtaagtcctcgtatcattggattcggcgaatgtttaccgggggagcctgtaacaaatgaacaaatggagcagctcctttcgattcgtaaggaatggttggagactatgatcggtaatcgatcacgccattttgctgtgaatttttcgagtcgaaccatcgactatggcttggcagatctttgtacagaggcggcagtcgaggcgattgacgacgctgggattaacgctgaagagttggatttgatcgtattgtctacagccacccctgaccatcttatgcctgcaacagtcaatattgtcgcagaccgacttggccttgaaagagttaagacttatcaaattcaagcggggtgctcaggggcacttcaagcattagatgttgcacgacacatgttggttggatcacatcggtatgcactagtgatcggaggggatgtttgtaataagtatatggatttatcacgtgatttttccaaattacgttcttctgaattaatcaattatgcactatttggagacggggcaggtgcagttgttcttacaaatgagaatcaagatggtctgcaaatctcttatattgaaaatcgttttgaaggaaagggaagggcgccaggacaaatcatgaattggttcggcaccgttcccgaaaatgttcaggagctcagcaaaagggagcttcgaaagcaatttcagtcagcaaaagaagattataaggcgattgaacaacatgttcctatcatgactgagcaggcaatcgaggagttgctcggacaaatgaagtggacaaaggaagaagtgtcctattatcttcctcctcagctcgggtggaacatgacgaaaaaaattattgatcttctcgggcttcccttggattctacgataaattgcgttcaagagacaggaaataacgggaatgccttaccatacttacaattaaagcgacttaatggaatactcaaacctaatgacaaggttgttggcgttgcgattgagtcatcaaagtggatgaagacagggattacactcgaatataaaaagggtgaggcacttgatggaacgagagattcttaa

SEQ ID NO: 40946 - DNA, 1497 bp, Bacillus halodurans
atgggaagacgaccaaaaaaatcaagctatgatgtagttgtcatcggtgctggtatgggcggtttaagcgcagcgacttttttagctcaggaaggatattctgtcttagtattggaacggcattatcgtgcaggtggttacgctcattcctttcgtaggcggaagtttattttcgattcggcagtccgtattgctgctggggcaatggatggagggctgctggaagaattacttcaggaagctggagtctcacaagacgttgagttcctacatttggaggacatttacacggcctattatcctaatcgtaaaattactgtaaaagggtcggtggaaggattaatcgaagcctattgtgaagagtttcctcatgaatgtcataacattcgtgcgctcgtccaagagatggaaaaactatacgaagtaacactcatgctccttcattcaggagatcctctaaaggttctgtcaaacccgttgatgctcaagtatcgtgacaaaagttttcatgatttgacatcgtcattcctacaggacccacaagccatccactcttttgcagcattatgggcgtactatgggacgccaccgactcaaggaagcgccatgttttttgcttacgcaatcatgagttattttaaagaggatatttactatgcaaaaggaagcttccaatcgcttgcggatgcttttgttaaacgaattgaatccttaggtggagaagtgtgccttcgtaatgaagttcaacgtgttgaagtggaagacaggcaaatcaaaggagtacatttgcaaacgggagagtatgttgaggcagagaaagttgtttgtaatggagattttttaaagctcgtgcaacacctagtcggagaggagcactttcctgctcgatatctcaaacggattagcaaactgaaaccgtccatctcagcctttgaggtgtttttaggggttgaccttccgttagagaaacaaggactatctcatgaaacgtttatttataacgattacgactacgatctttttatggaaaagcatcaatcattaggagaaataggggcaagtggcttaagtggactagccatctcaattccttcactagtcgattcaagcctagcgccagaaggaatgcacacagcgatcctcaccacactcgtaccttatgatattggttgtgattggaaagaaaaaaaggaagactatcaagaccagttgattaaaatggcggaacgggccattccgaatctcggtcgtcatgcggtccatgttgaatcaggaacaccgttgacaatggagcgttatacgaacaatagctttggctcgatatatggctgggaacaaacaaagaaccaaatgactggtcggcctcagcatgaaacgccgataaaaggattatacctttctggacaatggaccgatccaggtgggggaatcgtctctgccattctatcaggctacaagcttcggaaaaaaatcatgaaagaacaagtggtgatgtaa

SEQ ID NO: 40947 - DNA, 960 bp, Bacillus halodurans
atgaaccgaggtgttatctgcttaggtgaagcgttgattgattttattccgatggattctactaatgaaatctaccaaaaaagtcccgggggtgctccggcaaatgtggctgtaggattagccaagcttggggcaaagtcaacgtttgtcggcaaggtgggggacgacttgctcgggcgatttttaaaagaaactttgacgaaagcgaatgtaaacactgagcacatgctgtttagcaaggaggtccgtactggggctacgtttgtaacccttgcagctaatggcgaacgaagctttgatttttatattaatccgagcgcggatcgttttttagaaaaaggtgagattgcccctactctatttgaagagcatggtgttctccattttggttcaattagtttaataagtgaaccggcacgaacggcgacaagacatgctgtgtcgttagcaaagaaaaatggactgatgatctcctatgatccgaatttacgcctaaacctttgggaggatgaggagcaagcacgattgctcatcacttcaatgctaggggaagcagatgtgctgaaaatcagtgaggaggaattggcgttcatcacgggcgaacagacaattgaggcgggtttggatcagcttgtagcttacaacattccgcttgtttttgtcacattaggggaaaaaggtagcatcgtttcgtataacggcatccagcgtaagattccggcgatggcagtacaaacagttgatacgaccggtgcaggtgatgcatttgtttcagctattcttttcaaactgcaagaggaacggaagcaagtagctgagttgtctatcaaagaagtagagcagatggcccgatttgctagcgtgtctggagggttagcggctgcaacgaaaggggcgatgacggcattgccgacccttgagaaagttaatgacatcctacgaaatgaacagatggagtga

SEQ ID NO: 40948 - DNA, 1464 bp, Bacillus halodurans
atgacgaatcgagatcaagaattacgacaaaaggcgaaagagaccattaaacgatatgagcgcttagtagaacgtgatccataccgtcttgtttatcatttaatgccacctgttgggttgttaaatgatccgaacgggtttattgactgggatgggacctaccatttattttatcagtggcatccattcgaagcggctcatgggcctaaattttgggggcatttcgtatcaggcgatctagtcttttgggaagagaaagagcccgcgcttacgccaagcgattggttcgataaaaacggctgctattcaggaagtgctgtggcagacaacggaaagctaaaactcttttatacagggaatgtaaaaaatgaaaatgacgaacgggaaagctatcaatgtgtagcagaatcagaggatggcttaacatttacaaaaaaaggcgtgattttgcacgttccggacggttatacggcgcattttcgtgacccaaaagtatggaagcgtgatggtatctggtatttagtgattggagcacagacaaaacagatcgacgggcacgttttgttgtttcgatcagacgatttaaaagaatggcagtttgctggtattgtgacaggatcgaatgtacgaagtatgggtgatttcggctatatgtgggaatgcccagaccttttccatttagatggggaggatgttttgctcgtttcaccacaagggctcgaaaagcaaggttatctttatcataacgttcataataccggctattttattggtcggctcgattatgaaacgggcgagcttgtccatgggccatttaaggagctagatcgtggctttgaattttatgcgccgcaaaccacgatcgatcgttacggtagacgaattttgttcggctggatgggggtaccggatcagggagaggagaagcatccaacggtcaaacatcagtggattcatgcgatgacattacctcgtgaactgaagttggtggatgggaaaatctatcaacgcccagtggaagagctcaaacaattacgaaaaaatgaagtgtcacgaccaagtgtaaagatctcagaacaccctcagaggtttgaagaaatctctggggaagcctttgaattactccttgatgttgaagagaatcaggcagaggtgtttgaattaacgatacgcgataatgtccgtgtcattttcaatcgagggttaaaacgactaacattagaacgagtgagctttgttgatggtttaaccgaaagccgtcattgtgagttagctgagctatcatcgcttcacctctatgtggatacgtctgctgtcgagctgtttgtaaacgaaggcgaggaagtgttcacggctcggtactttgcagatccagccaatcgcagcattcagtttaagacgctccatggctctctaacagcttctctaaaaaaatgggcgctagactccattatgaaaaaataa

SEQ ID NO: 40949 - DNA, 1503 bp, Bacillus halodurans
atgacacttacagcaacaatggttgtcgacaaatcgtttaaaattggcgaaattgataagcgcatttatggttcatttattgagcacctaggacgtgctgtttatgaaggaatttatgaacccggacaccctgatggggatgagcaagggtttcgcaaagacgttatccggctcgttcaagaactgcaagtgccactcgtacgctatcctggcgggaattttgtatccggttacaactgggaggatggggtaggtcctgtttccgaaaggccaaagcggttggatttagcgtggagaacgacggagacgaatgaaatagggacaaatgaatttgttgattgggcgaaaaaggttggggcagaggtgaatatggctgtgaacctcggctctcgcggggttgatgcagcccgtaatcttgttgagtattgtaaccatccgtctggttcttattggagtgatctacgcatctcccatggatacaaagatccgcataatattaaaacatggtgtttagggaatgagatggatggtccttggcaaatcgggcaaaaaacagcagaagaatacggtcgtgtagcggcggaagcaggaaaagtgatgaagctcgtagacccttccatagaactcgttgcttgtgggagctccaacagtaaaatggcaacgttcgccgattgggaagcaacggtcttagaccatacgtacgattatgtagactatatttcgctacatacttattacggaaatcgtgatgatgatctagcaaactatcttgctcagtcgatggatatggatgagttcattcgctcagtgattgcgattgctgattatgtgaaagcgaaaaagcgaagcaaaaaaacgattcatctctcattcgatgagtggaatgtttggttccactccaacgaagcggatcggcaaataactccgtggagtgtagcaccgccattattggaagacatttatacatttgaagatgcccttcttgttggaagcatgctcatcacgttactgaagcatgccgatcgtgtcaaaattgcgtgtcttgctcaactcgtaaatgtcattgctccgattatgactgaaaaaggtgggccggcttggaagcagacgattttttatccgtacatgcacgcatcagtatacggacgtggtgtggctttacaagcgcaaatctcttcacctaaatacgatagtaaagattttacagacgttccttatttggatgcggcggtggtgcatctcgaggaagccgaagaagtgacgatctttgcagttaataaacaccaaacagaatcgctaaatttacaatgtgatatgcgtagctttgaagggtatcacgtattggagcatattgtccttgaacatgaaaatatgaaagcgacaaatcaaggacgagaacaggtaacgcctcatcacaatggtgactccgccattgatcaagggcggctgacagcgaatctagcaaagctatcttggaacgtaattcggctagggaaaaaataa

SEQ ID NO: 40950 - DNA, 1200 bp, Bacillus halodurans
gtgaatcatctattgaaacaagcgaagcgagtcgctagtgaatgcgagtgcggtcacgaacatcaatggatcgaaatggatgaattgcaactgggtaggaacgcgattaactacctccctgagtatctacatgaaaaagggctattacatgtgacaatagttgccgatgccaatacgtatgctgtagcaggacaattagtagctcagctccttaaaggccgcgggatcgatgtagaaaattgcatccttaaagagcagggggcgcttactttacttgctgatgagcatgggcttggccaactcgtcattggggcagctaaggaaacagatgtctttcttgcggtaggagccggtacgattcatgatctgacgcgcatcgctagttacaagtttggtaagccatttatcgcgattcccacagcaccttcggtcgatgggtttacctcgatgggggcaccggttatccgtgatggggtaaaaataacgttccaaacgcaggccccgatcgctttatttgcagatttggattttttaacacaagcccctcgttctatggtagctgccggtttcggtgacatgctcgggaagtccacatcacttgttgattggcaagtgagccatatgttgaatgatgagcctttttgtcccgctgtttttcacatgacaaaatctgcgctcacgatgtgtatggagcatgctgatgagattgcagcttgcaatgaacaagggatccgcctgttaacagaagctctcatcatgtcagggttagccatgcttatttttggtcattcccatccggcatcaggtgcagagcatcatctatcccattattgggaaatggcctttctacgttcaggaggaacgcagccccttcatggcgcgaaagtcggctatgcgacaatgctgatttcggcattatataaaaacgaagcccgaaaaaagatcgaaacgttccaaggcgaaggctccccgttggtcaatagcattcataaacatcgagagagacttttaatgttaattgacacgataccagaatctagcgacattcaaaggttgctagaaagtgtaggtggggcagtgaaaagtgctgatttagctcttgctgattcgttggaggacgaggcgttagagaaagctcataagctacgagagcggtgtacgcttctttactgtctgaatgaacatttaaaaacgtcttaa

SEQ ID NO: 40951 - DNA, 1299 bp, Bacillus halodurans
ttggaagtgaatcgattatctgctttaactccaccgatggggtggaatagctgggattgttatggagcgagcgtgacagaagaagaagtgctaggaaatgccgaatacatggcaaatcatttaaagaagtatggatgggaatatatcgtcgtcgatattcaatggtacgagccaacggctaactcatctgcctacaacccgtttgcccctctttgtatggatgagtatggccggttactacccgcaacaaaccggttcccgtctgcaaaaaacggggccggattcaaaccattaagtgatgccatccatgatctcggcttaaaattcggtatacacatcatgagaggcattccgagacaagccgtttatgaaaactcccctgtcttaggctctacgaaaactgctcgcgagattgctcacaccaattccatttgcccatggaatacggatatgtacggcgtagacccgacaaaggagggtgcgcaaagctattataacagcttatttgagctttatgctcagtggggtgtcgatttcgtcaaagtggatgacatcgcggcctcaaggctctacgatacacatctggaggaaatcaaaatgatccagcgggcgattcaagcatgtggaaggccaatggttttaagcctctcccctggtcctgcccctataaaatatgctcaccactttaaaacgaacgccaacatgtggcggataacagatgacttctgggacgattggtcccttttatatcaaatgtttgaacgatgtgaagtttgggaaaaacatatcggtacaggccactggccggattgtgacatgctgccactcggtcatatcggtatccgttctgttgacggacctggtggtgatcgctggactcgttttacaaaagacgagcagttaacgatgatgaacttatgggccatctgtcgctctccgttaatgttcggcggcgaactcagggataacgacgagtggacattatcgctattaacgaatgagggaatcctctcgattaatcaaaaaagcgtattaaaccggttcgtctatcgtgaagaggataaggttgcctgggctgcaaatggtagaaatggcgaggcatatgttgcattatttaatttacacgatcaacaaaagacgttacaattccgattagatatggtaggtattatggaaacggttcagctttttaatgtatgggaccgttcatttttacaatccctcgccccttctgaatcgtttcaaatagaactgaagccccatcagtcgatgatgttaaagctctcaccagaccggtaa

SEQ ID NO: 40952 - DNA, 1692 bp, Bacillus halodurans
atgacaacgaaatacacaattggggttgactacgggacggagtcaggacgtgcggtgttaatcgatctatcgaacgggcaagagctagctgaccatgtgacaccatatagacacggagtcatcgatcaatatttgcctaatacaaacattaaattaggtcacgaatgggctttgcagcacccccttgattatgtagaggttttaacgacatcggtgccagcagttatgaaagaatcgggagtggatgctgacgatgtgattgggatcggcgtcgattttacggcatgcacgatgttaccagttgacgaggaagggcagcctttgtgtttgctcgcgcagtacaaagacaatcctcatagctgggtgaagctctggaagcatcatgccgctcaagataaagcgaacgctataaatgaaatggctgaaaaacgaggagaagcctttttgccacgatatggcgggaaaatatcttctgagtggatgatcgcaaaagtgtggcaaattctcgatgaggcggaggacgtttataaccgaacggatcaatttttagaggcgaccgattggatcgtctcacaaatgacgggcaaaatcgtgaaaaatagttgcacagcaggttataaggcgatttggcataagcgagagggttacccttccaatgaattttttaaagccctcgatcctaggcttgagcatttgacgacaacgaagctacgcggtgacatcgtccctttaggtgaaagggcaggtggtttattgcccgaaatggctgaaaagatgggcttgaaccctggcatcgcagtagcggtaggtaacgtagatgcccatgccgctgttccagctgttggcgtcacgacgcctggaaagttggtcatggcgatggggacgtccatttgccacatgctactaggggagaaggaacaggaagtcgaaggaatgtgcggagttgttgaagatggtatcatcccaggttatttaggctatgaggcagggcaatccgcagttggagacattttcgcctggtttgtgaagcacggcgtttcggcagcgacgttcgatgaggcgcaagaaaaaggggtgaacgttcacgctttgttagaagaaaaagcgtcacaattaagacctggcgagtcgggtttacttgcactcgattggtggaatgggaatcgttcgattctcgttgatactgaattatcagggatgcttttaggctacacgctccaaacgaagccggaagaaatatatcgagcattgcttgaggcaacagcatttggtacacgggcgattgttgatgcttttcacgggcgaggggtcgaagttcacgaactctatgcatgtggaggtttaccgcaaaaaaatcacctgttaatgcaaatctttgctgatgtgacaaacagggaaattaaagtggctgcttcaaaacaaacaccagctcttggggcagcaatgtttgcttctgttgctgctggttcagaggtaggaggctatgactcgattgaagaagctgccaagaaaatggggcgagtgaaggacgaaacttttaagccaattcctgaacatgtggctatctatgaaaagctttaccaagaatatgtgacgcttcacgattacttcggacggggtgcgaatgatgtcatgaagcgtttgaaagcgttaaaaagtatccagcatcgtccgtcttctttgttaacgtaa

SEQ ID NO: 40953 - DNA, 1494 bp, Bacillus halodurans
atgttacaaacgaagccatatacgttttggttcattactggaagtcagcatttatatggagaagacgcgatagagcaagtaagacagcactcgcaaactatggtagaaaagcttaataaaattggcgagttgccgtacaccattgaattaaaagaggttctcacaacacctgatgcgataagaaaaatggtcattgcggccaatagcgatgacgattgtgcggggatgattacgtggatgcacacattttcccctgcaaagatgtggattaacggtttaaaacaattaaaaaagccgctcctccacttgcatacgcaatttaatcgagaaatcccttacgatgacatcgatatggatttcatgaatttaaatcaatctgcccacggtgatcgcgagtacgggcacattggggcacggcttaacatctctcgaaaagtaatcgtcggtcattggcaaaataatgatgtacaagaacggctaggggcttggatgagaactgctgcggcctttgtggacggtcatcacttaaaagtggctagatttggcgacaacatgcgggaggttgctgtgacggaaggagataaggtcgaagcacaaattcaattcggttggtcgatcacggcctttggtattggcgatctcgtcgaaaaaatgaaagcagtatctgaagacgaagtccggcgattattcgatgaatatcaagagctttaccgcttaagtccatcgattctcgagcaagatgaggtaaaagcagcggttttagagcaagcgaaaatggaactagcgttaaaggagttcttggaggaagggggctacacagcgtttacaacgaactttgaagacttgcacggaatgaagcagcttccaggcctagcggtgcaacgtcttatggcagagggatatggctttggtggagaaggagactggaaaacggcggcgttattgcggatgatgaaaatcattgctgatggtaaaggaacctcattcatggaagattacacataccatttggccgaagggaacgagctcgtgctaggttctcatatgttggaaatttgcccaacgattgcggcgaatcagcctgaaatccaagttcatccgctaggtattggcgggaaagaagatcctgcacggcttgtttttgatggggccgatggaccggcgttaaatgcctccttgatcgatcttggccaccgattccgtttagttgtgaacgaggtagaagcaatcaaaccagaacgggatatgccgaagctgccagttgctaaagtactttggaagtgcaagccttccttaagtgaagcaacagaggcttggatccatgcagggggagctcatcatacggtgttctccttcgaagtgacgcctgagcagctctatgattgggcaactttagctgatattgaagtggttttcattaatgacaaaacagacgtactgcaattccagcaacagctccaatggaatgaagctttccgccgactatttaaataa

SEQ ID NO: 40954 - DNA, 1497 bp, Bacillus halodurans
atgaagcaatcaattaaagtctatacagatcttgaacatgggaaaattagcaagcatatttatggtcatttttcagagcatttaggcaggtgcatttatgaaggattgtgggttggagaggactcaccaatcccaaatacagaggggatccgcaatgatgtactaggggcattacaagagttaaacatcccggtcctacgctggccagggggctgctttgccgatgagtaccattggaaagatggtgtggggccaagggagaaccggaagcgaatggtgaacacccattggggcggtgttgtcgaaaataatcatttcggcacgcatgagtttatgagattatgtgagctcctcggcgccgaaccttacatttgtggaaatgtcggcagtggtaccgttcaagaaatgcaagaatgggttgaatatatgacatttgatggggaatcgccaatggccaattggcgcacagaaaatgggcgagaagagccttgggctttaaaatattttggtgttggaaatgaaaactggggctgcggggggcatatgcgtcctgaatactatgcggatctttaccgacgctatcaaacctatgtccgtaactatggagacaacaaaatttataagattgctggtggggccaatgtagacgactaccgttggactgaggtgttgatgcgagaagcggctcatcttatggatggattgagcctgcattattacacggttccaggggatttttgggaaaataaagggtcggccttagacgatcgtgaatctgaatggtttaaaacgttgaaaaagtcgttccgaatggatgaattattgacgaagcattcgacaattatggaccgttatgatcctgaaaagcgagtcggcttaattgtcgatgaatggggtacatggtttgatgtggagccaggtacaaatccaggcttcctttatcaacaaaatacgatccgtgatgcgttagtggctggcgttcattttcacattttccatgagcataacgaccgggttcatatggcgaacatcgcacaaatggtcaatgttttgcaggcgatggtgttgacggaaggggagcagatgcttttaacgccaacctatcatgtatttaacatgtataaagttcatcaagatgcaacgagacttgaagtaaatgcagacgtgggaacttacaagttcggagatgatgaacttccagcggtaaccgtttctgcatcgaaggataacgaaggtgccattcacgtaagtgtttgtcatttagatcctcatcgtgatacagatcttacacttaagctaaatgggctaaacaagtcgttgtcagcatcatctgtttcaggagaactattaacagcaaatgaattaaatgcccacaatacgtttgaacgaccgaatgaggtggagcctgttccgtatgagccagcttctgtaagcggacatgagatggagctaaaggttccagcatcatctgtactccgtgtgacaattagaccataa

SEQ ID NO: 40955 - DNA, 2322 bp, Bacillus halodurans
atgaaattttcagatggtcagtggctgacacgacaagagtatacaattataggagcggttcaagttcatgagatcatacaaggggaagcatccatgacggttctagcctcgccgaaaccgattgtggatcggtatggacagcttgataccccgttactggagatcactttttccgcccctaggcgagagatgatccgcgtgcaaatcgatcatcataaaggagggagaaaacgaggtccggtttttactaccaaacatgatcacaagcatcaagcaagttttacagaaacggagacgacggcaatcctcacaagtggcgacctatccgtcaccgtccataaagaaggtgattggctcattaccttttcctatcaaggaaaaacgatcacatcgagtggttcaaaaagcatcgcccacattctcgctcaggacggaaaggcttatatgcgtgagcagcttagtctccagccagatgaaatgatttatgctttaggcgaacggtttacacctttgattcgaaacggtcaagtcgtcgacatttggaataaagatggcggtacgaacacggagcaatcgtataaaaatgttcccttttatctttctaacaaagggtacggcgtgttcgtgaaccatccggagtgggtgtcgttcgaagtaggatctgaaagtgtgtcgaagtctcagtttagcgtcgaaggtcatcgccttgattactatgtgatggctgggccgtcgatgaaaaaagtcattgaagcctacaccgatttaacgggaaaaccagcattgccgccggcctggtcgttcggtctttggctgtccacatcgtttacaacgaactatgatgaagcgactgtcacccaatttattgatgggatgaatgaacgcgacttgcctgttcacgtgtttcattttgattgcttctggatgaaggaatttgaatggtgtaattttgaatggtatcggcgggtatttccagagccagaaaaaatgctacagcgcttaaaagaaaaaggcttgaagctatctgtctggatcaacccttatattgcgcaacgctctccgctgtttcaagaagcggctgcaaatggatacttactgaaaaaagaaaacggtgatgtatggcaatgggatttatggcaaccagggatgggcgtggttgactttacgaaccctgacgctcggatttggtatcaggaccaccttcgcaggcttctagaaatgggcgttgattgttttaaaaccgatttcggtgaacggataccgaccgatgtcgtgtatcacgatggctctgacccagaaaaaatgcataattactacacgttcctctataatcaaacggtgtttgacgtcttgaaacaagtaaagggtaatcatgaagccgtcttatttgctcgatcggccacggctggcagtcaacaattccctgttcactggggtggagattgtgccgcaacttactcgtctatggcggaaagcttacgagggggattatctctcggtatgtctggttttggctactggagtcacgacattggcggctttgaaagccaatccactgctgacctttataagcgctggaccgcctttggtttattatcgagccatagtcgtctgcatggaaataaatcgtatcgagtcccgtgggtttatgatgaggaagccaccgatgttcttcgtcagtttacaaaatggaaatgtcgcctcatgccatacctttatgcgaaagcatgtgaagcaagaacgaccgggctcccactcatgcgtgcgatggtgttagaattccaagacgatccgacgtgtgcgtttttagatcgccaatacatgctcggggatcagttgcttgtggctccgatcttcaatgaagaagggctcgctcattactacgttcctgatggtcgttggacaaatctcttaacaggcaaaactgtggaaggtggtagctggaagaaagagcatcacgaccatctgagcatccctttactcgttcgcccaaattcgatcgttccgatcggctcggtggatgaccgtccagactatgactatacagacaatgtggcattccacgtgtttgcccttgaaaattacgcgacaacatccatctatacagtagagggagaggaagcactcactttatctgcgactcgctccaccactacagtcacatttgatatatctgatggaagcaagccttggaccgtacatttacacgatgtcacagaggtgtctagcgttgagggagctgactttgaaattagcgatggctctgtcatcctccaccctatccttgatgtgaaacaggtggttgtccacctaggcgtctaa

SEQ ID NO: 40956 - DNA, 1344 bp, Bacillus halodurans
gtgtcgatcattcaatttccgaaagaaatgaaatggggagtggcaaccgcttcctatcaaattgaaggagcaatcaatgctggaggtagaggcgcttcaatatgggacgtctttgcgaaaactccagggaaagtaaagaacggtgacaatggagatgtggcttgtgatagctatcatcgctatgaagaagatattgagataatgaaggatttaggcgtggatatgtatcgcttctctgttgcttggccgcgaatttttccgaatggtacaggggaggtgtcacgtgaaggattagattattaccatcgacttgttgatcgtttaaccgaaaacgggattcaaccgatgtgtactctctaccattgggatttgccgcaagcattgcaagaaaagggcggctgggataatcgcgacacgatcgacgcttttgtccgttatgctgaggtcatgttcaaagagttcggtgataaaattaaccactggattacttttaatgagctgtggtgcgtttctttcctttcaaattatatcggtgtccatgcacctggaaataccgatctccagctagcgacaaatgtggcccaccatcttctagttgctcatggaaaagcggttcagtcgtatcgaaaaatggggcttgatggacaaatcgggtacgcgccgaatgtagaatggaatgagcctttcagcaatcaaatggaggatgctgaagcttgtaagcgggggaatggttggtttatcgaatggtttatggatccagtcttcaagggagcctacccatctttcttagtcgaatggtttgagaagaaagggattaccgtaccgattgaggctggagatatggagacaatccaacaaccaatcgactttttaggaattaactattatacgggaagtgttgcccgctacaaggagaacgaaggactatttgatctagaaaaagtagatgcaggttatgagaaaacggatattggctggaacatttatcctgaaggcttttacaaagtgttgtactatataactgagcaatatggacaaatcccgatttatattacggaaaatgggtcttgttacaatgatgaacctgtgaatgggcaagtgaaggatgaggggcgaatccgctacttgagccagcatttgacggcactaaagcgtagcatggagtcaggtgtcaacattaaaggatacatggcgtggtcattgctcgataattttgaatgggccgagggctacagtatgaggtttggcatcgttcacgtcaattatcgaacgttggaacggacgaagaaggatagtttctattggtataaacaaatgattgccaatcagttctttgaactttaa

SEQ ID NO: 40957 - DNA, 1617 bp, Bacillus halodurans
atgatgaactcaccacttttactctcccatttcattgaacgagcagaacgttattttcctacaaaacaagtcattagccgaacacttaatggaaaaaagagcttaacgtatcagcaaattggggaacgaacgagaagattggcatcggctctggcccaatttggcattaagaaaggagatcgagtagggacctttgcatggaacacacatcgacatttggaggcgtatttcgccataccagggattggcgccgtgctccatacgattaatttacgtctctctcaagatcatattgcctatgtgatcaaccatgccgaagaccgggtgcttttcgtcgatgcagatgtttggccgctcattgcccagctccgtgatcaactctcgtcagttgaagcgtttgttttgatgtctgatggtgagcttccggaagtcgattggccgaatgttttctcatatgaagagttcatcgcgaaaggggacccttccttcgagtttgttcagtcgatcgatgagacatctccggcaggaatttgctacacctcagctacaactggaaaaccaaaaggggttgtttacagccatcggggaatttatttgcacagcatggcattaggacttgctgataccgcaggattgtcagaaaaagacgtgctcatgccagtcgtccctatgttccatgtaaatgcgtggggtctcccttttgctgcgacttggtttggcacaacacaggtgatgccaggccctcagtttacgccacaagtgctggcagagctaatcgatgaagaaaaggtaacacttgcggcaggagtgccaacgatttggttaggtctcctgagagagctagagacgggagtttatcaaacagagcatctccgtgccatcttatgcggagggtctgccgcaccagcagccatgattcaaacctttgagcaaaagtacaacgttccatttcttcatgcttatggaatgacagaaaccagtcctcttgtgacagtttcgatggtaaaaagctatcaagctgatttgaatgaagaggaaacgttagaattacgggcaaagcaagggttagttgtcccaggattggaggtgaaggtcgttgggcctaatggggaggttaaacctgatggggcggaaatgggcgagcttctcatccgtggaccttggattgccgaccactattataaggcagaggaggtatcagatgcttttgccgatggatggctccatacaggggatgtggcgacgattgatgaagaaggattcattaagcttgtggatcgaacgaaggatttaattaagagtgggggcgaatggatttcttctgttgatttagaaaatgcgatcatggcccatgaggatgtttttgaagcagcagtcgttagcgtccctgatccgaaatggcaagaacgcccagttgcatgtgtcgtgctaaaagatccaaataaagggtcggtagctgaagcagatattcgtcgctttctagaagggaagtttccatcttggtggcttccagaccgggtgatctttatggatgagctaccaaaaacatcggtcggaaaatttttgaaacgggctctccgtgagcaagtaaaagaacaaatggaagccaataggtaa

SEQ ID NO: 40958 - DNA, 1227 bp, Bacillus halodurans
atgaaagcgatccaatttgatctaagcattcctaaatatgcattaagcaaggcgatgggaaaaatgaattcgtctctctatgtggaatcgccgttttcatgccttcaactaagagacgtagaaaaaccggctctcccgaacgaccactgggtagaaattaaagtgaaatatgggggaatctgcgggagtgacctaaacctcatttttttaaatgacagtccagctacctctcctttcgtttccttcccgtttacccttgggcatgaaatggttgggacgatttctaaagcaagaaaaagtgtgacaaatttacaagtgggtcagcgcgtcgtcatcgatccgcttctttcctgcgaggttcgcggcattacccccgtctgttctgaatgtgcaaacggaaattataacctatgtcaccatatgaacgatggcgacattgcccctggtttattgacaggaacatgcaaagacacaggtggtagttggggccggtacttggtcgcccatcaaagtcaggttatttcgttgccttctagtgtggatgatgacaatggtgtactcgtggagccatttgcctgtgcccttcatgcggtcttgcaaaacaggccgaagccttcagacacggtatttgtcatcggatcgggggtgattggcatttgcgtgatcgctgccattagagcgttagagatcccatgcaaaatcgtgacgttagccaaacacccctttcaagcggaacttgctaagcaatttggggcggacgaaatcgtatttctttcgcgaaaacgagactacgttacagcggttgccgagtcattcaacgccaatgtccttcatcccgtttttggtgaaccgattgtacatggaggggcggacatcgtatacgaatgtgtcggaaatcgcaaaagcttgcatgactctttgcgatttgcccgtaaagggggcaaagtcgtcttgatcggactcgcaagctttatcgacaaccttgatatgacgatgatttggctaaatgagctagaggttaaaggcagtttcacttacggcatggaagattggcagggaggaaaaaaacgaacgttacaaatcgcagtcgatttaatagccgacgggaaggtagatctctcccctttaattacccatcgttttccgttggaagcgtaccgtgaagcactggcaactgcggcaaataagaaaaaaggccaaaccatgaaagtcgtttttgagccttaa

SEQ ID NO: 40959 - DNA, 1125 bp, Bacillus halodurans
atggaacgaggaccattgatattttccgcttctataggcaatggacataatcaggctgccaaagcccttcaagtggagtttcaaaacaaaggatatcaaccagaaatcattgatacgttttattcattaagtccggccttacacaaatttatgcttacgagctatgtaaacttgctcaaggtgggtccaaggatctggcaaaagatttactttcaagcggaaaaatatccgttatttttgtttttagatcagtttgctactttctttgtagaaagcctccatgcgactgtgaaaagcaaccggtgttcctttttagtttccacccatccgtttgtcaccgcctttctcgttcgtttaaaaagcaagaagcagttaaatctgccgttatatacagtgattaccgatttcgttcttcacccagcctatctccgccctgaaattgatggctactttacaagtgatccgaactttaccgactttgcgaaattgaacaacgtatccgatgatcgcttctttccaacgggtatcccgattcctaatctggaatcaatcgatcaaccgaaatggaaagtgaggaacgatctaggattagaccctcaacgtaaagtgttgattattgcaggagggggcattggcttaaccaattacgctcaagtgatccgcgcccttgaatgtttacccgagcccattcaactgttatgtatgattggtcacaattaccaggtgaaagaaaaaatttcacgaatcaaaagcaaacacgagctaaaagtaatcgaatttaccgataaatttttactctacctcaaagcaagcgatgcgattttgtctaaggccggggggttaacgatggctgaatcattagtgtgtgagacgccaattatcattcaccagccagtgcctggtcatgaggaacacaacgcaaaatttttaattgacgctggcgcagcgctaagggtaaagggaagcaaggaaattcctacaacaatcaagcgagttctttacgaagaagcgtgctttggtccgatgatcgaaaatgcgagaaaactaaaaaaaccaaatgctgccaatgagattgtggagcagatgctgcttttagtgaaggaacagcagcacgccttccgctag

SEQ ID NO: 40960 - DNA, 2136 bp, Bacillus halodurans
gtggacaaagaccaacaaggaaccgaatcatctgaaaataagaagaatgaacagctagaaccattcaaggtggatcacaaaaacacgaagctcacaacgaatcaaggggtgagggtatctgacacggacgattcccttaaagcaggggatcgaggccctaccttaatggaagacttccattttcgggaaaaaatgactcattttgatcatgaacggattcctgagcgtgtcgttcatgcgcgaggtttcggtgcccacggctactttcaagtgtatgagccaatgaccgaatatacgaaagcatcatttttacaggaccctaatgtaaagacaccggtgtttgtccgtttttctacagtggtcggttcgcgcgggtcagccgatacggttcgtgacgtaaggggatttgcgacgaagttttacacagaggacggaaactatgacctagtagcaaacaacatcccgatcttttttattcaggacgctattaagttcccagatgtggttcacgccttaaaacctgaaccgcacaatgaaatcccgcaagcttctgcagcgcacgacacgttctgggattttgtcgttagcaacacagaaaccgctcatatgattatgtggctcctttcagacagagcaatcccgcgcagctttcgaatgatggaagggtttggcgtcaacacgttccggttcgtgaacgaacaagggaaggcccgattcgtaaaattccattggaagccgaagctcggagttcattcgctcgtttgggatgaagcgcaaaagcttgccgggaaagatcctgacttccatcgtcgcgatttgtgggaagcgattaacatgggagaataccctgaatacgagttaggcgtgcaaatgattgaggaagaagatgagttttcgtttgatttcgatatccttgatccgacgaagttttggccagaggaaatggttccggtaaagcttatcgggaaaatgacattgaatcgaaatcaggacaatttcttcgccgaaaccgaacaagtcgcatttcatgcagggaatgtcgtcccagggattgatttcagcaatgacccgctcttacaaggtcggcttttctcttatcttgacacccaactgcttcgcttaagtggtccgaactttcacgaaatcccgatcaatcgaccaattgcccctgtcaacaacaaccagcgagatggattccatcggatgacgattgacaagggggctgttagctactcgccaaatacgcttcgcaataactcgcctgaaccagcatcggatcaagaacacggatacgttcattatatggaaaaggtcgaaggacaaaaaattcgcaggcgcagtgagagctttaacgatcatttcagccaagccactttgttttggaacagtttgtcgacagcggaaaaacaacacctgatcaaggcgttccattttgaagtcggaagtgtaaaggataaaaacctcaaacaacgtgttgttgagatgtttaatcaagtcgatggaaagttagcggcagagatcgcgaaaggaatcggtgtcaaccctccgaccacacctgggggaacgggagtaacagcgtcatctccagccgtcagtcaagaaaatacgatcaaactggcaagaacgcgaaaagtggccgttctaattgatcatggctttgctttcgacgaggtgtcacaagtggtcactgcgctacaatccgctggtctcggagtagatctcgtgagtaagcagttagggatgatttccagcgctgaaggggagcaactagaagcaaacaaaagcttcgccactaccggtgccatcatgtacgacgcactttacatcggcggtggtgcccaatccattagtagcctcaatttgtacagtgaatcgaaaacctttgttgatgaagcatttaaacatgcgaaaacaatcggagctacaaatgaaggcattgaactactaatagctgcacaagttcaaggaattacattcgcaggtcctgattcgaacgatcatgttgtgaacgacctagggattattacgattcaaacagataaagattttaaggcatttactgatgaaatgatccacgccattgcccagcaccgccattggatgcgggaatttaaggatggcaaattgtccggttaa

SEQ ID NO: 40961 - DNA, 1536 bp, Bacillus halodurans
gtgacgaacttgaagttgttagatggacgctccttatcccttcatgatttgcatcgaatcatttatgaaggtgagacggtaggagcttcagatgaaagtatggagaaggtaaaacagagtcgaaaagcagtcgaacaaatcgtcgcagacgaaaaaattatttatgggattacgaccgggtttgggaagtttagcgatattttcatcgatccagacgatgtggagaatttgcagcacaacttgatctattctcatgcttgcggtgtagggtccccgttcccagaaacagtaagccgaaccatgctcgttcttcgggccaatgccctactaaaaggattttctggcgtaaggccccttgtgattgaacgacttctcgcccttgtgaatgcaaatattcatcccgttattccccagcaagggtcacttggagcgagcggtgatttagccccgttgtctcacttagccctcgtactcctaggagaaggagaagtgttttacaaaggcacgaaaacgaaggcaagcttcgccttaaaggaagaagagattgagccgattacgttaactgcaaaggaggggctcgccttgatcaatgggacacaagcgatgacagcaatgggggtgattgcttatttggaagcggagaagctggcctttcaatcggaaatcatcgcctccttaacaatggaaggattacgtggcatcatcgacgcctttgatgaacaaattcatttcgctcgcggctatgtcgagcaagtcgacgtcgctcgaaggatggagtcctatcttcaagacagtcaattaacgactaggcaaggagagctccgagtccaggatgcgtattcgctgcgttgcatcccccaagtccatggtgccacgtggcaaacgttgcgctatgtgaaggaaaagctagaaattgagatgaatgcagcgaccgacaatccattaatctttgataatggtcaaaaagtgatctctggcggaaattttcatgggcagcaaattgccttggccatggactttttaggaatcgccatggctgagcttgccaacatttccgagcgccgtatcgagcgtttagtgaaccctcaattaaatgacttgccgccatttttaagtgcggcacctggcgttcagtcaggggtcatgatcttgcaatattgtgcggcttcacttgtctctgaaaacaagacgttagcccatccagcaagcgtcgattcgatcccatcctctgctaatcaagaagaccatgtcagcatggggacgatcggatctcgtcacgcttatcaaatcatccaaaatgtccgtaacgttcttgcgattgaattgatttgtgccatgcaggcggttgacattcgcggccgggaaaagatggctagtttcacgaaaaaaatactagaaaaaggaagagagcacgttccttatattgatcaggatcgaatgtttgccaaagatattgaacgcgctgctaaatggctgaaggatggcagttgggatttcacaaaaatgcgtgaaaaggaaaggaccaatcactactaa

SEQ ID NO: 40962 - DNA, 960 bp, Bacillus halodurans
ttgaagggttatccatttctcgataaagcaaatgctccttttgtggatcgccatgtgacaaaagcaggagagattttttatccgtgggatggaaagagaattgacggattcggattaatcggggccccattatctaaatcatcaattagccactctggcgcttcgttcgccccgacagttattcgtaaatgcttacatgccttttctacctattcagtggaggaagatctggatttagcacagttaaagctaacagaccttggcgacattacgatgcacgtgaccgatattgttggctcgcaggctcggatcgaagaaacgatgacaaagctgctagaaaatgagcagaattggcagccaatcgttctagggggcgatcactcgattagcttcccgagtattaaggcgttcgcaagtgcaaaaggaaccattggcgtcatccaattcgatgcgcaccatgatttacgcaatttagaagatggcgggccatgcaatggaactccgtttcgcagcttactcgaaactgggtcgcttgtaggagaacatctcgtccaaatcggaatccgcgatttttcgaacagctatccttatagaaaatacgcagaaaagcacggggtcaaagtgtacacgatgaaagatgtaaacgcccgtggcctcctgacgattctagatgaagcggtggcaaaattgaagaggagcgtagatgttatctatgtttcggttgacatggatgtgctcgatcaagcccacgctcccggctgtcctgcgatcggacccggcgggatggatagcacaacattgctacaaggaatctttcatttaggaaaggactcgctcgtacaagggatggatattgtggaagtcgatcctacccttgacttccgtgagatgacgagccgggcagccgctcacgtcattttgaattatttaaaaggaaaatgcatcaaatcaatcggctag

SEQ ID NO: 40963 - DNA, 864 bp, Bacillus halodurans
atgacgatacacactgtaggagtggtaggagcagggaccatggggagcgggattgctaatctagctgccatgtccggattgcaagtagtcctgctcgatctggacgataaccaactggacatagcatggcagaaaatcaataccttcatggagaaaagtgtagcaaaaggtaaaatgagcgaagcggaaaaagaagcagctcttggacgaatcaaatcgacaacgacgtatgaagagcttgcagaggctgatctcgtcatcgaagcagtcattgaaaatttagatgtaaagaaagaagtgtttcacacattagatacctgtttagcgaacgacacgattattgctacaaatacatcttcaatgtcaataacggaaattgctgcggcaacgaatcgtcctgatcgagtagtcggaatgcatttctttaatccagcccaacttatgaagctcgttgaagtcgtccgcggttatcaaacgagcgatgatacggtagaaaccgttaaacaatttgcccgacagctaaaaaaagaacccattgaagtgaaaaaagataccccagggtttatagtcaatcgcatcatgattccccagtttattgaggcgattaaactcttagaggaaggggtcgcttcagcagaagatatcgataaagctgtaacattaggcttaaattatccgatggggccatttacgctacaagattatgcaggcgtcgatatcggccttcacgtgatggaatattttcagcaagaattcaacgatccccgttttacccctccactgctactaaaacagcttgttcgcgccggaaggctaggaaaaaaggtcggtgctggattttatgattacgacaatgaacgatag

SEQ ID NO: 40964 - DNA, 1179 bp, Bacillus halodurans
gtgaaagatgtagtcatattggatggagcgaggacaccctttacaagttttggtggtagctttcgagaggtctctgcgattgaattaggcgttgcagcagcgaaagaagcaatcaaacgggcaaatgtggacccggaagaagtggatcaaacgattgtcggtaacgtcatccaatcgagttctgatgcgatattaatggggcggcatgtcggattaaaagctggagttcgaacagagacgacggggttaacgattaaccgtctttgcggatcaggattgcaatcgatcctcactgcggctgaatcgatccgcttaggtaattccgaggttgccctagcaggtggtgccgagaacatgagtcaaatcccccacgtgattcgtggcgctagatggggattgccactcgggcaagcgaaaatggaagactatctttgggaagccctttacgatccttattgtgattgcacaatggcgatcaccgccgaaaatctggcggaacagtatcagatcactcgagaagaagtagatatgtttgccttgcgtagtcaccgcttagccttagaatcaatgagagatggaacgtttgcaaaagaaattgttgcggtgaacgtcaaaacaaaaaagggagagcgcatgattgacaaagatgagcatccccgtgaaactacgttagaaaagctcaggaatctcgtgccccgatttaaggaaagtggtgtcgtcacacctgggaatgcgagtggaatcaatgacggggcggcgatgatgattgtctcgtcaatggactatgcagagaggcgaaaccttaagccgcttgctcgcctagtgtcctatgcagttgtcggtgttgagccgtccatcatgggaatcggccctgcccctgcgattcaagaagctctcagacaagcaagtatgaaaatcgaggatctggatctcgttgaaattaatgaagcctttgccgcacagtatttagcctgtcaacaggaattagatttcaatccagacatcgggaatgtcaatggaggggcgattgccctaggccatcctttaggagcaagtggtgcaagaattaccctttctctcatttatgagttagctcggcgcaataaaaaatacggggtatccgcggtttgcattggtggggggcaaggaattgctgccatttgggagcgattacattaa

SEQ ID NO: 40965 - DNA, 1542 bp, Bacillus halodurans
atgctggaaaaagattattctgtttttcctcttttgtatcaggctgtgcaagcaaacccaaaaaaggaagcgctttacgatcttaacgaacggatcacatatgagcaattgcttgaaagagttaatgaactagcagcgattttcatagagatgggggtcgtcaagggggaccgaatcggcgtttgtctaccgaattggaatgaaacagtgatcatcttttttgcagcggcaaagcttggtgcaacggtagtcccgtttaatccaaactatcgggaatatgaaattgcctacattgtcgccaatgctgcgccaaagctattgttcgtctgtgaaaaggtagaagaaaatgtcggacttgccgccctagtagccgatcaacggcaacttatttcggtaaggttcaaaagcccctttgcgattccttttgagcaattgaagcgaacaaacaagtccgccatcgatgtctcaatcgttccgtcacatgaacgttactgcattttgtacacatctgggacgactggattaccaaaaggggtcatgatcacacacagcagtgttgtgcaatctgggctcgcccttgctcgtagcctgaaatgcacgaaagacgatgtctttatcgttccagctccgttattccatattttcggaatggcttgtaacttaatggctgccgtctcatgccaggcgaaggtcattttacaagaaaagttcaagccagaccatacgttagcattaattgagcaagagaaggtgacgattcatcaagctgttccgaccatgtttattttggaattaaatcaccccgatttctcaacttttgacttatcttcactacgagctggtatggttggtgcagccccatgtccgaaagaaaccgtacaagagattcgcaaaagaatgggattccacctttgtatttcttacgggatgaccgaagttggcgccgcaacgattacgccttatgaggatgaagacgaaagcagtcttgatactgtaggaaagccgatggaaggtgtcgagataacgatcgttaatgaggatagagaacctcttcccgttggggatattggcgagattgcgattcgaggcttcggcaatatgatcggttattacaagctacctgaacaaacaaatgaagtactcggcgacaacggctggttttacactggtgacctcggttctttagacgaagaaggttatcttcgttttatcggccgaaagaaggagttaatcattcgcggtggttataacatttatccgcaagaaattgaagcgattttatccgaacatgaaaaagtccaggagtcagcagttattggacttccagatgaggttcttggtgagcttgtatgtgctggcattaagctaaagcaaggggctcattcaagcgagcaagaactgttagcttacttaagcaagcgaatcgctcattacaaagtacctagtaaaatcgtatttgttgaggaattgccggtcaccgcaagtgggaaagttcaaaagagtcaacttcgtgagcagatcattgaaacaatcaagtcttaa

SEQ ID NO: 40966 - DNA, 1458 bp, Bacillus halodurans
atggaagcgatctatacgcgtcagtttcttgccggagaatggattgaaggggctagtactcaaacgatcaccaactataatccgtatacaggagagaaaatacatgaaatcaaaggagctagtctggacgatttagatcaagcataccgcgccgcgaagaatgcgcaaaaagaatgggagcagacgctaccagcacaaaagcaagaggttcttgaaaaagcagcggctctacttgctgaacggaaagatgaagtgatcgaacggctcgtcaatgaagcaggcagttcaatcatcaaagcgagcattgagtggggggctactttgcaaacgataaaagtcgcggccaccttccctttgcgcatggagggaaaaattctcccatctaatatccctggaaaggaaaaccgcatttatcgatcagccaaaggggtcatcggtgtgattagcccttttaacttccccctcgtcttagcgatgcgttctgtagcacctgcacttgcaactgggaatgcggttgtacttaaatgttcgtctgatgcgccgatcacgtcaggtcttctcattgcagagctttttgaagaagccggtttaccgaaaggagttcttaacgtcgtagtcggaaaagcggctgagattggagatgctttcgttacgcatcctatcccaaaattaatctcgtttaccgggtcaacggaagtggggcgacacattgctcaattagcggctcgtgagttaaaggagacggctctagagcttggaggtaacaacgtgatgatcgtccttgatgatgctgatattgaaaaagcagcagaaaaggcagctgtcgggaaatttttacatcaggggcaaatatgtatggctttaaatcggatcatcgtagatgcgagtatttacgattcttttgttgaagtgtttaaagaaaaagtgagccagctacaaacaggaaacccagccgagcctgccacattgattgggcctctcattaattataagcaaatcggccgtatccaacagctagtcaaggaaagtgttgcccaaggagcggtaaaagtattggaaggacatgttcaaggtaatctaatgagccctacgattttatcagaagtgacaaacgatatgccagtggcaaaagaggaaatcttcggccctatcgctccaatcattaaagcgaaggacgaagcggaagcgatagcgattgccaacgattccccatatggcttaagcggctctatattcacaggctctcttcatcgaggtgttcaagtggcaaaacaaattgatactggcatgattcatgtcaacgaccagcctgttaatgaggaggcccatatttcatttggcggggaaaaagattctgggatcggacgttttggcggggaatgggtgttagataaattcacaactgttaagtggattagcattcaagagaaggagcgagtatacccgttttggggataa

SEQ ID NO: 40967 - DNA, 2070 bp, Bacillus halodurans
atgtctatacacggtaaaacatttgtcacaaaggctaagcatatgcttcacggcggggattacaaccccgatcaatggttggataggccagatattttagcggacgatcttcacttgatgaagctgtcccatacaaacaccttttcagtcggtatttttgcatggagtacactagaacccgaagaaggagtttatcattttgaatggcttgatgacatctttgaaaacatccataaaatcggtggaaacattattttagcgacaccaagcggggctcgaccagcttggctatcgcaaaaatatcctgaggtccttcgcgtcgatgaaaatcgtgtcaaacagcttcatggcggacgccacaaccattgctttacctctgaagtatatcgaaaaaaaacacagcagatcaatcgcttgctcgcagaaaggtatggaaaccacccagccctcttaatgtggcacatttcgaacgaatatagcggcgaatgccactgtgaaaaatgccaagaagcgtttagagattggcttaaatcaacgtataacaacgatttagatgcgttaaacaaggcctggtggacctcgttttggagtcacacttataccgaatggtcacaaattgaatccccctctccaatcggagagaagggggtgcacggcttaaacttagattggcgtcgctttgttacagaccaaacgatttccttttttgaaaatgaaattgtcccgttgaaggagctcacgccagagattcccattacgactaactttatggcggatacgtctgatcttattcctttccaagcccttgattacagcaagtttgccaaacacctcgatgtcattagctgggatgcttatcctgcatggcataacgattgggaaagcaccgctgatctggcgatgaaggtcggctttattaacgacttatatcgaagcctaaaacaacaaccgtttttgttaatggaatcaacgccaagtaaagtcaattggcatgacgtcaataaggcaaaacgccctgggatgcatttgctttcttcgatgcaaatgattgcacatggctcggacagcattttgtatttccagtggcggaaatcccgaggttcttcggaaaaattccacggagctgtcgttgatcatgataacagtccgaataatcgagtgtttcaagatgtcactgaagttggagaaacattggaaaagctagcacctgtcgtcggtacgaaccgcacctctgaagtagccatcttgtttgattgggaaaaccattgggcactcggggatgcgcaaggatttggaatgaaatcaaaaaggtacccacaaacgctgcagcaacactaccgtacgttctgggaacgcgatattccagtcgatgtcattacgaaggagcagaatttctccgcttatcgattgctcattgttcctatgctctatttagccaacgaggagacggttgcccgtttaaagtcatatgtggcaaacggaggtacgcttgtaatgacttatattagcggaattgtgaacgaatatgatttaacctatacgggcggttggccaaaggactttcaagacattttcgggatgagaccactcgaaaccgacacgttgtatccaagtgatcgaaattatgtcacctaccaagataaaacgtacccgataaaagattacgccaccattattgatcttgaatcagcccaagcggagggactctataaggaagacttttatgcaaagcttccagccgttacgagtcactcttataaaggtggaaaagcatactacattggcgctcgcctagacgatgagttccatcgtgatttttatagtcgtctcatgactgatttatctctaacatccgttctactagtgaatcatggtccaggtgtttctgtgcaagcaaggcgagataccgtaaccgactatgtgttcgtcatgaattttaccgaagaaaagcaaacggttactattcaatctgaagtacaggatttagtaacgaaagaaaacgtacctgctgaatttacgttaaagccctatgaagtgaagattcttgtccattcaaaatctaacaaatag

SEQ ID NO: 40968 - DNA, 1185 bp, Bacillus halodurans
atgacggaagaagtcgtaatcgccagcggggttcggacgccgattggccgcttcggtggtcatttaaaagatttgaaagcgccaacattaggagcgcttgtaatctcagaagcgctccaccgggcgggagttcttaatgagcaggtagatgaggtgattatggggaatgtcctccaagctggacttggacaaaatccagcaagacaggcggcgctccaagccggcttgcctgaaacagttccagcgatgacgattaataaagtttgcggttctggcttaaaagcggtccacttagcgtcccaggcaatcgcttgtggtgatgccgagattgttgtcgccggcggaatggaaaatatgagccaagctccttatctagcagtaggggcaaggaatggctatcgaatggggcatcatcaactaattgatagcatgatccatgacgggttatggtgtgcatttaatgattatcacatggggatcaccgctgagaatctatgcgagcaatatggactgtcacgaaccgaattagatgaattttccgcatggagtcaagaaaaagccgtccaagcgattgaatcaggtcggtttaaagatgaaattgtaccagtagacatcccacaaaggaaaggcgaaccgatccagtttgataccgatgaatatgtgaaaagagggacgactactgaaacgctaggagctcttcggcccgcatttaaaaaggacggcaaggttacggctggtaacgcctctggcatcaatgatggagcagcagcggtcgtcgttatgagtaaagaaaaggccgttgagctcgggatcaaaccactggtcacagttagagcgaatgcaacagcaggggtggagccgaggattatgggaatcggtcccgttccagcaacaaaaaaagcattaacgaaagccgggctaacgatggatgacattgacctcattgaagccaacgaagcctttgccgctcaatcattggccgttgccaaagaactttctttcgcagaggatcggttgaatgtcaatggtggtgctatcgcattaggtcacccaatcggtgcaagcggcacgcgaatttttgtcaccctccttcacgaactcttgcgccgcggggaaacctatggtttagcgaccctctgcatcggtggcgggcaaggcgtagcgacaatcattgaaagagcataa

SEQ ID NO: 40969 - DNA, 1974 bp, Bacillus halodurans
gtgttcaaaatcgatggaagtcgcctcgtgagagagtacgattctgagaaactatggattgaaccttggggaaaggatgccctgcgagttcgtgcttcgtatacggcaatagaagacaccgattgggcgcttcttcccgtaaaggaaatggaagcggatatttctttaaccgaggaaacagccacaattgtgaatggcaaaataaaggcggaggtgaagcgaaacggacaaatcactttttataatcagaaaggtgacgttttgttaaaagaaacggaaaatacttaccaactgaagtacggtggcagagaattaaccccgtatccaggaagtagtgactatcgcctaactcttcggctagagtcaaatccgaaggaaaaactttttgggatggggcagtatcagcagccttttcttaacttgaaaggatgtatgcttgaactgacacatcgaaatagtcaatccagtgtcccatttgtattgtctagcctaggctacggatttctctggcataatcctgccattggtcgggtgaactttaacctcaatgtaacggaatggatggctccttccaccaagcaactcgactactggattacagcaggggatactcctgcagagattgaagaaacgtatgcgtctgttactggaacggtccctatgatgccggagtttgccatgggcttttggcaaagtaaattacgatatcaaacgcaggaagagttgttagaagtagccagagaatataaaaggagagagcttcccatttctgtaatcgttattgatttctttcactggccgaaccagggcgattggaaatttgaccccgagtattggcctgaccctgcaagtatggtgaaagagttaaacgaaatggggattgaagtgatggtctccgtatggcctactgtccaaacggaaagcgaaaattaccaggaaatgattggaaaaggatatctagttagatccgaccgaggggttcgcacccaatttcaatttttgggacaaaatgccctattcgatgccactaaccctgatgggcgcgaatacttatggaaaaaaatcaaaaaaaattattatgataaagggataaaagtattctggctcgatgaagcagagccggaattcacggtttacgaccatgatatttatcgctatcatctaggctccagtttacaaataggaaacatttatccgagtaaatatagtcaaacgttttacgatggaatgatagcgtcagggcagagtgagatcattaatctcgtccgtgctgcttgggccggtagccagcgctatggtgctctcgtttggtctggcgatattcattctagctttgaagtattggccatccaagtacgtgctggtttgaatatggcgatcgccggaattccttggtggacaaccgacattggaggttttcacggcggtaatcccgaagatccttcgttccaggaatgtatcattcgctggttccagtatggtgtattttgccctgtatttcgacttcatggagacagattgcctagtcaaaagccgatcggaacgactgggggaggacaatgccctagcggcgcggccaatgaggtatggagttatggagaagaggcctacgaaatcataaaggatcttttacatgtacgcgaaagactccgcccttatattaccggccttatgaaagaagctcatgtaaaaggtactccgcctatgagaccactattctatgactttcacgaggacgagcacgcttgggaagtggatgatcagtacatgtttggtccagatattttagttgctcctattctaaaagaaggagagcgaagccgccctgtctatttgcctaagggagcagattggtcgaacccttattctggacagtcttttgaaggtggacaacagataaccgtagatgcaccattaaaacaaatcccgttgttccttaaaaacggggcagaccttccgattgttcaccggtaa

SEQ ID NO: 40970 - DNA, 933 bp, Bacillus halodurans
atgcttgaaacgatcaatttgtgcaaaacttttaaaggacagccagccgtgcaagaggtcaatatgtatttgaactctggtgaatccgttggcttgctaggcccaaatggggcagggaaatcaacgacgatctctatgatctcaactttgattaaaccgacaagcggagaaattaagcttaatggtataaacattattagtcatccaggagacattcgaaaaattttaggcgtggtgccacaggagttagccctttaccaagagctttcagcttatgaaaaccttaaatttttcggttcaacttataaaatgaaaggaaaacaccttgaaaataggattcaacatgcattagaaattgttggattaaaagaccgtcaaaaggatttggtcaaaaccttttctggtggaatgaaacgccggattaacattgcagcagccctgctccacgagccgaaaattcttattttagatgaaccaacggttggtatcgacccgcaatcgagaaatcatattctagaaacagtccgaacattaaatgaaaacgaaggaacaacggttttatacacgagtcattatatggaggaagtcgaacagctctgtgatcgattgtacattatggaccatggggaaattattgcagcaggtacgaaagaggaactactgagcattttatcgacggaggatacgattaaagttgaacttagtaagattgacgaaacttttgttcagaatgtgaagatgatcgaaggtgtacgtaaggtagaggcttctcattcgcaattgaaaatgatcgcgaaaaaaggcagccatttgattcgcgaactcgtccacctaacggaccaacatcaaattcaaatgatccattttcatacagagacgcctagcttagaggatgtgtttcttcatttgacaggtcgaacattacgggattaa

SEQ ID NO: 40971 - DNA, 1377 bp, Bacillus halodurans
atgacaacattggtaagagagaaacaaacgtatgacgttcagtattatgtacagcacgtatacgaaaccgtgaaacgacgtaatccgaatgaacatgaatttcatcaagcggttaaggaagtgtttgattcgttactacctgtccttgtgaagcatcctcaatatgttaagcaagcgatactcgaaagaatcgtagaaccggaaagagttatttcctttcgagtcccttgggtggatgatcaaggaaacgtccaagtgaatcgtgggtttcgtgtacaatttaacagtgctctcggaccgtataaaggtggtttgcggtttcatccttctgttaatgcaagcatcattaaatttctcggatttgagcaaatatttaaaaacgctttaacaggtcaaccaattggcggtggcaaaggcggctccgattttgacccaaaaggaaagagcgacggtgaaatcatgcgttttagccaaagcttcatgtcagagcttagcaactatattggaccggatatagatgttcctgcaggagatatcggtgtgggcgccaaggaaattggctatatgttcgggcagtataaaaaaatgcgtggcggctttgaggccggagtgctgactggaaaaggcattggctacggcggaagtcttgccagaaaagaagcgactggctacggcacggtgtattttgtagaagaaatgatcaaagatcacggcttcagctttgctgggagtacggttgttgtatcgggatcgggaaatgtctcgatttacgccatggaaaaagcgatgcagctcggtgcaaaagtggtagcatgcagcgattctggaggctacgtctacgacaaaaacggcatcgatttacagacggtcaagcgtttgaaagaagtcgaaagaaaacggatcagcgaatacgtaaacgaacatccccatgctcattatgttcaaggttgctcaggtatatggtctgttccgtgcgacattgccttgccttgtgcaacacaaaatgaactcgatgaagcggctgcaacgatgttaatcgctaacggtgtgaaagcagtcggtgaaggagccaatatgccttccacacttcaagctgtccatacctttcaagagcatggagtactgtttgcgcctgcgaaagcggcgaatgcaggcggtgtttccgtgtctgctttggaaatggcacaaaacagcacaagattagcgtggacttttgaggaagtggatgccaagctgtatgagataatgaaaaacatttatcgcgaaagcataaaggcggcggagttgtatgaggcttctggaaatcttgtggtcggcgccaacattgctggattcgtgaaagttgcagatgccatgatttcccacggggtcgtctag

SEQ ID NO: 40972 - DNA, 1191 bp, Bacillus halodurans
atgattacactttttagaaagccttttgttgctgggctagcgatctctttattagttggaggggggatcggcaatgtagctgctgctcaaggaggaccaccaaaatccggagtctttggagaaaatgaaaaaagaaatgatcagccttttgcatggcaagttgcttctctttctgagcgatatcaagagcagtttgatattggagcagcggttgagccctatcaattagaagggagacaagcccaaattttaaagcatcattataacagccttgtggcggaaaatgcaatgaagcctgaatcactccagccaagagaaggtgagtggaactgggaaggcgctgacaaaattgtggagtttgcccgcaaacataacatggagcttcgcttccacacgctcgtttggcacagccaagtaccagaatggtttttcatcgatgaagacggcaatcggatggtggatgaaacagacccagataaacgtgaagcgaataaacagctgttattagagcgcatggaaaaccatattaaaacggttgttgaacgttataaagatgatgtgacttcatgggacgtggtcaatgaagttattgacgatggcgggggcctgcgtgaatcggaatggtatcaaataacaggcactgactacattaaggtagcttttgaaaccgcaagaaaatatggtggtgaagaggcaaagttgtacattaatgattacaacaccgaagttccttcaaaaagagatgacctttacaacctggtgaaagacttattagagcaaggagtgccaattgacggggtaggacatcagtcgcatatccaaatcggctggccttccattgaagatacaagagcttcttttgaaaagtttacgagtttaggattagacaatcaagtaactgagctagacatgagtctctatggctggccaccgacaggggcatacacgtcatatgacgacattccagcagaactccttcaagcccaggcagaccgttacgatcagcttttcgagttatacgaagaattagctgctgatattagcagtgtaactttctggggaattgctgataaccatacatggcttgatggccgcgctagagagtacaataatggagtagggatcgatgcaccatttgtttttgatcataactatcgagtgaaacctgcttactggagaattattgattag

SEQ ID NO: 40973 - DNA, 1125 bp, Bacillus halodurans
atgattggaaggaagcgcaagtatgaagatcctcacatccgatcttttcacgagctgttaagcggacacaatccggttctatataagaaagaagacttgctagcctatgattgcgatgggtttacgattcataaacatttgccaaaggcggttgtgtttccggaaaatacaagggaagtggcaagcattgtccgttactgtcacgatcacaaccttccctttctcgccagaggagccggaacaggactaagtggaggggcgatcccgatcaatggggaggtcattattagcctcgtacggatgaagcgcttacttgaagtcgatctgaaaaaccgccgcgcgatcgttgaacctggctatgtcaatttaaagcttactcaatccattgaggacaaagggtattactatgcgccagatccatcgagccaatattgctgcacaatcggtggtaatgtggcagaaaatgctggcggtgcccactgtcttaaatacggagttaccacgaaccatatcttaggaatggaagtggtactcccgaatggggacattgtggaaatcggaaaagctggaatattggatgaacctgggtatgatttgcttggactgatgacgggatcagaaggaacacttggaattgttacaaaaattaccgttcgcattttgaaacatccagaggcgaaacagacggttttagcttactttgacaaagtgagcgatgcaagtcacacggtgtctgacatcatttcagaagggattgtcccagcagcgcttgaaatgatggatcgcatagcgatggaaggcgtggaggccgccgctttccctatcgggcacctacttgatgcggaagcggttttgctaatcgaagtggacggcatttctgccggaatggatcaacaaattgaacgtattttaaccgtttgccgaaagcatcatgttcgcgaggtgaaggatgaaatggtgggcgaaccgaaaaacaggctttggtgccatgggtgccatctcacccgattacctcgtacaagatggagtgatcccgcggacaaagcttccggtcgtgctttcaacgattcaaaaaatcagcgaaacatacgggctacgaatcgcaaatatttttcacgccggtga

SEQ ID NO: 40974 - DNA, 1326 bp, Bacillus halodurans
atgatcgtctctaatgcgcacgccaaacttgtcaaacaattaaataatagccaagttgtacaacgtgaccgaatgaacgatccctatggaaatacaggtttactagaaattatcccaacaacggagcgagagctagccgatgttctgacacttgcaagtgaagaggagcatcttgtaacggttgaaggagctggaacgaagcgggggtttgctgggacattattagaaacggaatgggtcgtatcacttcaacagtttacaggcatcgtagaccactcgataggagacatgacggtgactgtgaaagctggaacgcctctacgaaaacttcaaaaagagcttgccatttttaagcaggcgctcccattcgacatgccctgtgatgaagctgcaacgattgggggcatgattgccacaaatgaaagcggacctaaacgcctccgtcatggagcagctagggatcatgtcatcggcttacgggtcgtctatcctgatggtcgcatcattcgtactggtggaaaagttgtcaaaaatgtggctggctacgatatgaataagttgtttattggttcgatgggaacattgggtgtcatgacagaggtgaccttaaagctacgcccgcttccaaaggatgagcgagtaatcattgcctttttcaacgaaaaccaactgacactgatcgaagatgttgtcgccagtttacttgattcctatatggagccggttgcacttgaaatcatgaattcgacatggacggaagcagtcacaggggaggtggcgttaggccttctgattagctttgaagatataccgtcctcggttcactatcaagaacaatacgtcttatcacaattgccaaagggaacgaacgctgccatctttcagcgagaagatgccaataggttctgggatcaatggcgaaaaagggagtcaagtcaaacattggatcaatccaaccaacagacagcagttaagctcaaagtagcagtcaaaaatttcgatcttttttcggtgctgcaagaatgtaagcgattaacagtccaatatcatgtttctacctcttttcatggcggtgtggggcatggtctcggtgtgatcatcttaacaggagacgaacaagacatttgtctagcgatcgcggatttgcgtcaagttattgcaggtgcctctggacatctcgttctcacacatgctcctcttacgattcgacaaactgtcgatgtatggggagaaccacctgcttacatggaactgttacaagggattaaacaggctattgatccacagcgaatactcaatcgaactcgctttgtaggggggatttaa

SEQ ID NO: 40975 - DNA, 774 bp, Bacillus halodurans
atgaaaaatcaaacaatcattgtcacgggtggcagcaatggaatgggaaaggcaatggcggcaaggtttgcttccctaggggcaaatgttgtgatcacaggacgagatcaagagcgtctcgaaacggcgaaaagcgaagttgcacaagattccggacgagtgttgaccgtccaaatggatgtcaggaatcctgatgatgtggaacggatggtgaaagatacgctctcagagttcggagcgatagacggacttgttaacaacgcagcgggtaatttcttatgcgcagctgaagatttgtctctgaatggttggaaatcggttattgatatcgttctcaatggaacgtggcattgcacacaagcggttgggaaggagtggattaaggacggacgaaaaggacatatcctaaacatggtcgctacgtatgcgtggactgcaggagcaggagttgttcattcggctagcgctaaggcgggagtattagcaatgactcgcacgcttgccgtagaatggggaacaaagtacggcattcggttgaatgcgattgctccaggaccaattgaaggaacagggggggctgagaagctaatcctaaacgagacatttcagaaggcagttttgcagacggttcctttgaaacgatttggtacattagaggaaatcgcaggtcttgcagcttatcttttctctgaagaagctacctatatgaatggagaatgcattagccttgacggcggtcaatggctgcgcggaacccttttcccgttttcttaa

SEQ ID NO: 40976 - DNA, 831 bp, Bacillus halodurans
atggcaaacaacttacaagcaacgactaccttacataacggcgtgaaaatgccttggtttggccttggtgtgtttaaagtaagtgaaggggatgaagtgatccagtcggtaaaagatgctatcagggctggatacaaaagtattgacacggcagctgtatacgggaatgaggaaggagtaggcaaagcgattgctgaatctggagtcccgcgtgaggagctcttcatcacatcaaaagtatggaatgcagatcaggggtttgattctacgatttcggcgtttaacacaagtttgaaaaagcttggccttgattatctggatctatacttagttcattggccggtgaaaggcaagtatgtcgagacatggaaagctctagagaaactgtatcaagatgggcttgttcgtgcaatcggcgtaagcaacttccaagtgcatcatctgaaagacgtcctagaggcagggtcgattgttccgatggtcaatcaagtggagtatcatcctcatttaacgcaaacagagcttcatgacttttgtaagcaaaacaaaatccaattggaagcctggtctccattgaagcaaggtcagttgttaaatgatccaacaattgtagccattgcagaagcgcatcagaaaacacccgcacaaatcattttacgttgggatttacaaaatgaagtcgtcacgattcctaaatcggttaaaaaagacagaatcattagcaatgccgatatttttgatttccaactgactgaggaagacatgcagaaaataaacgagttgaacaaaaatgaacgggtaggccctgatccagacaactttgatttttaa

SEQ ID NO: 40977 - DNA, 753 bp, Bacillus halodurans
atgcaattattctctttagaagggaagatcgcgttagttacgggagctagccgtgggcttgggcaagggatggccgttggacttgcagaggctggagcggatgttattggcgctgggattagtgatatgtctgaaacgcgacagcagatcgaatctttaggtcgaactttttacgagctgaaagcagatctatttgaggaaggggccggaaagcaattaatcgctgatgcgattgaaaaggcaggacgtatcgatattctcgtcaacaatgcggggattatacggcgcaacgaagcagaggctttcaccgataaagattggaatgatgtcatcaatgtcaatttaaatgctgtatttcaaatgtgccgcgaagcagggaatcatatgatcgaaaacgggtttggacggattatcaacattgcctctatgctttcgtttcaaggtggactcagagttcctgcctatacggctagcaaacatgccatcgctggacttacgaagtctcttgccaacgagtggtcaaaaaaaggagtcaatgtaaacgccattgccccagggtatatggtgacagataatacggcagcgcttcgtgccgatgaggtgagaaacgcctatattacgtcacgaattccaaaaggtgagtggggaacgcctgccgatttaaaaggaccggttgtctttctcgcatcggaagcatcaagctatgttaacggccatattttgtgtgtagatggcggttggatgagttcatag

SEQ ID NO: 40978 - DNA, 1368 bp, Bacillus halodurans
atgaaggcgagtcaggctgaatctgaaaaaatgctaaagtggtgggaactctctctccttggggtcggctgtatcattggaacaggcttttttcttggttcgagcattgcgatccagatggccggcccgtctgtattgctcgcatttattttagcaggaatcggtacatatattgtttttgatgcattggcacaaatgacgtctgctgaccctgagaaaggatcgtttcgttcttatgctaaaaaagcctacggccgatgggctgggtttacgagtggatgggtgtattgggcctcagaaatgttaattatggggagtcagctaacggctctgtcgattttttctcgtttctggtttccagatgttccgctgtggattttcgccagtggcttcgccgttcttggcatcatcgtcattttgactggctcgaaagggtttgacagaatcgaaaatctgtttgcagttatgaaggtagcggcaatcgtcatgtttattgctctggccattttagctttgtttggggtttttcgcgctggccctgaaggtgcaggtataccgaggacttggaacggtttatttcctgaagggtttcttggactctggccagccctcattttcggtttttatgcctttggcgggattgaaattatggggttgcttgccaatcgtttggaggaaaaaggggatgcagcaaaatcagggcgtgccatgctgctgttgcttacgtttctatacgtcgtttctgttggactggccctcattctcgtccccctcaatcgctttaatacggagacaagtccatttattactgcattgaagccatacggtttaccgatcgtgtcccatttgtttaatggcgtcttgattattgctggcttttctactatggtagcctctttatttgctgtgacgagtattttagtgacattggccgcagataaagatgcccctaatctgtttgccaaaaaagtaaaaaataaaatagctctcccagccatcggactaacggcgatcgggatggcgttatccgtcgtgttgtcgttgcttatccccggtcgaatttacgaatactttacgacggcagcgggactcatgctcttatataactggctatttatcatcgcctcgtcagggaagttaattcagtaccgtttaacgaagcgttggattggcaccttgttcattttgttagctgtaatcgggacgttgtttcaccgaacaagtaggccgggttttttgtttagtcttgggtttttagttgtaatcggaattgtgaccctcatgatgaaaaagcgctggaagcaagaggagggcgatggaaaaaagcgcccttccatatttgtgaagttaaaaccaaattctgaatga

SEQ ID NO: 40979 - DNA, 615 bp, Bacillus halodurans
atgaagcatatttttcgaaaaggggcagatccaaatgccccgacccttttactattacacgggaccggaggaaatgaacatgacttagtcccacttgcggaaatgataagtccaggctcctccattttgggtgtaagaggcaacgtacttgaaaatgggatgcctcgtttctttcgccgtatcgcggaaggggtatttgacgaagaggatttagttatccgcactaaggagcttcacgagtttttagatgatgctgtaagagagcatgcaattaatcgtaaccggcttgttgccattggctattctaatggtgcgaacatcgcagctagcctgctgtatcattacgagcaacctttgatgggagccattttgtttaaagccatggtgccattacggaacaggacagtaccggaccttcagcaaatgccgatttttatcggtgctggaaaatatgacccactcattccacaaacagaaacgaaggagctcatcaacaccttgacgaatgcaggtgcaaatgtttacgagcaatggattgacgtgggccatcagttaactcgcgaagaggtggagcgagcgaaggaatggtttaacgaacagtttttagaagcataa

SEQ ID NO: 40980 - DNA, 1152 bp, Bacillus halodurans
atggaccttttgacatgtgagacggaagcgcagcgacttacggtaacgaaaaaagtggcctcagcgtttcaagagggggcgcgaattcatgatcaggaaagcacgttcccgtttgctcatattgaagcgttgaaaaagattggctatcctagcttagcgttgccgaggactttcggtggcctagaaataacactgcttgaaatgatgaaacatcaagaaacgattgcccgttttgatggtgcaacagctttgtcgattggctggcacgtcggtcaaatctttcaatggagggctactgcacagtggaaaaagccggagtaccgcttgatttgtgagcaaatccaaaacaagcaaattctattgaattcagcggcgacagaaaaagcgacaggcagtccagcccgcggcgggaagcccacgacgacagcgacaaaaagtggagaagagtgggttatccaagggagaaagacgtttacgagtatggcaccagcgttggattacgcgttggtgacggccaccattgcaggtgaaaatgaagtggggcaatttttagtcccgatgaacgcgagaggtgtcacgattgatgagacgtggaacatggttggcatgcgggctacatcaagtcacgaccttgtccttgatcatgttcgtttaccgttagaagcgcttatggaacgaatagagcctggaatgaaaaaagcagcaggttggcttcttcatattccggcatgctatcttggcattagtcaggcggcttatgatgaggcgattcgctttgcgaagcagtattcaccaaatacactagacggaacgatttcaacgttaccccatgtacagcaaaaaatcggagaaatggcgatgcttcttatgcaaagtcgcaccattcttcattcggttgctagacagtgggatgaaagctctgacttggagcgagaggaaatgaaaagggagctagcgatggcaaaagtaacggttatcaataacggactgagtgtcgtggatatagcgatgcgtattgttggtgctcacagtttgcatatggatcatgatttgcaacggtactatcgtgatatgcgcgctggcttgcacaatcctccgagcgaggatatgacgatcgccatgttagcaaaggaagccctacgtgatgagtag

SEQ ID NO: 40981 - DNA, 2136 bp, Bacillus halodurans
atgaaatgtcaacaatgtcaaaccaatgaagcgactgtcactttgcacgtaaagattaatcaatccagtcaacaacttcatgtttgttcaagctgctatcaacagatcgagcagccatttggtttttccgacttttcttcatttgacaacatgtttaagcaatggatcggttctacttcttcttccatgaatggaagcgatcaacctgtaagctctatcgcaatgaaatcaaaaacaaatcatagcggaggtggttttttagatcagcatggtcgaaatgtaacggcagaagcaaaagcaggacaaatcgaccctgttattggacgtgaccaagaggttgaacggctgatccaaattttatgccgccgtacgaaaaataaccctgtgctgattggagaagctggtgtcgggaaaacggcgattgtcgaaggctttgctcgacgaatcgccgaaggcaacgttccggcgaaaatgaaaaacaaggaagtgtacgaacttgagctatcctctctcgtggcaggaacgagctatcgcggccaatttgaagaaaagatggagcaactcgtccgtgaactagaagcgcgggacgacgtcatcctctttatcgatgaaatccatatggtcgtaggtgcaggtgctacgtctgaaggctcaatggatgccggaaatatcctgaaacccgcccttgctagaggacaattgcagatcattggtgcaactactttaaacgaataccgtaaaattgaaaaagatccggcccttgaacgtcgctttcaaccaatcacagttaaggagccgacacttgaagcagcggttgagattttaaaaggggtgcgacccatctatgaagcttatcatcacgtaagctaccctgatgatgtgcttgaagcgtgcgttcgcttatccgatcgatacattcaagatcgtttcttgccagataaagcgattgatttaatggatgagattggctcagcgctcactcttacatctggtcctacgacccttgatgaactaaaggaacgccttgctgaaatcacaaaagaaaaacaacaggcgacggcacaagaagattatgaacgcgcagccaaactccgtgatgaggaaaatttgttacacaagcaaatgaatgaaaaccgtgcggaaaaaactgaagttactgttgcagacattcaagggctcattgaaaaacggacaggcattcctgttcgcaagctgcaaaaagcagagcaaacgaaaatgaaagatttgcacaaccgtctcgctagacaagtgattggtcaggcagaagcggttgaaaaagtagcaaaagcgatcaaacggagccgtgctggattgaagccgaaaaatcgcccgattagctttatgtttgtaggaccaacaggtgttggtaaaacggaactgacgaaaacactagcccaagaattgtttggctcaaaagaagcgatgatccgcctcgatatgagtgagtttatggaaaaacactctgtctctaaactaattggatcacctccaggttatgtcggacatgacgaaggcggccaattaacagagcaagttcgccgtaagccttacagcatcattttgcttgatgaaattgaaaaagcgcaccctgatgttcagcatatgttcttgcaaatccttgaggacggacgtctcactgacagtcaaggccgagccgtctcctttaaagatacggtgatcattatgacgtccaacgcaggtgttggtgtcaaaaaaataaccgtcggctttgagaagaatgtggaaacacaaaataaagccggaattcttgaacaaatcaaccaatactttaaacctgaattcttaaaccgtcttgatgcgattattgagtttaaccatctcacagagcaagatcttatgcgaattgttgacttgatgctacaagacttaggagaccgtctagctgaacaagatatatcccttactgtctctgagaaagcaaaagcacaactcgttaaaattggctctgaccgtgcatttggcgcgagaccattgcgccgggcaattcaagaccatgtcgaggacagcataaccgaaaagctgatcgatgaagaaagcatcaacgccattcatgtcgattatgatgtcgttcaacaatcgttcactttcgcgtaa

SEQ ID NO: 40982 - DNA, 1212 bp, Bacillus halodurans
atgaatgaaaggataagtaaagggagtgcttacatgatcgcaaaagagatcgaacaaaatttaacacaaagttcatggattcgaaaaatgtttgaggaaggtcaacgccttaaatcgatccatggaacggaaaatgtttttgatttttcactcgggaatccaattattgatccgcctgcttcttattttgagcaacttcgggcgtatgccaatgctccgatccaaggtggtcatagttacataccgaatcaaggattaccagaagccagacaaaaagtggcagagcatatgaatggtcgttttaacacaaacataaccgcccaaaccgtgacaatgacgtcaggtgcagctggagctttaaatgttgctttaaaaagtattatgaatccgggggatgaagtgattatatttaccccgtattttgccgaatataaattctatgtaggaaatgcgaatggtgttgctgtttactgtccgctagcagaagacttcacctttgattttaatgaactggaaaaggcgatttcaccgaaaactaaggcgatcatcttgaacaacccccacaaccctacggggcagctaatccctcaatctgacctagagcgattaaatcaatatttagttgcaaaagagcaagaatggggaacggaaatccatgttctttatgatgatccatatagtcaattgatttacgatggtaacgtgccaaatccttttgcggcaattgagcgcctattttatatttcttctttcagtaaggatctaggcttggctggggagcggctaggatatctcgcgattagacctgattttcctagtgtcgagcaatatatggcagccttcgtttttgcgaatcgcacgctcggttttggaaatgctaccgtcactgtgcaacgcatgataagcaaaatggacacgttgacacaggagcagcacgaatacaaaaagcgtcgcgatgccatggttcaagtcctcgaagatgctgggtttgagttcgtctatccgaaaggtggattctttatttttccgaagtcaccgattgctgatgatacgaagttttgtcaagtggcagccgaagagttccagctccttgttgtacctggtattggttttgggcgcgctggtcacttcaggctatcctacagtgtttcgatggaacaaattgaacggtcggcacccgtattgaaaaagttaaaatcttacttttcttag

SEQ ID NO: 40983 - DNA, 1236 bp, Bacillus halodurans
gtgattgaaattaaagtaccggaactagcagaatcgattacagaaggaaccatcgcgcaatggttgaaaaaggttggggaccacgtatcccaaggggaatacattgcagagcttgaaacagataaagtcaatgtagaaattacggcagagcactcgggtgtcattcaagaactaaaaagagaagaaggtgacacagtcgaggtaggagaagtgatcgccgttctagcggaaggcgactctcctactgcttcaaccgaacaagcagaggctccgaaagaagagaagaaggtttctactgtagcttctgaggaagcagcccctgcccctgggaatcgtccggtcgcgtcaccggcggcacgaaagcttgcgcgggagaaagggattgatttagaagctgtgccaacagctgacccgttaggacgtttgcgcaagcaggatgtggcttcatatgaagaaaaaccagcagcttctgctccggcgaaggcacctgagaaaaaagcggctcctgccgcagctaacgttgaatcaccaggaaagccagtggagcgaatcaaaatgtcccgtcgccgtcaaacgatcgccaagcgtcttgtagaagcacagcaaacagcagctatgctcacaacgtttaatgaggtagatatgtcggcggtaatggaacttagaaagcgccgcaaagaccaattttttgagaagcatgatgtgaagctcggattcatgtctttctttacaaaagcagttatcggcgcattaaaagagttcccgcttcttaacgctgagatccaaggagatgaaatcttactgaaaaaatattatgacatcggcatcgccgtatcgacagacgagggccttgttgttcctgttgtccgcgatgcagatcgcctcggtttcgcaggcatagaaagagaaatcatgcaccttggaaagaaagcacgtgagaataagctctccctttcagaattgcaaggaggaacgtttacgatcactaatggcggcgtgtttggctctctttggtcaacaccgattttaaatgcgcctcaagtggggatcttaggaatgcataaaattcaatggcgccctgtggcaattgacgaagaaaactttgaaaatcgcccgatgatgtacattgccctttcttacgatcatcgaattgtagatgggaaagaagcggtaagcttcctcgtacgagtcaaagaaatgctagaagatccagaatcgctgctcttagatagttaa

SEQ ID NO: 40984 - DNA, 2838 bp, Bacillus halodurans
atgtccagcaaggagcacacgtcggaagagccttggcaaggattttatggtcctaaccttggtgtagcagtagagctttatgaagagtaccaaaaggatcccaatgcggtcgatgatgaattgagagaagcatttgaaaaatggggaccaccgccggcaacagcaccagagcgtacgcaatcaacgtttacagcagcatcaatcactgacccagacgtcattaagaagttcgtgggtgcagtgaaattagctgatcatattcgtgcgttcggtcatttagcagcggatattcaaccaattctcaaagagcagcgcagggaagatatgttcgatttggatcgttttggcttaacagaaagtgacattcgctccgtacctgtggacttactctgtccatatgcacctgcccatgttaagaatgggttagatgcgatcaatcatttaaaagaagtttatacaaagacgattgcttttgaatttgtacacgttaccgatgaagaagagcgcaaatggttgaatcgtatgattgaatctgggctctacttaccaaacttatcgactgaacaacgaaaatccttacttaagcgcttaactgatgtagaaggattcgaaaagtttttgcatcggacattcgttggacaaaaacggttttcgatcgagggtttagataccttagtgccaatgctagatgaagttgttcgagaagctgttcatgaaggaacgacaaacgtgatgattggcatggcccatcgcggccgtttgaatgtccttgcacacgtattaaacaaaccatatgaaatgattttcgctgagtttttacactcgctaaataaagatttattcccatcggaaggctcgattggaattaactatggctggacgggagatgtgaaatatcaccttggagctgacaggcaaattcgcgatgaaaatactgccgaagcaaggttaacgcttgcgaacaacccaagtcacttagagttcgtaagcccaatcgttgaagggtacgcccgagcggcccaagaggatcggacatcacctggtgctcctgagcaggatatcatgaaagcctactcgattttaattcatggagatgccgcgttccctggtcaaggtgttgtaacagaaacattgaaccttagccgcttaaccggttatcaaacaggtggatcgttgcatatcattgcgaacaacaacatcgggtttacgacagaaacattcgattcacgttcaacactatattcgagtgatcctgccaaggggtttgagattccgattgtacacgttaatgccgatgacccggaagcctgtttggcagctgtccatcttgctttccaataccggaaacgcttcaagaaggatttcttgattgatttaattggatatcgccgcttcggacacaatgaaatggatgagccggctgtgacacagcctggggtatatcaaatcattcgcaagcatccgactgttcgcgagctttatagcaagcagctagttaaaaaaggtttgatcgacgagcaaacagtcaagcagcttgatgatgaggtgcaagacaaactgcaaagcgtatacgaggagacgttaagaaatcgcacagatgaacatctaccagatacgcctccagtcgaagtggtgaatggccttccgaaactcgatacaggagttcagagtgaaacgttaaaggcgatcaataatgaattgctcgaatggccagagagcttctcggtgaatccaaagctagagaaaattttaaagcggcgcctgaacgtttttgatggtgatggaaaggtcgactgggcattagctgagactctcgcttttgcgacgattttacatgacggcacgccaattcgtttgacgggtcaagactctgaacgtggaacattcgcccaccgtcaccttgtattgcatgattctcgcacaaacgatgtgcactcgcctttacaatcattccgtcatgcgaatgcctcgtttgcggtccacaatagcccgttaagtgaaatggcgattgtcggctttgaatatggctataacgtatttgctccggagacgctcgtactctgggaagctcaattcggcgactttgcgaacggagcccaagttatgtttgaccaatgggtgtctgccggccgagcaaaatggggacaaaaatcaggtctagtctgcttgcttccacatggctacgaagggcaaggacctgagcattcaagtgcaaggctcgagcggttcctcgtcttagcagcagagaataactggacgattgcaaactgtacgtcagcagcgcaatacttccacattcttcgccgccaagcagcgatattaaatacagattctgtgcgcccactcataatgatgacgccaaaaagcttgttgcgaaaccaaaaggttgcctcttccgtggaagagctgacgacaggaagatttaaaaccgttttggagcaaccaaatttaggggaaagccatgagaaggtagaacggattgttctttgtagtggaaagattgccattgatttgcaagatcggattgaaaaagaggcggataaagattgggattgggtgcacatcgttcgcgttgaacagttatatccattcccgaaagagccgctacaagaaatctttgcccgctatccgaacgtaaaggaaatcgtttggtcgcaagaagaaccacgaaatatgggagcttggccgtttgttcagtcgaaaattcgccgtgctgctcctaacggaatcaatgttcgctacgaaggccgcacgtatcgctcaagtccagcggaaggcgaccctatcattcataaacaagaacaagaacgcatcgtaacagaaactttgactcgataa

SEQ ID NO: 40985 - DNA, 735 bp, Bacillus halodurans
atgaatgatacaaaagtagtgatgataactggagcatcaaaagggttaggaaaagcattagcgctcacatttgcgagaaaccattggtccttagccttgtgtgcaagaaatgagcaggcgctagaagctgttaaacaagaggcgttagaatccggagctgaatcggttctcgccatccaagcagatggtgcagtagaaaaggatatggatcgattcgtctctttaacggaatcaacgttcggacacattgacgtactcattgtcaatgcctccattttcggccctgggccggcatggcttctcgattatgatctctcttcattccaagacgttttgctgacgaatgtcctccatccgtttatgattacgaaacgtgtgctaccaggcatgcttcaacgaaagaaaggaaccattttacatgtcacatcagaggcaggaaaaacaggctttgccgaatggggggcttacgggattagcaaatttgcgctggaaggcttagctgagacatgggctaatgagctaacggagacggatattgctcttagctggatcgaccctggtgaaatggatacagacatgcacgccatcgctgttcctgattgcgattaccctcttgcaaaaccagaagatgtagcaaatgtatttttcgcgattgctagccgaaagcgagaggaagttcacggcaaacgttttgaggcgcaggcattgatgacaaaaggaggggtaagcttatga

SEQ ID NO: 40986 - DNA, 2247 bp, Bacillus halodurans
atgcctattttttatacagaacaaacaaaggagtttcatttacaaacaaaaggaagcagctatatttttacggttttggacaatcagcaactcgggcacctgtattacgggaaaaagattgaacaccgggattcttttacccatttacttcgatttcaacgacgggcgacaagttcatgtgtgtttgaaggaaacttagagttttccctcgatttgattaagcaggaatttccttcatatggcacaaccgattatcgtgagcccgccttccaaattcttcaggaaaatgggagccgaattacgaactttgagtataaaaaccatgtgatctccagcggaaagaaaccattgaagggacttccggccacgtacgtcgaatcggaagaggaagccgcaacgcttgaggtgttcctctatgattcactcattgatgttgagcttgtgttgacctataccgtatttgcagaaacaaacgtgattacacggcatgcgcggttcattaaccatcattcgtcgccggttcagctcatgcgcgctctaagcatgtcggttgatcttcctgatgcagattttcaaatgcttcaactttcaggatcgtggtcaagagagcgatatgtgaaggagcgtgctctcgttccagggattcatcaaatttcaagcacgcgaggggcgagcagtagtcagcaaaacccatttatagctttaaaaagaccacaaacaacagaattccatggtgaggtttatgggtttagtctcgtttatagtgggaactttttagctcaagtggaagtggaccaatatgatgtttcaagagttcagatgggaatccatcctttcgattttcaatggcttcttgaagctggagagtcgttccaaacgccagaagtcgttatggtctataccgatcagggattaaatcatttgagtcagctctaccattctttataccggtctcgtctcgtccgcgggaattggagagatcggccaagaccgattctattaaatagctgggaagccacctatttcgatttcacagaggactctctagtcgagtttgcgaaggaaggaaaaaagcttggggtagagctgtttgttcttgacgacggctggttcggaacaagaaacgatgatacgacatcgttaggagactggttcgtaaattccgaaaagcttccgaatggcattgaaggattagctgaaaaaatagaagcgctcggtctagctttcgggctttggtttgagccggaaatggtcaataaagagagtgaactttttaagaaacatccagattggatcatccatgtggaaggccgtagccagtcccatggtcgcaaccaatatgtcctagatttttcaagggctgaagtggtggatgctatttatgagatgatggcggagcttctaagaaaagcaccgatttcctatatcaaatgggacatgaatcgtcatttaacagagatcggttcacctgcgtggccgaaagagcggcagcaagagattgcccaccgatatattctaggtgtctacgacttatacgagcggctcgtttcggaatttcctgacgttttatttgaatcatgtgcgagcggtggatgccgctttgaccctggtatgctttactatgctccgcaaacatggacgagcgatgacaccgatgcgattgaacgattgaaaattcaatacggtacatcaatggtttatccgttgagctcaatcggtgcacacgtatcggcagttcctaaccatcaggtacgtcgagtaacaagccttgagactcgcggcaacgtcgctttcttcggagcgtttggctacgaattggacgtgacccaattgacagacgaagaaaaagaaaacatgaaaaagcaaatcgctttttataaagaacaccgtgagctgatcatgtttggtacgttttatcggttacgtagtccatttgtaggggatggaaatgtgacgagttggatcgtcgtgtcagaggatcaatcagaagcgctcgtcggctattaccaaacactggcaaaggtgaatgctgggtttcgtcagctgaagcttaccggcttacaggaatgtggcttatatcaaattgacggcatgattggaacgtatggcggagatgagcttatgcattctggtctgcaattgccgaatgaattttcgggggccagtgctttaagagaggatgagcaatcaggggatttccaatcgtacgtttttaaactgaaaagaatcgagagcgatcgccattaa

SEQ ID NO: 40987 - DNA, 1305 bp, Bacillus halodurans
atgggaaagattacatttcttggagcaggaagtacgatatttgcgaaaaacgtactcggtgactgcatgctgacaccgagcttacaagaatttgagtttgcgctatttgacattgaccttgatcgtttacatgattctgaaacgatgctgaagcatttaaaagaaacattgcaagcaaatgttaaaatcgaagcgtacacagatcgaaaagaagcgttgcgcggggctaaatacgtcgtcaacgccatacaggtcggcggctatgatccgtgtacgataactgattttgaaataccgaaaaaatacgggttacgccaaacgatcgcagataccgtcgggatcggggggattttccgcagcttgcgaacgattccagtcatgctcgattttgctactgacatggaggaggtatgtccggatgcatggctgctgaattacacaaatcctatggccacattgacagggactatgctgcggtatacgggagtaaaaacggtaggcttgtgtcacagtgtgcaagtatgtgcacctgaactcctcgatcgcctcgggatggaaaaggacaatattcagtggaaaattgcaggaattaatcatatggcatggctcttggaaattacaagggaaggggaagacctataccctgaaatcaaacgtagagcaaaggaaaaacaacaaaatgaacggcatgatgacatggttcgctttgagttaatgtttcgtttcggctactatgttacggaatcctctgagcataatgcagagtatttcccatactttattaaggaaaaatatccggagcttattgaacgtctaaacattccccttgatgaatatccacggcggtgcatcaatcaaatcgaagattggaaaaagatgcgtaaagatttagtaaacaacaagcatattacccatgaacggactcatgaatatgcctcctatataatggaggcgatggagacgaataagccgtttcaaattggcggtaacgtcttaaacaaaggtagattaatcgccaatttgccggagaacgcctgtgtcgaggtgccgtgtctcgtcgatcgaaatggcattcaaccaacgtatgtgggcgaacttccagagcaactagccgcgctaaatcgaacaaacatcaatacccaactgctgacaattgaagcggcgatgaaacggaaaaaagaggcgatttatcaggcagctatgttagatcctcatacgtctagtgaactttcgatcgatgatattgtttccttatgtgatgatttaatagaagcccatggaagctggctacagtccttcaaataa

SEQ ID NO: 40988 - DNA, 1446 bp, Bacillus halodurans
atggctttacaaacagaacaattcaacgcaaacattctaaggaatggtgagtgggtggaaagtcgaactggcgaacgcatttcgatttctgctccagcatctggcgtagctcttggatctatcccagccttatcccaagaggaagtaaatgatgcgattcaaggagcaaaagatgcacagaaaatttggaagattcgcccgattcatgaacgtgtagacttgctttacgcttgggctgaccttttagaggaacgaaaagagatcattggcgaactcatcatgcatgaagtggccaaaccaaaaaaatcagcaattggtgaggttagtcgaacagctgacattatccgtcacacagctgatgaagccctccgtttaaatggagaaaccctcaaaggggaccagttcaaaggaggaagttcgaagaaaattgctctggtggagcgcgaacctcttggtgtcgttttagcgatttcaccatttaactacccagttaaccttgcggcagcaaaaattgccccagccctcgtgacaggaaatactgtcgtctttaaaccggcaactcaagggtcattaagcggtattaaaatggttgaagcacttgcagatgcaggagcaccagaaggaatcattcaagttgtaaccggccgtggttctgttatcggtgaccacttggttgaacacccagggattgacatgattacatttacaggtggaacaactactggagagcgtatttccgaaaaagcgaaaatgattcctgtcgttttagagcttggcggaaaagatccagcgatcgttctcgacgatgccgacttaaagcttacagctagccaaattgtgagcggagctttttcctactctggtcaacgttgcacagcgattaaacgtgtgttcgttcaagacagtgtagcagatcagctcgtagctaacattaaggagctagtcgagcaactaacggtcggaagccctgaggacgatgcggacattactcccgttattgatgaaaaaagcgccgcgttcattcaagggttaatcgatgatgccctcgaaaatggagcaaccttactatctggcaacaagcgtcaaggcaacctcttgtcaccgacactgttagatgatgtcacacctgcaatgcgtgtagcttgggaagagccattcggccctgtccttccaatcattagagtgaaagacgcaaatgaagccattagcttgagcaatcaatcagactatgggcttcaagcgagcatctttacgaaagacaccgatcgcgcgatcaacatcgggaaacatttagaagtcgggacggtccatattaacgcaaaaacagagcgtgggcctgatcacttcccattcttaggtgtaaaaaaatctggtctaggtgtacaaggcattaagccaagccttttatccatgactcgcgagcgcgtgaccgtacttaacctgtaa

SEQ ID NO: 40989 - DNA, 531 bp, Bacillus halodurans
gtggaaaaacgtctagaacgagcgatgtttgctggaggctgcttttggtgtatggttcagccgtttgataaacaacctggcatcgaaagtgtcgtatctggttatgcaggggggacggtcgaaaacccaacatatgaacaagtaaaaaccgggacaactggtcattatgaagtggttcacattacatacgtccctgagttgtttccattcgagaaattgttatcgctctattggccacaaattgatccgacagatccagatgggcaatttcacgataggggaccgcaatatcgtacagctatcttttatgaaaacgaagagcagcgcgcgcttgccgagcggtcgagagaagcacttgagaagagtggaaaatttaaaaagcccatcgtgacaagcatattaccgatggcaaccttttatccagccgaggaggagcaccagcaattttataaaaaaaatccgatggcatacaaggaagatcgtgaaaaatcaggtcgggatgaatttatttataaacattggggaaagtag

SEQ ID NO: 40990 - DNA, 1338 bp, Bacillus halodurans
atggcaaaggatgaaagctatttaataaaaccactgcttgacagaaactatccgtgtgtttcctacgggaaaggagcagcgctttatgatatggatggaaagcgctatcttgacgcttgctctggagctgtcaccgcatcgatcggccatggggtggatgaagttgtccaggcgatgtacgaacaggctcgtaaagtatcgttcgtctatcgctctcagtttacgaatgaaccggcagagcggctcgcaatgaaattagcggaacagctgccagggcaattgaatcatagcttttttgtgaacagtggctcagaagcaaccgaaacagcaattaaaatctcaattcaatattggcaagagcgcggacgtcctgagaaaacgttaattctctctagatggatgagctatcacggaattacacaaggagcgctttcattgtcaggtcattatgaacggagacaacgatttgaaggaatgctagaccggctcccatttttatctcccccgtatccgtacagacaagtgagagaaatgtctggtgttgactatgccgaagagcttgatcacctgatcgagcagatcggacctcacaggatcgcagcttttatcgctgaaccgattgttggcgccgcgggaactgcattagtaccgggtgaatggtactatgaagcgctaaaacaagtgctcgatcagcatgacattttattcatatgcgatgaagtgatgacgggaatgggacggacagggaaggatctggcgattgaacattgggatgcgacgcctgacattgtcactttaggcaaagggttgtccgcagggtacgccccactcgctgcaaccgttgtcgccgaccatgtgcttgagccaattcaagcaggatcgaaccttattatgagcggtcatacgtttagcgccaatcctttatcctgtgcggctgggttagccgtactccactacgtaaaaaaacacgatctcgtaaaacgcgcagctacaattggtgaaaagttgatagaggatcttcaagagattcaaacggcctcggcgatcgtaggggatgtgagagggaaggggttgctcatcgggcttgagtttgtgaaaaataaagcgacaaaagcaccttttccgaaagatgctcaagtggcggctgttatcgtaaacgaggctcaacggcaaggccttttgctatatccatcagctgccggattaaagggggagggagctggttgtttaattgctccacctttcacgttgacgaaagaggaacgatgtgaattgttaggaaaattagcaaggacacttgaacgagtcgaaaaacagctgttgggggctgagaaatga

SEQ ID NO: 40991 - DNA, 933 bp, Bacillus halodurans
ttgcgtattttcgatgcccattgtgatgctttactcaagctgtgggaagaccctgcgagggaatatacagatgatccagcaattgaagccaatgctgtccgtttaatggaaggtggggtaagggcacaatgctttgcgatcttcgtcggacccaacattccctttgatcaaaagttccaagtcgccttacaacaagcggagctctttcacgaaaaaattttaaaaaagcatcctcagttttcgtttattgaacgttgggacgatttgctgacccttgatgctgaccagataggagcgattttaacattggaaggtgcggacccgtttggtgatgatccgacaaagctaaagacgctctatcgcctcggtgttcgttctctaggtctgacatggaatcaggcgaatctatgcgcggacggtgttggagagcctaggggcggaggtctaacggaatgggggaaagccgtcgtttcattaaacaatgaacaccatgtattgacggacgtatcccatttaagtgaacgaggcttctgggatgtgatcgagtatgcacagttcccggtcgcgactcattccaacgcaaaagcgatatgtaaacatagacgaaatttaaccgacgctcaactaaaggccttaattgaggcgggtggttttataggcatcgtgtttcaccctcattttttgacggggaccgatgatgcttcaatcgatgatgtcatgaagcatattgagcatatttgttccctcggggggcaaaagcatgtcggctttggctccgattttgatggtatcccttgctttgtggatggtttggaacatgcagggagatttcaatggttcatggacgaattattgaagcggtacgatgaagagctagttcgtggatttgcatgggacaattttttgaaagcaacaccgatttcgtatgtatga

SEQ ID NO: 40992 - DNA, 435 bp, Bacillus halodurans
atgagtcgcgaggagagcggtaaaagcaagctccctaacgtatatcaagattttttacgttccatcgatgattttttttctaaatcgtttcaacatctccatgataatgggatgttcgctccttccattccgattcgccaatacgagaaaggagagcagtttatcattgaagccgaacttccaggcgtatccaaaaaccaaattcagctagacgttttcccccaatatgtacgtattcgcattcatgaagaagaagtacttgaaatgcgggaagatgaaaaaggaatctactcaaaatccatctcaagtcaagcgagagaacgagtgattcctttcccataccccgtgcaagaaggtgatatcaaagcgagattacgaaacggcttattgacgatcgcgattccgaaccatcggaaacgtatcaacattgaataa

SEQ ID NO: 40993 - DNA, 822 bp, Bacillus halodurans
atggaaattaaaaaagcgattattccagcagctggatatggaactagatgtcttccgattactaaagtcgttccgaaagagatgttccctattaatggtaaagcagctctccattacattgtggaagaagctgttgcagccggaattgaagaaattttcatcattctttcgagaaatcgcacgttgattatggattactttgatcggtccattgaattggaaacatttctgaaaaaaatgaataagcagcatctcctagaaaagttagctcttcctgatgtaaccatccaatttattcgtcaacctcatgccaacggattaggggatgccattcgattaggagaacgatttgtcaatggagaaccctttgctgttttgttaccagatgatttgtttatttctccaaaacacacgtccgtattagcagaactagtgaacgtttataagcaatacaataaaagtattattgggctccaagaggtcgagtcggaactattaaagcgatatggagtcattgctggtcatccactgtcaagtgatgaatataaaatagagaatgtggtagaaaaaccacagacaaatcctccgtctaacttagccattgttggacggtatatatttgaacccgccatcttccaaaagctaaaaaatatagggattggcaaagggggagaagtacaattaacggacgcaataaaggctttgcttatttcgcataccgttataggaaaaatcatcgaagggtgtcgttatgacatcggcattgaggaagactaccaacgtttaatacaagagtttagcgaaaagaaaagctctacgtaa

SEQ ID NO: 40994 - DNA, 1458 bp, Bacillus halodurans
atggcaaacttagcaacaggtgagaagctaaaaaactttatcggtggtcaatgggtggaatctgattcaggtaaaactgaagctgtccccaatcctgccacaggagaaatcttagcccacgttcctatttcaaatcgagaggatttagatcgtgcagtatcagtggccaaggaagcctttaaaacgtgggggaaaacgccagtcccaagacgagcgagggttttgtttaagtatcaacaattgcttgtagaaaattgggaagagctggcgcgtctcgtcacactagaaaacggaaaaagctacaaggaagcatacggagaagtacagcgtggaattgaatgcgtggagtttgcggctggggctccttcgttaatgatggggaaacagctcccggatattgccacgaacattgagtctggaatgtatcgttacccaatcggcgtcgttggcggaattacaccatttaactttccaatgatggtcccgtgctggatgttcccgttagcgattgcctgcggaaatacattcgtcttgaagccatctgagcgcacgccactacttgccaatcgtttagccgaactatttacagaagcgggtttgcctgaaggtgtactgaacattgtacacggggctcatgatgtcgtaaacggtttgcttgaacatcctgatgtgaaagcgatatcgtttgtaggttctcaacctgtggctgaatatgtatacaaaaccgcttcacaacatggtaagcgagtacaggcgcttgcaggggcgaaaaatcattcgatcgtcatgccagatgccgatttggatggggccgtgaatcaaatcgtgaatgcggcttacggatcagcaggagaaagatgtatggcagcagctgttgtcgttgcagtcggtgaggtagctgagccgttaatggaaaaattacagaaagcagttaatgagattacgattggtaacggcttagacgatgacgttttcctcggaccggtcattcgtgaatctcataaacaaaagacagaaaactatattgagcttggagagaaagaaggagcaacacttgtgcgggacggtcgtaaagacaatgtgtcaaaagacggatatttcctcgggccaacactatttgacaatgtgacgacggagatgacgatctggaaggaagaaatctttgctcctgttttatcggtcgttcgtgtggaaagcctggacgaagcgattcagctaacaaatcaatctgaatttgctaacggtgcgtgcctttacacgactaacggcagctctgttcgaaaattccgtgaagaaatcgatgcaggtatgctcggaatcaacttaggcgttccggcgccgatggcctttttcccattctcaggttggaaaaactcgttctacggcgatctgcatgcgaacggtacggatggtgtggaattttatacacgcaagaaaatgataacggctcgttggtaa

SEQ ID NO: 40995 - DNA, 996 bp, Bacillus halodurans
atgacctatgaactttcaacagatcgagagtttgatttgattgcgattgggcgtgcatgcattgacttaaatgctgttgaatacaacagaccgatggaagagacaatgacgttctctaaatatgtaggcgggtcccctgctaatattgttatcgggagctcaaagctaggactgaaggcaggctttatcgggaaaatcgcagacgatcaacacgggcggtttatcgaatcctacatgagaggtgttggggtggatacgtccaaccttgtcgttgatcaggagggacataaaacaggtttagcgtttacagagattaagagtcccgaagaatgcagcattttaatgtatcgtcaagatgtggctgacctttacttatccccagaagaggtgaatgaggcgtacattagacggtctaagctattgcttgtttcaggtaccgcactatcaaagagcccatctcgggaagcggtgttgaaagcgattcgtttggccaagcgaaacgatgtaaaggttgtttttgaattagattaccgtccgtactcttgggaaacaccagaagaaacagcagtctattattcccttgtagcggagcagtctgatatcgtcatcggaacacgggaagaatttgatgtgctcgagaaccgtacagaaaaaggggacaatgatgagactatccgttaccttttcaagcattctccagaattgatcgtcattaagcacggggttgaaggttcttttgcttatacgaaggccggggaagcgtatcgcggctacgcttataaaacgaaagtgctgaaaacgttcggcgcaggtgactcctacgcatccgctttcttgtatgcgttgatttcaggaaaagggatcgagacggcattaaaatacggtagcgcttcggcgtcaatcgttgtgagcaagcatagttcatctgacgcaatgccgtctgtggaagaaattgaagcgctaattgaaaaagatgaaacgattacgatcgcatag

SEQ ID NO: 40996 - DNA, 1800 bp, Bacillus halodurans
atgatagatcataaagatcgcgtgttatcaagtaaagaacagcgcactgtctttaaaaggttgctgtcgtatgcggcccattataaaggacagctcatggtcgcttttctgttactgtttattgccacaggtgctcagctactcgggccgatcatcgttaagatttttatcgatgattatttaacgccacgctattttccaacagacgtcctttttctccttggagctggctatcttgtccttcatttgacagctgtcatcatcgattattatcaactatttttgtttcaaaaagttgccttgtccattgttcagcgactgcggattgacgtgttctcgagcgtgcaacggctcggtctttccttttttgaccaaacacctgcaggagggcttgtctccagaataacgaatgacacggagtctattaaagaattgtatgtgacggttttagcgacgtttgtgcaaaatatcatattcttaattggtatttttgccgccatgttttatttaaatgtgaccttggccatttactgtcttgttcttctaccactcatttttgctttaatgcaagtgtaccgaaaatatagttctcggttttatgcagatatgagcgaaaaactaagtctcttaaatggacgaataaacgaatcgattcaagggatggctatcattcaaatgtttcgccaagaacggcggatgcggaaagaatttagcgccattaacgacgagcattttttagcgggaatgaaaagcatgaagctggacggtttattgttacgtccagcggttgatgtcttgtccatcttggcgcttatgttgattttgagttattttgggatcatgtctatggacacagcggttgaaattggtgtcgtttacgccttcgtcaattacttagaccgtttttttgagccggttaatcaaatgatgatgcgactttctatgtttcagcaagcgattgtctcagcggggcgcgtctttaaactgatggatcatcgggagttagctccagatcgtgaggggaatgaacatccagcgatcataggggaaggaaatgtggaattccggaatgtttccttttcctatgacgggaaaacaaacgttttaaaaaacatttcgttcacggtgaaaaaaggagagacagtcgccctagtcggccatacgggtagtggaaaaacatcgatcatcaatgtgctaatgcgattttatccgttgcaggatggggaaattctcatcgatggtaaaccgctcacgtcctttgaaaataatgagctgcgcgctaaggtcgggcttgttttgcaagatccgtttctttatacaggaacgattgcgagcaacattcgtttgtatgatcaagccatttccgatgatcggatcaagcgggctgcctcgtttgttcgggcggatggatttatcgagcggctgtctcatggttatgagacaaaggtgacggagcggggagcaacgttttcaagtggccaacgacaactgctctcctttgctcgtaccatggtccgtgagccggcgattcttattttggacgaggcaacggcaagtgtggatacggagacggaagaagcaatacaagaagcacttgagcgaatgaaacaaggacggacgacgattgcgatcgctcaccgattgtcgacgataaaggatgcagatcaaattctcgttcttcaccaaggagaaattgtagagcggggaactcatgatgaactcattgccaaaaagggactttatcaaaaaatgtatgttttgcaaaaaggggatgaacaaggagaagcactgctgtcctaa

SEQ ID NO: 40997 - DNA, 1758 bp, Bacillus halodurans
gtgaaagtttttgttgatttatggtggttttttaaacaggagaaaaagtcttacgggtttggtattgtcatgcttgcgattgtttctttattaacactcgtcccgccgcgtgtcgtcggaatcattgttgatcatatttacgaggggacattaacgatgccagtgttgctccaatggattggggttttggcggcgcttgcgctcattgtctatgttgcacgctacctttggcgggtcatgatttttggcgcttctctccgtttggctcggcttcttcgtaatcaattgtatacccattttacgaacatggccgctcccttttatcaaaagcatcggacaggagacttaatggcccatgccaccaatgatattcgtgcaattcaagccacggcggggcaaggggtactcactctagtcgactcgctaacgatgggtggattcgtgatccttacaatggcgattacgattagctgggagcttaccttgattagcttgctcccgatgcctcttatggcgcttcttacaagttattatggatcgttattacataagcgctttcaccatgcccaagcggcgttttcctcattaaatgataaggtgcaagaaagtgtgacaggggttcgggtaacaaaagcatttggacaagaggaacaagacattgaggcgtttcgcaaacaatcagatgatgtggtgaagaaaaatgtagctgtggctcgagtggatgctctttttgacccgaccatctcattgatcgtaggtctttcctattttctcgcgatcgttttcggcgccaggttcgttattgctgaacagttaacgatcggacaattaacgagctttacgatttacttaggcttgcttatttggccaatgcttgctttcggatttttattcaatattgtcgaacgtggccgtgcctcctataatcgcgtgtcacagcttttgcaagcaaagcaagagattaccgacagccgggcccgcattcatgttccgccgacaggacacgtagacgttgcgatcgatcaatttgtttatccgaatcaaaaggagccggctttagctgacgttcagtttgaattgagtgagggagaaacgttaggaatcgtagggaaaacaggagctgggaaaacgacccttctccgtttactacagcgagagtatgacataaagcaagggacgattatccttgacggtcgacccatcgaacactatacactggacgcgctaaaggctgcctttgggaccgtgccgcaagaccattttctcttttctgctacgattgcggataacattgcgtttgccaagccggatgccacgatttcagaaatcatccaagtgagccaattagcccatattcatgacgatatcatacaatttgaacaagggtatgataccgtcgtaggcgaacgaggcgtgaccctttccggcggacaaaaacagcgcgtttcaattgcccgtgcattgcttgctaacccgaatattctcatcctcgatgattctttgtctgcagtcgatgcgaaaacggaggaagcgatcttatcatcgttacgagcagaacgaaaagggaagacgacgatcattaccgcccaccgattaagcgcgattaaacatgcggatcatatccttgtaatggatgatgggcgtatcgttgaacgaggaacgcatgaaacgttaatggaagctggcggttggtaccggaacatgtatgaaagacagcagctcgaaacccttgtagagaaaggagggcgttcgtcatga

SEQ ID NO: 40998 - DNA, 1914 bp, Bacillus halodurans
atggcgaagatcattaagctcgatgatcatctctccaataaaattgctgcaggggaagttgtcgaacgccctgcgtctgtcgtcaaagagttagtggaaaatgcccttgatgccaacagccgaaaaattacgattgaagtagaggctggcggacttgatcgcattcgcgtcattgatgatggagatgggattgaaagagaagatgtcgaaacagcctttttccgtcatgcgacaagtaaaataaagacggataaagatttgtttcaaatcgcaacgctcggcttccgcggggaggcactaccgagtattgcttcagtctctcacgtccagatcaaaacgagcactggcggtgatggagggacagaaatggttttagagggcggtgtgattaaaaaaatcggctcaaccgccatgggaaaagggacagatttaaccgtcacacagctcttttacaacacacctgcccgattaaaatacgtcaaaaccgttcataccgagctcgggaatattagtgatgtggtcaatcggttggccctcgcccacccttatgtatcgttccagctttttcataacggaaagaacgtgttgcgtacgtcgggaaacggcgatcagttgcaagtgattgcggcgatttacggaagaacggtcgccaaacaaatggtaccgttaagcggggagacgattgattttacggtgagcggatttgcggcaaaaccggaagtgacccgagcttcgaggcagtacatgtcgctacttgtgaacggccgatacattcgaaatgtagctctctcgaaagcgattcaacaaggtttccatacgttgcttcccatcggtaggtatccgattgcaatcgtcaacattgagctcgatccgcagctgatcgatgtgaacgttcacccgtccaagcttgaagttcgagtaagtaaagaagaagaattatgccggttagtgacagagacgatcgagcgtgcttttaaaaaggagcagctcattccagaagcaacaaagcctacagggggaaaacaaaaaagtgaacagctctcctttacgttggacgattttacatcagcaaaaccgagcgaggaccgaggaagtacttcgagtaatgaggaaaatgaacaacgctcttcgatcgataaaaatgttcttttccaagaggagagaaagctatcaaatgatttaccatcaataaatatggtccgtgaggcatcggcaagcgttgagcctgcccttgaaaaggagcccccagccgctgagctgactgccggtgcaaagggtgcgatggaacaagcttcaatggaagaggaaacgtccaactcgttgcctgcgaatcgggtaccgacaatgtatccaattggacaaatgcatggaacgtatattttggcacaaaatgatcaaggcttgtatataattgatcagcatgctgctcaagagcgaatgaagtatgaatattttcgcgagaaggttggagaagtgacaaacgagctacaagagctgattgtgccgattacggtggaatgcacattacaggaagcagcgtatattgaagagcacttggaagatttgaagcaagtcggcttatttttcgaggagttcgggccgcagacatttatgattcgtcagcaccctacttggtttcctaaaggcttagaggaagaaacgattcgggaaatgattgatcagttaatggaaaaaagaaaggttgacattaagaagcttcgagaagaggtagcgattctcatgtcatgtaaagctgcgattaaagcaaaccgccatctgcgccatgatgaaatgtacgcattactggaggcattacggaaatcaagcgatccgtttacgtgcccgcacggacgcccgattatcgtacaaatcacgacctatgagatggagaaaatgttcaaacgggtgatgtaa

SEQ ID NO: 40999 - DNA, 2598 bp, Bacillus halodurans
atggcactacaaactcctatgatgaagcaatatttagagatcaaggcacaatacaaagatgcctttttatttttccgtttaggtgatttctacgaactttttttagatgacgctgttaaggctgcacaggaactagaaataacgctaacgggtagaggaaaaggggaggaacgtatcccgatgtgcggcgttccataccattcggccgatcattacatttctcgtctgctcgagaaagggtataaaattgcgatttgtgagcaagtagaagacccaaagaatgccaaaggtgtagtgaagcgtgaagtgattaagctgatcacccctggtacaatcatggacgggaaattaattgttgaaaaggagaacaattttttatgcgcggtaacgaggtttgaagatcagagctatggcatcgctcgcgccgatttaacgacaggtgaaagcagggttagtcttgtaagtgaacaggatgatttgttccatgaacttgcttcttcaagcataaaggaggtcgtcctgagtccaggctggactgaagaagacgctcaccgtttgcgtcaatcgctctcggtcactttgtctgaggaagaggcagaggacctgccaaaaggttacgaatccctatgtgaaaacgtggaacaaccaaagttgctgcgagcatttggccgacttttgcagtatttgttacggacgcaaaagcgttcgcttgagcatttacagcctgttcaatatgatccaccaaatgaagtgatgaaaatcgatcttcattctagacggaacctagagctagtggaaacgttgcgggaaaaaaagaaaaagggttcccttctttgggctgtggatgaaacggtgacggccatgggggggcggctgttgaagcaatgggttgaacgtccactgctctcgaagaaagaaatcgagcggagacaagggctagttcaatcgttccttgatcattattttgagcgggaagaactgcgtgatgagctacgccatgtttatgatttagaacgactcgtcggaaaagtggcctacggaaatgtcaatgcaagggagctcgttcagttacgcaaatcattgcagagaattccggcaatctttgcccttgtagaaaaaatcggtaatcaagatgtaaatgagcgattgcaaacgatcgatcgctgtgaatcattagtcgatttgcttgagcatagcttagtcgatgaccctccggtctcgattaaggaaggcgggatgatccgtgatggttttcacaaggagcttgatacatatcgtgatgcaagtcgaaatgggaagtcatggattgcagagcttgaacaaaaagaacgggaagcgactgggattaaatcgttaaagatcggctacaacaaagtgttcggttattatattgaagtgacgaaagcgaacatacacctactagaggaaggacgctacgagcggaagcaaacgctcacgaatgccgagcgctacgtcaccccagagttaaaggaaaaggaagctctcatcttaaacgctgaggaatccatcgttcagcttgaatacgacttatttttacaagtccgtgagcaagtgaaggactacattcgaccgttgcaagcgctcgcccaaatgattagcgagctcgatgtcattcaagggtttgcaaccgtcagcgaaacccatcattacgtgaggccagcacttcaagaggatcgggcgattgccattaaaggaggacgccatccagttgtcgagcgtgtaattccgaatggtgaatatgtagccaatgacgtagatatgaaagatggacgaagcattctcctcattacagggcccaatatggcggggaaaagcacgtacatgcgccagcttgcgttaattgcgatcatgggacaaatcggttgctttgttcctgcggatgaagcgaggctgccgatctttgaccaagtgtttacgagaattggggcagcggatgacttagctagcggacaaagcacgttcatggtggaaatgctagaaacaaaatatgcgctacaaaaggcgacacaaaacagcctcatcctgctcgatgaaattggtcgcggcacctccacctatgatggaatggcactcgcccaagcgattattgaatacattcatgatgaaattcgtgcaaaaacgctgttttctacccattatcacgagttaacagctcttgaaaaggagctttctgacgtaaaaaatgttcacgtgtcggcagtggaagagcaaggaacggtcgtgtttttgcataaagtcgtcgatggacaagccgatcgaagctatggaatctatgtagcagagcttgcaggattgccaaatgtggtcaccgaacgggccgaaacgctactagctgaacttgaaggggagaaggagatagtcgcttccgagaaggaagtagcgtctactaacgagcctacgcagctttccttgtttgaaccagaaccgttggaagcgtacaagcccaaagggaacaaacagccgttatcggacgaggaaaaaacagtactacatgaccttcagtcggtcgatgtcctaaacacgacccctttggaggcgattcgtttattaaatcagtggcagcaaaaattacgttag

SEQ ID NO: 41000 - DNA, 1620 bp, Bacillus halodurans
atgaacgaagcaatgataaagtttaatgagttacaaattggagaagaaattaaaaaggcgattattgagatgggatttgaagagccatctcctatccaagcaaaggcgattcctgcaatccttgcaggtggtgatgtcattggccaagcccaaacaggaacaggaaaaacagctgcatttggcataccagtagtggaaaaagtgtcgacgggccgccatgtacaggctcttatcttaacacctacacgagagctagcaatccaagtgtcaggagaaattcaaaagctttccaagcacaaaaaaattcgtacccttccgatttatgggggacaatcgattgttcatcaaatcaaagctttaaaacaaggagttcaagtcgtcattgggacaccgggtcgtattatcgatcatctgcgtcggaaaacgttaattttagaccacgttaatacagtgattttagacgaagctgatgaaatgcttgatatgggctttatcgatgatatcgagtccattctgcgccaggtgaaaaatgagcgccaaaccttgcttttctctgcgacgatgccgccagcgattaaaaagctatctcgcaaatatatgaacgatccacaaaccgtatccatcaatcgacgagaagtgacagcaccttctatcgatcaattttattataaagtgttagagcggaataaattagattctctttgccggattattgacagcgagcagattgatcttggaattttgttttgccggacgaaaaaaggtgtggcagagctaacggaagcattgcaagctcgcggttacattgccgatggattacacggtgatttaacacaatctcagcgtgatgcagttatgcggaaattccgtgactcatcgattgaattcttgattgccaccgatgtggcggcgagagggattgacgtggggaacgtctctcacgtgatcaattatgatattccccaagatccagaaagctatgttcaccggatcggtcgtacaggccgtgcaggacgtaaagggcttgcacttacgcttgtcacgccaagggaaatgaaacatctccgttcgatcgaacaagaaattaaaatgtcaatcccgtctcaagaagtgccgacgattgaagatgtggtggaaaaacaaaaagaatcatggaagaagcaaatcgcccatcgaattgagaaaggctctaaccaaaagcacctcttcgagcaaatgactgaagagttgatggcagagtacgattcaaaagaggtgatctctgctctccttcaattaaactacgcgatggacacagctcctgaggatgcgggatatagctttggggaaaccggtggtgccaaaggcatggtccgtttctttatcaatgttggtagaaatgtgaatatgagtccaaagattcttgtcgaggagattgcagagcttgttggcattcctggtaaggcgatcggccgaatcgacatctttgaaaaattcacgtttgttgaagtgcctgaagaagtggctccgtttgtttatgaagcgcttcgttactcaaggatcaacggtgctcgtgtgaaccttgagccagcaaaacctcgtccaaagcgggaatcacagcgaagaacatttcaaaaatag

SEQ ID NO: 41001 - DNA, 729 bp, Bacillus halodurans
gtgaagcagcgacgggttttagttactggtgcatcggggggaataggggcggccatttcaaaggcattagccgctcctcatacgaccctctatttacactattatcaaaatgagcggagcattgatgacgttcgtcttgcctgcgagcagcttcaggcggaagtggtcacagtcaaggctgaccttagccatgccgctggagtggaggagcttttaacccaatgcggctcggcgatcgatgtgttcgtacatagcgcaggacaaagcgtagaaaagctgtttctcgatacgtccacgtcagacatcatgagaactttccaacaacatttgtttagcttcatggaactctctcggggatttctccctcatatgctaagaaaccgctacgggaagatagtggcggtttcttcggtttggggtgagacaggtgctgcgtatgaggtcgtctactcggctgcgaaaagtggcatgaatggcttcgttaaagcgttagcaaaagaaatggcgccaaacggcatacaagtgaacggtgtggctccaggagcgattaacacttccatgctttcaagctatacggaggaggaagttttagctcttacagaagaaatcccagcaggccgactaggaactccaatggaagtcgctgaaaccgtcgcgttcttatgctcagagcgtgcgacttacattcatggccacgtattgtccgtaaatggcggctggtattgttaa

SEQ ID NO: 41002 - DNA, 879 bp, Bacillus halodurans
atggactttggccacgtccttacagccatggtcaccccttttgatgcaaagggaaatgttgatctagaaaaagtggaacgacttgtggaatttttgcttgccaatgggacagagggtctcgttgtagcaggtacgactggtgaatcaccaacattgagagaagaagaaaagctagccctatttgaaaaagttgtcacggttgtgaacaaacgagttccagtgatcgcagggacaggttcgaacaatacgtacgtctccgcccaactgacgaagaaagcgacggctcttggagttgatggcattatggctgtcacaccttattacaataaaccgtctcaggaagggatgtacgctcactttgcagcgatcgcagaagcgacacacttgccggttatgttgtacaatattccgagccgttccgttgtgaatttatcagcggaaacaattgtgaaactctcttatatcccgaatattacctcattaaaagaagcgaacggtgatttggatcatatggtgtcggtcatcgagcaaacccctgatacgtttcatctatatagtggggatgattcgctaacactcccggccttatccatcggagcaaaaggggtcgtgtcggtcgcctcccacataataggacctgaaatgcagcaaatgatgatggcgtttcggggtggagatgtggagcatgcagcaaatctccaccggaagcttttgccgatcatgaaaggcttatttactgcgccaaatcctacatgtgtgaaagccgccttgcagatcaaaggattcgatacaggtggtgttcgcttaccactcgtgccacctacatctgagcaacggcaacatttacagtttttaattgaacagttgaaagtctcgtaa

SEQ ID NO: 41003 - DNA, 1236 bp, Bacillus halodurans
atgaaaattatcatccagaagtttggtggtacctcggtcaaaacggctgaagtacgcgaaatggcagctaaacacgtcgaaaaagccgtagagggtggatataaggtcgttgtcgtcgtttccgccatgggacgaagcggtgatccttatgcgacagatacccttttacagctagtggatacgaagacaattgcaaaacgagagcaggatcttctcgtctcgtgcggtgaaatcatctcttcggttgttttcaccgaacttttgctcaagaaaggaattcaagctactgcgatgaccggggcacaagctgggttccggacgaatgaagaattcaccaatgcaaaaatagtcgatatgaaagtggatcgtttgaaaaagacgctcgttcatcaagatgtcgtcgtcgtggctggtttccaaggtcaatcacctacaggtgagacgacaacgcttggacgcggcggaagcgatacgtctgccacggcccttggggcagccctggatgccgaatgggttgacatcttcacggacgtggaggggatcatgacagccgatccacggatcgtaagtgaggctcgcccactggatacgatgacgtataatgaagtgtgtaacatggcatatcaaggagctaaagtcatccatccccgcgcagttgaaattgccatgcaagcgaagatccctatccatattcgctctacgtactccgatggaaaaggaacgcttgtcacttcgatgctgacggaagctggtgcgagggatgtccaagatcggatcatcacggggatcgcccacatgtcgggagtgacacaaatcaaagtccacgcgaaagatggagaatttgatttgcaggaaaaagtgttcagggcgatggccgctgaaaaaattagcgttgatttcatcaacattaatttaaccggtgttgtttatacggtaatggatgaagtggcagatcgggcaatcgaagtattacgagagctcggttttgatccagaagtgaagcggcattgtgctaaggtgtctgctgttggtgcggggatgacaggagtcccaggtgtaactgctaaaattgttgcagctctttctcaggagaacatccgtatcttacaatcggctgattctcatacaacgatttgggtgctcgtcagcgaagacgatttaacaaaagcagtcaatgcgcttcatcgcatgttccaccttgaacaatcggagcaaacgaaacaaaaacaagtttga

SEQ ID NO: 41004 - DNA, 1050 bp, Bacillus halodurans
atgaccaatcagcaaacattttcagtagctgttgtcggcgcaacaggcgcagtaggacagcaaatgttaaaaacgttagaagagcgtaattttccagtaggacagttaaagttactttcatctaaacgttctgcgggaaaaacgattacatttaaaggtgaaccatatacggtggaggaggcgactccagaagcgtttgaaggcgtgcaaattgccttatttagcgcgggtggctctgtttccaagaagcttgtaccagaagcaattaaacgtggtgccatttgtgttgataacacaagtgcgttccggatggatccagaagtgccgctcgttgtaccggaagtaaatgaagaagatgtgaaaagccataatggcgtcatcgcaaacccgaactgctcgacgattcaaatggttgttgctttagagccaattcggcaaaaatacggcttgaaaaaagtaattgtctccacgtatcaagctgtttctggagctggccttgaggcgattgaagaaatgaaaactcaaacgaaagaagtgcttgagggcaatgaagtaaacccagagattttacctgtgggtggggacaaaaagcattatcaaatcgcatttaatgccatcccgcaaatcgatttgttccaagacaatggttttacatttgaagaaatgaaaatgatcaacgaaacgaaaaagattatgcacatgcctgaattagaagtagctgccacgtgcgtgcgtcttccggtggaaacgggacactctgaatcggtctattttgaaaccgaacagggcggagcttccgtttctgaattaaaaggacttttagaaacagctccaggtataacggtccaggacaatccgagcgagcagctttatccaatggcgatccatgcggtcggtaagccagacgtcttcgtcggtcgacttcgccgtgatctagaccgggataatgggtaccatatgtgggtcgtatctgacaatctattaaaaggggctgcatggaactctgtgcaaattgcagagagtctcgtgaagctcggtctcgtgaagtag

SEQ ID NO: 41005 - DNA, 1242 bp, Bacillus halodurans
atgattaacacgatgacgctagataacggtgttcggattattaccgagaagatgtcaaccgttcgctccgtatccatcgggatatgggtgggaacgggctcaaggtatgaatcagctgaagaaaacggcatctctcattttcttgagcatatgtttttcaaagggacgaatacgaggtctgctcaggagattgccgagttttttgactcgattggcggtcaagtcaatgcgtttacgtcgaaagaatatacgtgctattatgcgaaagttctagacgatcatgccggacaggctattgataccctttcagacatgttctttcactctacttttcaaaaagaagagctggaaaaagaacgcaaggtcgtgtttgaagaaattaaaatggttgatgatacgccagacgatatcgttcacgatttattaagctcggcaacctatggaaagcactctctcgggtatccgattctcggaacggtggaaacgttaaattcatttaatgagggaatgttacgtcattatatggatcgcttctataccggtgactatgtcgtcatttcggttgcgggaaatgttcatgatgaactgattgataaaatcaaggaaacgtttagtcaggtgaagccgacaacctataactatcaaggggaaaagccgatgtttcttccgaatcggattgtacgtaaaaaagagacggagcaagcccacttatgtctcggttatccaggacttccgattggggacaaggatgtgtatgcccttgtgttgttgaacaatgttttaggtggtagtatgagcagccggctgtttcaagacattcgcgagaagcgagggctctgttactccgtgttttcctaccattcttcgttccgggatagcggtatgcttacgatctatgcaggaacaggccatgaccagctagatgatttagtttattcgattcaagagacaacgtcagccctggccgaaaagggtttgacggaaaaggaattggaaaacggaaaagaacagctaaaagggagcctcatgctaagcttggaaagcacgaatagccgcatgagtaggaatgggaaaaatgaactgttattaaaaaaacatcgttcattggatgaaatgatcgaacagattaatgcagttcaaaagcaagatgtgtctcgtttagcgaaaatactcttatctgctagtccgtccatttctttgattaatgcaaacggtgagcttccaaaagcattgattcactaa

SEQ ID NO: 41006 - DNA, 1314 bp, Bacillus halodurans
atggacgctagatcactcatttctctgattccatcgttatctgcttataaatggtatggaaaagtgactcgcgtgattggtttaacgatagaagcaaaaggaccacaagcttccatcggtgaattgtgttacatcctcgtaggaaaacaaggaacaaaagtgatggctgaggtagtcggctttaaggaagagcgagtgcttttaatgccgcttaacgggacggcagagattgctcctggtagcttagttgaaggaaccggtcgccctctccaagtgaaggtgggctatagcttaattggccatgtcattgatggctgtggtcggcctttaactggggaagcattacctaatgggttaacgccgtatccgacagataacccgccgccaaatcccatttctcgtccacggattaaggaagcgatgcacttaggggttcgcgcgatagacggactgcttacagtcggaaaaggacaacgtgtcggaatttttgccggaagtggcgtagggaaaagcacactccttgccatgttagcgaaaaacgctgccgctgatctgaacatcattgctcttatcggcgaacggggacgagaagtgaaagattttattgaaagggatttaggcgaagatggacttaggcggtcgattatcgtagtggccacctcagaccaaccagccctcatgcggattaaaggggcgatgacggcaactgctcttgctgaatattttagggaccagggcctacacgtcaatttaatgatggattcagtcacaaggtttgcgatggcacaacgggaaattggtctagcggtcggtgaacctccgacaacgaaaggctatactccatcagttttcgctttgctaccaaaattattggaacgtgcaggaaccaatgggaaagggagcatcactggcttctacacggttctcgtcgacggagatgatttgaatgaaccgatctcagatacggttcgtggaattcttgatgggcatttcgtccttgatcgcgagcttgccaataaggggcattatccggcgatcaacattttaaaaagtgtgagtagggtgatgaatgatattgttacagatgagcaaaagcgtgctgcagagcatgttcgctcactattatcggtatataaagaatcggaagacttaattaacattggcgcttacaagcgtggctcatcgaaacaaattgatgaagcgatcgagcgacagccggaagtgatttcctttttaagacaaaatacggatgaagtggcgattgctgaacattcgatccaacaattaattcaagcttttggaaagggtgattga

SEQ ID NO: 41007 - DNA, 2073 bp, Bacillus halodurans
gtggcagactatttagtaatcgtggaatctcccgctaaagcgaaaacgattggaaagtacttgggaaaaaaatatacggtaaaggcgtccatgggtcatgttcgtgacttaccgaaaagtcaaatgggcgttgatatagaggacgagtatagtccgaggtatataacgatccgcggaaagggaccagtattaaaagagttaaaaagcgccgccaagaaggtgaaacgcgtctatttagcagccgacccggatcgtgaaggtgaagcgattgcttggcatttagctcatagcttagacattgatgaaacgtctgaatgccgtgtagtatttaatgaaattacgaaacaagcgataaaagatgcttttaaaagcccgaggccgatcaatatggacttagttgacgcccagcaggcaagacgggttttggatcgtctcgttgggtataacattagccctttattatggaaaaaagtaaaaaaagggttaagcgctggacgtgttcaatccgtcgccgttaagatgattattgatcgggagaaagaaattcaagcgtttgaacctgaagaatattggagcatacaagggacattcgccttggacggagagccttttgaagcaaagttctatggaacgaacggtaaaaaggtagagcttaaatcagaagatgacgtgaataacgtattggcaaagttaaaaggcgatcagtttcacgtcgattccgtacagaaaaaggaacgaaagcgaaatccggtcagcccgttcaccacgtcttcactgcagcaggaagccgctcggaaattaaacttccgcgcgaagaaaacaatgatgctcgcacaacaactgtatgaaggtattgacttaggaaaagaaggtacggtaggtctcattacatacatgcgtacagattctactcgtatttccgatacagcgaaagcggaaacaaaagaatacattgaatcaaaatttgggaaagaatatgcgcaaaatgggacgaaggcagtaaagaaagacaaaaaatcccaagatgcccatgaagcgatcaggccaacctctgtcgaacgagatcctaaatcgttgaaggagtacctatctcgcgatcagctacgtctctataaattaatttgggagcggcttgtcgctagtcaaatggctcctgcgattatggatacgatgaccgtcgatctttccaatgaaggcgtcttgtttcgagcaacaggttcaaaggtgaaatttcctggatttatgaaagtctacatcgaaggaaatgacgaagggaagaaggaagaagatcgtcttctcccgaacttacaagaagggcaaacggtgacaaaagaagagatcgaaccgagccaacactttacacagccgcctcctcgatatacggaggctcgactagtgaagacaatggaggagcttggaatcggccgcccatccacctatgcaccgacgcttgatacgattcaaaaacgcggctatgtggcccttgatgagcggaggtttgttccaaccgagctcggtgaaattgtccttgagctcatgacagagttttttcctgaaattcttgatgttgaatttacggccaagatggaagatgacctcgactcaattgaggaaggtaagcagcaatggataaagatcatcgacgatttctataaagggtttgaagaacggttaaaagtcgcagaagaagaaatgaaagaagtcgaaattaaagatgaaccgacgggagaaatgtgtgaaaagtgcggccatgaaatggtgtacaaaatggggcgttacggcaaatttatggcctgttccaacttcccggactgtcgaaacacaaagccaatcgtgaaagaaattggtgtgaaatgtccaaagtgtgaaaaaggagaaattgttgagcggaaaagtaaaaaacgtcgggtgttttatggttgtaatcaataccctgagtgcgatttcgtctcgtgggataaaccgatcgcccgttcatgtccgaagtgttcaagctatcttgtagaaaaacggacgaaaaaacaagttcaagttcaatgttcttcctgtgattacaaagaggaagcaaattaa

SEQ ID NO: 41008 - DNA, 909 bp, Bacillus halodurans
atgagtatcttaattaacaaggatacaaaagtcatcgtacaagggattactggtgcaacaggtttgttccatacaaagcaagcagttgaatatggaacaaacattgtcggtggtgtaacacctggaaaaggcggaacagaagtagaaggcatcccggtatttgatacggtgagtcaagcggttgaagcgacaggtgcaaacgcttctgttatttatgtaccgccagcatttgctgcagatgcaatcatggaagctgtcgatgctgagctcgaccttgccatttgtattacagagggaattcctgtgatggacatggtaaaggttaagcgttatatggaagggaaaaagacccgtttagttgggccaaactgcccgggtgtgatcacgccggaagagtgcaaaattgggatcatgcctggctatattcataaaaaaggccacgttggcgttgtgtcccgctccggaacattaacgtacgaagcggtccatcagctttcaacagccggcattggacagtcaacggctgtcggtatcggcggagatccagtgaatggcacaaacttcattgatgtcctaaagttatttaatgaagaccctgacacatacgcggttatcatgatcggtgaaattggtggtacggcggaagaagaagcggcagagtggatcaaagccaatatgacaaagccagttgtcggatttattggtggtcaaacagcacctccaggaaagcgcatgggtcatgctggtgcgatcatctctggcggaaaaggaacggccgctgaaaaaattaaaacgctcgaaagctgcggcgtaaaagtagcggaaacgccttccgttatgggagaaacgcttatttccgttcttaaagagcaagggcttttagaaaagtgcacgacacatcaagtataa

SEQ ID NO: 41009 - DNA, 1161 bp, Bacillus halodurans
atgaatatccatgagtaccaagggaaagagctccttcgtcagtacggtgtagcggttccgaacggaaaagttgccttttctgttgacgaagcggttgaagcagcaaaagagctcggctctaatgtttgtgtggtaaaagcgcaaattcacgcagggggtcgaggaaaagcaggcggcgtcaaggtggcgaaaaatcttgatgaggttcgtacatatgctgacgagattttaggaaaaacgttagttactcatcaaacaggtcctgaaggtaaagaagttaagcgcttacttatcgaagaagggtgcgacatccagaaagagtactatgttggccttgtcctcgacagagccacttctcgcgttgtcatgatggcatctgaagaaggtggtactgaaatcgaggaagtggcagaaaaaacacctgaaaaaatctttaaagaaatcatcgatccagtggtcggcttacaaggcttccaagcgcgcagattggcgttcaacatcaacattccgaaagagctcgttggacaagcagtgaagttcatgctcggattgtacaaagtatttgttgaaaaagattgctctattgccgagatcaatccgctcgtcacaacaggtgatggaaaggtcatggcccttgatgcgaagctaaactttgattcgaatgctctttatcgtcaaaaggctatcctcgaattccgtgatttagacgaagaggatccaaaggaaatcgaagcgtcaaaatatgatttgagctacatttctttagatggaaatatcggctgcatggtaaacggtgcaggtttagccatggcaacaatggatattattaaacattacaacggtgaaccggcgaacttcctcgatgttggaggcggtgcgacggcagagaaagttacagaagcgttcaagatcattctttctgatgaaagtgttaaaggaatctttgttaacattttcggtggtatcatgaaatgtgatgtcatcgcagaaggggttattcaagcgacgaaggaagtaggattaagcatccctcttgtcgttcgccttgaaggaacaaacgttgatttaggtaagaaaaagcttgaagagtctggattaaacattacagcagccgattcaatggcagacggtgcacaaaaaattgtttctctcgtgaaatag

SEQ ID NO: 41010 - DNA, 3567 bp, Bacillus halodurans
atgttcctcaaacgtttagaaattgtcggatttaaatcattcgccgaacaaatgaccgttgagttcgtaaaaggtgtaacagcggttgttggcccaaatggaagtggaaaaagcaatatttcagatggaattcgctgggtgctcggtgaacagtcggcaaagtcgctccgagggtcaaaaatgcaagatattatttttgcaggaagcgatacacgaaagccattgaattttgctgaaatcagtttggtgctcgataacgaggaccagcatattccgatcgactatagtgaagtaagtgtcacacggcgtgtttatcgttctggagagagcgagtacttattgaaccgtcagccatgccggttaaaagacattgtcgatctttttatggactctggcctaggacgagaagcgtattcgattatcggccaggggaaagtggaagaaattttgagcagtaaggcagaggatcgccgcgtcatttttgaagaggcggccggtgtgcttaaatataaaacgcggaagcagcaagcggaaaaacgcctcgatgacacacaggagaatctgaatcgcgtcgaggatattcttcatgagcttgaaggccaagtcgagcctttaaaaattcaagcatccgtggcaaaggactatttagaaaagaaaaaagaattagagcaagttgagattgccgtccttgtctatgatattgaccggatacatacagagtggaacaaagcaaaggaagctcttgatctattaaaagaacaacatcgagctttagagcagcaaatcagcgaaaaagaacaatccgtgcaaggattgaagcaacagatcgcccaattggatgaggaagcccaaatagcccagcaacagcttttatcggcaagtgaaacattagaaaaacgcgaaggccggagagatgtgttgaaggagcggctcaaaaatgctgcggaaaatcgggagcaacttttgcagacaatccgtgaaggtgaggagaaggtcgcctccctcaaagttcatttagcaaaagaagaagaagcgaaacaaaaagcttacgagcaaatgactgcgcttgaagcagaaatacgcaatcaagaaaaagctcttcacggaaatgaaaaagaactggaagaaacggtcgatcggttaaaatctgattacattgaactattaaacgaacaagcatcgctgcgaaatgagacgcgctatttagaagagcagttgcagcagctacagcaaaagcaggaacggctcatccgggaaaatgaagcgtattttcaaaagcgaaaggaactggaagcacaggaagagcaagagcgcatgcagtttgaagcaaaggaaaaacagcttcaccgtcttgtggacgagtaccggaaccagcagcggaaggttgagcaagtaactcgcgtctacgagcaaaaagaaaagcaactgtacgaagcatatcagctcatccagcgattaacgtcgcggaaagacgttcttgaagaaatgcaagctgacttctcaggttttttccaaggggttaaagaggtgttaaaagcgcgccactccactttaaaaggaattgtgggtgcggtcgccgaacttgttacggtgccaaagccatatgaaacagcgatcgaaatcgccttaggtggaggagcacagcatatcgttgtcgaatcagagcaggcggcgagacaagcgattcagtacttaaagcagcaacgctttggccgagcgacctttttacctcttccggtcatgaaagggcgcgagcttccagcggcctctatgcaattgattcaagaacatgatgcatttgttgggattgctagtgagcttgtatcgtttgatcaacgcttcacgccagtcattaggaacttgctcggtcacgtcatcgtagcgaaaagcttagaaggagcgaatgctatagctaggttactccaacatcgttaccgcatcgtcacccttgaaggagatgtggtcaatcctgggggttctatgacaggagggagtgtcaaacaaaagcaaaccccgcttcttggccgtcagcgcgagctagaagaattgacggacaaactaaagcaactagagaaggcggcggcgaaattagagcaggaagttaaacaacaaaaaaacgaacgaacagaattgcagcaattgatcgaggacttacgcttacaaggggaagctgcccgggctgaagttgatggagcgaaagaaacgtggcaggcggttacctatgaagtgaaggcgatgcgcgagcgtttatcattggtcgaccgcgagcatgagtcgtttactgatgaagaaacgcgaattcgcgctcggcttgctgaattaaagcaattgcttacgagtgccgaacaggaagcgagcaagatgcagcaaacggttgcggagattgaaggaaggctgaagcagagccaatcatccaaggaagagcggcagtcacaattaaccgaattgaaaatccagcttgcaacggcgaaagagcggtatggcaacattgaagagcaacgagcaaggatcgctgagcagctagctgaggaaaaggaaaaacttcgggagcgaaaagaaacgtttcagctgttggagacagagctgtcacaaagtacgagtggtgagctttccttggacgagcaaattgaaaagagtcgtcaagaaaaaagcgagttaagcgaacatgttgcccacttgcaaacgaagcggaaggagctcggaggacagcttgaagcagaagaacagctgttggccgatctaggacgaaaacgtgcttacatgtcagaatccagtcgcgatgccgaagtgaaggtgaaccgcctagacgtcgagcttgacaaccgtttaaaccagctacgggatgagtatgagctaagctacgatctagcgaaagtggaatatccattaatgatggagatcggagaggcgcgaacaaaagtaaagctcataaaacgagcaatcgaagagctagggacggtgaatctaggggcgattgaagaatacgaacgggtaagcgaacgctatgaatttttaaaggaccagcaagcagaccttgtcgaagcaaaggaaacgctacacaatgtaattgaagaaatggatgaggaaatgacgaagcggttccatgatagttttacagaaattcaagcccattttcgcgtcgtctttaaggaattgttcggcggtggagaggctgatcttgtgttaacagagccggaccagcttctgacaacgggtgttgacattatggcacggccacctgggaagaaacgacagcacctcggactgctttcgggtggtgagcgggcgttgacggcgatcgctctcctattttcgattttacgatttcgccccgttccgttttgtgtgcttgacgaagtggaggctgccttggatgaggcgaatgttagccggtttgcgaaatttttaaaggacttcagtgatcaaacgcagtttatcgttatcacccaccgcaaaggaacgatggaagaggcagatgtcctttatggcgtgacgatgcaagagtccggggtttctagggtgatctcggtcaaattagaagaaacgaaagagttaatcgaaagctaa

SEQ ID NO: 41011 - DNA, 741 bp, Bacillus halodurans
atgctacaaggaaaaacagcgattgttacaggggcatctcgcggaattggccgagcaacagcgatggaactggcacgtcatggagcgaatgtcgtggtcaattatgcagggaataaggagaaagcggaaaaagtcgttgctgagattaaagaactcggagtggaggcaattgcgatccaagccgatgtagctgacagtgagtcggtccaagcaatggtcaaagagacgatcgatactttcggtgcagtcgatattctcgtcaacaacgcagggattacaagagacaacctatttatgcgcatgaaagaagaagattgggatgcggtgatcgatacgaatttaaaaggagttttccactgttcgaaagctgttacacgaccgatgatgaagcagcggtttgggcgaatcattaacgtatcgtctgttgttggtgccattgggaatgctggacaagcgaactatgttgcggccaaagcaggtgtcattggcttaacgaaaacacttgcccgtgagcttgctaaccgtaatattacggtaaatgcggtcgctccagggtttatcgaaacagatatgaccggtgaattgccggaagatgtcaaagcacaaatgctagggcaaatcccccttgctcgtctaggacagcctgaggaagtggcaaaagcggttcgtttcttagcgtccgacgatgcttcttacttaacaggacagacgatccatgtaaatggcggaatggtcatgtaa

SEQ ID NO: 41012 - DNA, 942 bp, Bacillus halodurans
atggcaaaagtagcatttctattcccaggtcaaggctcacagtctgtcggcatggggagcgaattactttcagaggaaaaagcaaaagagatttttgacgaggcggatgaaagactcggctattccctttcaagcattatgtttgaagggccagaagaaaaattgcgccggacggaaaatacgcaaccggccttgttgacgatgagcacggccgttttatcgctcgtgcgtgaatatggaatcaaacctgattatacagccggtcatagtctaggggagtacagtgcccttgtggcttcaggctctttaacgtttgccgatgctgtgtacgctgttcatcaccgtggattgtttatggaagaagcggtaccattcggcgaaggagcaatggctgccatccttggcatggagcgggacgaattagaacaagtaacgaagcgcgtaacagaagcaggggctgtcgttgaacttgcaaacttaaactgtcctggacaaattgtcatctcaggttctgctgagggtgtcgaacaagcatcagaggaagcaaaggaagcaggggcgaagcgagtgatcccattgcaagtgagcggaccgtttcattcatcgcttatgaaaccggctgccgaaaagcttgaagccgtgttagccgatttggcaatcgctgatgccgctccacctgttattgccaatgtgacagcagatctcgttcaaaaagccgctgacattcgctcatctctcattgagcaagtgtactctccagttcgttgggaggacactgttcgtcgcatgcttgagctcggagtggatacgttcgtggaaatcggatcaggaaatgtgctctcaggcctcgtccgcaaagtacagcgccgggttaatgttttttctgtgagtgatcgggcaagcattgaagcgatggtaaaaaaattggaacaggaggcataa

SEQ ID NO: 41013 - DNA, 750 bp, Bacillus halodurans
atgaacttttcatttttaaccgatgttgggaaggttcgtcctcataatgaggataacgggacaattatggaaaagaacgggcaactgctcgtcgtggttgctgacgggatgggaggtcatcaagcgggcgatgtagcgagcaagatggcaactgagctgctgaaagaagcgtgggaggaagcgagcctttccccttctagtcaagaaagcgaagggtggctccggaatcaagtgcttcatgtgaatgagagcctttatcattacgcgcaaaagcatgaagaatgtcaaggaatgggcactacattagttgcggcaattgtcgataaggaacgagtgacaattgcgcatattggggacagtcgtgcgtatttattgaatgagcacggattttcccaaaagacaagggaccactcccttgtcaatgagctcgttcgtacggggcaaatttcagacgaagaagctgagcatcatccgcgcaaaaatgtattgctcagagcgcttgggaccgaattggatatcaagctcgatctgactaccttctcatgggagccagatgatgttctcctattatgttcagatggtctatcaaataagctatcaaatgaagattttgctcggtacatgtctggtacgaaagaagttaatgaaacggcgagagagatggtacaattagcgaacgatcgtgggggcgaagacaatatcacagtggcgttaattaaaaatacaggttcctcgtctgaagacaggtga

SEQ ID NO: 41014 - DNA, 2709 bp, Bacillus halodurans
atgaagtggtatcaaatgggagaggaagaggtaaaaaaagcaacaggggtccttggggcagacggattgccgcaaagggaagtcgacaaacgattaaaaagggttggcttcaataaactggacgaaggggaatcggtgtcagccttgattctcttctttatgcaatttaaagatttcatggttctcgtccttcttgcagctacgcttatttcgggcttgcttggagaatatattgacgctattaccatcattttaattattctactaaatggcgtcctcggatttattcaggaacgaaaggcagaaaaatccctttcggcgttaaaagaattatcagcaccgcaaatggtcgttttacgtgatggcaaatggttaaaggttccagccgctactgttgtccctggcgatgtagtgaaactaacaagcggtgaccgagttggggcggatatccgcttacttgaaacggcaagccttcgcattgaggagtcctctttaacaggtgagtcgcttcccgttcataagcatggggacagaatggagcagaccgacttacagctaggcgaccaagcgaacatggcgtttatgggtacccttgtcaccgaggggcaaggaatagggattgtggtagcaacaggaatgaaaactgagatgggcaaaatcgctcacctgttgcaaacgacggaaacagtcattacgccgttacaacgtaagcttgagcaactagggaaagtgttgatcgctgttgcgcttttacttacggcaatggttgtcgtcattggggttatacagggtcatgatgcgtacacaatgtttcttgccggagtttcccttgccgtggctgcaatcccagaagggttaccggcaatcgtgaccgttgcccttgccctaggggtgcagcggatgatcaagagaagagcgattgtccgaaagctgcccgctgtggaaacgctcggctgtgcctccgtcatttgctctgataaaacaggtacgctcacgcaaaataaaatgacggtgacgcaagtatgggcaagtggtgaaacatggcatgtgtcagggacgggctatgagccccatggtctttttacgaaagggaaaaaggaaacggacccgaaaaggcaccggagtttacatctcttgctctcatacgggctcttatgcaataattcacagttgaagcagcggacggtaaaaaaagggatgttgaaaacaaaggaaagcacagcctaccacatcgaaggcgatccgacggaaggggctctgttagttgccgccatgaaggcaggcttctcccgggaacaattagatagacagtttaaaagactgaaagaatttccgttcgaatcgacccgcaaaatgatgagcgtcgttgttgaaaatgagaaagggcagcgttttgtcgtggcgaagggtgcacccgatgtcatcttacaggtgagtaaaaaaatccgttatcgcggagagcaggaagcgttaacccccaaacgccgggaagaggtagagcggacgattcaaacgatggcatcacaggcgctacgaacgattgccgttgcctacagaccgctcaggccaaatgagtcggtagacgaagcttatgaagcagagtgtgaccttacgtttatcggtttacaagggatgatcgatcctccacgtgaagaagtgtttgattcgattgaagaatgccgtcaagcaggaattaaaaccgttatgattacaggtgatcatcgccttacagcggctgcgatagcgaaaaagcttggcattttacccgctggagggaaagtcatagatgggacggagcttaaccacttaacagatcgtaggctaaccgagatggtcgatcaaatctacgtatacgcaagagtttctcccgaacataaattgaagattgtcaaggccatgcaggagcggggccacattgtagccatgacaggcgatggagtcaacgacgctccagcgatcaaagcagcgaatatcgggattgccatggggattacgggaacggatgtagcaaaagaggcctcttcccttattttgagcgatgataactttgcgacgattcgcgccgccattcgcgaagggcggaacatttacgataacattcgcaagttcattcgctacatgcttgcgtcaaacgtaggggaaatacttgttatgctgtttgccatgttgctcggcatgcctttgccgctcgttgcgacgcaaattctttggattaatctcgtgactgatggtttgcctgcaatggcgctcgggatggatcagcccgaaggaaacgtcatgaagcggccgccccgtcatccgcgagaagggatatttgctagggggcttgcatggaaaatcgtgagccggggatttatgattggcgttgtcacattggccgctttctggctgacgttacaagcgaatccagacgatttgacaagagctcagtccgtggcctttgttacccttgtgatggctcagctcattcacgtgtttgattgccgaagtgaatattcggtttttcaccgtaacccatttgagaacaaatatttagtcctagcggtgctttcgtccgttttattaatgctgatcgtgatctattaccctccattacagcaagtgttccataccgttccgttaaccgggcgtgaatggttactcattatcggaatggctgcaattccaaccgtcgttttaggaggatttcgcttactaaaggcaaaataa

SEQ ID NO: 41015 - DNA, 1260 bp, Bacillus halodurans
atgaaaacgacaaaaaaccgttggctcattgcgcttgcggcagttggaatccacatttcgatcggctcggtctatgcttggagcgtctttacgaatccattgattgagcaattcggttggggtttgggggaagtgtccttaacatttagtatcgccattgcgttcctcggcgtttccgcagcgtttatggggcacttcgtcgaaaaacatggaccgcgaaaatcagggatggtggctgcctcgtttttcggactcggcaccttaggcgcagggctcgccgtttctcttgaatctctttggctgctctatttttcctatggggtccttggcggatttggactcggtgttggctacataacccctgtctctaccctcgtcaaatggtttcccgaccggcgcggcttagcgacaggactggcgatcatgggctttggcttcgcctccctcgtgtttagcccgatcatgaatgcgttcattacatctgttggtattgctgcaaccttttttatccttggtggcctttacatgatcattatgtttaccgctgctctatacttagagccaccccctcaaggctgggtacctgctggttttaaagaagcaaaaacggaaaatggtcgtttgcaaaagcaggatctctcacaactaacggccaatgaagcggtaaagacgaaacggttctggttcctatggacgatgcttttcattaacgtcacatgtgggatcgcgattttagccgttgcctcgccaatggcgcaagagattacgggcatgacagcagcaacagcggcaacaatggttggacttatggggctttttaatggactgggacgaatcggctgggcgtccatttctgattacattgggcgaccgaacgtatacactgcctttttccttattcaaattgtcgccttcgtgatgctcccttcgatcacgcacgtgctattgtttcaagtggtgctctttttcatcatgacttgttacggcggtgggtttgcgtcgattcctgcttacattggggatctgtttggtacgaagcagctcggtgcgattcatggctacattttgacagcttgggcattagcgggactcgttggacctatgattgcttcgtatattcgcgagacgacgaatagctatgcaggcaccctttacatttttaccggcatgtttatagtcgcccttgccgtttccctttttattcgtgtggacattcgtcagttgcgcgcacaaagcaacaaacagggactcgtgagctga

SEQ ID NO: 41016 - DNA, 2349 bp, Bacillus halodurans
atgggaaagacgaaacatgctggcccgatgaaactagataaaaaatgggacccgtcattatgggcggggaaagtgcccctcggcttaggaaaagtgaaaccaaaacatattcgcgatacgttaaaagtcgcactcgaaaatcgcgacaatcttggctatgcctaccgtattttaacacagggggtctgcgacggctgcgcccttggcgtttccggcttgcaagaccaaacgctcgcgggaccacacctttgcaccacacggttaaatgtattacggttgaacaccatgccggccatcgatccgaaatggttggacgatgtggaagagcttaggaagcttgatagtacggagctacgcaagctcggccggattccgtatccactgtcgcgaaagccgggagaaaaaagatttacccgcattagctgggacgatgccttgaaccgtatcgccgcaaaaataaaagcgattgacccaaaacagcttgctttctacttaacggcaagaggaattacaaatgaagtgtattacacagcggccaaggtggctcgttttctaggaacgaacaacatcgataatgcgtcgagaatttgtcattctccaagtaaaacggcgttaaaacgttctctcggtatcggtgcgtcaagctgtaattatcaagattggatcggtaccgacgtcctcgtcttttggggctctgttgccgccaataaccagccagtatcaacaaaatatatgtatgccgcgaaaaaggcagggacgaagatcattatgattaacccgtaccgtgagccggcgatggaaaactattggatcccttcgattcctgaaagcgccctgttcggcacacaaatagttgatgatgtatttcaagtaaacattggcggcgatattgcgttcatgaacggggtgatgaagcattggtttgaaatggagaaagagcagccaggatctgcgatcgaccacgcgtttattgcgaaccatacgaacggctttgcagagcttaaggagcatgtggagcaattaaactggaacgacatcgtgaagtctgccgggctttcgaaagaacgaatcctcgagttcgccaagcttttagccaactcacgatcgggcgtgtttatttggagcatgggacttacccagcaccgatttgcgaccgataacatttcccaagtcgccaatttagctcttttgcaagggtttatcgggcgaaagcattgcggtgtgatgccgattcgcggccatagtggtgtgcaaggctcaggagaaatgggcgctgatccatttgtcttgcctggcggtgattttgaaccagaacataaaaagcggatcgaagcgatctggggattccacattccagattggcaaggggacacggtcgggcaaatgttagagaatgtcttgcttccagacgatcatgaacgaaaggtgcgccttttttatacgagtggtggtaacttccttgaaacgatgccggacccagcgtttatccaacgcgtgttggaaaacgtcgagcttcgcgtccatcaagacatcattttcaacacgtccactctcgtagatgcaaaagaagaagtgatcgttcttccagcgatgacgcgctatgaacagccaggtggaggaacgtcgacgagcacggagcgaatggtctacttcagtccggaaattaaaggcccgcgaatcgaagaagcacgggcagaatgggacatttacgtcgagctcgccaaacgagtcgatccagaacgggcccatttaatcgattttcaaactgcccaacaaatccgtgatgaaattgccgtagctaatccgaattatgacggaatccaacacctgaaaaatcgcggagatgtctttcaatggggaggtgcatggctttgtgaagggggtgtttgcccaacgcctgatggacgtggaaacttactccctatcgacctaccagagttccgccgcaccgagggtcacttttacgtgacaagtcggcgaggcaaacagtttaactcgatggtgtacagtgaaacggacccatttaacggagccgatcgctatgacgtgatcatgaacgaaacggacgggaagaaattaaatattcgtaacggtgaatcgattgtcgtctacaaccaatatggtacgttccaaggacgcgcctgctttggcgacacccagacagggaacattgcggtttattggccggaaggaaacatgcttcttccgaaaggtgtttacgaaacgcatgcgaaaatccctgagtacaatacgacggtgatcgttgaaaaagccgagagcttccatgcgcaaaaagacagacgctacctcgaaaaacgggtcgaggagctggagcttgaagcgaactga

SEQ ID NO: 41017 - DNA, 918 bp, Bacillus halodurans
atgagtcggttagcagtagaattaccaggtctctctatgaaaaatccgattatgccagcttctggttgcttcggctttggtaaagaatttgctggcttttacgacctgaatcatttaggtgcgatcgccattaaagcgacaaccgtagagccacgcttcggaaacccaacgcctcgcgtagcagagacccattcgggcatgctaaatgcgatcggcttgcaaaacccaggcctcaataacgtcattgataacgagttggctcggcttgcggacgtggatgtaccgattgtggccaacattgcgggttcaaccgtgaacgattatgtcgaagtggctgaagccatttcccgtgtggacaatgtccatgcgcttgaactaaacatttcttgcccgaacgtaaaagagggcgggattgcctttggaaccgtgccagatgtggcggcacagctaacgcaagaagtgaagcgcgtctctactgtgcccgtctatgtgaagctttcgccaaatgtgagcgacattgtggaaatggcgcaggcagtggagcgagctggagccgacggattgtcgatgatcaacacactccttggaatgcgccttgatttaaaacggcggacgccgattttagcaaacggaacaggtgggctgtctggacctgcaataaagcctgttgcgattcgaatgatttatcaggtgagccaagccgtttcgattccgatcattgggatgggcgggattcaatcggctgatgatgtgctggaatttatgctagcaggagcagatgcggtagcggtcggtactgccaactttaccgatccttacgtttgtcctacgatcattgacgagctgccaaagcgaatggatgagcttggcattgaacggattgccgatattgtcggagggagctggaagcagtcatga

SEQ ID NO: 41018 - DNA, 3189 bp, Bacillus halodurans
atggggaaacgcgaagatattaaaaaaattctcgtcatcggttcaggaccaattgtcatcggacaagcggcggagtttgattacgcaggaacgcaagcgtgtcaagcattaaaggaagaaggctatgaagtgattctcgtcaattccaatcctgccacgatcatgaccgatacgacaatggctgaccgtgtctacattgagccgttaacgctagaatttgtgagccgaattattcgcatggagcgaccggatggcatcttgccgacactcggtggccaaacagggttaaacatggcggttgaattagaccaagcgggcattttaaaagagtacaatgtcgaacttctcgggacgaaattagattcgattcaacaggcggaagaccgtgacctgtttcgagcattgatgaaagaattaaatgaacctgtgccagatagtgagatcattcatacgttggaggaagcgtacacgttcgtcgagcgtgtcggctacccgatcatcgttcgccctgcgtatacgctcggcggtactggcgggggtctcgtatacaatgaagaagaccttgttgaaatcgtaacgagcggtttgaagtatagccctgtgacccaatgtctagtggaaaaaagcatcgcgggctttaaagaaattgaatatgaagtcatgcgggatggaaaagatcatgcgatcgtcgtctgtaacatggaaaacatcgatcctgtcggcgttcatacaggggattcaatcgttgtggccccgtcgcaaacgttatccgatcgtgaataccaaatgctacgaaactcgtcgttaaagattattcgcgctctaggaattgaaggagggtgtaacgttcagtttgcccttgatccggatagcttccaatattacatcattgaagtgaatcctcgggtgagccgttcatctgccctcgcgtcgaaagcgaccggttatccgattgcaaaaattgccgcaaaaattgccgttggttatacattggatgagctgctcaatccgattacccaaacgacgtatgctagcttcgagcctgctcttgactatgtcgtcagcaaaattccacgctggccttttgataaattcgaagcagccaaccgttccctcggtacacagatgaaggcgactggggaagtaatggcgattggacggaacttggaggaatctctgttaaaagcggttcgttcattagaagccggggtctatcacttagatcaaccagatgtaaatgaccttgataaagaaagcctcgagaaaaagctgacaaagcctgatgacgagcgattgtttgccttaggagaggcgatccgtagagggtatacgatcgaagagctttgggcgttaacaaaaattgatcgcttcttcctccgttcgtttgcaagaatcatccagctcgaaacacaactaaaggaaaacgtaggcgatttagagctactaaaagaagcaaaagagcgtgggttctccgatatgatcatcgccgatctatggggaacatccgaacaggaagtgtatgagctccggatgaaccatggcctctcaccagtctataaaatggtcgatacgtgtgcagcagagtttgcgtcggcgacaccgtatttttacggaacgtacgaagaagaaaacgaatcggaacgaaccgataaaaaaagcattctcgtgttaggctctggcccgatccgaatcggacaaggaatcgaatttgattatgcgacggttcatacggtatgggcgattaaagaagcggggtacgaagcgattattgtgaacaataaccctgagaccgtatcaacagactttagcacgtccgacaaactttattttgaaccgctcaccgtcgaagatgtgatgcacattgttaatttggagcagccagaaggggtgatcgtccagttcgggggacagacagcgattaatttggcgtccgagctagcggcacgcggcgtgaaaattatcggaacggctcttgaagacatggatcgtgccgaggatcgggataagtttgaacagacattggttgaattgaacatcccacaaccattaggcgatacggcaacttcgattgaggaagctcgccaaattgctgaacgtatcggctacccagttctcgtcagaccgtcgtatgtactcggcggccgggcaatggaaatcgtttataaagaagaagaactgttaaactatatggcccatgcggtcaaagtgaatccgaaacatcctgtgctcatcgaccgctatttgacaggtaaagagctagaggtcgacgcaatatccgatggagaaaacgtctatattccaggcattatggagcacattgagcgggcaggggttcactcgggagactcgattgctgtctatccgccgcaaaccgttcctgaatcgctgaaacaaaagctgatcgaacggacgatcgagcttgctagagggttgcggattgtcgggttgctgaacattcagttcgtctggcataaagacgatgtgtacgtccttgaagtaaacccacggtcaagccgaacggtaccgtttttaagcaaggtgacaggcgttccgatggcgaatgtggcgacgaaggtgatgcttgggaaaacattgccgcagctcggctatgaaacaggctaccatccagaggcaaaagaagtctctgtaaaagtacccgtcttttcgttcgcaaaattgcgccgggtggacatcacgctaggaccagaaatgaagtcaacaggtgaagtaatgggccgagacaaaacgttagaaaaagcattgtacaaagggttaattgcttcaggaatgagcattccgacccacggttcggtgttgtttacgatcgccgataaagacaagcaggaagcgatcagtctcgcaaaacgattctatcaaatcggcttttcgattctcgcgacggaaggaacagcccacattctacatgaggagggcattccagtgacgacggtcaacaaaataagtgacgaaaagccccatttgctagacgtgatccgtgcaggtgacgctcaatttgtcatcaacacgttaacgagaggaaagcaaccagcccgtgacgggtttcgaattcgccgtgaatcggtcgaaaacggggtcgtatgtctcacatcactagacacagccgaggcgcttctccgcgtcctagaatccattacgttttctgctgaaagcatgccggtcatgcaatag

SEQ ID NO: 41019 - DNA, 1089 bp, Bacillus halodurans
atgaaaagacagctcattttagaagatggtagcgtgtttgtaggaaaagggtttggtagcgatcgagaaatgtcaggagaagtggtatttaacacgggaatgacaggatatcaagagatgctttccgatccgtcttattgcggacaaattgtgacattaacatacccgctgattggaaattatggaattaaccgcgacgactttgaatcgatgaatccagcgatacacgggttaatcgtcaaagaagcatgtgacattccgagcaactggagaagtgaagaatcattagactccctgttaaaagcgaagcaaattcctggactatctgggatcgacactcgaaagctcacccgcttgattcggatgcacggtacgttaaaaggccagctctgcccacttgatgtagacgtagagcaaatcgttcaggagttgaaagcaacaccaacaccgaccgatcaagtgtcgcgcgtctcaacgagagatccataccacgtaccaggccctggtaagcgcgttgtcctcgttgattatggaatgaagcataacattttacaggagctcatccgccgcaattgtgaagtgtttgttgtgccttaccacacatcagcagaagaggtgctccgcttagggcctgacggcgtcctgttaagcaacggaccaggaaacccagaggacgtatctgagggagtagaaatgatccgcaacctattaggaaaagttccgctgtttggtatttgcctcggtcatcaactgttcgcacttgcttgcggagcaaaaacagaaaagcttcgcttcgggcatcgcggctcgaaccaccctgtgcgtgaacggagtacgggattgatcgaaattacggcacaaaatcatggctatacggtaacggaaggttcacttgtgaatacggatttaatcgttacccatgaagcagtgaatgacggaacaattgaaggattggcacacaaagtacatccagcgttcagcgttcagtaccacccggaggcatcaccaggaccggaagattcaaacgtgctattcgatcgttttattaagctgatggaatcaaacaagcatcgggcgctcacggtataa

SEQ ID NO: 41020 - DNA, 918 bp, Bacillus halodurans
atggcggtaccgttcttacaggatcatgatacgaaacacgacttgcttactatgtcccatttatcgcttgaggaaattgagcacattttgcacgatgcccagcagtttgaaaatggtgccctttggtcgccagaggaaaagctttttgtcgccaatttgttcttcgagccgagcacgcggacgagagtgagctttgaagtagccgagcaacgacttgggctccatgtcgtcaatgtggatggggaacgatccagcgtgcagaaaggggaaacgctgtacgatacggcgaaaacactcgagtctatcggtgtaaacgccctcgtcattcgccatcgccaggaccgatatttcgaagaattgaaagatcgcatcaacatcccgatcattaatgctggcgatggttgtggccatcacccgacccaatccttgctcgatttgtggacgatccaacaggaatttggtagattttctaaccttatcactgttattagtggagaccttcgccatagccgagtagctcgctcgaatgccgaaaccttaactcgtctcggtgcccgcgtttacatttcaggtccgcgggaatggatggaaggctatgagggggtttacccttatgtgacgatggatgaagcggtcgaactagcggacgtcatcatgctcttgcgcgttcagcacgaacggcatgatgggaccgtttcattcacccaagcatcgtaccatgagcaatttggcttaacggtcaaacgggaagcgcggatgaagccaaaaagcattgtcatgcacccagcgcctgtgaatcgtaatgtggagattgcgagcgagcttgtggaatgcccacgctcacgaatctttaaacagatgaaaaacggggtcgccatccgaatggccgtgttaaagcgagcattgacagatgaataa

SEQ ID NO: 41021 - DNA, 543 bp, Bacillus halodurans
gtgtcgcggttaattttagatgagcaagcgattcggcgagcaacaacgcggatcgcccacgaaatcatcgaacgcaataaaggtgtgagcgattgccttcttgtcggaattaaaacgagggggatctatttagcgaaccgcctccaagaacgaattgaaacgatcgaaggcatcaagctcccagtcggtgaagtagacattaccctttatcgcgatgatttaacggtgaagtcaacgacggaggagccgattttgcaagggacggatgttcctgtcgatgttacgggaaaaaaagtcatcctgatcgacgatgtattatataccggtcgaacggtgcgagcagccttagatgcgttaatggatttaggccggccagaacaaattcaattggcggtgttaatcgaccgcgggcatcgggaattgccgattcgcccagattacgttggcaaaaacgttccgacgtctaagcaagaacaaattgtcgccaagctttctgaagtggatggcattgatgaagtaacgattgaacaaaaaacctcataa

SEQ ID NO: 41022 - DNA, 1293 bp, Bacillus halodurans
atgaatcatgaaaaccaatggcagttagaaacaaaggccgttcattcaggacaggagatcgatccgacaacgttgtcgcgagccgtcccattgtaccaaacgacgtcctacggatttaaagatacagaccatgcggcgaatttattttcactaagtgaatttggcaatatctatacccgattgatgaacccaacgacagatgtgtttgaaaaacgtgtggctgcgttagaaggaggagcggcagctttagcgacggcctcagggcaggcggccattacgtattcgattttaaatattgcggaggctggagatgaaatcgtgtccgctagtagcctttacggcggaacgtataatttattttcgattacgttgccaaagctaggggtaaacgtccgtttcgttgatccatcggacccagaaaacttcaaagcagcgattactgaaaagacgaaagccattttcgctgagtcgattggaaaccctaagggagacgtgttagatattgaagcggtggcgaaagttgcacacgatcatcaccttcccctcattgtcgataacacgtttccaagcccatatttgcttcaaccgataaagcacggcgcagacattgttgtgcattcagcaacaaaatttatcggtggtcatgggacgtcgataggagggatcattgtcgatggagggacgtttgattgggcgaaaacggatcgatatccagggctaacaacacctgatccgagttaccacggtgttgtatatacagatgcggtcggtccaattgcttatattattaaagcgcgtgttcagctattgcgtgacatgggggcagccatatcgccatttaactcgtttttactgttgcaagggttggaaacgttgcatttacggatggagagacatagtgaaaatgcctacaaagtagcagagttccttgagcaacatcaagcggtcgaatcggtgagctactctggactgccatcccatccatcctacccattagcgaaaaaatacttacctaaaggccaaggggctatcttaacgttcgaggtaaagggcggcgttgaagcaggaaagaaactcattcattcggtccagctattctcccaccttgccaacgtaggtgattcaaaatcgttgatcatccatcctgcaagcacgacccaccaacagctctcggaagcagaacagcgagacgcaggagtgacacctgggatgatcagactttcggtaggaaccgaatcgattcatgatattatcaccgatctcaaacaggcgattgaggcgagtcaagcgtaa

SEQ ID NO: 41023 - DNA, 1527 bp, Bacillus halodurans
atgacaatcgatacgaacttttcaaaatggtttctccagccgagtaaagaaagtgcgcaaatgtatgagacggtcatgcaacgagcactcacactagtcgtagagcatatgaaggaagcggcaaatcctttttctggggctgatcgtcactcgatccaacaagcggtgaaggacgctgcatttatatcctattctggcgaaccaattgacggagtgatccgagcgattcaagaaggggtcatgaagcattctctatggatttcccatccttccgcaatggcgcatttacattgtccaccgctcttaccatcgctagtagcagaagtcgtaatcaatgcgctaaatcaatcgatggattcttgggatcaaagtccatccgccacctatgtggaaacagaattgctccgcttctttacgaggtcgatcggttattctgacttaggagatggcgtgtttacgagtggtggtacacagtccaactacatgggcatgctcctcgcacgaaacaaaatatgcgagtcagcctttgctacaaacgtgcaagaggaaggactcccagttgacgcgcgaaaattgcggattctttgttcgcaagaagctcatttctctgtacaaaaatctgctgcccaactcggcttaggggctaacgctgtcgtccaagtagcgacaaatgagcggcagcaactttgcgtgaatgaaacaaggcagacaatcaatgagctgaggctgaaagggcttatcccatttatgatcgttgcgacagccggaacgaccgattttggtagcatcgataagcttagagagatcgctgaacttgcgagagagcaagagctttggctacatgtggatgccgcatatggtggggcattgttgttttcccggcaatatggccacttgctaaacggtctacatttggctgactcgattacgatcgattttcacaaattttattatcaatcgattagttgtggtgctttctttgtaaaagacaggcacgagtttgaacggattcgttttcacgccgactacttaaatccggaagaggacaaagaagcggacattattaatttggtcgagaaaagtgtgcaaacgacgaaacgcttcgatgctttgaagttattggtgacctttaaatggatggggaccgaacagtttgggcaaatgatcgattacacgatccagcttgccaaggagacaggcgagctgcttagacgatacggatttgacgtattaaatgacccagaattaaatgctgtcgtgtttcgttatgtaccagagtgccatcgtgacgatcagagctatgttgatcagctcaaccttactcttcaacgccatttttatgagcggggagatctcattatggcgaaaacgaaacagagaggccatgtgtacttaaaatttacaatgctgaatccgttaaacacgattgagaacatgaagacgcagatccaaaaagtgaagaaagcaggaatcgaatttgagaaaacacaaggagcgattcgccatgaacatgtcatccatagctaa

SEQ ID NO: 41024 - DNA, 1365 bp, Bacillus halodurans
atggatgtaatcgctcaagtaacagctacaaatcaacaattcttatcgcaacaagagaaacgggagtcaagtgcaaggtcttatccaagacggttaccacttgcgattcaaaaagcggaagggatttgcgtaaccgatatgaacggcaagcaattcatcgattgcttagcaggtgcaggaacgcttgcgcttggtcataatcatccggtgattcgccaagcgattgaaggagtgttagcatcatatgtccctttacattcacttgatctaacgacaccagtgaaggaagctttcgtcgatgaagtattcgcttcgttgcctgagtcatttgcgaaaaaagcaaagattcatttttgtggaccaacgggggcagacgctgttgaagcggccgttaagctcgtaaagacagcgacagggaatagagcgatgctgtcatttcaaggcggctaccacggctctacacacggtgcccttagcttgaccgggacgactgatccgaaaaagcgcatccatgctctaattccagatacgcattttcttccttatccatatgaataccgctgcccgtttggaatcgggaaggacggacatcgtgtcaacagtacatatctcgaatcccttctcgatgacccagaaagtggactggtcaaaccagctggcatcattgtggaagttgtacaaggggaagggggatcgatcccagcaccagttgaatggttaaaggaattacgccggatgacatcagagcgcaacattccacttattattgatgaagtccagactggtatcggccgtactgggaaaatgtttgcctttgaacatgctggaattgagccagatgttttagttttatcgaaagccattggcggaagtcttcctctttccgtggtcctttatgatcgcaagcttgatcaatgggagccaggtgcccatattggaacctttagaggcaaccaaatggcaatggcaacaggacgggcgacactacaatatatcaaagagaaccaagtaccaaagcatgtgcatgagttggggcaatatgtgaaggatcagctttcgtcgatccaatcaagcatgcgctctattggtgatgtgagagggcgaggtcttatgatcggtgttgaaatcattgatccacgaaaacaaccaaatgcaattgggagttatcctgcttatggcgagttagcaaaggcgatccagcgtcattgctttgaacggggactaattttagaagtaggtggacggtttagtagcgttattcgtttcttaccgccattgatcattacgagagaacaactcgacgatgtcctggagcgtttctatgatgctacggttcaagcagaaatagagttcggaataagatag

SEQ ID NO: 41025 - DNA, 3453 bp, Bacillus halodurans
atggacggattaaagaacataaagaaagtgttagttgcaaaccgaggcgaaattgccatccgtatttttcgcgcgtgtacggaattacatattcgtacagtagctatttactcaaaagaggacacaggcgcttaccatcgctataaggcagatgaagcttacttagtaggggaagggaaaaaaccaatcgaggcttatctcgatattgaaggcattatcgaaattgccaaacgtcatggtgtggatgccattcaccctggttatggatttttatctgaaaatatcgaattcgcgaaacgctgccatgaggaaggcattatcttcatcggacctgagcttgaacacttggtcatgtttggggataaagttcaagcccgtgagcaagcgattaaggccaatttaccagtcattcctggaagtgatggtcccgtttctagcctagaggatgtgaaagcttttgcggacaagcatggctatccgttcatcattaaagctgctcttggtggtgggggacgcggcatgcgaatcgttcgttctgaaaatgatgttcaggaatcatatgagcgggcaaagtcagaagcgaaagctgcttttgggaacgacgaagtatatgtggagaaatttatcgaaaacccgaaacatattgaagtacaaattcttgccgataaacacggcaacaccttgcacttgtatgagcgcgattgctctgtccaacggcgccatcaaaaagttgtggaagttgccccaagtgtatcattatctgaagatgtccgtgagcgcatctgtcaagcggccgttcagctagcggaaaacgttaattatgtaaatgctggtacggttgagtttcttgttgaccgagaaggaaatttttacttcatcgaagtgaacccacggattcaggtagagcatacgattacggaaatggttacaggaatcgatatcgtgcaatcccagctctttattgctgacggagagcatttgcatggggacaggcttgggattccgaagcaggaagagatcgtttgccatggatacgcgattcaatctcgcgtgacgacagaagatccaagcaacgggtttttgcctgacactggccgtattaacgcctatcgttccggtggtggattcggtgtacgtcttgacgcagggaacggattccaaggagctgttattacaccgtactatgattcgttgctcgtaaaagtgtcaacatgggcgctgacgtttgaaggggctgctgcaaaaatgctgcgaaaccttcgcgagttccgaattcgtggaattaaaacaaacattgcgtttcttgaaaatgtcgttcagcatcgccagtttttatccggtgaatacaatacgtcctttattgaccaaacacctgaactgtttgtgttccctaaacggaaagaccgggggacgaagatgctttcatttattggtgagacgattgtcaacgggtatcctgggcttgaaaaaacgaaaaaaccggtgtttgacaagcctccggttccaaagttaaagctatccgaaccgataccagacggaacgaagcaaatacttgatcagcacgggccagaaggattggcgaagtgggtcaaggaacaaaagcatgttctgttgacggatacgacgttccgcgacgcccatcagtcgctcttagcaacgcgcgttcggacacatgatttaaaacaaattgcagaaccgacagcaaggctactgccaaacttgttttccatggaaatgtggggaggcgcgacgtttgatgtggccatgcgtttccttcatgaagatccgtgggagcgtctgttaatcttgaggaaaaaagcacctaatgttttgtttcaaatgttgcttcgcgcctccaacgcagtcggatacaaaaattatccagacaatttgatccgtgaatttgtcgataagtcagcgaatgctgggattgatgtgttccgcatcttcgatagcttaaactgggttgaaggtatgaagttagccattgaagcggttggggaagcaaataaaattgctgaagctacgatttgttatacgggtgacattttagattcgagcagaccgaagtacgatttggcgtactataaaaaattagcgaaagaactagaagcagcaggtgcacacattcttggaattaaagatatggcaggactcttaaagccagaagctgcttaccaactagtggcagaattaaaggatacggtgacgatccccgttcaccttcatacacatgatacgagcggtaatggtatctttacgtatgctcgggccattgaagcgggcgtcgatatcgttgacgtggctgtaagttcaatggcaggtctcacatcacagccgagcgcgaatagcttatactatgcactagcggactctgaacgtcaaccgaatgtgaacattaccgcactagagcaattagctgaattctgggaagagacgcggaagttttatgctggattcgaaagtggtatgaacgcaccacacactgaggtatacgagcatgaaatgccaggtggacagtatagtaacctacagcagcaagcgaaagcagtaggtctcggtcatcgttggaacgaagtgaagaaaatgtaccggacggtgaacgacatgtttggagatgtcgtcaaagtaacgccatcatctaaagtagtcggtgatatggccttgtacatggtgcaaaacgacctgaccgaggaagaggtttatgagaatggtcataagcttgacttccctgattcagttgttgagttttttgaaggacagctaggtcaaccgtaccaagggtttccaaagaaattgcaggaaatcatcctgaaaggacggaaaccaattacgaatcgccctggtgaaaatatggagccaatccaatttgaggcgattaaagaagagctatataacaagttggatcgtcaagtgacgagccatgacattctatcatatgctctttatccaaaagtctttatggaatttgaacggttccgtcaaacattcggagatgtctcggttcttgatacacctaccttcttctatggtttacgtccaggtgaggaaattgaagtggaaatcgaacaagggaaaacattaattgtaaaatttatttccctttccaagccacaggatgatggaaaccggatcgtttactttgaattgaacggtcaaccacgggaagtgttgattaaagaccaaagcgtgaagacgagcattatttctcgtccaaaggccgataaatcaaatcctaatcatatcggagcgtccatgccaggaacggttgtgaaggctcttgttgaaaagggtgacaaagtgaagcaaggagatcatctcatgatcacggaagctatgaagatggaaacgactgtacaagccccatttgatggagaagttgttgccttgcatgtgaaagacggagatgcgattcaaacaggtgatttactaatcgaagtgaaagagctataa

SEQ ID NO: 41026 - DNA, 1410 bp, Bacillus halodurans
atggttgtaggtgatttcgcaaaagaagttgatactctcgtcattggttcaggtccaggaggctacgttgccgcgattcgtgcagcgcagcttggacaaagcgtaacaattgtagaaaaaggtactcttgggggagtatgcttaaacgttggttgtatcccttccaaggcgttgatctctgctggtcatcgttatcacaatgctctacattctgacgatttagggattaaggcagaaaacgtgacattagacttcagcaaagttcaagagtggaaagcatctgtcgtaaataaattaacaggtggcgtagaagggttacttaaagggaataaagtagaaatcattaaaggtgaggcctactttgcttcggaagactctgtgcgcattatggatgagaaaaatgcaacaacatacaagtttaaaaactgcatcatcgcaacaggctctcgtccaattgaattaccgaacttcaaatattcaaagcggattatcaattcaactggtgccctcgcgctagaagaagttccgaaaaaacttgttgttatcggcggtggctacatcgggatcgagcttacaggtgcatattcaaacttaggttcagatgtagttgtacttgaaggtggcaaacaaatcttacctgggtttgaaaagcaaatggcaaagcttgttgagcgtaagttgaaaaagaacggtgtttctttccatacagaagcgatggctaaaggcgtggaagaaacagaagatggcgtaaaagtaacggcagaaattaaaggcaaagaagaagtatttgaagctgattatgtattggttactgtcggtcgtaaaccaaatacggatgagcttggtcttgaacaaatcggagtcgagcttacagagcgcggtttgatcaaagttgacaaacaatgtcgtacgaacttaagcaacatttatgcgatcggcgacgtcattgaaggacctgcactagcacataaagcttcctacgaagggaaaatcgctgcagaagcgattgctggggaaaaatcagaaattgattacttggcgattccagccgttgtattctctgacccagagctcgctacggttggctatactgagacagaagcgaaggaagctggctatgatgtaacagctgcaaaattcccgtttgctgcaaacggaagagcgttgtctctaaatgatgcagatggtttcatgaagctcattactcgtaaagaagatggcctcgtcattggtgcacaaattgccggtccgaatgcttctgatatgattgcagagcttggccttgcgattgaaactggtatgacggctgaggatattgctcttacgattcatgcccatccatctttaggcgaaattacgatggaagctgcagaagtagcacttggaacaccaattcacatcgtaaaataa

SEQ ID NO: 41027 - DNA, 1281 bp, Bacillus halodurans
ttggcttacgaatttaaattgcctgacatcggggaaggcattcatgaaggtgagattgtcaaatggttcgtgaaacctggtgatgaagtaaaagaagacgatattcttttggaagttcaaaacgataaagcagtcgtagaaattccttcaccggttgacgggaaaattttagaggttaaagtagaagaagggacagtagcgattgtcggtgatgtgctcgtcacgatcgatgctggagaaggagtaggagcggaagaaacagaagaagcccctgcaccagaagaaaaagctgaggaagcagcaccagctgagccggcaccagcaaaagaaacagcacctgaagaagacggcgacgaagacaaacgcgtcatcgcgatgccatctgttcgtaaatacgctcgtgaaaaaggtgtaaacattaagaaagtgaagggaacagggaaaaacggtcgcattttacgtgaagacattgatgctttcttgagtggagatactcaagcagaggcttcggaagaaaaagccgaaacagcggcacctgcggcagcatctaatgtggagccgactgaaattcctgttggtgaacgggaagagcgcgtaccgcttaaagggatccgtaaagcgatcgcaaaagcgatggtcaactcgaaacatacagccccgcatgtcacccacatggatgaagtggatgttacggctcttgttgcacatcgtaaacagtataaagaaatcgcagcagagcaagggacaaagctcacatacttaccttatgttgtgaaggctttaacgtctgcgttgaagaagtatccggttcttaatgcgtcgattgacgacgtgaacgaggagattgtgtacaagcattacttcaatattggtattgcggctgacacagagcaaggacttgtcgttccagtcattaaagacacagatcgtaaatcgatctttgaattagctgacaacattaatgagcttgcgattaaagcacgtgatggtaagttgagcgctgctgaaatgaagggcggctcttgcacaatctcaaaccttggttctgctcgtggtcaatggttcacgccaattatcaaccacccagaagtagcgattttaggaattggccgaatcgaagagaagccagttgttaaagatggtgaaattgtagcggctccagttctcgcactttcaatcagctatgatcaccgcctcatcgacggggtcacagcacaaaacgcactgaatcatgtgaagcgtttgttgaacgatccacaattaatgttaatggaggggtaa

SEQ ID NO: 41028 - DNA, 978 bp, Bacillus halodurans
atggcgcaaatgacaatgatccaagcgattacggatgcgatgcgtaatgaactaaaacgtgacgagaatgttctcgtttttggtgaagacgtaggccaaaacggtggtgtattccgtgctactgaagggcttcaaaaggaatttggcgaagaccgtgtattcgatacaccacttgctgagtctggaattgggggcctagcgatcggtctaggattaacaggcttccgcccagtcatggaagttcaatttttcggttttgtatttgaagtatttgattcggttgctggacaaatggcgagaatgcgatatcgttcaggtggcaagtatcattcgccaattacggtccgctctccgtttggtggaggggtaaaaacacctgaacttcacgccgataacttagaaggtttaatggcacagacaccaggtgtaaaagttgtgattccgtcaactccatatgatgcaaaagggttattgatttctgcgattcgtgacaatgatccagttatctacctagagcatatgaagttataccgctctttccgtgcggaagttccggaagaggagtacacaattccacttggtaaagctgatgtgaagcgcgaaggaaaagatgtttctattattacgtatggcgcaatggttcactcttctctaaaagcggcagaagagcttgaaaaagaaggcattagtgccgaggtcattgacctgagaacaatcagtcctattgacatcgatacgattttagaatctgtgaaaaagacaagccgagtgatcgttgtacaagaggctcaaaaacaagctgggattggtgcgcatgtagcttcagaaatccaagaacgtgccatccttcatttggaagcaccgatcatgcgtgtttctgcgccagatacggtttatccgtttgcagcagcggaagatgtatggcttcctgatttcaaagatattgttgaaaaagcaaaagcagtcattgaattttaa

SEQ ID NO: 41029 - DNA, 1086 bp, Bacillus halodurans
gtgagtacaaagacgttagaaaaagtggaaggtcagtttgagacatttcaaattttgaacgaagaaggcgaagttgtaaacgaagctgcaatgcctgatctaagtgatgaacaattacaagagttaatgaagcgcatggtgtatacaagaatttgggaccaacgcgcaatctccttaaaccgccaagggcgtttagggttctacgcaccagttgcaggccaagaggcatccatgcttgggtcgcaatttgcccttgataaagaggattggattttacctggatatcgcgatattcctcaaatcgtattccatggtttaccgctctatcaagcgttcctatattcccgtggtcactttgaaggcggacaaattccagacggtgtgaacgtgcttatgccgcaaattattatcggagctcagatcgtccaagcagctggagttgcgatgggtcttaagcgcaaaggaaagcaaaatgtagcaatcacatatacaggagacggtggtgcgtctcaaggggatttctatgaaggaatgaactttgctggtgcttacaactctccagcgattttcgttgttcaaaacaaccgttttgcgatttcggttcctgtcgaaaaacaatctgctgctaaaaccattgctcaaaaagcagttgctgcaggaattgaagggattcaagtagatgggatggacgtcttagcagtctatgcagcgacaaagcaagcacgtgagcgagcgctcgctggggatggtccgacattaattgaaacgctttgctatcgctatgggccgcatacgatggcgggagatgatccaactcgttatcgttcttctgacctcgatgatgaatgggaaaagaaagatccgctcgttcgtttccgtaagttcttagaaggaaaaggactttggagtgaagagcaagagaacgaagtggtagaaaaagcgaaagaagatattaaagcggctattaagaaagccgatgctgcccctaagcaaaaagtaacagatttgatcggatttatgtttgaagaagctcctcagcatcttcgtgagcaattagaagaatatacagcaaaggagtcgaagtaa

SEQ ID NO: 41030 - DNA, 552 bp, Bacillus halodurans
atgacggacaagcgtatggtagcaaagcaagcacctcgctttgaaatggatgctgtaatgccgaacaaggagttcggaaaagtaagcctcgaagagaatatgaagaacgacaaatggacagttcttttcttctatccaatggacttcacttttgtatgtccaacagaaattacatcactcagcgaccgttatgacgagtttgaagatttagatgcggaagtaattggggtttcaaccgacaccattcacacgcataaagcttggattaacacgtctcgtgatgacaacggcttaggagaccttaagtatccattagctgcagacacgaatcacgaagtctctcgtgaatatggtgtacttattgaggaagaaggaattgcacttcgtggactattcatcattagcccagaaggcgagcttatgtattctgtcgtcaaccataataacattggtcgtgacgtggatgaaacgcttcgtgttcttcaagcgctccaaactggtggcctttgccctgcaaactggaagccaggtcaagaaacattaagcgtttaa

SEQ ID NO: 41031 - DNA, 897 bp, Bacillus halodurans
atggagattggattaatcggtttaggacgaatggggtacaatttgggcctcaatatccttgatcacgaacatcagcttgtcgcttatgatgtgaatcgtgaagcggtaaaagaaattggcttagctggtgcaaaagaagctgattcgctagaagagctcgtaagcaaactatcagcaccacgcaagatttgggtcatggttccagccggggatataacagaaaatgtcgtttcacagctaagctctcttttggacgaaggggatgttgtgattgatggcgggaatgcgaattataaggatacgttacgccgtgcaaagcaatatgaggcgaaggggcttcattttgtggatgcaggaacaagcggtggcattgacggggcacgtgaaggtgcttgtttaatggtgggaggaacgaaagaggttgttgaatctttagcccccctattaaaagaaatcgcagtagaagatggatatttatatacaggccctgtcggtagtggacattttttaaagatgattcataacggaatagagtacggtatgatgcaagcgattgcagaagggtttgacctgttagaaaacagtccgtttgactatgattacgaagcggtagcaaaagtgtggaacaacggttcggtcatccgatcatggctaatggaactaaccgaatcagccttttcaaaggatgcgaacttagaaaagattcgcggtgtgatgcattcgtccggtgagggaaaatggacggtggaaaccgcgctagatttacaaatcgaagcgcctgtaatcgctttgtctttaatgatgcgctatcgttccttacgtgatgatacgttttcagggaaagtggttgccgctttaagaaatgaatttggtgggcacgcagttgtaaaaagttga

SEQ ID NO: 41032 - DNA, 1503 bp, Bacillus halodurans
atgaatgatcgatatgtaatcggattagatattggtacaacaagtacaaaagctgtactgtttcactatgatggtgctgtgatcggagaactggaggtcgaataccctattctccgacctcaggcagactgggctgaacaagatccagacgaaattgtcaacgctagtaaacaggcaatccgcttactcatggaacggacatccgtctcccctagtgccgtaactgctgtcggtatttcgtcggcaatgcattccatcatttgtttaaatgaagacaaacaaccgctctccaacgccatcatctgggcggatacaaggagcagcgagcaagcagcacaattaagattgtcactcggttctcaattcatgaaacgaacgggaaccccctttcatccgatgacacctttttgcaaattaacatggatgaaacagaagaaatacccgccttttatagaggcttcctccttcgcctctattaaagaatatttgtgccttttatggtttggcgagcatgtagtcgattatgcaacagcctcttcctatgggatgttcgacatcgacgcatgcgtgtgggacgtggaggctttacagcttttacagctttcctctgaacagttcggtaagcctgttccaccaacgtacaccctttatggtatgagtgctgcacttgcagatgaacttggccttcttccttccactccttttgttgtgggagccactgacggtccacttgctaacttaggagttggcgctactggggaaggggataccgtgattacgattggaacgagcggcgctattcgtcaactgtcctaccgtccaatggtcgacgagcatcagcgcacgttctgttatcgtgtcgatgaccatctttttgtttcaggcggggcgacaaacaatggcggtatcgtattacattggctacagaagctatttgcgataaatgggcttgagaaaaatgctagtttcacaccgagctatgattcgctgcttcggcttgccgaacaatcaccagctggggcgaatggcgttctgtttctaccatacttaaatggagaacgtgcccctatttgggacggagcagcccggggaagttttgtcggattaggaatgtcacatcatcaaccagacatgattcgcgctgcattagaggggacgatctttagcctctatcatgtcgggcaaacgctgagagaaatgagcggtagaccgacccgcttgtttgccaatggtggtttttcacgttcaaggctttggcttcaaatagcggccgacatgtttaatcaagaactactgttgccaaaaagccaccaaagcgcagcatggggagcggcgtggtatagcttatatgccttaggagaagttccttccctagcagccattaaaaatagtgtcccgatgaccaattccattcttcctgtaactgaacattctctcgtctatgaaaaaaatttcacgttttacgaaaaattagccacctctcttccgatgcttcgtaaataa

SEQ ID NO: 41033 - DNA, 1581 bp, Bacillus halodurans
ttgcataaaatcatctccatgccaaaacgtctgttggtgaaagagcaaaacgtacagacgaaaacaacaggggagcgcttacgactatttttagaggagttaggcccaacctttgtgaagatgggacagatggcaagcacacgtccggatttgatcccttctgaattgatggaggagctggaaaagctacaagatcgcgtctccccattttcgtatgaagaagtaaaagccattgtggagcatgagctagggatggctgtagacgaattgtttcgcgagtttcatgaaacaccccttggtgcagcttcaatcgggcaagttcactttgccgtcttgcaatcaggtgaaccggtagcggtcaaagttcagcgaccgaacatcgaggagatcatcaaaacggacttagaaattttgcagcatttagcagaaatagctgaacaccgcttggagtgggcagcaaactatcaattagttgaaatcattgaggaattttcaaaggctctgttagctgaattggactatacggtggagggacgaaatgctgatcggctcgccaagctgtttgaagacgatccgaccgtccagattccacaagtgtattgggactattccacgaaaaaggtattaacgatggagtatgtggaagggacgaagttaaatgaacgagaagaactcaaacaaagaggctatgatgaaaaaatgttggcccagaggataacccatgcgatactaaaacaaatcttactggagggcttctttcatggggatccccacccaggaaatatttcggcgttacctagtgaagccatagcgtttatggattttggtatggtcgggcgcctttccccacagatgaaacaacatttcgcttctttagtgattgccatcatgcgccgacgttcggagggagtcttgaacgctattacaaaaatggggattgtccccgatgatgtggacatgcagctgctgcaatgggatatcgatgagttaagggaaaaatttgatgatgtccctttaagtcaggtgagccttggggaagcagttaatgacttgtttgccatcgccaatcgccaccgcattcaaattccagccgatttaacattgctaggtaaaacgcttcttacaatggaacaaatggtggaaaagttagatccggagcttagtatcgtaaaggtggctgagccttttggtcgtcaattgcttaaggagcgtttgagcccaaaatctgttgccgaacacgtatataatcagtggaatgaatatggggacgttcttacagagttgcctcgaacgttaaaagaattaacagcgatcacaagaaaagggaagctacctctagaactgtcactaccaaaaatcgaacgatttctaaataaattagatcgaattagtaatcgtttgtcctttagtatcgtcctcctgtcgttcagtatcattatggtcggattaatcatcggctcagctctaggaggacagtcatctctcctttggaacattccagcagttgagattgggttcgttgtggcgctccttatgtttatttggctcttatattccatcttgcgttcaggaagattttaa

SEQ ID NO: 41034 - DNA, 1344 bp, Bacillus halodurans
atgacccgtttcgacgaaaacgctcgcagtccatggacaccgctacacgacgtcaaaacagtagaattattccccctcaatcaaaggctggatggctcgatcacattacctggcagcaaaagcttaaccaatcgagcccttatcataagtgcattggcaaatagtgactcaatgcttacaggaatgttaaaaagtgatgatacatattggtgcattcaagcattaaagcgtttaggtgttcaaattaatgttcaaggcgagacgacctccattcgaggaatcgggggacaatggaaatcaagttccctttacatcggagcagccggaacacttgcgcggtttttacttggagcattagccatttcacgaagtggcaactgggagatcgaggccagtcaaagcatgagcaagcgtcctatagagccacttgtcggggtattaagagagcttggtgcgacgatacattacttacgaagggaaggcttttatcccctttcaatccatgggaacggcctagcgggaggaactgttcgtctttcaggtcaaatgtctagtcaatatattagtggcttgctaatcgcagccccctatgcggacaccccggttacgatcacggttcaaggtagcatcgttcaacacgcatacgtctttttgacccttcacctaatgaaatcatttggtgcgcaagtagagtatgatcagcaattacaaacgattgtcgttcatcctaccccttatacttgtcaagacatcgatttagaagcagatgcctccacggcctgttattttcttgctctcgctgcactgacaaagggtcggattcgtctaaacaatttaaccgctagcacaacccagcccgatcttcacatgctcaccgtgtttgaaaaaatgggctgtactgtgacgagaggatcgtcctttatcgaacttgaaggtgtctctcaacttaaaggcggctttcagatctcaatgaacgaaatgtcagatcaagcactaaccttagcggcaatcgctccttttgctgatgggcccattaccattaccgatgttgagcatatacgatatcatgaatccgatcgaattgctgtcatttgtgaagccttgacgagactcggaatccaagtggatgaatttgaagatggattgacggtttaccctgggactcctaaaccgacgttacaccccctctctacctacgatgatcacagagtggccatgtccctttcgctcataggaacaaaagtaaaaggactcaggttaaatgatcctggctgtgtggcgaaaacatgcccaagttattttcagctgctagagcaactcggaatccaagtacattatcaatag

SEQ ID NO: 41035 - DNA, 1293 bp, Bacillus halodurans
atgaccattttgaaggagccacagcgaacgcaagtagatgaaataaaagagatcaccgaattaagcttattacagtcaacacaatccgtcatcaaagaagcgctcgacctcctcggttattctgaggcaacatatgagcttttaaaagagccgattcgaatgctaacggtccgcattcctgtacggatggatgatggaaacgtcaacatattcaccggctaccgagcccaacacaatgatgcagtaggcccgacaaaaggcggtgttcgcttccatcccgacgtgaatgaaaatgaagtaaaagccctctccctttggatgagtttaaagtgcgggatcgctgacctcccatatggaggcgggaaaggcgggattatttgtgacccgcgtacgatgtcgttcggtgaattggaacgattaagccgtggctatgtacgggcgatcagtcaaatcgtcgggcctacgaaagacattccggcacctgacgttttcacgaactcacaggtgatggcgtggatgatggacgaatatagccgcattcgggaatttgattcccctggctttattacaggaaagccgattgtccttggtggctccctcggacgggaaagcgcaacagcaaaaggagtcatcatttgcattgaagaagcggcgaagagaaaccagcttgacctcaaaggggcccgagtgatcattcaagggtttgggaatgctggcagcttcctagcaaaattccttcacgacgctggtgccctcattgtcgggatttccgatgcgtacggcgcactttatgatcaggctggccttgacatcgaatacttgttagataaacgtgatagttttggaacggtcaccaacttatttaagaagacgattagcaatcaagagcttttgatttcggattgtgacattcttgtcccagctgcgatttcaaatcaaattacaaaggaaaacgcccatgacattaaagcaaaagtagtcgttgaggctgcgaacgggccaacgacgctagaagcgacccggattttaaccgagcggggcatttttttagtacccgatgtgttggctagttcaggaggggttacggtctcttactttgaatgggtacaaaacaaccaaggttactactggaatgaagaagaaatcgatcaaaagttccgcaacatgatcgtaggttcgtttgagaaggtatgcaccttttcaaaccagcaccaagtcgacatgcgtctcgccgcctatacggtcggcgttaagcgaatggctgaagcttctcactttagaggctgggtataa

SEQ ID NO: 41036 - DNA, 3045 bp, Bacillus halodurans
ttgaaaacgcactcaaacgtaagctggcttcgcgatgtgaatgtatttgccgtcaatcggcttccggcccattctgatcatgtatattatgaaacggtggaagaagcgaaaaaagaaccgccaatgtccatgcgccattcgttaaatggccattggaagttccattatgcgatcaatccgaatactcggccaaaggagttttaccagctcggttttgattgtaaatgttgggacgatattctcgtaccagggcatattcaactacaagggtacgggaagccccaatatgtgaacacgatgtatccatgggacggtcaccaccaccttcgcccgccggaaattccggaagatgataatccagttggcagctatgtcaagtattttgatattccgaataacatgtcgaaccaccctctctttatctcctttcaaggggtggaaacagcgttttacgtttggctcaatggggagtttgttggctatagtgaggatagttttacgccggcagaatttgacctgaccccgtatgctgtggagggggaaaacaaactatgtgttgaagtgtatcaacgttcgactggtagctggttagaggatcaagatttctggagattttctggtatttttcgcgatgtctacttgtacacgattccgaacatccacgtatatgacatgcacgttcgcgcggatctagaccgttcgttgcagacaggtatccttgaaacaacacttgaactaaaacgatcccaagaaaaagaggtgatgatcgttgctgaattgtacgatgctgaaggagcggtcgttgcaacggcggatatgaaaacgaatcaagatcaagcgactgtgtccatgagcgtagattcgccagcattatggagtgcggaagatccttatttatacaagctgtttttgaaactatttgatgaaaatgggacattagtagaggtcgtcccacaaaagataggatttagaagatttgaactcgtgaataacatcatgactttgaatggcaagcggattgtctttaaaggcgtgaaccgccacgagtttaatgggcgaacagggcgtgtcgtgacaaaagaagacatgcttgaagatataaagacgatgaaaaagcataacattaacgccgttcgtacttctcattatccgaacaatagtgagtggtatcaattgtgcgacgagtacggtctctacgttattgatgagatgaatttagaaacccacggctcgtggcaaaagttagggaaggtagagccatcctggaacattcctgggaatcatctggagtgggaaccgatcgtgatggaccgagccgtctccatgtttgaaagagataaaaatcacccatcgatccttatctggtcgtgcggaaatgaatcgtatgcaggtgaggttattctgaatgtgagtcgctactttaaatcggtcgatccaagccgtctcgttcattatgaaggtgtctttcatgcgagagcttatgacgccacgagcgatatggaaagtcggatgtatgcaaaaccaaaagacattgaggactatttaacgaacgatccgaaaaagccgtacattagctgtgaatatatgcatgcgatgggcaactctttaggtgggatgcacaagtatactgagttggaacagaaatacccgatgtatcaaggaggcttcatttgggattatatcgaccaagcgcttttgaagaaggatcgctacgggaaagaatactttgcatacggcggagattttggcgacaggccaacagactatagcttttgtgcaaacggcattgtatatgctgatcggaagccgtcaccaaaaatgcaagaagtgaagtttttatatcaaaacatcaagctagtaccagatcgcgagggagtgctcgtgaaaaatgaaaatctgttcaccgatacatcagcttatcaattagagtatgtattatattgggaagggacagaactctatcggaaaaagcaagatgtatttgtagctccgcaggaagaagtatatctaccgtttgattggcttgaacaggggatgaatgaatctggagagtattgcatccacacaatgcttactttaaagcaggatcaactgtgggctgagaaaggacatgaggttgcgtttggtcaacatgtataccgaatgggagcgattcaaaaagaaaggaacgcaagaggagcacttaaggttgttcatggcgatgtaaacatcggcatccatggggaagacttttccgtactcttttccaaagcggttgggagtctcgtgtcgcttcactatgcgggcaaagaaatgattgagcagccaccgatgccacttttctggcgagcgacaacggacaacgataagggatgttcccagctttatcattcaggcatttggtatgcggcaagtttagcgagaaaatgcgtgaacatggaggtcgaagagaagcctggacacgtatctgttctttttacctatcatttcgctataagtgatcgagttgaagtaaaggttggttatacggtgtttccagacggaagccttcgggttcgctccacgtatcaagccagcaaaggaggcgaaaccttgccacagctaccgatgtttgccttatcctttaaactaccggccgattatgagcaattggaatggtacgcattaggaccggaagaaaattatgcggatcgcgcaacaggagcaaggctttgcacattcaaaaacaaagtagaagacagcctctcacaatatgtgaccccgcaagaatctgggaaccgaacaggggtccgcaccgtgaaaatcctcgatgcaaacgggcaagggatcgaagtctgctcggtggaggagccaattgaatgccaaatctccccatacactgcatttgagcttgaacaggcaagccatccatatgagctgccaaacgttcattatacggttgtgaatgtggcaggaaaacaaatgggtgttggaggagatgatagctggggtgcgcctgttcacgatgaatatgtgctgaaagcggatcaagatttagaattcgtgtttgacatcaatcgggtgtaa

SEQ ID NO: 41037 - DNA, 1413 bp, Bacillus halodurans
ttgttagcaaaagaagtcaaggaaaaactgatcaagatcgtcggattagaaaacgtggaggattctcctgtggagaggctcgtctattcttacgatgcgaccccgcagtttcaagcgctgcctgatgcggtcgtttccccaagaaatacgaaggaagtggctgaaatcgtaaagatttgtaacgaatacaacatccccattgtccctcgaggatcaggcacaaacctttgtgcgggcacttgcccgacggagggagggatcgtccttctttttaaacatatgaattctattttagaaattgatgaagagaatctaaccgtaacggttcaacctggggttatcacgttagacatgattcgagctgtggaggaaaaaggtctgttttatccaccagatccaagctctctcaagatttcaaccatgggcggaaatatcaacgaaaattctggtggtttacgtggattgaaatatggagtaactggagactatgtccttgccttagaggtcgttttagccaatggcgaagtgatccgcacaggaggaaagcttgcgaaggatgttgcaggttatgatctcacacggttgatggttggatcggaaggaacgctagggattgtaacagaagcaacatgtaagctaattccaaaaccagagtctaagcagactatgcttgcgctctatcaagacattgaagcagcagcacaaacggtctccagtattattgcaaacaaagtgattcctacgacacttgagtttttagatcaaccgacgttaaaagtggtggaagcacacgctcagatcgggctaccgaccgatgttcaagcggttcttctcattgagcaggatggcccaagtgaagtcgtaaaacgagagatggagaaaatgcatgcattatgtgaacaagggcaagcgatttcagttcagatcgctgagtctgaggatgaggcagaggccttgagaaccgcgagacgaagcgccctttccgctctcgctcggttaaagccaacaacgattttagaggatgcgacggtaccgcgttccgagattgcgaacatggtaaaagtgattaacgaaattgcagaaaaatacgagcttacgatttgcacgttcggtcatgctggggacggtaatctccatcctacttgtttaaccgatattcgcaatcatgaagaaatagagagagtagaaaaagcgttcgcggaaattttcgaaaaggcgattgcgcttggcggaaccattactggcgaacatggagtaggggtgatgaaggcgccttatctcgaacgaaaacttggtgaggctggaatggcagcgatgaaggcgattaaagaagcgctcgacccaaatcacattatgaatcctggaaaagtgtttgcgaaggattgtagaaaacgggtggtggtttcacggtga

SEQ ID NO: 41038 - DNA, 1548 bp, Bacillus halodurans
atgttgcaaccatataagcatgagccatttacagattttacggtggaagcgaatcgaaaagcgtttgaagaagcacttggacttgtagaaaaagagttaggcaaagagtatccattaattatcaatggtgagcgggttacaacagaggacaagatccaatcttggaaccctgctcgtaaagatcaattggttggttctgtttctaaagcgaatcaggaccttgcagagaaagctattcaatcagcagatgaagcgttccaaacttggcgcaacgtcaaccctgaggagcgtgcgaacattttagtgaaggctgctgcgatcatccgtcgccgcaagcatgagttttctgcatggcttgtacatgaagctgggaagccgtggaaggaagcggatgcggatacggcggaagcgatcgacttccttgaatattatgctcggcaaatgattgagcttaataggggaaaagagattcttagccgtccaggcgagcaaaaccgttacttctatacaccaatgggcgtgacagttacgatttctccatggaacttcgcccttgcgatcatggtcggtacggcagtagctccgattgtgacaggaaacacagttgtccttaagcctgccagtacgacacctgtcgttgctgctaaatttgttgaagttcttgaggatgcagggttaccaaaaggcgttatcaactatgtaccaggaagcggcgctgaagtcggtgactaccttgttgatcatccgaaaacgagtcttattacgtttacgggctcaaaagatgtcggtgttcgtttatatgagcgggcagctgttgttcgaccaggacaaaaccacttgaagcgcgtcattgtagaaatgggtggaaaggataccgttgtcgtcgatcgcgatgctgatcttgatttggctgcagaatccatcctcgtctccgccttcgggttctcgggacaaaaatgttctgctgggtcacgggctgttatccacaaggatgtctacgatgaagtgttagaaaaaacggtcgcccttgcgaaaaacttaacggttggcgatcctacgaaccgcgacaactacatgggaccagtaattgatgaaaaagcgtttgaaaaaattatgtcatacattgaaattggtaaaaaagaaggccgtctcatgacgggcggagaaggagacagctctacaggcttcttcatccaaccgacgattattgctgaccttgatccagaagcggtgatcatgcaagaagaaatatttggaccggtggttgctttcagcaaagcgaacgattttgatcatgcactcgaaattgccaacaacacagagtatggcttaacaggagcggtgattacgagaaatcgcgcccacatcgagcaagcaaagcgagagttccatgtcggaaacttgtatttcaaccgtaattgcacaggagcaatcgttggctatcatccatttggcggctttaaaatgtctggtaccgattcaaaagcaggtggtcctgactatttagcgcttcatatgcaagcgaagacagtatcagaaatgtattaa

SEQ ID NO: 41039 - DNA, 1497 bp, Bacillus halodurans
ttgagatatgtactaggcgttgatctaggaacgagcgcggttaaagtgttacttgtcaatgaacgaggggaagtgtgcaagcaagtcacaaaatcgtatccgttgtatcaagacaagcccggttacagtgagcaagacccagaagattggctaaatcaaacgattgaagcgatatctgaagtgacaagcgaagcaagtgatccagaggcgatcgatggtattagcttctctggacaaatgcacggcctcgttctactagatcaggagcaacgcgttctgcgtccagctattttatggaatgatacacgtacaacgaacgaatgtcgggaaattgagcaaactctaggaaaagaaaccctactagcgattgcgaaaaatcctgccctagaagggtttacactgccgaagctattatgggtaaaaaagtacgagccagatgtttttgctcgcgccaacgtttttatgcttccaaaagattatgtccggtttcgtttaacaggaaagattcatagtgagtattcagacgctgccggaactttactgttcgatgttgctaagaaagaatggagtaaggacatttgttcttgctttgaattgcccatcagcctgtgtcctccagtcgtcccttcaagcggggaagtcggtgaactgttaccagagattgctgcgaagacgggactgaaaaaagatgtgcgcgtgtttgcaggcggagcagataatgcttgtggagcaattggtgcaggaattttaaaagatggcgccactctttgtagcatcggtacatcgggtgtggtcctttcctatgagcaagcagctgatcaagacttcgcaggcaaagtgcattattttaaccatggagaggcaacggcctattacacgatgggtgtgacgctagcagctggttatagcttgagttggtttaaggagacatttgccccagaagagccatttgaaaacatagtaaaggaaatcgaaaaaagtccacccggagcaaacggacttttgtttaccccttatattgtaggggaacggacgccccatgctgacgcaacgattcgcggtagctttatcggtgtacacgcgggtcacaagcggcatgactttacacgagccgtcattgaagggattacgttttcgctaaacgaatctatcgagattttccggaaaaatggaaaagacatttctaccgttgtctcaatcggtggaggggctaaaagccctgcttggcttcaactgcaagcagacatctttcaagcgaaagtaattaaacaatccagtgaacaggggccagggctcggtgcggctatgttagcagcctatggacttggatggtacgattccttagctgattgtgctgaagcttgggtcaaagaacaagaatcatatgagccaaacgctgaaaaagggaaagcatatgaagagctattcaccctttatcgccacgtatatgagcaaacatatgaattaaatcacggtttaagtaaatttagagaatag

SEQ ID NO: 41040 - DNA, 1281 bp, Bacillus halodurans
atggcgactgaaattacgatgccccaactaggtgaaagtgtaactgaagggacgattagccgttggctcgtcaaacctggagataaagtcaataaatacgatccgttagctgaagtgttaacagataaagtaaatgctgaaattccttcctccttttcaggtaccattcaggaactactcgtagaagaggatgaaacggtagcggtcggtcacgtgatttgtacgatgaatgtggaaggggaggcggttgaggctgaaacgaatgataccagcgtgtcttctgccgaaaccactgagagcccaaccgagactcaggaacaatcgacttcagctaaaaaacgctactcgccagctgttcttcgtttggcagaagagcatgatattgatctgacccatgtgactggatcagggaaaggcggacggattacacggaaagatctacaagcgattatcgagggtggcgacataccaaaagcggcgccgatgacggaacagaaaacagctcctgtacatgagactatgccattgacagaaaaggtacaggaacctgtccaagtgccaactgtgtcaggggatgttgaaatccctgtttccggtgtacgaaaagcaatagcgcaaaacatggtgaaaagcaagcacgaagcccctcatgcatggacgatggtggaagtggatgtaacgaacctcgtccagctgcggaatcaattgaaggaaggctttaagaaaaaagaaggcttcaatttaacctttttaccattctttatcaaagccgtcgttgaagcattgaaggcgtaccctcagctaaattccatgtgggcaggggataaaatcatacaaaagaaagacataaacatatccctggctgttgccacagatgatgcgttattcgtgccggtgatcaagcatgccgatgagaaaacaatcaaaggtcttgctcgggaagtgaatgaactcgcacataaagttcgtacaggaaaagtgacaagtagtgatatgcagggcggcacctttacggttaacaatacaggctctttcggatctgtcctttccactccaatcataaaccatccgcaagctgcgattttatcggtagagtcgattgtgaaacgaccagttgtcattgaatcagaagcaggggacatgatcgcgattcgcagcatggtcaatctctgcctctcacttgaccatcgcgtactagatgggcttatatgcgggcgcttcctagcaaaggttaaaaacattttagaaaacatgaccattgaaaatacgtctatctattaa

SEQ ID NO: 41041 - DNA, 984 bp, Bacillus halodurans
atggctgtaatgtcttatatagaagcagtgacgctcgcattaaaagaagagatggagcgggatgaaaatgtatttgttctcggggaagatgtaggggcacgcggtggtgtattccgggcaacgaacggactctatgaacaatttggcgaagcgcgcgtattagacaccccgcttgctgaatcagcaattgcaggtgttgggattggcgcggcaatgtatgggatgcgcccagtggcggaaattcagtttgctgattttattatgccagctgtgaatcaaattgtgtctgaggctgctaaaatccgataccgttccaacaatgattggcaatgcccaattacgattcgcgcaccttacggcggagggattcacggggcgttataccactctcaatctgtggaagcaatgtttgcgaatactccaggattgaaaatagtcatgccttctacaccgtacgatgtaaaagggctgttaaaggcggccattcgttctgatgacccagttctctttttcgaacataaacgggcttatcggctcattaagggtgaagtgcctgaaaacgattataccctaccaatcggcaaggcagatgtcaaacgggaaggggacgacgttactgtcattacatatggtctggcggtccacttcgcgttgcaagcagctgagcgtcttgaaaaagatgggatctcgacccatattttagatttacgcacagtctatccgttagacaaagacgcgattatcgaagccgcttcaaaaacaggaaaaatccttttagtgacagaggataataaagaaggcagcatcatgagtgaggtagcagcgatcattgccgaacattgtttattcgacttagatgccccgattcaacggttagcaggtccagatgtaccagcgatgccatatgcaccgacgatggaaaaacattttatgatcaatccagataaagtagagaaggcaatccgtgaattagcagagttttag

SEQ ID NO: 41042 - DNA, 993 bp, Bacillus halodurans
atgacagaaccacgccataagcagctagggttgtctgatgaaacagtcgtacatatgtatgagacgatgctcctcgcacgaaaaatcgatgagcggatgtggcttttaaatcgagctgggaaaattccatttgtgatttcgtgtcaaggacaagaagcagcccaagtaggtgcagcttttgcccttgatcggacgaaagattacattcttccatactatcgtgacatgggtgtcgtcttaacgtttgggatgacagcaaaggatttaatgctctctggttttgcaaaagcggaagatccgaactcaggaggccggcaaatgccaggacatttcggatcgaaaaaacttcgcattgtaaccggatcatctcctgtcaccacgcaagttcctcacgctgtagggatcgccctagcgggaaaaatgaaaggggaagactttattacctttacgacgtttggggaaggttcttccaaccaaggagactttcatgaaggtgccaactttgctggcgttcataagcttccggttatttttatgtgtgaaaacaataaatatgcgatctcagttccgattgaaaaacagcttgcatgcgaaaaagtatcagatcgggccatcggctatggaatgccaggggtaacggttgatggaaacgatcctcttgctgtatatgaagcggtgaagcaggctgcagatcgtgcacgtcgcggcgaaggcccgtcgttgatcgagacggtttcatatagattaactccgcattctagcgatgacgatgatcgcgcctaccgctctcgtgaggaagtggaggaagcgaaaaaatacgatgccctgattacgtttgctgaatacttactcgaaacgggagcgcttacggaagaaggaaaagaagcgatggataagagagttagtgacatggtgaacgaagcaacagagtatgcagaacgtgcaccgtacgctgatccagagcaagcgttgggccacgtatacgcggaatag

SEQ ID NO: 41043 - DNA, 1425 bp, Bacillus halodurans
atggcggaagagtacgatctcgtcattttaggtggagggactggtggctacgtagccgccatccgcgccacacaactcgatctaaaagtggcattagtcgaaaaaggaaaattaggtggcacgtgcttacataagggatgcataccgagtaaagcgttgcttcggtcggcagaagtattttcgacggttcagaaagccgatcagtttggcgtgaagattgacggagccgcgttagactttacgagtgtacaaaatcgaaaagaacaaattgtcacgcagcttcatcgcggggtcgaaatgctgatgaaaaaaggaaaaatcgatgtctataaaggccatggacgcattttaggtccatcgattttctcccctacgcctggtacgatctctgttgaaatgaacaacggcgaagacaatatgatgctcattccgcgaaacgtcattattgcaacaggttcctcacctcgcgtcttaccagggatggaaattgacggtgaggctgtcttaacgtctgacgaggcgctgaaaatggagcagttgccgaagtcgatgctcattgttggtggcggcgtgatcggaatcgagtgggcttcgatgctcaatgactttggcgttgacgtgacagtcattgaatacggtccacgaattttaccgaccgaagatgcggatattgcaaaggaagctgagcgtcttttaaaaaagagaggcgttacattcaaaacaaacgcaaaagtgttagcggaaacgttggaaaaaggagataactcggtcgtaattgaggcggaggttggcggtgtgagcgagcgtttcaccgctgaaaaaatgctcgtttccgttggacgaacaccgaacgtgaatgacatcggacttgaaaatacagatattgaagtcattgatggcgccattgcggtaaacgagtggtatcaaacgaaagagtcgcatatttatgcgatcggtgatgtgatcggcgggatgcagcttgcccatgtggcgtctcacgaaggaatccttgcagtcgagcatatgacggatcacaagcctgaaccacttaattacttaacggttgcccggtgtgtttatagccatccagaaatggcaagcatcggactatcagaagcggaggcaaaagagaaaggctacgaagtaaaagtcggaacgtttccgtttcaagcgatcggcaaagcacttgtctatggcgaatctgatggatttgtaaagatcctatctgataagaaaacagatgatctactcggtgttcatatgattgggccccatgtgaccgatatgatttctgaagctgcactagcaaaggttctcgatgcagcccattgggaagtggcccatacgattcatccccacccaacgttatccgaggttgttggtgaagcggcattagccgttgacggaaaggcgattcatttttaa

SEQ ID NO: 41044 - DNA, 1890 bp, Bacillus halodurans
atggacttagagaagctgcacgatccttccctgatcaaatcaatgacaaagcaagaattggagcaattagcggaagagattcgtcaatttttaattgaaaagctatccattacgggcggccatctcgggccaaaccttggggttgtcgaattgacgttggcattacattcactgtttgacagtccgaaagacaagttgatttgggacgtaggtcatcaagcttacgtacataaaattttgactggacgagcaggacaattcgatcaacttagacaatataaagggctttgtggatttccgaaacgcgacgagagtgagcatgatgtttgggaaacgggacacagttccacttctctatctgcagcgatgggaatggctacagcccgtgatttaaaggggacagatgaaaacgttatcgccatcattggtgatggagcgttgacaggtggcatggccctcgaagcgttaaaccatatcggacatgagcagaaggatttaattgtcgtattaaacgataatgaaatgtcgatcgctccaaatgtcggtgctcttcacaatgttcttgggcgcttgcggacagcaggtaaatatcaaaaggcaaaagaagatctggaaatgctgatcaaaaagattccagctttcggtggtaagttggctcaagcggctgagcgtgtgaaagacagcttaaagtacttgctcgtatctggcattttctttgaagaaatgggctttacgtatttaggaccagtcgacggccatgaccttgacgatttgatggaaaacttgaaatacgcgaagaaaacaaaaggtcctgtcctcattcacgttctgacgaaaaaaggaaaaggctacgccccagcagaaaatgatgagaagggtacatggcatggggtcggtcattacaaaattgaatcaggtgagcttgtaaaaaaaccggctccgccaagttatagcggtgtgtttgcagaaacattaaagaaaattgctcgcaacgaccctcgaattgtggccctcactgcagccatgcctggtgggacgaagcttgaccaattcgcaaaggaatttccagatcgtatgtttgatgtagggattgcagagcagcatgcgaccacaatggccgggggacttgcaacgcaagggttaaagcccgtattcgctgtgtattcaacctttttgcaaaggggatatgaccaagtcgtacacgacatttgcaggcaaaacttaaacgtgttttttgcaattgaccgagcaggacttgttggggcagatggcgaaacacatcaaggggttttcgatatcgcctatttacgccatttaccaaacatgaagatccttatgccaaaggacgaaaatgaattgcagcacatggtttatacagccattcaatatgagggtggaccaatagctgtccgttatccgagagggaacgggtatggaatcaaaatggacgaggtgttaaaggaaatcccaattggatcgtgggaagtgctgcaagaaggaacggatgcctgtattcttaccttcggaacgatgatcccagttgcagagcaagcgagtaaagagctttcacaacaaggttattccatccggttaatcaatgctaggtcggttaaacctcttgatgaggcgatgcttcacgagattgcgaaaagcgggcgaccagtattaacgcttgaggagacagcggtgcaaggaagttttggtagtgcggtactggaatttttccatgaccatgggtatcacaatgtcgtcacccagcggatgggaatacctgatcgatttattgaacacggaagcgtaagcgaattgcttgaagaaattggcctcacctcaagccaagtggcgaaccaattaagcaaattgcttccgagaaagcaaaaaagggcgtaa

SEQ ID NO: 41045 - DNA, 885 bp, Bacillus halodurans
gtgagtgtacaactgttacaatttttagatgaaattaaagacatcatcgaagagcggatgcctgcacatattgaacgactaaattctcctgacatgctgaaaaattctatgctttactccttgaaggcaggaggaaaacgaattcgaccagcgctgctattggcaacgatgaaaagttttcaaaaggatatttcacaggggattgaccttgcctgtgcgattgagatgattcatacgtactcgctcattcatgatgacctcccatcgatggatgatgatgatattcgccggggaaaaccgacgaaccataaagtgttcggagaagctcatgccattcttgcaggggatgcattattaacgtacagctttgagattgtggccaaaatgaaaggtgttgacccggccaaaacactctgcttgatcgaagagcttgcaagggctgctggaccagaaggaatggtaggcggacaagtagctgatatcgaaggagaaaatcaaaaactaacggtcgagggacttgaatatatccaccatcataaaacaggggcgcttctctcgttcgccattgttgcaggggcaaggcttgcggatgcatctgaacaagatattgagaacatacgtagattttcaagagaattaggcttactctttcaaataaaagatgatattttagatgttgaaggggatcaagctgccattggtaaaccagttggaagcgatgatggaaatcaaaaaagcacctatccaagcctattaaccctcgaaggggcaaaagagaagcttcacttgcatactttgctggcaaaggaatatttatatagtgttcaaatgaaccatcgcttattagaggaattaacggattatgtcgtgaatcgtaaccattag

SEQ ID NO: 41046 - DNA, 840 bp, Bacillus halodurans
atgagtgcagtgttattagatggaaaagcattagcagcaaaaaagcgtgacgaattaaaatcagaggtaaccaagttaaaagaacgtggaatcaccccaggcttagctgtgattcttgttggtaatgatcctgcatccacagtatatgttcgctcaaaacaaaaagcgtgtgagcaaattggaatttattctgtattaaaagagcttccagcatccacttcggaagaggagctgttaacagaaattgaccgtttgaacaacgatcctacgatccatggtatcctcgtgcaactgccattgccagaacaaatttcggaacaggcggttattgaacggatttctcctgccaaagacgtggacgggttccatccgatcagtgtagggcgaatgatgatcggtgaagacacgttccttccttgtacgccttttggtgtgcttgtcatgctgcaagaagcaaatgtggagattgccggaaagcacgttgttgtcgttggacggagcaatatcgttggtaaaccagtcggacaattaatgttaaatgaacatgctaccgttacatattgtcattcgcgtacaaaaaatttaactgagatcacaaaacaggctgacattctaattgttgcggttgggagagctcgttttattgacgcaagtcacgtcaaagaaggcgctgttgtgatcgatgtcggcattaaccgtgtcgatggaaagctttgcggagatgtggactttgaaagtgttcgagaggtagcgtcccatcttacccctgttcctggaggcgtcggaccaatgacgatcacgatgctattagccaatacgattcaagcagcgaaagaatag

SEQ ID NO: 41047 - DNA, 1359 bp, Bacillus halodurans
atgataaagaaactgctagttgccaatcgcggggaaattgccgttcgaattattcgcgcttgtcgcgagttaggaattgaaaccgtggctgttttttcagaagctgatcgcgatgcccttcacgtacgaatggcggatgaagcttattgcattggaccgacgccatctgcaaaaagctatttaaacttcacgaatatcatgagtgtggcgactttaactgaagtggatgcgattcaccctggatatggatttttagcagagaacgccgattttgctgaaatatgtggggaatgcaacattacttttgtaggtcctagtgcggatgcgattagcaaaatgggaacgaaagacgtggcaagagaaacaatgaaacgtgccggcgttccaatcgtcccaggctcagaaggaatcatcgagagtgtggaagacggcttagcagtagcggaacaaatcggttatccagtcatcattaaagctacagcaggcggtgggggtaagggaattcgcgtcgctcgtaatgaagaggaattgcgaaaaggtattaacattacccaacaagaagccgcaacagcgttcgggaatcctggtgtctaccttgaaaaatacattgaagatttccgtcatgttgaaattcaagtgcttgccgacaaccacggtcacgtaattcatctaggggaacgggactgctcgattcagcgaagattgcaaaagctattagaggaaacaccgtctcctgcaattacagagaagaagcgtaaggagatgggggaagccgctgttgctgcagcgaaagccgtcaactattcgggggcaggaaccgttgagtttatttatgaccataataatggtgatttctactttatggaaatgaacacgagaatccaagttgagcatccagtgacagaaatggtgacgggaattgacttgattaaagagcaaatcaaagtagcttcagggaagccgttgtcctacaaacaagaagacgttacatttaatggttggtcgatagagtgtcggattaacgcagaaagcccagagaaaaattttatgccatctccaggtaaattaaaaagctacttagcacctggtggactaggagttcgggtcgattctgctgcatacccaggctatactattcctcctttttacgattccatgattgctaaggtgatcacccacggagcgacaagggacgaggcgattgcaaaaatgaagcgagcacttgcagagtttgaggtagagggaattgagacgaccattccgtttcacttgcgcttgctaaaccatgaaacgtttgtatctggagatttcaacacgaaatttttagagatttataacatcatggaggagagcaaatag

SEQ ID NO: 41048 - DNA, 510 bp, Bacillus halodurans
atgttaaaagtacaagaaattcgcgagttgatccgtgcggttgatcaatccgatttagacgagtttaagcttgagcaagaaggattaaagctcgtattgaaaaaatctcagggagagactgttgcttaccaacagcctgttcagagcgctccagttcctgcccctgttgttcaggccgttcaagagccacctaagggacaagccgttcaagcagcccctgcttcagagcctgtgaaggaagaggctgaaacgaaagcaactgacaacttacataaaattacgtctccgatggtagggactttctatgttgcaccatcgccagattctgatccgtatgtaaaggtcggcgataatgttagcgaaaatactgttgtttgtatcgtggaagcaatgaaattaatgaacgaaattgaagcggaagtgaaagggaagatcgtcgaagttttagcggagaacggcgaattagtggaatacggtcaacctctatttgtagtagagccgcaaaagtag

SEQ ID NO: 41049 - DNA, 438 bp, Bacillus halodurans
gtggagacgattatggtcattaatggaccgaacttaaatcgtttagggaagcgagagcctgacatttacggccgtgaaaccttgtcagatttgcatgaacgccttatcaagtttgcagaagcacgagggtataaggctgactgtcggcaatccaatcatgaaggtgacatcattgattggattcatgaggctgaagggcggtcaagtggagttattcttaatccaggtgcgtttacccactatagctatgctattcgtgatgcaattgcgagcatatcagttcctgtcatagaagttcacttatccaatgtccatgcgcgggagtcgtttcgtcatacatctgtcacagctccagtgacaaaaggacaaattgttggcttaggggttatcggctatgaattggcaatgcttgctctattggagggggaaaaaaaatga

SEQ ID NO: 41050 - DNA, 2343 bp, Bacillus halodurans
atgcgtattgctttacataacggacagcacgtcgatctcgcacattgtgaccgacaagattggcaaaagctatatatggctagtgttggacaagaaataaaatgtatgcactgcggaaaacccgttaggttacgtttaaccattcagcatgagcctacctttgttcaccgtcacccgtccgagctctgtctgcaaaaagaagtggactacatagaacaaaagcaacaggtcaagagcaatcacacatcttcgccaactggaacattcgttgggagctttcgcttaccgaagcaacaaaaaatttcaaacggttcaactgaaatgataaaaaagtggaaggaacctgaacgaatgacatccttccctccctttatcccgaatgaggtgaacacaaaccaatctcgctccccttttgacgaacgcttgaaggaacaaggaattttcttaaatgacgaccaatggcaggccattacaacaacagaaggtcctttgcttattatagctggtgcaggaagtggaaaaacacgcgttctcacgacaagggccgcctatatgatttctgaacaacaaatcgatccgttgagtatgctgctagtcactttcacacaaaaagctgctcgcgaaatgcaagaacggatgtcaacctattttactctccctaccaatcgcttaaagcgattagctatcggtacattccatagtattttttatcgaatcgctgcccatgcaactcctgagaagtggcgaatggataaattattaaaatgggattggcaacgaatgcaacttttaagagagcatggtcagaaaaaggggttggatgagaaagaatttgcttacgaccaagcgttaacacagattagttggtggaaaaaccatatgctccatccaggtgacatccaaccaaagtcaacttgggaagaaaactgcttatacctctatgaaggatacgagcgttcacgtattagccagcaatggtttgattttgatgatatgctcatcggcgcatatgaaacccttacacaaaaccacgagctattagcgcggtaccaggagcgatttcgttatctgtttgtcgatgagtatcaagacatcaataaagttcagtatgagctcatccgactgttaacacaaaaagagaagaatatttgcgtcgttggagatgatgatcagtccatttactcgtttagagggagtgacccttcttatattcaagcgtttgaacgagactatgagcacgcaaaacaaatcgtccttaaagacaattaccgctcctcccatccaattgtcatgtgtgcgcaaaatgtgatccatcataacaaacagcggattgcgaagtcggtgcgtgcgcaatacgattcagaaaaggcgcctttgcttttttacccttatgatgaagaggaagaagcgacgatgattttaagcgatattcaggagaagattgcctctggcacctcaccttcagcatttgccattttatatcgtacaaatgttagtgtacgtgcgatgtttgaacggttggtcgcttcgaatgtcccattccgaatggagcaggaaggagaatcattctaccaacgctccaccgtccggaaagtgctagcctatctacgtttaagtgtgaatcaagatgatccgaaggcgatggaggaattgttaccggctctttttctaaaaaaagacacgcttcaagaactaaaggcgatcacgatctttcacgattgctctttactcgacgccctccttcatcttaaaaatgtacagccgtttcaacagaaaaagctaaagaagctccttccttattttcagaagcttccacacctttcacctactcaagcgattagcatgatcgaaaaacacatggggctgacagactttattaaaaagcgaggcaatgaagggaatgtcatggatcgggggtctgatgatttgaaggatttaatcgttgcggctaactcctttgcaaccattcctacctttttggatcatgtgagtcacatgattgcaaagcatcacgaactaaaaaaagcacctgcccaagaggaagcggttcagctcatgaccattcatcgtgcaaaaggattagagtttcagcatgtttatttattaagcgcagtggaaggaagcctccctcatgattatgctctcgatgcctggagagaaggagacgatcgcccattagaagaagaaagacgattgatgtatgtcgcgatgacgcgagctcaagaacaactgttcatttccgttccatcgatgcgccgcggtaaaaacgcccagcgctcccgatttgtacgagagatgttacgcaatcacagacaacaccaaagaaaaggagtggaacaatga

SEQ ID NO: 41051 - DNA, 783 bp, Bacillus halodurans
ttgattcaattgtcattagttgatcgtacatatgttgtcatgggcgtcgccaataagcgtagcattgcttggggaattgctcagtccctagccaatgcaggagcaaggctgatttttacgtatgcgggagaacgacttgagaaaaatgttagaggattagttgaaacgttagagcgtgatgatcacctcgtattagagtgtgatgtgacaagtgatgaagccgttgaagcaacatttgcgagcatcaaggagcaagttggcacaattcatggattggctcactgcatcgcttttgctaataaagaggagttagaaggggagtatttaaatacgactcgcgatggctttttattagctcacaatattagtgcatactctttgacggctgtggcgaaagcggcccgtccgctcatgaacgaaggaggaagcatcgtaacacttacttatttaggcggtgaaaaagttgtccgtaattacaatgttatgggcgtagcgaaggcgtctcttgacgcaagcgtaaagtatttagcaaacgatcttggcaaggaaaacattcgcgtaaacgctatttccgctggaccgatccgcacccttgcggccaaaggaatcggcggcttcaatgacgtcttaagagaaatcgaagagcgtgcaccactccgccgaacaactacgcaagaagaagtaggggatactgcattgttcctcatgagtgacctttcaagaggaatcacaggggaaattttacacgtagacagcggatataacattttatctctttcataa

SEQ ID NO: 41052 - DNA, 1845 bp, Bacillus halodurans
gtgttaaccccgctcattcgtacaggtgaaaaggggagcggggcattcaagccgatatcatgggagcgggcactttccataattgtggatcgatttgaggcaattatagcttccgcaaatccaacggccatattgccttacagctatagtggaacgattgggatcattcaaaatggtagcatggaccgacgcttttttcaccgtttaggtgctgcgacacttgaacggacgatctgtgctgctgccggaaccgaagcttttcgctatacgatgggagcctctgtcggcttacaaccagaggagacgaggttcgccaatctggtcatcgtatggggaagcaatctagtcgtaacgaacgtccatcaatggttgtacatacttgaggctcgtaagcgtggagcgaaggttattgttattgatgtagagcgaacagaaacagcaaggcaagccgattggtttattcaaatcaaaccagggacggatttagaattggctttaggcattcagcatgtcttaatcgaagaggagctcattaacggttcttttattgaaaggcaaactgtcgggtttcgggagcttgcagcgcatgttgccacctattcattagatcgagtagaacgaatgacaggaatcaataaagaagacattcaaaggctagcccgcatgtacgggacagaaaagcgatcctttattaggattggcaatggccagcaacatcaccattcaggtggaatgagtacgagggcgattcttagtttacctgctcttacaggagcttgggaagcgaagggaggcggggcgatttattttaacttgaaacatggtgagtattcttccgatattctccaccgtccagatttacggacgaatgaggaacgacgtgttaacatgaatgagctaggaaaggtccttcttagtcaacaagagccgattttggcattgtttgtttacaatagcaatccagcgtcggttgctccagatcaaaggaaggtgcttcaagggttagcccgagacaatttgtttgttgtcgtccatgaacagcagctgaccgatacggctaaatttgcggatatcgttttaccggccacgacttttttagagcatgacgatgtttatcgttcgtattggcatccttactggcagttagggagacgagtgatttccccgatcggtcaaagcaaatcgaataccgagttgtttcgaatgctagcaaacgcctttcattttcaagagctatgctttcgcgacaatgacgaaacgttaatgaagcaggcgatatttggagacagttctgttgattccggtgtctgggagcagtttttatcaggaaagccaattcgttggaagccgacacatctatcagcgcaacaaattgagccgtggaaaatcggtgaatatgaaacaccgtcaggaaaaattgaactttattcagaggcgatgcacgaggcaggattaccacctttaccagaaaaaatcccatataaacaagcagccgctccgtatcagctaatcatttcaccgtcaagaaaagggttgaattctcaatttatagaatacgcgaaaggaaagccggtcgttcagctttcaaaagaagatgcaatgcgagaaggaatctatgatggtgatcgtgtttgtcttttcaacgatcatggacagctaacgtgcacagccaacgtttcagaggcatgtcagcaaggcgttatcatcgctcgcggggtatggtggcatcatcaacatgaacaacaaggaaattttaataccttaacaggaggagacttatctgattttggcggcggggcaacatttttttctacctatgtgcaagtcaagaagagtgaggcgtag

SEQ ID NO: 41053 - DNA, 1236 bp, Bacillus halodurans
atgaatagacgtgtagttgttacggggatcggtgcagtgacaccacttggaaatacggcagaggaaacgtgggaaaaagccattgccggccaatctggggttggtctgttaacgcgtgtcgaagctgctgatttcccgatgaaagtagctgctgaagtaaaagaatttgatccgacaacgcatattgaccgaaaagaagcacggaaaatggaccgttttacgcaatttgcggtcgcttctgcattaatggcgttgaaggatgctgaccttgagatcacagaagacattgcaccacgagtcggggtctggattggctctggcatcggtgggatggaaacatacgaaaatcaatttagaatgtttatcgaaaaaggataccgtcgggtcagtccgtttttcgttccaatgatgattcctgatatggcttctggacaagtgtcaattataacaggtgccagaggaatcaactcttgctctgtaaccgcttgtgcatcaggagctaactcgataggtgatgcgtttaaagtcatccaacggggagatgctgatgtgatgattactgggggcgcagaggctccgatcacgaatatggctgttgctggttttagtatggcgaaggcgatttcaacaagcgaagatccaaacacggcgtcacgtccatttgatgcgaatcgagatggctttgttatgggagaaggctctggaattctcattcttgagtctctggaatctgctgaaaagcgtggggcgaagatttatgctgagattgtcggatatggcgcaacaggcgatgcttatcacgtgacacagcccgctccagaaggagaaggagcggcccgtgcgatgaagcaagccatcgaggatgcaggattgacgccagaagacattcaatacatgaacgctcatggaacgagcacgtattacaatgataaatacgaaacactagcagctaaacaagtgttcggtgaccatgtgaacaatttggctattagttcgacgaagtcaatgactggtcatttgctcggtgcagcaggcgctgtagaagcaatcttttcggtgaaggcgattgaagaggggattattcctccaacgattaactatgaaacgccagacccagattgtgatttggactatgttccaaatgaagctagaaagcagggcgtgaatgctgtattaagtaactcattaggctttggtggacataacgccaccctcgtctttaaaaaatatcaatag

SEQ ID NO: 41054 - DNA, 939 bp, Bacillus halodurans
gtgaccagagcaggaattcttggaattggaagttatgtgggagagcatgtcgtaacaaacaaagattttgagaaacggatcgatacgtcagatgaatggatccgcacacgtactggtattgaggagcggcgttttgcccctgacaatgtagacacatcagacatggcctatgaggcatccgtcaaagcattaaaagctgcaggagtctcagcggaagagattgaccttattttagtcgcaactgttacaccagatatgccattcccgactgtttcaacattggttcagcaacgtttaggagccaaaaaagcggcagcgatggacattagtgcagcatgcgctgggtttatttacggattagcaactggacaacaattcattgaaaatggtggatataagcacgtcctcgtcattggggtcgagaagctatcaaaaattacagatatgacagaccggaatacagccgttctttttggtgatggggctggagccgccgtcatgggggcagtctctgaagacagaggaatccttgcatatgagttaggagcggacggggaaggcgctatgcatattaatcaaaaaggggagtacatccaaatgaatgggcgggaagtgtttaagttcgccgtcagacaaatgggtgaatcagcgctaagcgtccttgaaaaagcgggcctatcaaaagaagacgtggactttcttatcccgcaccaagcgaacattcgaataatggaagcttccagagaacgtttggagttgccagttgagaaaatgtctacgaccgttaagaagtatgggaacacttcatcagcctctataccgatggctatggtggatgagttaaaagatggtaaaataaaagatggagacttgctcgtactcgttggatttggagctggacttgtgtggggttcattagctcttagatggggaagataa

SEQ ID NO: 41055 - DNA, 960 bp, Bacillus halodurans
atgaaccatttgtcagaaaaagtcatctctttaaaaggtcgtgacttattaacactgttagattatacaccagaggaagttcagcaacttcttacccaagcgctcgagctgaagcaaaaagcaaagaatggagagccgaccccttatcttacaggaaaatcactcgggatgatctttgaaaatgcgtcgacgagaacccgggtgtcatttgaagtcggaatgacgcaacttggagggcatgcactgtttttaagcccaaaagatttgcaaattggtagaggcgaaccaattaaagataccgccaatgtcctttcccgctacgtggatgcaattatgattcgaacgaattctcatgagtctgtggaagagcttgcacactatgcgaccgtaccagtgattaatgcattaacggatgcttatcatccttgtcaggcgcttgcagatgccttgacgattctcgagaaaaaagagacccttatcggtaaaaagctcgcttatattggcgatgggaacaatgtttgccattcattgcttgccataggggcaaaaacgggcatggatgtgacggttgctactcccaaaggatacgaagtcgatcaggagatttttcaacgagcgacagaagcagcgaaagagacaggagcaacgctcgttcagacgacaaacccgcaagtagccgcggaaaatgctgatgcgatctatacagatgtttgggccagtatgggatatgaagcagagcagtctgagcgtgaagaggtattccagccgtatcaagtgaatgaccagcttttaacattagccaaaaaggacgttagtttcttacattgcttaccagctcaccgcggagaagaagtaacagcttctgtcattgacggtcctcattcggctatttatgatcaagccgaaaaccgtctccatgcacaaaaggctgtcctaacagctcttttaataggtgaatga

SEQ ID NO: 41056 - DNA, 3144 bp, Bacillus halodurans
atgcctaaacggacggatattcaatcagtactcgtaatcggctcaggtccgattgtcatcgggcaagcggctgaatttgattacgctggcgcacaagcatgcctcgccttaagagaagaagggatccaagtcattctcgtcaacaacaacccagcaacggttatgacggatgaagcgtgcgctgatgtcgtttatttcgagccattaacggttgccagtgtgaagaacattattgaacgggaacgacctgatggcttactggcaacattaggtgggcaaacaggccttaacctggcgatgaaactagaggaagctggtatcttagaggcctacaatgtggagctattagggacacccatggagtcaattaaaaaaggggaagaccgagaagcgtttcgtcaattaatgcatgagctccatgagcctgtaccagaaagcgaaatcgttcattcagtggcagaagccgttgattttgcaaacacggttggttatccgattatcgttcggccagcctatacccttggcggtgctggtggtggaatcgctgaatcagaggaagcgctcatccgcattgtaaaaggcggcttagaactaagtccgattcaacaatgtttgatcgagaaaagcattgctggttttaaagaaattgaatatgaagtgatgcgtgacagcaatgatacgtgtattactgtttgtaacatggaaaacattgatccagttggcgttcatacaggggattcaatcgttgtcgcaccgtcacaaacgttaaccgatcaagagtatcaaatgcttcgctcagcatcgttaaagatcattcgtacccttggaatagtaggcggctgtaacattcaattcgccttagaccctgatagcaaacaatactatcttattgaagtcaatcctcgcgtgagtcgttcatcggcgctcgcttcaaaggcgacagggtatccaattgcacgaatggcagcgaagcttagcttaggttacgggttacacgaactaaaaaaccctgttactgaagatacgtatgcgagctttgagccttctcttgattatgttgttgtaaagtttccacgttggccgtttgacaaacttgtccatgtcaatcgcgaactaggaacgcaaatgaaagcaactggtgaagtgatggcgatcgagcggaatcttgaggctggcttacaaaaagcggtacgctcgctcgaaatcaaaacacacggactctctcttccttctcttagccaatgggaggacagcgagttatgggtgattgtgaaaaaagcggatgaccgccggttttttgcaatccttgaactgcttcgccgtggcgtaacaattgaagcgattcacgagcaaacgaagatcgatcgttttttcctcacctcctttgccaagttaatgacattggaaaaggaaattgcaggacaatcactagatgacataacatcagatgaactttccacttataaaaaatacggattttccgatgaatggctcgcatctagttggggagttggattggctgatgttcggcacactcgaaaagcgttaggggttgttccaagctacaaaatggttgatacgtgtgcggcggaatttgaagcaaaaacgccatactactactccagttggactggggaaaacgatttactgctaccggaaaaagcaaaagaacgagtgttaattattggctctggtccgattcgtattggacaagggatcgaatttgattactgttctgtacatggggccaaaagccttagagcacgtaactttgaagcgatcattattaacaataatccggaaacggtcagcactgattatgaaacagccgatcgtctttactttgagccattagctgtagaagatgtattgaacgtcatcgaggtggaaaatgtagatcacgtcattgtccagcttggtggacagacagcgatcggtcttacgaaagggcttgaagaagcaggtgtctcgattttagggacgacgcaagatgtcatcgaccagctagaggatcgtgagcgtttttatgaatttatgcgctccgtcgaggtgcctcacattccagggaagacggcagagacgaaggaagaactactgaaagctgcacaatcgatcggttatccaattttactccgcccatcgtatgtgatcggtggtcaagggatgttcatcgcttccaatcaggaggaactggcggccttttgtgaagacaagaaccattcggtcacgttcccgatacttgtggacgcctattatccgggtgtggaatttgaagtcgatgtattaacagatggatctgatattttcataccggggatgtttgaacatgtggaaaaagcaggtgttcattctggtgatagtatggcggtgactccaccacctacacttgaagctaagtggaagcaacaggcgatcaactatacaaggcaaattgctaaagggatggcgtacaaaggattattcaacattcaattcgtcctttatgatgaagagctatacgttattgaagtgaacccccgggcttcccggaccgtgccgattttcagtaaggccacttcattaccactcatcacgtatacaattgatgttttgttcggtaaaaccattgccgagttaggcctatcagctggttaccgaaaggaatccccgtattatacggtaaaagcacctgtgttttcatatcaaaagctcgcggggctcgatccattactagaagcggaaatgaaatccactggtgagctgattgctattagtaaggatctcccatcggctttccgaaaagcgtttgcgtggggagaggaacagactccagcgcttttccggaaaaaaggctctgttttctgtcaagtggatcgagcgtacgataccgaatggcaaccgcttcttcgacaattaaaagaaaaagggtattcagttgtaacggaggaagcgatgtccttttctgagtggctcgcttcagaggatgccatttgtttagtgagtgtcccggctcctgggcaaaaaaccggaaaacaaaatagagaagaggcattgaagcaacgagtgacggtcgtgtctgacctagccactttcgaaaaaatgattgaatgtctagaagtaaaggatggcgagccgtttttacttccagatgttgtgatgaattag

SEQ ID NO: 41057 - DNA, 1080 bp, Bacillus halodurans
gtgaaggcatatttagtattagcgacaggggaaacatttgctggagagatcgcgaatgcaaaagaggatgtatatggagaggttgttttctttacgggaatgactggctaccaagaggtgttaagtgatccatcgtttaaagggcagctagttgtcttcacataccctcttatcgggaattacgggatcaatgcttcagattttgaaagcaaggagccacaagccgctgggcttatcgttagtgaacaatcggaagaaggacaccattatgaagcgactcaatcgttgcagcaattttgtgatcagcaccagcttccgctactaacaggcattgatacgagagctgtcgtgaaacgaattcgtgagcaaggtgatatgcctgcggtcatcacgaccgacctttcccgtgtgtcatttgaagagtgggtgcccctgtctgagcgggcgttagtggatgaagtgtcaacgaaaaaagtagagacgtttgaagggaacggtcctcacattgttttaattgattacgggtttaaacaatcgatcttaaattctttactaaaacgtgattgtcaggtgacgattgttccctacgatgtttcgtttgaagtggtgcaagaattaaatccagatggtctcttattttcgaacggtccaggagatccaaagcaaatcgaggatcggcttccgactatctatcgccttgcatcgacctatccgagtctcgggatttgccttggacaccagttgctcgccttagcctttggtgcagacacggagaagctccgtttcggtcatcggggagcgaaccaacccgtgatcaacctgaagtcgaatcgtgtgtatatgacgtcacaaaaccatagttacgtcgtgaaggaagactcactccaacgaacggattgggacgctacgtttaaaaatattaatgacggttccattgaggggttaacccacaaatatttaccgattcagacggttcaattccacccagaggctcatccagggccaagtgacagtgacgaaatttttcactcattcatcgatgatgtagcagcaaaggggagagagaaaacctatgcctaa

SEQ ID NO: 41058 - DNA, 1155 bp, Bacillus halodurans
atgagccatctttttcccacatatgccaaatgggatgtaacgattacttctggaaaaggaacaaagctttatgataaccaaggaaatgaatatttagattttgtctcaggaatcgctgtttgtaacctcggtcattgccatccgaaggtcgtggctgccgtagaagagcagcttcattcgttttggcacgtgtcgaacttattccatattccaattcaagaaaatgtagcagcactgttaacggagcaaagcggaatggatgccgtctttttttgcaacagcggggcagaggccaatgaggcggcaattaagcttgcacgtaaagcaacgggcaagcacgagatcgtcacatttactcaatcgtttcacgggcgtacactcggaacgatgtctgcgacaggacaggacaaaattaagactggattcggtccgatgctagaaacgttccatcacgttccattcaatgacattgcggctttaaaacaggttgtaaacgagcaaacagctgcgattgtccttgaggtaattcaaggagagggtggcgtgaaccttattgatcctgagtttgccgctagtgtgaatcatgtatgtcaggagcatgggattttacttataatagatgaaattcaaacaggaattggccgtacagggacggcattcgccttccagcaatacgagctaacacctgatatcataacggtcgcaaaaggactcggaaacggttttccagtcggcgcgatgcttggaaaacaacatttgatcgacgctttttcagcaggaagtcacggctctacgttcggtggaaacccgctagcaatggcggccgcacaagcggtactgacagaagtgttccagcctaactttttacaggctgtgcaagaaaaagggaagcagttgttgagcggtttgaacgaagccctttccggtctagagattgtgaaagagattcgtggcaacgggcttttagtcggaatcgagcttcaagaagaaggggcccctttcatcaaacaactgcgggaaaaaggcttgttagtcttaaacgcagggccgaatgtgattcgtctgttgccacctctcgttgtgacttcggaagagttgcacgaggcggtcacacaattgaaggaagtgcttgatcaagcttccgtacacgcttaa

SEQ ID NO: 41059 - DNA, 783 bp, Bacillus halodurans
atgggggacattgtcgtcattaaatgcgggggaagtgtattagattcactgtcagattcattttttacgagtgttcggcgcttgcaggccgaaggagcgaaaccgatcattgtgcatgggggcggaccagccattaatggcatgctcgccaagctcgaggttgaaacaacgtttgttgatggtttgcgaaaaacaacggattccgtgttgtcagtggccgaaatggtattgtgtggtcagacgaataaaaaggtcgtccgtaaactgcaaaaagcaggcgtgaaaagcattggattatctggctctgacggtgaactcgttcgcgtcaaggcgatcgatgaagcaattcttggctacgtgggtgaaccggtgcacgttaatggtgaacttttgcatatgcttgtagctgacggatttgtcccagtgctcgctccaatcggcgtcaatgatgaatttgaaccgtacaatgtgaatgcagacacggtcgcaggggcggttgctactgcgttacaagcaaaagaactaatcttcgtaaccgatgttgcaggaattttaaaggatgatgagttagtccctgctttaacgcctgaggaagtagagtcattgattgaagagggcacgatctatggcgggatgattccaaaggttcgttccgcaattcatagtttgacagggacccttgaggctgtttcgatcgttaatggcaacgacgtgttttttgcagagtctgggaagttgatcggaacgacgataaaaaagcaagtcattcattcgcaaggatag

SEQ ID NO: 41060 - DNA, 1236 bp, Bacillus halodurans
atgaacgtcatcaatgaaacagcaaatgttttaaaacttgaaacggggagcgttacatcggcgaaaggcttctccgccgtaggcattcatacgggtgtcaagcgaaagcgaaaagatttaggcgcgattgtttgtgaagttcctgcgagcagcgcggctgtttatacattaaacaaagtgcaggcggcaccgttaaaggtgacacaagaaagcattgccgtggaagggaagctgcaggcgatgatcgtcaacagtggaattgctaacgcttgtacgggaaaacggggattggatgatgcctatacgatgagagcggtaggggcagaaacatttcacattccagagcattatgttgcggtgacctctacgggagtgatcggcgaatttttaccgatggacgtcatcacgaatgggattcgtcaattgaagccagaagcgactatcgagggcgctcacgcgtttaatgaagcgattttaacgaccgatacggtagaaaagcatacgtgctatcaaacgatagtaaatggtaagaccgttactgttggaggagttgcaaaaggatcagggatgattcatccgaatatggcgacgatgttatcgttcgtgacaacggatgcaaatattgatcatggtcatcttcaaggggcgttatcggcgattacgaatgagacctttaatcgaattaccgtggatggagatacatcaacaaatgacatggttgtcgtcatggcgagcggtcttgccgaaaacgaagctctcacaccggagcatcccgattgggctaatttttacaaggcactccagcttgcttgtgaagatctcgcgaagcaaattgcccgtgatggcgaaggggcgacaaaattgatcgaagtcgaagtcacaggcgctgctaatgatcaagaagcaggaatggtggcgaagcaaatcgtcggttctgatcttgtcaaaacagcgatttacggggctgatgccaactggggaaggatcatttgtgcgattgggtacagcggttgtgaagttaatcaagagacaattgatatagcgatcggaccgattgtgacattaaagcaaagtgagcctacaggcttttcagaagaggaagcaacagcttacttgaaagaagcagaccctgtaaaaatctcggtgaaccttcatattggcaatgggacaggaaaagcgtggggctgtgatttaacctatgattacgtacgaattaatgccggttatcgaacgtaa

SEQ ID NO: 41061 - DNA, 1038 bp, Bacillus halodurans
gtgaaggttggtattgtcggtgcaacaggctacggaggactagaactcattcgtctgttatcgcagcatccgaacgttgaggaaatcatctgctattcatcatcacaagaagggttaccgttagatgacatgtatccgcacctttctggaaacgtgcgctggacgttaaaggcaatcgatccagaagcgatacgcgcggacgtggataccgtgtttttagcgacaccacctggagtatcgggagagttgacacctgatcttgtgaaattaggcctgaaggtgatcgatttatctggtgatttgcgaataaatgaaccagatgtctatgaagcttggtataagcgacaagcggctccagtgggaacgatccgaggcgctgtatacggattaaccgaatggcaacgtgacgaaatagcagcggcccaaatcattgccaatccaggttgctatccaacggctgtcctgctcgggttagcgccattagtacaacagaaatggattgacccgaaacgaatcattattgatgcgaaatcaggaacatcaggggctggacgaaacccttcgcagattacccattttagtgagatgaacgaaaactttaaaatctatcaagtgaaccagcacaaacatacaccggagattgagcaacaattgcgcaactgggatgagtcggtcggcaatgttaccttctctacacatctcgtcccaatggttcgaggaattatggcgaccatttatgctgaggctaatcaagcaatctctgaaaaggaattgcgcgaacattttgcgtacgtgtatgagacgtcaccgttcgttcatgtgtactcagaggggcgttacccagcaacgaaagaagtgtttgggagcaatcgttgtcacatcggcgtgacttatgatgagcggacgaatcgaatcacggtcgtttcggtgattgataatttggtgaaaggtgctgcagggcaagcgatacaaaactacaacgtaatgaacggatatgaggaaacattgggcttggaaggctctcccctatacccgtga

SEQ ID NO: 41062 - DNA, 1686 bp, Bacillus halodurans
atgagtacgcaatggtggaaagaaagtgtcgtttatcaaatttacccgcgaagctttcaagattacaatggggatggaattggcgatattcctggtatcatttcacgacttgattatttaaaaacgctcggagtggatgtcatttggctctcaccagtttacgattctccaaatgatgacaatggctatgacattcgtgattataaggcgatcatggatgagttcggtacaatggccgattgggaaacacttttagctgagattcacacccgaggaatgaagctgatcatggatcttgtcgttaaccatagttcagatgagcacgcatggtttgtagaatcacgaaagtcaaaagacaatccgtatcgggatttttacatttggcgaccagggaaagatggtaaggaaccgaacaattgggcttctaattttagcgggtctgcatggacgtacgatgagacaactggtgaatattatttgcatttgttttcaaaaaagcaacctgatttaaattgggagaatccgaagttacgggaaaagatttatgagatgatgacgtggtggcttgacaaaggaatcgatggctttcgcatggatgtgatcaactttatatcaaaagtggacgggctacctgatgcagaacctcaaccggggcaaccgtacgtatctggttcgaactattttatgaatggacctaacatccatacgtatttacaggaaatgcatgaaaacgtcctgcagcattatgatctcatgacggttggtgaaatgccaggcgtaacactagagcttgcccagctttatacgggagaagagcgtaacgagctgaatatggtattccaatttgaacacgttggtctcgatcaagggccaaacgggaaatgggatcttaagcctctcgagcttaaagacttgaaagcaagtctttcccgctggcaaaaaggattgcaagacatcgggtggaattcactctattggaacaaccacgatcaaccgcgaatcgtttcacggttcggtgatgatcaatcctaccgtgtagaatcagcaaaaatgcttgccactcttctccattgtatgaagggaaccccttttatttatcaaggggaagaaatcgggatgacgaatgttcgcttcgattcgattgagcaatatcaagatattgaaacactgaacatgtacaaagaaaaacgagcacaaggggttcctcatgaaacacttatggcgtctattcatgcaaaagggcgagataatgcacgaacgccgatgcagtgggatgagacaaaacatggaggttttacagacggaacgccgtggcttgaagtcaatccaaattataaggaaattaacgtaaagcaagcattgaaagacccgaactcgattttttatcactatcaaaaactgattcaattaagaaaagagcatgcgatcctcgttcatggctcgtacgatctcattcttgaggacgatccagagatttttgcctacaaacggacgtacaatgggcaaacacttctcgtcgtatgtaacttttacgggcgaataaccgactttgaatgcccagccgaggtagtgttaagcgaaccgaccttgctgcttagcaactatgatgaagaagaaaacggatcatatacatccttccgattacgtccatatgaagcaagagtctatttgggaaagaatgaatag

SEQ ID NO: 41063 - DNA, 1737 bp, Bacillus halodurans
ttgaaagctacaatctaccatcgaccaaaaagtgaagacgcttatgcttatgataaaagcacgatgcacattcgtcttcgcacaggtaagaatcacgtgcgaaaagtgaacctgatttatggtgatccttatgactggacgaaaaaccaatgggtaacttctaaaaaagagatgactccaacaggatctgatgcacagcatgatttctggttcgtagaggtgactcctccttatcgacggttgcgttatggtttcgaaattataacaaaaactgaaacgatctactatggagaaagtgggtttctcgatacaccatcaaaagatacgagcgactatttctgctttccatttatgaatccagctgatttgttttcaccacctgagtgggtaaaagacaccgtatggtatcaaatttttcccgaacgctttgcaaatggggatccgagccgtaatcctgaaggtaccttaccgtggggaagcgctgccccaactccaaccaaccatttcggtggagaccttcaagggatcatcgaccatctcgattacttgcaagagttagggattaatggaatctatttaacaccgatctttgaagcgtcttctaatcataaatacgacacgattgattatttaaaagtggaccctcactttggtgataaaacaacatttaaacgtcttgtagatgagtgccacaaacggggaattcgcatcatgcttgatgccgttttcaatcatgcaggcttctactttccaccgtttcaagatgtgctcaaaaaccagcaacactcaaaatatagtgattggtttcatttgcgtgactttcctgttcgtgctgaagagccgcccaactacgatacgtttgccttcacgccatttatgccaaagttcaatacggaaaacgaggaagtgagggaatacttactgaatgtggcaacgtattggatcaaagagtttgacattgacggctggcggttagacgtagctaatgaagtcgatcatgccttctggcgagaatttcgtaaaagagttaaagcattaaagcctgacttatacatccttggtgaagtatggcacaactcccttccttggcttgccggcgatcaatttgatgcggtcatgaattatccactgactaatgcgatcatcgattttgccggaaaacaaaagataggtcaacagcgattcgagcatgtcataacccaattgacgcacatgtacccaattcacgtccaacaagtagcctttaatttgctcggtagtcatgataccccgcgaatattgacgcaaacggacaatgatgtggcacgtgttaaacttcagtttctcttgctcttttcgcagcgcggaacaccgtgtatttattacggtgatgagattggcatgacgggtgggcaagatcctggatgtcgtaaatgcatggtttgggaagaagaagaacaaaatcaagagttactctcctttgtcaaaaggctcattcaacttcgcaagcaagagaaagctttcggaaccgaaggggatttgacgtttgtggagaatgattcttctcttctcatctatcaaaagacatacgaaaatcaacagctcttgtttgtcatcaattcaacagatcaaccagacagtgttcagttacctgttagctggacaaatcgtaacgcaaatgacttgctaacaggtgaaactttctcgctcgcaacagaaattgtcatcccggctaaatccgcgatggttcttaaatag

SEQ ID NO: 41064 - DNA, 1386 bp, Bacillus halodurans
atggcgatggtagaagacacccgacctgagcacacgtatgcggagcaaaccccccgatcgaaatcgtggattgaacaggcgaaaaaggtaatgcccggtggaattacagcaaacattaaacattttgctccataccccattgttatgaaaaaaggttgcggggcgttcattacagatgtggataaccaccaatatgtagactatttactcgcctatggggcgttgatgctaggtcacggtcacccagaggtaaagcaggcgatcgatgagatgtttgcagactccggaactcttttgtttggggcacctcatccgttggaagtaacgtttggacatgaaattcagcagctctatccgagcatggaacggctccgttacacaaattctggaacggaagcgacgcttttagccatgcggattgcacaggcgtatacgaacaaaaagaggatcgctaaatttgaaggtcattaccatggcggatacaatgatgtactttatagtgtcagtccgacactttcggaagcggggccagcagacgcgcctataccggttaaagaatcaaaggggatgcatgtgacggatggagaagagccgctcattttaccattcaacaatttaaccgcatgtgaacgattgctacgggcacagcaagattcgattgcggccgtcatgatcgagccgttgcaagggggatttatacccgcgaccgatacgtttattgccggtttacgggaattgaccgaagagttagggatcgtgctaatttttgatgaagtcaaaacaggttttcgcattagactcgggggtgcgcaagagtggtatggggtgtcaccagacctgacgacactcggaaaagtcattggcgctggattcccatttggaattgtcggcggacggaaggacattatggaggtcacatctccaacgacgggttctgatgtgtttgatcaatcacaaagcaccttttcaagggcaaaagatgttgtctttcatagcggtacgtacaatggacatccgctgattttagcagcagggttaaaaaccgtggacgttcttaaacgggatatcaaagatgtttttgcacgaacggatatgctgaaggatgagttggaagcgttgtttgtccgaaaaggagtgccaatgaaagcggttggcatcggttcaatctttagtgtagtattaacagaggaagacatttttaattaccgtgatctccaagcgtccgatctacaaacgcgtaaactgattgacctgcatttattaaatgaaggtatttatacgaaacctcttaaccgttatagcttatccactgcccatacggagcgtgaggtggagcgaacgatttcggcgtatgatcgagtgttatcccgattatttggaggttga

SEQ ID NO: 41065 - DNA, 777 bp, Bacillus halodurans
atgatagagtttaaaaatgtgtctctcgtctatccaaacggaacacaagggttaaaagatgtaaacttaaaaattaacgaaggagagtttgtcgtcattgttggcctttctggtgccgggaaatccacgctcatacgcagcatgaatcgacttgtcaccccaaccgaaggcgaacttcttattgatggtgaaaacattcttccctattcttcaagacagttacgtaagcttcgcacaaaggtcggcatgatctttcaaaactacaaccttgtcaaacgttcatctgtgatgaaaaatgtcatttctggccgcctcggtcatgttggaacgttcgcaagccttttaaacctttatccgaaggaagatgtggcacttgcgtatcgcagcttgcaacgggttaacattgccgaaaaagtgtatcaacgggccgatcaactgagtggtggtcaacagcagcgtgtcgcaattgcacgtgtgcttacccagcaaccaaaaattattttagcggacgagccagtagcaagtcttgacccgccgacttctcatcaagtgatgacctatttacgcaagatcaacaaggaagataaaattacaacgattgtcaacttgcatttcatcgacatggcgatggaatatgcggaccgaattatcggtatgcgtgcaggtgaggtcgtatttgatggacctgctagtgacgtgagcgaggaaacgttcgaggaaatttacggtagaaaaattcgcgaagatgacctagtaggaggtcaggacaatgagtaa

SEQ ID NO: 41066 - DNA, 903 bp, Bacillus halodurans
atggatcgaaagaaaattgctgttattggagcaccgatggatttaggacaaaatcgtcggggggttgacatggggccaagtgcgttacgctatgctggattaattgagaggctccaatcaattggctatcatgtggatgacatgggggatattccgattgatcgccccggggaagtaagcgaggaaaaaacaaatttaaaaaatttaggcgaggtcatcaaggcgaacgagctgctctgtctccatgtagagaaagccgtggcaaacggctactttcccctcgttctagggggggaccatagcatcgccattggtacgttagccggggtggcaaagcgccgacaccaactaggggtcatctggtatgatgcccacggggacttgaatacggcagaaacctccccatctgggaacattcatggtatgccactggccgtaagcttaggcatcgggcatgaaaaacttacgtcaatcggcggctttgcaccgaaaataaagccagaaaacgttgtcattattggtgcccgttcattggatgaaggggaaaaggcatatattcgcgaacatgggatgaaaatttttacgatgcatgaagtggaccgactcgggatgacgagggtgatggaggaagcgattgcccacgtgtcaaacgggacggatggtgtccatttgagccttgatttagatggacttgatccgaatgatgctcctggtgtcggcacgccggtgctcggtggaatttcctaccgggaaagccatttggcgatggagatgttagccgaagccgagattgtgacctcagcagaatttgtggaagtaaacccgattctcgatgagcgaaataagacggcggaggttgctgttgaactgatgggctcattgttcggagaaaaacttttgtag

SEQ ID NO: 41067 - DNA, 1293 bp, Bacillus halodurans
gtgcaaaatgaaaggcaagccattgaatggattcattcttttttaccgtttggaattaagccaggtttacaacgaattgaatggatgttggagaagcttggacacccagaaaaagagttaaacgttgttcatatcggtggaacgaacggaaagggttcaacggttagctttatgcgttgcatgctcaccgaagcaggctacaacgtaggtacgtttacatctccttatattgaacattttagggaacgtattgcttataaaggcgaaccgatcagtagcgaagagcttgtacgaagctgcttaaatattatcgacgtggtcgaagagctcaaaaggacagatttggggagccccacggagtttgaggttattacggtcatagcctttgacttttttgcccgtgtgaaccctgacatcgttctactagaggtcgggcttggggggagacttgactccacaaatattgtgaccccgcttctatcgattattacgtcaattggacacgatcacatgaacgtattggggggaacccttgaaagcattgcttatgaaaaagcggggattattaagccggatattccagccatcgttcatgttaaacaacctgaagcgtttcgggtgattcaggataaggcgaacaaggtgaaagctccgctctttgcttacggaactgatttccactccttgcccaaaagtgtgacaatggataaacagtttttttcatatcaatcacaatcaggtctcaccctatcattagaaacggtaatgaaaggccaccatcaaatagagaatgcaagtatggcgattcaagccatcgaacaattacgatccatgaaacactacgagctctctaatgaccatattgttagggggattaggaacacgacatggattgggcgttttgaaaaaatatctgaagcaccgcttacgtttgtagatggagctcataatgaagaaggcatgaaagcactagccgaattactagcgcttcactttccaacgtataagtatcgctttgtcatggctgtaacgaaagaaaaagagatgaaagctttactggccccttatgttgaccttcccgcttcttttacttttacgacatttgaatttgaacgagctcagaaagcagagcaattgtatgaacaagcgcctgtttataacaaatccatttgtgcagattggaaagtggccattaggcgagaacgagaaagttgtaaagctaatgaaatggttatcatctgcgggtcactttattttatttcaaaagttagggcgtttctgttagagagataa

SEQ ID NO: 41068 - DNA, 1290 bp, Bacillus halodurans
atgaaaacgttcgaaaaatcaagcgcagcgtttaatcgagcgaagccgctcatgccagggggggtaaacagccccgtccgtgcctttaagtctgtaaacatggacccagtgtttatggaacgaggaaaaggagcgaacatttacgatattgatggaaacgagtatattgattatgttctttcatggggaccgcttattttaggacatgccgatgatcaagtggttgaaaaattaaaagagacgacagaaaaagggacgagttttggcgccccaagtgaattagagacaaagctagctgagcttgtcattgaacgtgtcccttcgattgaagtggtgcggatggttaactcaggaacagaggcgacgatgagtgcactccgtttggctagaggctatacgggcagaaataaaattttaaaatttgaaggctgctaccacgggcatggtgattcattactgattaaagctggatctggtgtggcgactctcggtcttccagatagtccaggagtacctgaaacagttgcccaaaatacgttgacggttccatacaatgacctcgagagcgtccgttatgcgttcgagcaattcggcgatgatctagcgggtgtaatcgttgagccagttgcagggaatatgggagttgtcccacctgaaccagggtttttagaagagttgcgccgtctaacagaagaaaatggtacacttcttatctttgatgaagtgatgacaggattccgtgtcggctaccactgtgcgcaaggggcatttgggattacacctgatttgacgtgtcttggaaaagtcattggaggtggtcttccagttggcgcctatggtggaaaacgagagatcatggagcaaatcgctccgagcggcccgatttatcaagcggggacactatcaggaaatccgttagcgatgacagctggttatgagacacttgtacaattaacggaagcgaattacgaatattttgatcgactaggagatcgattagcagaagggctatcagctgtggcgaaggagtatgatattccacactatacgtcccgggctggctcaatggttggctttttctttaccgataagaaggtgaaaaattttgcagacgcttcaagctcagatctagaatttttcgcaaaatattttaaggagatgttacatctaggagtatcacttccgccatctcagtttgaaggaatgttcctatcaacgaaacatacagaggcagatattgattttacagttgatgcagcacgtcaagcattcaagcgtttaaaaaaatag

SEQ ID NO: 41069 - DNA, 987 bp, Bacillus halodurans
atgggacaagatttaacgtttaagcgccatcgaagacttcggcaaacggccgctattcgcaacatggtaagggaaacgaaactacatattgatgatcttatttatccaattttcgtgaaggaaggcgaaggggtgagacaagaggttccatccatgccgaatgtctatcaattatcgctcgatcagttggatgcagaagtggatgaaatcgtctctttaggaatcccagcgattattctttttggggtcccagctgaaaaagacgctgtcggtagcgctgcctatcatgagcatggaattgtccaacaagcgattcgtcaagtaaaagaatcatatcctgatttaacggtaatcgcagatacgtgcctttgccaattcacggatcatggtcattgtggtgtcattgaagaaggaaaaattctcaatgatccgagtcttgatttattagcgagaacggctgtttcccaagcaaaagctggggctgatatcattgccccttctaacatgatggacgggtttgtagcggccattcgtgctggactggattctgcagggtttacagatgtacccgttatgtcgtatgcggtaaaatatgcatcagcattctatggacctttccgcgacgcagcacatagttcacctgtgtttggtgatcggaaaacataccaaatggatccggcgaatcggttagaagcactgcgagaagcccgttctgatgtagaggaaggtgccgattttttaattgtgaaacctgccctctcttatctcgatattattcgtgaagtaaaaaatgaaacgggtcttccagttgtggcttataacgtttctggggaatattcgatgattaaggcagctagcttgcaaggatggattgatgaaaaaagtacggtacttgaaaagctaataagtatgaagcgagcgggagcagatttaattttaacctattttgctaaagatgtagcccgttggttaaatgaagagaagtga

SEQ ID NO: 41070 - DNA, 762 bp, Bacillus halodurans
atgattgcacccgtattaaaggggaagggtgtgcttattacgagagcaaaggagcaagcctcttccctttctcgtttgattgaggaagcagggggagttccaattgaagtcccactgctttcgtttataaaaacgatggacgtgtatgaagaagtaggggcgtccatccaatcatatgaatggattgtattcacaagtgccaacgccgtccgtttttttttcaacacatggccacggcaggagcttaaaaaattgccttccattgcggctgtagggagctcgacacaacgagagctttcgcgctacggaatcagtgtagacttaatgccgaatgagtacgttgcagagtcattggtggaaacaatggtgaaaagattaaagccgtgccgagtcctgtttccaaaagggaatttagctcgccctaccgtaaaagttggactggagacaaacggctttatcgtcgatgagatgaccgtttatgaaacgaagcggccattggaagccaaagtgatgttatgcgaagcgtttcaaaagcataggattgagattattacgtttacttcgccctcagccgttgatcattttgtgacgcttctcgatcgtgagttcatacttcacgagcatttattgtatgcttatattggtccaattgctgccgctagagcaaaacagcgtggactgccggttcatattgtagccaagacgtatacaggggaaggtcttgtaaacgcgatctgtgattttgtaaaggaggacggataa

SEQ ID NO: 41071 - DNA, 936 bp, Bacillus halodurans
ttgcgaaaaataattatcggttcaagacggagccaattggcgcttacccaaacggagtgggtgatcagcaaattaaaagaggccggtgctccttttgattttgaaataaaaaaaattatcacaaaaggcgatcaaattcttgacgttaccctctcaaaggtaggggggaaagggttatttgttaaggagatcgaacaggcgatggcgaacaaagaaatcgatatcgccgttcacagtatgaaggacgttccttctgtacttcaggaaggatttgctctaggagcaacaacgactcgagtcgacccaagggatgcgctcatttcaaatgaaggatatacgttggccgaattgccagccggttcaattgtcggaacgagcagcttacgacgctccgcccaaattttagcgaagcgtccagacctagaagttaagtggattcgtggaaacattgaaacacgcttgcgaaagctaaaagaggaagatttcgatgcgatcattcttgccgcagcaggtcttgagagaatgggctggtccaatgaaattgtgaccgaatatcttgacccagacctttgtgttcctgcggttggacaaggagctttaggcattgagtgccgagcggatgacgacgaagttcttgagatgttaaagacgatcaatgatgacacaacggcaaagacggttctagcggagcgaacattccttcatcggatggaagggggatgtcaagttccgatcgctggatacgccacgttaacagatgaaggagagattgagctaaccgccctagtcggcacaccagatggtgagcaaatttttaaagaaattcttcgtggaaaagatcctgttcaacttggtgaaacgatggcacaggctttgatggatcaaggagcgaaggaagtgctagaacaagtgaaaaaagggttggagtcgcaatga

SEQ ID NO: 41072 - DNA, 1380 bp, Bacillus halodurans
atgcacattttaatgatcggattaaattataaaacagcccctgttgaaattcgtgaaaaattctcctttcaagattcggagcttcctcaagcccttcatcagcttcgtcaaatgaagagcattttagagtgcacgattgtttcaacatgtaatcgaacggaattatatgtcgttgccgatcaacttcatactgggcggcacttcacaaaaacttttttggctgattggttcaagctgccgaaagatgaatttaccccgtttttaacgattcgtgaaaacgatcatgcgattgagcaccttttccgagtggtgacaggattagattcgatgatccttggcgaaacgcaaattttaggacaggttagaaatagctttttcatcgctcaagaagagcaagtcactggttcgatttttaatcatctgttcaaacaagcgattaccttagcgaagcgggctcactcggaaacggatattgggcaaaatgcagtatctgttagctatgcagctgttgaacttggaaagaaaatctttgatgattttaaaggaaagcaagtgctcattctaggagcaggaaaaatgggcgagctaacagcaaagcaccttcacagcaacggtgcagaacaagtgacggtcattaatcgcacgagagaaaaagcagcagagcttgccaagcgtttcctcggtgtggatcgtccatataatgagctgacagaggcgatagtggaggctgatatcctcattagttccactggtgctacaggttatgtcgtcacgtcagatatggtttctcacgcattaaagaagagaaaaggtcgccctctttttatggtggacattgcagtgccacgagatttagacccggcccttgcttcgcatgatgacgtatacttatacgacattgacgatttgcaaaacatcgttcaaacgaacttagaagagcggagaacggaagcagaaaaaattgagcttttgattgaagaagagctggtggaatttaagcaatggcttaatacactaggggttgtcccaatcattacagccttgcgaacaaaagcgctaaccgttcagggggaaacgatggaaagcattgaacggaagcttccaaacctaacggaaagagaaaagaaagtgcttcgcaagcatactaaaagcattgtaaatcagttgttgagagatccaatcactcgtattaaagagcttgcgaacgcaccggagagggaagaagcactggatttgtttacaaaaatctttgctctagaagaagagttggctgagcaagaaaaacaagaaaaagtaaagcaagcagagcaagagtggcttgcgaaaaaacgtccaatcacctgtatggagaaacaatctcatgttatggtaaaatcttag

SEQ ID NO: 41073 - DNA, 2325 bp, Bacillus halodurans
atggctgaaagcgtgcggcgcaatataccactgttgccgctaagaggattgctcgtttttccaacgatggtcctccatctagatgttggacgaaagaaatctgttgaagctttagaacatgcaatgattgatgaccactacattttactcgctgcgcaaaaagaaatttctatagatgaaccgatcgaaaccgacatttatcaaattgggacttatgcgaaagttaagcaaatgttaaagctcccgaatgggacgattcgtgtactcgtcgaagggcttcagcgagcgaagatcgaaaaatatgttgccaatgatgcatttatcgaagtagagatgtgtaccttgcctgaagatgatgaagataacgcgaccgaaaataaggctcttatgcgcaatgtgctgcaattatttgaacaatacatcaagctatcgaaaaaagtgtcggctgaaacgttagcgtctgtttctgatattgctgagcctggtcggttggcggatgttatcgcttctcatctaccgttaaaaattgtcgaaaagcagcagcttcttgaaacaacgtccgtaaaagagcggttgctgcaagtcattgacgtattgaacaacgaaaaagaagtgatcgggctcgaaaagaaaatcggtcaacgggtcaaaaaatcaatggagcgtactcagaaggagtattaccttcgggagcaaatgaaggcgattcaaaaagagctaggagataaggaaggaaaaacaggggaagttgcctcattacgtgagcaaatagatgaggcgaacatgccagaaaacgtagaagaaaaagcattaaaagaattggaacggtatgaaaaaatgccggctagctccgcagaaagctctgttctccgaaattatcttgattggttgatacagctaccatgggtgaaggaaacggaagacattcttgacgtaaaccgtgccgaacgcatcctagacgaagatcattatggtttagaaaaagtaaaagaacgtgtcattgaatatttggcggttcagcaattaacgaaagaactaaaaggtccgattttatgtctggcgggcccccctggagttggaaagacgtcgctcgcacgctctgtggcacgagcacttaaccgggagtttgttcgtatatccctaggcggtgttcgggatgaagctgagattcgtggtcatcgtcgtacctatgttggggctatgccgggacgaattattcaaggaatgaaaaaggcaggatcggtcaacccagtatttttacttgatgaaatcgataagatggcaaacgactttagaggagacccagcagcggcccttttagaagtactcgaccctgaacaaaaccatacgttcagtgatcactacattgaagagccctacgacttatcgaaagtgatgtttattacaactgcaaacaacattatgacgattccaggtccgcttcttgatcgaatggaaattatccaaattgctggttatacagaggttgaaaaacagcgaatagcgttagactatcttctgccaaaacaaatgaaggaacatggcctaactaaaggaacttttcaagtgaaggaagaagcgattttaaaagttattcgctattatacccgggaagccggtgttcgaagcttggaacggcaaatggctaccctttgccgcaaaggggcaaaaatgctcgtatctggaaagaaaaagcgagtggttgttactcaaaacactatcgaaacaatgttagggaaaaagcggtttcgctatggacttgcagaagagcaagatcaagtgggagcagcgacaggtctcgcctatactacggcgggaggagatacgctctcgattgaagtatcggtcgtgcctggaaaagggaagctcattcttacaggaaagcttggcgatgtaatgaaagaatcagctcaagctgcgtttagttacattcgctcacgctcaaaagagctagacatcgacccgagcttccatgaaaaaaacgatatccatattcatgttcctgaaggggctacaccaaaagatgggccgtctgcaggaatcacgatggcgacagccctcatttccgcattaactggtcgtgttgtgaaaaaagaagtaggaatgacaggggaaattacgttgagaggccgtgtgttaccgattggtggtttaaaagaaaaatcgatgagcgcccatcgtgctggactgacgactatcatcatcccgaaggagaatgaaaaagatttagaagatattccaaaaagtgtacgtgaggatttaaactatattttagttgatcacttagatcaagtgttaaagcatgcgttgggagagaagaaatga

SEQ ID NO: 41074 - DNA, 1719 bp, Bacillus halodurans
atgcatcacaaaattactggcatcgctgcgtcatctggcgtagcgatcgccaaagcattcattcacctagaaccaaacgttgacatagaaaaaacgtccatcacagatgtttcaacagagatcgaaaaattaacagccgctctcgaaaaatcaaaagaagagctaagagcgatcaaagatcaaacagaagctagtatgggagctgacaaggctgagatttttgcggcgcatttgctagtacttgacgaccctgaactcgtagatgggatcaaagggaaaatcgagaatgagcaaatgaacgcagaatatgcattaaaagaagtatccgatatgtttgtctccatgtttgaaagcatggacaatgaatatatgaaagaacgagcggccgacattcgtgacgtttcgaagcgggtgttagggcatcttattggcgtggaaactggttctctggcaacaattgctgaagaaacggttattatcgcagaggatttaacgccttcagatacagctcaattgaacaaacaattcgttaaaggatttgcgaccgatattggaggacgtacgtcccattcggcgattatgtcccgttcacttgaaattccagcggttgttggaacgaaggaagtaacagagaaaattcaacatggcgatatggtgatcgttgacggcatcgagggaattgtgatcgtcaatcctactgaagaagaagtgaaagcctatgaagaaaaacgcgcggcctttgaaaagcagaagcaagaatgggccaagctcgtaggggagccttccacaacgaaggatggcgctcatgttgaattagctgcaaacattgggactccaaaagatgttgatggtgttctagccaatggcggcgaaggcatcggcctttaccgaacagagtttttatatatggatcgcgatcagcttccgacggaagaggagcaatttgaagcatacaaggaagttgtacagcgaatggacggaaagcctgttgtcattcgcaccctagatattgggggagataaggaactttcctacctacagctaccgaaagagcttaatccgttccttggtttccgggcgattcgtctgtgccttgaaaaacaagatattttccggacccaactccgtgccttgcttcgcgcaagcacatacggtaacttaaaggtgatgtttccaatgatcgccacccttgaagagcttcgccaagcaaaagcgatcatgcaagaggaaaaagacaagcttcttagtgaaggagtggacgtatccgattcaattgaagtgggaatcatggtagaaatcccatcgacggcggtagcggctaatctttttgcaaaagaagtagactttttcagtatcggaacgaacgacttaattcaatatacgatggctgctgaccgcatgaatgagcgagtctcctacctgtatcagccataccaccctgcgattttacgcctcgtcgatatggttattaaagcagctcatagcgaaggcaagtgggtcgggatgtgcggtgaaatggctggagatgaagtggcgattccactcttgcttggtcttggattggacgagttcagcatgagtgcaacatcgattttaccagctcgcagccaacttttgaagctatcgaaagaagagcttaaaccgtttgcacaaaaagcgttaatgcttgatacagcagaggaagttgagcaacttgtaaagaaaacgtacttgaaataa

SEQ ID NO: 41075 - DNA, 756 bp, Bacillus halodurans
atgagcgaaaacgtcgtacgtttcattattactcgtcaagatgacccagatagcagtccttatgaagaagagtttcaggtcccgtaccgtcaaaatatgaatgtcatttcggctttaatggagattcgccgaaatccggtaaacagcaagggtgaaacgagcacaccagttgcttgggaaatgaactgcttggaagaggtttgcggagcgtgttccatggtcattaacggcaaaccgcgacaatcatgtacggccctagtggatcaactggagcagcccattcgcctagagccgatgaaaacattccctgtagtccgtgacctagtcattgaccgcagccggatgtttgactcattgaaaaaagtaaaggcatggattccgatcgatggaacttacgatttaggtcctggcccacgaatggcagagtcgaagcgtcaatgggcgtatgagctttcaaaatgtatgacgtgtggagtttgcttagaagcatgtccaaacgttaacagcaagtcagaattcattggcccagcgccgctatcacaagttcgtctttttaacgcccacccaacaggcgagatgaacaaagaggaacgactccaagcgatcatgggagacggtggacttgcgaactgtggaaactcacaaaactgcgttcaatcatgtccgaaaggaattccgcttacaacgtcaattgcggcattaaaccgttcggctacgttgcagtcgttcaaaaacttctttggcagcacaaactaa

SEQ ID NO: 41076 - DNA, 1770 bp, Bacillus halodurans
atgagtaaaggaaaagtcatcgttgtcggtggaggccttgcaggtcttatggcaactattaaggtagcagaggcaggcgtcccggtggagcttttttctctcgttcctgttaaacggtctcactctgtctgtgctcaaggcgggataaatggtgctgtcaacacgaaaggggaaggggactctccgtgggagcactttgacgatactgtatatggtggagatttcttagcgaaccaaccaccagttaaagcaatgtgtgatgcggcgcctggaatcattcacttaatggaccgtatgggcgtcatgtttaaccgaacagcggaaggtttgcttgatttccgtcgttttggtggaactcaacatcaccgtaccgcgtttgctggagcaacaactggtcagcagttgttatatgcattagatgagcaagtacgtcgccatgaaacatctggtctcgtaacaaaatatgagggctgggagtttatttcagctattatcgatgatgaaggaatctgtcgaggcatcacagcgcaaaacttgaaaacatctgagttccagagtttttcagctgacgctgtgattatggcaacaggtggtcctggaatcatcttcggaaaatctacgaactctgttatcaatacggggtatgcagcagctaagctttatgagcaaggtgtatattatgcaaacggggaatttatccaaattcacccgacagcgattcctggggatgataaactccgcctcatgagtgaatctgctcgcggggaaggtggtcgtgtgtggacatacaaggacgggaaaccgtggtatttcctcgaagaaaaatacccggcatacggaaatcttgtacctcgtgatatcgccacacgggaaatcttccacgtttgtgtcgacttaaagctcggaattaatggtgaaaacatggtatacctggatctttctcataaagacccgaaagagctcgatattaagcttggtggaatcattgaaatttatgagaagttcatgggagatgacccacgtaaagtacctatgaaaattttcccagcggttcattactcaatgggcggcatgtggatcgattacgatcaaatgacaaacattccaggcttgtttgctgcaggagagtgcgactattcgcagcatggggccaaccgtctcggagcaaactctctcttatcagcgatttttggtggaatggtggctggacctaaagcagttgagtatatgaacggtcttgaaaagtctgcagaatccatgccttcgtctttatttgaaggtgaactgaagaaagaacaagaaaaattcgatgacatcttgaaaatggatggaaaagaaaatgcgtacgttctccataaagagctcggtgaatggatgacggataacgtgacggtcgttcgctataacgataagctactcaaaacggatgagaagattcaggagctcatggaacgctataaaaacatcgacatcaatgatacggcgaaatggagcaaccaaggggcatcgttcacccgtcagcttgatggtatgttaaagctcgctcgcgtgatcacgttaggggcgtacaaccgtaatgaaagccgtggagcgcattacaagccagacttcccagagcgtaatgatgaggaattcctcaagacgacaaaagcgaaattcaacccagaaacgttggcgccagagtttgaatacgaggaagtggatgtatccttaatcgaaccgcgtaagcgtgactactctcaaaagaagcaaggagctgttaaatcatga

SEQ ID NO: 41077 - DNA, 1239 bp, Bacillus halodurans
atgtcaatcattgtacagaagtatggaggcacgtctgttggctccgttcaacgaattgaacatgtagcgaaccggatcatcgcaacggctgcttcaggaaagaaagtcgttgttgtcgtatcagcaatgggaaagacgacagatgagttagttggattagcgagcgaaattacagacgaaccgcgaaagcgtgaaatggatatgctcctagcaacaggagagcaagtgacgattgcgcttttggcgatggccctacataaacggggacaggaagcgacatcgcttacgggctggcaagctgggatgatcacagaatcacaccatgggaacgctcggattttggaagtggagagagcgcggatggatgaattactagataaagtccacgttgtgatcgtcgcaggttttcaaggaatcgatcaacaaggagagatcatgaccctcggcagaggcggatcagatacgtcggcagtcgcgattgccgcagctctcaaggccgaacgatgcgaaatttatacagatgtgacaggtgtatttacaacagaccctcgggtcgtgaaacaagcgcgcaagcttcaaacgatttcatatgatgagatgcttgaaatggcgaacctaggggcaagtgtccttcatccacgagcggttgaatttgcaaaaaattatgagattccgttacttgtcgcctcgagcatggtagatgagccaggaacaatgatagaggaggaaggaacaatggaacaaaatttactagtacgcggcattgcctttgaaaatgatgtgacaaaagtaacggtgcacgggttaccaaatgaaatccacacactcccgaccctattcgcccatttgtcggctgcggggattaatgtagatatcattatccaaaatcaaacagattcaggaatggcgatttccttctcgattacgcaaagctcattaaaagaaacactcgctcgcctagaagaattaaaaggggaactgtcgtttcaaggcatcgattatgaagaagagttggcaaaggtgtcaattgtcggctctgggatggtatccaatccaggagtagcagcaaaaatgttcgaaattcttgcagccaatgacatcgcgatcaaaatggtaagtacatcggaaataaaagtgtctgctgttattgatgaggagttaatggtgttggcggttgaaatgctccatgagcaatttaagcttcatgaagaggagcctgctgttgctgttaaagtttaa

SEQ ID NO: 41078 - DNA, 1695 bp, Bacillus halodurans
ttggttgatgtagagaaccgagaatggtttaacgcgtacccgaaggaagttccccatacgatcgactatccgaatcagacgctgcatgatttaataaaggaggcagcgacaacataccctcatcacgtagcgctacattttttaggaaaaacgatgacgtatcagttgttttatgagcaggtccaacgttttgccgctaatttgcaacaactaggattacaaaagggcgagcgtgtctccattatgttgccgaattgcccgcaagctgtgatcgcctactatggagtattggtagccggtggggttgttgtgcaaacgaatccgctctatgtggaacgggagttgaatcatcagctgatcgattctggtgcccgttttatcgtttgtttagatgtcctttatccacgggtcataaagtcgagagagggagcaccacttgaacacgtaattgtaaccgctatcaaggattatttgccatttccgaaaaatatgatttatccgtttatccaaaagccgaagccaaaaggaaaaattggctatggtagccatgttcatcgtttcgttccaatggcacaatcaggctcaactaatccaacccctgtccgaattgatccgaaggaagatttagctttactacaatatactggaggaacgacaggggttgccaagggtgtaatgctcacccactacaatttagtagccaatacgattcagtgccgaaaatggatgtacaaatggcgcgatgggcaagagcgaacgttagctgtattgccattcttccatgtgtatggcatgacaacgtcgatgaacttgacattgatgacaggatcagagcttcatattgttcctcgatttgacccattacaagtgttaaaaatgattgataaaaagaagattacgatgttcccaggagcgccaacgatgtatatcgcgctcattaaccacccagacctgaagaaatacgatctttcctccattgaggcctgtatcagtgggtcttcttctctcccagcagaggttcaacaaacgttcgaacagcttacaggaggtcgccttgtggaaggatacggcttaacggaagcatcgccagtaaccaactgcaatctcgtatggggagagcgaaaggaccaaagcattggtgtcccatggccggatacagacgtgcacattcgctcattagaaaccggcgaaagcttaccatcaggtgaaatcggtgaggttgtcgttaggggcccgcaggtaatgaaaggatattggaatcgaccagaagaaacgaacgcaaccttgcaaaacggctggctttatacaggcgatatgggatataaagatgaagaagggtatttttatattgttgaccggaaaaaagatatgattattgccggcggctttaacatttatccacgggaagtagaggaggttctgtacgctcacgccaaagtgcaagaagcggtagtcataggggttccagatgaatatcggggggagactgttaaagcatttattgtcgtcaaagaaggagaaagcgtctcagaaaaagaattaaacgactattgcagaacccatcttgccgcatataaagtcccgcggaaatatgagtttcgagatgatctaccgaaaacgatggtcggaaaagtattaaaacgagtccttattgaagaggaaacgaaaaaacaagggataaaacaatcaagttaa

SEQ ID NO: 41079 - DNA, 1701 bp, Bacillus halodurans
atgacaattgatcgagtttggttgaagagttatccgaaggaaattccccattctattgactatgaggaaaggacgttgcaatcgtatttaaagcaagcagcagaggagttcccgtcacatattgccgttcagtttctcggaaaggaaatgacctatcgtgagctgtatgaacaagcgaagcaatttggcaatcagctaaaaacgctaggtatctcaaaaggggatcgagtggcgatcatgctagccaacagtccccaatcgattattagttactacggagcgttaatgatcggggccgtcgttgtgcaaacaaaccccttgtatgttgagcgagaactggaacatcaattagttgattcaggagcaaaagtcattgtctgtttggatctcgtgttcccaagagtgtcaaaagtaagaaaagcaacccaattagagtatgtcattgtcacaagtattaaagattatttaccatttccgaaaaacgtcctttatccatttgtccaaaaaaagcaaacaggaatgaaaattgacattacgtataatgaaaataccctttcgtttaaaaagttcctccaaggaggagtgacgacggagccatctgaggatgtctcaccaacagatgatttggccctgctccaatatacgggaggaaccacaggaccagcgaaaggggttatgctaacccatgccaatttagtcgccaacacgattcaagggctccattggatgtataaatcgaagcgtgcagaagaagtcatactctgcgtcctgccgtttttccatgtttatgggatgtccgctggtatgaacttagcgatcatgaatgcgtataaaatggtgattttaccgaaatttaacccgaaggacgttctcaaagcaattgaaaagcataaagtcactttatttccaggggcaccgacgatgtatgtaggattaattaacgatccatccatacaggactataatttaacatctgttgaagcttgtattagtggcgctgccccgcttccacttgaagtgcagcaaaaatttgaacagttgactggagggaagctagtagaagggtatgggctgacggaaacgtcccctgtagcgattgcgacaccgatttgggggaaacgaaagcaacgaagcatcggcatcccgtggccagatacagatgttatgatcatttctgcggaaacgggtgagcctgcagatgtcaacgaagtaggcgagcttgccgttcgtggtccgcaagtaatgaaaggctattggaacagaccagaagagacggcccaagtgtttaaagatgactggtttttaacaggcgatatggggtatatggacgaagatggttacttttacattgtcgatcggaaaaaagatatgatcattgctggcggcttcaacatttaccctagggaaattgaagaaattttatatgagcatgatgccattaaagaagcggttgtgatcggtgcaccagatgcttatcgcggagagacggtgaaagcatttatcgtcttaaaagaagggagatcggtctcagaagaagaattagatgcattttgtcggaaacatttagcggcatacaaagtgccacgactttatgagtttcgtgaagagctaccaaaaaccctcgtcgggaaaatattacgtcgcgtcttagtcgaagaggaaaagaaaaaggcagagcaacaaaaggtgagcaacgaataa

SEQ ID NO: 41080 - DNA, 1035 bp, Bacillus halodurans
atgagagaacaattagaggcgttgcgtgatgacgcgatcaaaaaaattgagcaggcacaagagaaaaaagtggtgcaagagattcgtgtcaaatacctaggaaaaaaagggcccgtaacggaagtgctacgcggcatgggaaagctttcaccagaagagcgtccagttattggccaattggcaaatgacgttcgtgaagcgattggaaaggcgattgagtccaaaatggaagctttggagcaagcggagattcaccgtaagcttcaagaggagacaatcgatgtcaccttaccaggtcgcccagtattaaaagggggggcccatccgttaactgcgacgatcacagaagtggaagacttattcatcggacttggcttctctgttgcggaaggaccacaaattgaaaccgattattataactttgaggcgttaaatttaccgaaggatcacccggcccgtgatatgcaagactccttctattttacggatgaactgctgcttcgtacacaaacgtcccctgttcaagcgagaacaatggaaaaatataaaggaaaagggccgattaaaatcatttgtcccgggaaagtgtttcgccgcgatgacgatgatgcgacacactctcaccaattcatgcaaatcgaaggtctttacgtcgaccatggggtacgtatgagtgatttaaaaggagtgctccaagcctttgctaaatcattcttcggggaagagcgctccattcgtctgcgcccaagcttttttccgttcactgagccgtctgttgaagtggacgtctcttgcggaatttgccacggggacgggtgccgcgtctgtaagcaaacaggttggattgaaattttaggcgctgggatggttcatccgcgcgtccttgaaatgagtggctttaatccgaatgaatatagtggttttgcatttggtatgggagttgagcgactttccatgctgaaatacggtatcgatgatattcgccacttctatacaaatgatcgccggttcttggcacaattcaagcgagtgtaa

SEQ ID NO: 41081 - DNA, 1035 bp, Bacillus halodurans
atgaaagtgaaagtagcgattaatggatttggtcgtataggcagaatggtattccgcaaagcggtagaaaacaaacagtttgatgtggtggcgattaacgcttcctatcctgctgaaaccctcgcccatttaataaaatatgacagtgttcatggtccattccaaggaaccgttgagattaaaaatgatgcgcttgttgttaatggcaaggaaataaagctagtcaattctagagatcctcgagtacttccgtggaaagatctagaagtggacatcgttgttgaggcgactgggaaatttaaaacaaaagagacagcaggttatcatctagaagcaggcgcgaaaaaagtaatcattacagctcctgggaaaaatgaagatgtaaccgttgtcgttggagtaaacgaaaatgactataagccagaagagcatcacgttttatcaaatgcttcatgtactacgaattgcttggccccagtagcaaaagttttggatgaagcgtttacaattcaaagcgggatgatgacgacggttcatgcatatacgaatgatcaaaaaaacatcgacaatccccataaagatttacgacgagctcgggcatgtggtcaatcgataattccgacatccactggtgctgctaaagccatcagcaaagtattaccacaattagaaggaaaactaacaggaatggctttacgtgtgccaaccccgaatgtgtctcttgttgacttagtagttcaggtgaaagaggacgtgacgccagaaaaagtgaaccatgtgttaaaacaggcggcagcaggttcgatgaaaggaattctcggttttacagaagagccgttagtctcgattgactttaatggaaacgaacactctgccattgttgatggtttatcgacgatggtgatggaagatacaaaccaggtgaaagtcctcgcatggtatgataatgaatgggggtattccacacgagttgtcgatttagtcgaacttgtcgccaaagagcttaaaaagccagcaaaagtgattgcgtcctaa

SEQ ID NO: 41082 - DNA, 945 bp, Bacillus halodurans
atggcaattaaacgcagaaaggtctccgttattggggcgggtttcacaggtgctacgacagcgctaatggttgctcaaaaggaattaggtgatgtcgttcttgtggatattccgcaaatggaaggtccgactaaaggaaaagcgttagatatgctcgagtcaacgccggttcaaggggttgatgtgaacatcacaggtacgtctagctatgaatatacgaaggattctgatgtggttgtcattacggctggaattgctcgtaagcctggtatgagccgcgatgatctcgtatcaacaaatgcgggaattatgaaggctgttacgaaagaagtggtgaaacattcaccaaacgcctacattattgttttaacgaacccagcagatgcgatgacctataccgtttataaagaatctggtttcccgaaaaaccgcgtcatcggtcaatcgggcgttctagatacggcacgcttccgtacgttcgtcgcccaagagcttaacctatctgttgaagatattacaggttttgttcttggggggcacggggatgacatggtgccattgattcgttactcctatgcaggtgggattccgcttgaaaagctccttccacaagagcgcatcgatgcgattgtggaacgtacgcgcaaaggcggcggtgaaattgtcggcttgcttggaaatggcagtgcttattatgcaccagccgcttcacttgcagagatggtcgaagccattctgaaagataagaaacgcgtccttccaacgattgcttaccttgaaggtgagtatggatatgaagatatctatgttggagttccgacgattcttggcggagacggcattgaaaaggttattgagcttgatctaaccgatgaagagaaagcgacctttgctaagtccattgaatctgttcgcaacgtcatgtcggcactaccaaaagaataa

SEQ ID NO: 41083 - DNA, 1269 bp, Bacillus halodurans
atggcaaacggagagaaaattaaagtaagtgcaggggtacttgaagtaccaaacaatccaattatcccatttatcgaaggggatggaacaggtcctgatatttgggcggctgcacatcgggtgatcgatgcggctgtggagaaagcgtacaacggagaaaagaaaattgtctggaaagaaattttggcaggtgagaaagcgttcaatcaaacaggccaatggcttccagatgagacgcttgaaacgattcgcgagtatacaatcgctattaaaggaccgcttacgactccagttggaggaggcattcgttctttaaacgtggcattacgtcaagaacttgacctttatgtttgcttgcgtccagttcgttattttaatggggttccatctccagtcaaacgtccggaagatacgaacatggttattttccgtgaaaactctgaagacatctacgcaggaattgagtatcaggctggaacggatgaagtgaagaaagtaatcaacttcttacgggaagaaatgggcgttaagaaaattcgcttccctgaaacttctggtattggcatcaaacctgtttctcaagagggaacagaccgactagttcgtgcagcgattcaatatgcgattacagaaggacgtaagagcgtcaccctcgttcataaaggtaacattatgaagtttacagaaggtgcgttcaaaaactgggggtacgaagtagctgagcgcgagttcggtgataaagtattcacgtgggcacagtacgacaaaattgttgaagaacaaggaaaggaagctgcggataaagcgcaagcagaggcggaagcagcaggcaaaattatcgtcaaagattcaattgccgatattttcctccaacaaatcttaacgcgtccgaaagagttcgatgttgtagcaacaatgaacttgaacggtgactatatttccgatgcactcgcggctcaagtaggcggtatcggaattgcgccgggagcgaacattaactatgatacaggtcacgccatttttgaggccactcacggaacggcgccgaaatatgcaggcctcgacaaagtgaatccatcttctgtacttttatctggtgagctcatgcttcgtcaccttggttggaatgaagctgctgacttaattatggcttccatggacaaaacgatcgaaagtaaagttgtcacatacgactttgctcgattaatggatggggctacagaagtcaaatgctcagagtttgcgaatgaattgatcaagaacctttaa

SEQ ID NO: 41084 - DNA, 1119 bp, Bacillus halodurans
atgagtgtcactcgtggtcttgaaggcgtcgttgcgacgacatctagcgtaagttcgattattgaaagtgtattaacgtatcaaggatacgatattgatgaacttgctgaacatgcaagttttgaagaagtaatataccttctttggaatggaaagctcccaaataaagtagagcttaaagaacttgcagatgaacttgcaaataacgctgaaatcccgcaagaagtcattgagcaaatgaaagcttatccgttagatcgcgtacacccaatgggcgctcttcgcacagcgatttcaagcttaggcttgtatgatgaggaagcggatcttatggatgaagcagcaaacaagcgaaaggcattgaagcttcaagcgcaagtttcaacggttgtgacagcgttttctcgcattcgcgaaggaaaagagcctgttgcgcctcgtacagatttaagttttgcggcgaatttcttgtacatgctaacaggagaagagcctgatgaaatagcggttgatgcatttaataaagcacttgttctgcatgctgatcacgagctaaacgcctctacattcacagcacgagtctgtgttgcgactctttctgacgtttactctggtattacagcagcgattggggcattaaagggacctcttcacggtggtgccaacgaacaggtaatggccatgctcacggaaatcggcgatgttgaaaacgttgaaccttacatccgcaaagctttggacaacaaacaaaaaattatgggcttcggtcaccgagtgtataaaaatggcgatccacgtgctaaacacctacgggaaatgtctaagaaattaacgagcattacgggggaaagcaagtggtacgagatgtctgtgaaaattgaagaaatcgtaacaaatgaaaaaggactattgccaaacgttgatttctattccgctagcgtttaccatagtcttggaatcaaacacgacttatttacaccgatttttgctgttagccgtatgagcggatggttggctcatattttagagcaatacagcaacaaccgcttgattcgccctcgggcagaatatgttggaccgaacaagcgacaatatgtacgtttggaagagcgcaactaa

SEQ ID NO: 41085 - DNA, 1755 bp, Bacillus halodurans
atgcgaaagacaaaaatcgtttgtacgatcggtccggcgagtgaaagtgtagaaaagttagaacaattaatggaagcaggcatgaatgttgcgcggttaaatttttcccatggggactttgaagagcacggtgcacgaatcaaaaacattcgagaagcagcgaaacgtatcggaaaaacagttgcaattttacttgatacaaaaggaccggaaattcgtacccaaacccttgaagggggcgtggccgaattaaaggcagggcaagagcttgtcatctctatgaaggaggttgtaggtacgagtgagcgtatttctgtcacatatccgggcctagttcatgatgttgtaccaggtgcaaaaattttattagatgatgggttaattgggctagaagtcgttgaggttcgcgatcaagagattttgacaaaagtcttgaacagcggcacattgaaaaataaaaaaggtgtcaatgtcccgaacgtaagcgtcaacctgcctggaatcacagaaaaagacgcagcggatatcaagtttgggatagagcaaggcgtcgatttcattgcagcttcattcgttcgcagagcgcaagatgtactagaaattcgcgaattgcttgagcagcacggggcagagcatattaaaatcatccctaagatcgagaatcaagaaggcgttgataacatcgaggaaattcttgaagtatcagacggtttgatggtggcccgcggagatctaggggtagagattcctgctgaggaagttccacttgtgcaaaagtcgcttattaagaaatgcaaccttgtagctaaacctgttattacagcgacacagatgcttgactcgatgcagcgtaacccacgtccaactcgagccgaagctagtgatgtagcgaatgcgatttttgatggaacggatgcgatcatgctttccggtgaaaccgcagctggggattatccagtcgaggcggttcagacgatgagccgaattgcagagcgtgcagagcaagccctaaactatcaagaaatcttgtccaagcatacaaaagaagcgagaacgacgattacgagtgctattagtcaatcggttggccacacagcattcaacttgaatgcaagtgcaatcttgacggcgactgaaagcggccatacagctcgcgtagtagcgaaataccgcccgaaatcaccaattgtagcagttacaagtaacgaaacagttgttcgtcaactcgctctcgtttggggagtgtattcaatccttggagaagaggcagagacgacggatgatatgcttcaagtgaccgttgagacagcgttaaagtcccaattggtgaaacaaggggatcttgtcgtcatcacggcaggtgttccagtgggagagacaggaacgacgaacattatgaaagttcacgtcattggtgaagtggtcgcgaaaggtcaaggcattggacgcgacacggtgaacggcaaagtcgtcattgctgctaatgcagaggaagcaaatgcaaaggttgaagaagggtcgattttagttactttcagcacggataaggatatgatgccagcctttgaaaaagcagccgccgtcattaccgaagaaggtgggattacatcccatgccgcagttgttggtctaagtcttaatacacctgtgatcgtcggtgtacaaaatgcgtctgcgctctttaaagatggggaagaaataacggtcgatacgagccgcggtgacatttacagagggcaagcaagtgtactataa

SEQ ID NO: 41086 - DNA, 960 bp, Bacillus halodurans
atgaagcgaattggagtgttaacgagtggaggggactctcctggcatgaatgccgccatccgtgcggttgtacgtaaggcgatctatcacggagtagaggtttatggcatttaccaagggtatgctggtttaatttcaggagatattcgaaaaatggagcttggttctgtaggtgatattatccatcgcggggggaccattttatatacggcccgttgtgaagaattcaagacacttgaagggcaaaaaaagggaattgagcaactgaagaaatttggcatcgaaggcctagttgttatcggtggggatggttcatttgcaggtgcgcaaaaattaacggagcacggattcccaacagtgggagtgccaggaacgatcgataacgatatccctggaacagactttacaattggttttgacacagctttgaatacggttattgatgcgattgataaaattcgcgatacagcaacatcgcatgatcgtacatatgtcatcgaggtcatgggacgtaatgccggtgatttagcgctttggtctggcttagcagatggagcagaaaccattgtgattcccgaagctgatcatgatattgaccaaatcatttcccgtctgcaacgaggacaagagcgagggaaaaaacatagtataatcgtcgttgctgaaggtgtaggaagtggaatggacttcggaagagaaatttcagaacgaacaggggctgagacaagggtcaccgtgctcggacacattcaacggggaggctcaccaacaggatttgatcgtgttctcgcgagtcgtcttggagcgaaagcggtagacttgcttttagaaggacaagcaggtgtaacggtcgggattgaaaataataagcttgtccatcatgacattacagaagtattgcaacgtaagcattcgattgatttggatatgtatcgtttgtcacaggaactgtccatttaa

SEQ ID NO: 41087 - DNA, 759 bp, Bacillus halodurans
atgcgacatgcgctagtaacatcgggtactaaagggcttggagttcaagtaacaaaagccctgcttaaaaaaggatacacggtgaccgttagctatcgaacggaagacgaagcgatgaagcagttggaaacgacgtggggccatcttaaagatcgaattcaactagttcaagtcgatgtaacgaaaaaagaggatatttaccgtctagtggacggggcttatgatcgctttggtcgaatcgatgttgtcgtgaataacgcagggccttatattttcgaacgtaaaaagctttttgactatgaagagcatgaatggcagacgatggtgaatgggaatttaagcgctgccttttatatgttcaaaaaggttctccccatcatgcgcaaccaacagtttggacggattattttatacggatttcagggggcaaatacagctcctgcttggctctatcggtcagcgtatgctgcggcaaaagtaggtcttgtctcattaatgaaaacagtcgctgtggaagaggcagagtacggaattaccgtgaatatggtctgcccgggaaatatagtaggggaaatgaaagaagctacaattgaggagtcacgtaaacaaaaagaccctgacaccccgattggtcgttcaggaacgggtgaagatattgcccggacagtggcctttttatgtgaggatgactcggatatggtaacaggttcggttatagaggtcacaggtgctgtcgatgtattgcatcgttatcggtaa

SEQ ID NO: 41088 - DNA, 1377 bp, Bacillus halodurans
gtgacaaagctttggggaggccgattcacgaaaacagcagaagcttgggttgatgaattcggtgcatcgatcggctttgaccagcaacttgtggaagaagacatcgaaggaagcctcgcccatgtgacgatgctcgaaaagtctggaattctcgccaatgaagaagtggagcaaattaaaaaaggccttcacattttattggaaaaggcaaaaaaaggtgaactgaactattccgttgccaatgaggacatacatttaaatattgaaaagcttttgatcgacgaaatcggaccggtgggtggtaagcttcatacaggacggagccggaacgaccaagtggcgaccgatatgcatctttatttacgcaaacaaacgaaggagattttacagctagtcaagaatgttcaagcggcccttgtggagcaggcgaagcagcacgtagaaacgttaattccaggctacacgcatcttcagcgcgcccagccaatttccttcgctcatcatttgcttgcttatttttggatgcttgaacgcgattatggtcgttacgaagatagcttaaaacgattgaatgtctcaccgctcggggcaggtgcccttgccgggacgacgtttccgattgaccgggagtacacggctgagctgctcggatttgatggcatttatgagaacagcctcgatgcggtcagtgatcgggattttatcgttgaattcttaagtgcgtcttcactcttaatgactcatttatcacgtctttgcgaagagttgattctctggtcttcacaggagtttcaattcgttgagatggacgatgctttcgcgacaggaagcagcatcatgccgcaaaagaaaaatcctgatatggcggagctgatccgaggaaagacggggcgtgtttacgggagtctcttctcgctattaacggtgctaaaaggattgcctttagcttacaacaaagatatgcaagaggacaaagaggggatgtttgatgccgtgaagacggtgaaaggctcgcttgccatctttgctgggatgatccaaacgatgaaggtgaaggaagaaacgatgacgaaggctgtccatcaagacttctcaaatgcgacagagctcgccgattatttagcgacaaaaggtatgccgttccgagaagcccatgaagtagtaggtaagctcgtgcttctttgcatccaaaaaggcatctatttgctagatttgccgttaagtgattataaggcagcatctgatttgtttgatgaggatatttacgacgtattgcaaccgaaaactgtggtggctcgtcgaacgagtgctggcggcacaggctttacagaagtaaagaaagcaattgccaaggccgaaaagattttagccaattaa

SEQ ID NO: 41089 - DNA, 1230 bp, Bacillus halodurans
atgagcaaaaagaaagttgtcttagcgtattctgggggattagatacatctgtagccattaagtggcttagcgataaaggatatgatgtcattgccgttggccttgatgtcggtgaaggaaaggatcttgaatttgtaaaggaaaaagcattgaaagtaggcgcgatcgaatcgtatacaattgatgcgaaaaaagaatttgcggaagaatttgttttgccggcattgcaagcacatgcgttgtatgaacaaaaatacccgcttgtttccgccctatctcgtccattgatttcgaaaaagcttgtagaaatcgcggaacaaacaggcgcacaggcagtagcccacggttgtaccggaaaaggaaacgatcaagtgcgctttgaggtatcgatccaagcattaaatccaaacttagaagttttagcccctgtacgtgagtgggcatggtctcgtgatgaagagattgagtacgctaagaaaaacaacattccaattccgattgatttagataatccgtactctgtcgatcaaaacctatggggacgtagcaacgagtgcggaattttagaagatccgtgggcaacacctccagaaggtgcttatgagttaacagtcgcaatcgaggatgctcccgatcaaccagaaattgtggaaattggatttgaaaaaggaatccctgttacgttgaacgggaaaagctatccagtccatgaattgatcctagagttgaatcaaatcgcaggtaagcatggagttggacgaattgatcacgtagaaaatcgcttggtcggtattaagtctcgtgaagtgtacgaatgtcctggagcgatgacactcattaaagctcataaagagttggaggatttaacgttaacaaaagaagtggcccattttaaaccagttgtagagaaaaaaatagcagagctcatttatgaaggtctttggttctcaccacttcaacccgctttgtctgccttcttaaaggaaactcaatccacagtgactggggttgtacgggtaaaactgtttaaagggcacgccattgtagaaggacgtaaatcagagtattccctttataatgaaaagctagccacttacacaccagatgacgaatttgatcataatgcagcggtaggcttcatctccttatggggactaccaacgaaagtgtatagtatggtgaacaaggaaatgaaggaaaagcaagagaagaaggaggttacatcgtga

SEQ ID NO: 41090 - DNA, 1584 bp, Bacillus halodurans
atgaaagtggaacacatggcaccggaagaatacaatctgacggaggaacttgacgtatttgcaagggacgtaaaccgactcgccattcgatttttagatgataagggtcatcggaaagacatttcgtatgccgagttaatgaataccgttcatcaatatgcgaatgcgttaaccaagtgcggacttaagcggggagacaaagtgcttgtggtggtaccaagaattccagaagcgtattattgctatttagcctgtttaaaggcgggaattgttattattccttgttccaacatgcttcgggccaacgattttgtttatcgaattcaacattcagaagcaaaagccatcatcgcccatgttcaagcaaccgatgaaattgacagcatgagtgttcctcttccttcactacagtataaatgggttatttcaggcacaaaatcaggatgggaatcgctagaagatgttgcaaggaatgaaagcgtttcctttgagggtgtgaaaacaagacgggacgaaatggcgtttttgccttacacctcgggaacaacaggtaatccaaaaggggttgtccatacccacggttgggcttatgctcatttgcaaacagcagcgaaacattggcttggcgtccgtgaaggagatctcgtctgggcaacggctgctcctggatggcaaaaatgggtatggagcccgtttttatcaacgatcggtctaggggcgaccgcgtttgtctacaatggtccttttgatccgaacgagtatttagccttgttagagaaagaagacatcaatgttctatgctgtacgccaacagaatatcgttttatggcgaaagtagacaatctcaatcgctaccgttttccccatttgcacagcgcggtgtccgcgggagagccgctgaatcgaaaggtcattgagatgttccgagacacgtttgggatcaacgtaagggacggttatgggcagaccgagaacacgcttttagtcgggacgatgattggcatggaacagcgaccaggatcgatggggaagccaacacttgaagggcaagtcgtcatcgtgaatgaggatggtcagcctgtggcccctcacgaagtcggagagattgccgtacataaggatgcggctgctttattcaaggaatattatcgggagcctgagcggaccgctcaagcgtttcgtggagactactacattacaggggatctagcaagaatggatgaggatggctttttctggtttgaggggcgcagtgacgatattattattagttcaggttatacgatcggaccgtttgaagtagaggatgctttgacgaaacatccagcggtaaaggaatgtgcggttgtcgcgagtcccgatgaagatcgcggagccgttgtgaaagcgtatatcgttctgaaagattccacgaatctagatgaggaagcgctcagcaaagagttgcaagatcatgtgaaagcgcacaccgctccatacaaatacccaagaaaagtggagtttgtcgagtcgctaccgaagactatttccggaaaaattaggcgtatcgaattaagacaacaagagcaattgcgggcacagtaa

SEQ ID NO: 41091 - DNA, 957 bp, Bacillus halodurans
gtggaagaagcgattattaagctgaatgagattacaaaacggtacgatgatcattatgctgttgaccatctgtctctctcgattaggaaaggtgaaattttcgggcttcttggaccgaacggggctggaaaaacgacaagtattttgatgatgctcgggctcagtgagccaacctcaggaactgttcaggtggccggtattgattcaacaaaatatccgattgaggtaaagcggaaagtgggctatctgccagataacgtcggattttatccagatatgaccggcatggaaaacttgctctatacggctagtttgaatgggattcaaaaaattgaagccattgagcgggcgaatacacttctagaaaaagtggggctaacggaggcagcgaagaaaaagactgggcaatattcaagaggtatgaagcaaagactcggactagcagatgttctcatgaaaggtccagagattattattttagatgaaccaacactagggatagatcctgaaggagtgcgtgactttttacacttaatcagaaacctaaatcaaaacgaaaaccttacagtgttgctatgctcccatcatttgcatcaagttcagcaagtgtgtgaccgtgttggaatatttgtcgatgggaagttattggcctatggtgatcttgatcagttagtgaaacggttgtttaagcatgagagtgttgtgattcatgtggcagcatcaccaattgatgaaagtctattaaatcagctcaaaacgattgaacaggtaaaaaacgtggatgtaattcaagaggacaggctcgacatttattgccgtgaagatgcctcagcgacgattagcaaattaattgtggaatcgggttcaaacctttatcacttatacaaaaaacatttcggacttgatgaaatttaccatcgctattttgaaggacgtgaagcaaatgaagctggctaa

SEQ ID NO: 41092 - DNA, 1716 bp, Bacillus halodurans
atgaacttgcaagcgcttccagcaaaagaggggaaccataatctaaaagattacaatgaagctgtctctacctttgattggtcttctgttgaaaaacagttttcatggtatgagacagggaaagtgaatctcgcctatgaagccattgaccgtcatgcagaatcaaacagacaagataaagtggctctttattatagtgacgcaacaagggatgagcagtatacatttgctgatatgaagaagtatacagataaagctggcaacgttcttcgcgatgctggagtcagcaaaggggatcgggtctttattttcatgccacgctcacctgaactttattttgcattgcttggcgcagtgaaggttggtgcgatcgttggacctctttttgaagcctttatggaaggggcagtcagagatcgcttagaagatagtgaagcaaaagttctcatcacaactccagatctgttacaacgtgtaccagtcgaccaattgccacatttggaaacggtatttatcgtcggtgatcatgttgaagaagaagggccttatcgtgattttctctctaggttaactcaagcatcggacgacttagagattgaatgggtggaccgtgaagacggcttgattttacactatacttcaggatctactgggaagccaaaaggagtattgcacgtccacaatgcgatgattcaacactaccaaacaggaaaatgggtgttagatttaaaagaggatgatgtctattggtgtactgctgatcctggctgggtaacagggacgtcgtacgggatttttgccccgtggttatgtggagcgacaaatgtaattcgcggtggtcgctttagcccagcagattggtatgagacattgcaaaaatataaggcaaccgtatggtacagtgcaccaaccgctttccgaatgttaatgagcgccggggatgagctcgtgaaaaagtacgatctatcgtctttgcgccacatcttaagcgtgggtgaaccattaaatccagaagttgtccgctgggggatgaaagtgtttgatttgcgtattcatgatacgtggtggatgacagaaacaggagcgcaattaatttgtaactatccatcaatggacattcgcccaggctcaatgggaaaaccgttgccaggaattaaagcggccatcatcgatgatcaagggaatgagctaccaccgaatcggatggggaatttagcgatccgcaaaggctggccttcgatgatgcgtgccatatggaaaaatgaagaaaagtataacagctattttgaaattgatggctggtacgtttctggtgattcggcttatatggatgaagatggatatttctggttccaaggccgaattgatgatgtcattatgacctcaggggaacgagtcggtccatttgaggtagaaagcaagctagtagagcatcctgctgtagctgaagcgggagttatcggaaagcctgatccagttcgtggcgaaattatcaaggcatttgtctcccttcgcgatggatatgaactcaccgacgagttaaaagaagatatccgtacatttgtgaaggaaggtcttgctgcccatgccgctccaagagagatcgagtttaaggataagctaccaaaaacacgcagcggtaaaattatgcgtcgtgtgttaaaagcatgggagctagacttacctacgggagacctttcgacaatggaagattaa

SEQ ID NO: 41093 - DNA, 1170 bp, Bacillus halodurans
atgaaaaaagcaagttttgtctactcagaaaaccagctgtcgtatcaatttcattcgacccacccctttaaccatcaacgtttgcgattaacttatgatctgttaaaaagcatggacgctttggatgattcagaaattgtagctcctcgtgtagccacagaggctgaactccgcctcattcacgatcaagcgtttatcgatgcagtgaaggctgccggtaatggaacgttaagcgatggggtcgcattgaactatggtctcggaacggaagacactccgatatttaaaaacatgcatgaagccgcggcccttcttgtcggcggcaccctaactgctgtcgatcaagtgatggaaggtcatgccgagcacgcctgccacctaggcggcggcttacatcacgggtttcgtgggaaagcttcaggcttctgcgtttacaatgatagctcaatcgcgatcgaatatatgagacgcaaatttggtgcacgtgttctttacattgatacagatgcccatcatggtgatggtgtccaatgggcgttttatgaggaggacgatgtttgtacattgagcattcacgaaaccggtcgctaccttttcccaggaacagggaactttaatgaaaaagggcaaggcgaaggatatggttattcgattaacattcctctcgatgcgtttacggaggatgactcctttttattcgcctacgaacaggccgttacaaacgtcgtgaaattttttaaaccagacgtcattttaacgcaaaacggggctgacgctcacttccatgatccgttaacacacctttgcgcctcaatgcgaacgttccgctacatccctcagcttgctcacgcccttgcccatgaatattgtgagggccgatggattgctgtcggtggtggcggctatgatatttggcgagtggttccacgggcatgggctatgatatggcttgagatgaccgatcaattgcaaaaagctaacgggccgttacctgagcgatggctcagtaaatggaccacatatgctcagcatcctttgccttcacattgggaagatgaaaatgaagagttacctaccattccgcgccgtgatgaaattacagagaaaaacaagaaaattgtcgagaaggcattgtatcacatttacacagaattgaaaacgcaaacatag

SEQ ID NO: 41094 - DNA, 1095 bp, Bacillus halodurans
gtgagcaatgagcagctagatttgttaagagataagttagatgaggtaaacttaaagcttcttgaattgattaatgagcgcgcgcaactcgtgcaggaaatcggtcagctaaagagcaagcaaggcgttaatcgttttgaccctgttcgcgagcgaaatatgttgaaccatatcgcagaaaacaataaagggccgtttgaaacatcgaccctccaacatatttttaaggaaattttcaaagcaagcctcgaacttcaagaagatgataaccgtaaagcgctacttgtttcacggaaaaaacaccctgagaacacgattgtcaacgtgaaaggggaaacagttggcgatggcgagcaacgtcttattatgggaccttgtgcagttgaaagctacgagcaagtagcggcagtagcaaaggaagtaaaagcaagaggacttaaactattgcgtggtggtgcatacaagccaagaacatcgccttacgacttccaaggattaggacttgaagggttaaaaattttaaaacgtgtggcagatgagttcgacttagcggtcattagtgaaattgtaacgccagcggaccttgaagaagcaatcgattatatcgatgtgattcaaattggagcccgtaacatgcaaaactttgaactgttgaaagctgccgggtctgtgaacaaacctgttctattaaaacgaggtctatcagcaacgatttctgaattcattcacgcggcagagtatatcgtttcaaaaggaaatgggcagatcatgctatgtgagcgtggcattcgcacttacgaaaaagcaacgagaaacacactcgatatttcagcggtaccaatcttgaagcaagaaacgcatttaccggttctagtagatgtgactcactctactggccgacgtgatctgcttctcccgacagcaaaggcagctcttgctatcggcgccgatgcggtaatggctgaagtgcatccagatcctgctgttgctttgtcagactcagcacaacaaatggacatcgggcaattccatgcatttgtcgatgatcttattgcatcaggactatacaaagatgcaacgaaaactcctcaataa

SEQ ID NO: 41095 - DNA, 2154 bp, Bacillus halodurans
ttgaagcaaattgaagagcaggctgtcaaatgtctttttcattcagcagagattgtaacgctccacacggtgatgattcactttaccgtaacgaaagaacaggtttgcccatttgtcgttgagaaagaaggaacgacagtcccgttctctatcaagagttggcaggagtgggaaaggggagctattgcgttcattcaattcgatgatccacttgagcttggtgttgaatataagctacgtcagaaaaatcatgaacaaacccatttaattaaagtggggcgagtcgttcgtacggaagcatttgatcagcagtatgtttataacggagagctaggggctctttattcacatgaacgaaccgtgtttgctgtgtggactccggttgccacagaggtttctctattgctctatgaaaactggcatacactcgaagcgattgaatatcaaatgaagcgctcgcctaacggcgtttggtccgtcagcttagatggggacttacatcaatattgttacttgtatcgagcgaaggtaaatggcaaatggaaaacgacggtcgatccgtatgcaaaaagtgtgaccgtgaatggagaaaaaggggtcatttttgatctaaagcggaccgatccagcctcttggccaacggttcacccgatcccgccagaacatacaattatttatgagttgcacattcgtgatgcgaccgtttatccagggagtggtcatcataagaaaggaacctatctatccttggccgaacaaaatacgtgcggtccatggggggagtcgaccggtctatcgtatatacgcgaactaggtgttacccatttagagcttttaccggttgctgactatggaagtgtggatgaagccaatcgggaaaaagaatacaattggggctatgatgttgttcattatttcgccccagaggggagctatgcttctgatccttacgatggtgtgacgcgagtaaaggaattgaaacaattgatcgcacaatgccagcgaatggaccttagagtcattttagatgttgtgtttaaccatgtgtacgtgatgaaagagtctccgtttgaaaagctcgttccaggttactattttcgctatgatggggaaggaaatttggcagatggtaccggggtaggaaatgacattgccagcgagcggctaatggtccgtaaattcatcgttgattgtgttacttattgggctagcgaataccgggttgacggatttcgctttgacttaatgggaattattgatcaaatgacgatgaaggaagtgaagcgtgcccttgccccaatcaatcgtcagattttgctgttaggtgaaggttgggatcttgagacaccgttggaaaatgatcaaaaaacaacgctggcacaagcaagggcagtcccttttttacacttttttcatgatacgtttcgcgatgcggtaaaaggaagtacgtttgatcttaataaggggggcttttgtgcaggaaacatagagttgaaagagacgctaatcgctagtatgctcgggcatgaagctcagtttgacagaccaagtcaggcgattcaatatgtggaggcccatgataatcatacactttgggataagctccaatttgtcttccctgatgaagaggaggaagtgcttagagcatgtcaccggttagcaacagctatcgttttaacctctcagggcattccgtttcttcatgggggacaagagttttttcggacgaaacatggtgaaggaaatagttacaattctccggattggatcaatcaattagattggtcaagaagggctatttatgcggctgatgtagagtatgtgaaagggctcatcgcattacggaaggcccaccgcgccttttgcttctcaacattttctgaggtgaacacgcacatgtgtcctttgaaaactccatccgaagtgatcggattccattatcaccacatcgctaaatgggggccttgggatgagatggttgtcctccataatggtggaggagataaggtagacatacgactaccagcaagtggtgagtgggaagtcatcgttgacggaaagaaggcaggtttggtaccattgtatacgttcaatggtcatacggtaagtgtacaaagtcgatcatccatggttttgtatcgacttaacgaatag

SEQ ID NO: 41096 - DNA, 783 bp, Bacillus halodurans
atgtggaaatgggaagttgctgagccgcgtggggtggtcgtcgtcattcatggggcgggagaacaccatgggcgttatcaatggctcgcaaaaaagtttaatagcatcggattatctgtagtgatgggtgatttgcctggccagggaaggacaagagggaagcgcggtcacattcagtcgttccaacagtacattgatgttgtcttggaatgggtggaagcagctaagttggagcacgtgccaatcttcttgtttggccacagcatgggcggacttgtagccgttcgcacgatgattgaaggaggcacattgccagtgcgtgctgtcattctttcatcaccatgctttgatttatatcagtcacctgggaaaggaaaagaattggcttcgaaaatgttgcaccgagtaacgcctactttctcgcatcattcaggcattcgttccgatttagttactcgaaatgaagagattcgtgaagcctacttgaaggatgagcttagagtaacaaaagtgtccacgaaatggtattatgagttatcgaaggcgatgcgagatacccgtcgttatcctgaaaagttcccgaacgtaccattgcttgttatgcaggcgggagaagattatatcacggatagaaaagcggcgtgggaatggtttaattcggttcaagtaacggaaaaggcctataaagagtggaatggactctatcatgaaatttttaatgagcctgagcgggaggctgtgtttcaatacacctgtttttttatcgaacagcaattatcataa

SEQ ID NO: 41097 - DNA, 1200 bp, Bacillus halodurans
atggcagatacaagaagtcgtcgcttatttacatcagagtctgttacagaaggacatcctgataaaatttgtgaccaaatttctgattccattcttgacgaaattttaaaggaagatccgaacgctcgtgtggcatgtgaaacatctgttacgactggtttggttctcgttgctggagaaattacgacgagcacatacgtcgatattcctaaagtcgtacgtgacaccattagaaatataggatacactcgtgcaaaatatggctttgattcggagacgtgcgcggtgttaacgtcaatcgatgaacaatcaccagatattgctcaaggtgttaaccaagcgcttgaagcccgtgaaggtcaaatgaccgatgctgagattgaagcgattggcgcaggtgatcaagggttgatgttcggttatgcgaacaatgaaacgcctgaactcatgccactacctatttctttaagtcataaactagctcgccgtttatcagaggcacggaaaggtgaaatccttccatacttacgtccagacggaaaaacgcaagtcacagttgagtacgatgaaaacgatcagtctgttcgcattgataccattgtgatttcaacacaacaccatccggaagtgacgctggagcaaattgaaagcgacctaaaacagcatgtcattcgttcggttgtcccagaagagctgatcgatgaagaaacgaaatactttattaacccaacaggccggtttgtgatcggtggccctcagggagatgctggtttaacgggacgtaaaattatcgttgatacgtatggtggatatgctcgtcacggcggtggtgcgttttctggaaaggacccaacgaaagtcgaccgttctggagcatatgcggctcgatatgtagcaaaaaatattgtagccgctggtttagccgacaagtgtgaagtccagttagcttatgcgatcggggttgccaagccagtgtcgatttcgattgatacatttggaactggtcaagtgtcagaggcacgtttagtagagcttgtacgggaacactttgaccttcgcccagcggggattattaaaatgttagatcttcgtcgtccaatctacaaacaaacagcggcatacggtcactttgggcgaaccgatgttgagttgccgtgggagcaaacagataaagctgaaattttacgccaacaagcgtag

SEQ ID NO: 41098 - DNA, 1584 bp, Bacillus halodurans
atgaatacgatatcaactacaacacgtcttgaacaattgctgggcgaccagcacgtcttaaaaaatgcaccagcttctactttagtggagaaatcattgcttcgtggcgaaggaaggctgactgatactggtgcgttaacagtagctacaggggcttatacaggacgctcaccaaaagataaatttatcgtggatgagacttctgtccatgaaaaaatcgaatggggacaagtcaaccaagccattgaaaaggaaacgtttctacatttatacgaaaaagttcttacgtacttagctgataaagatgaattgtttgaatttcgcggttttgcaggggctgacaagacgtatcgtcttccccttcaagtcgtaaacgaatttgcatggcacaatttattcgctcaacagctgttcattcagccaacaactgaagagttaacgcaacatacacctgagtttacaatcgtctcagcgccaggttttaaagctgatccgtcggtagatggcacacgatcggaagcatttgtgatcatctcgtttgaagagcgtatcgtccttattggtggaacggaatacgcaggagaaatgaaaaagtcgattttttctgttatgaactacctccttccagagcaagatgtcttatcgatgcattgttcagccaatgttggggtagaaggtgatgtcgctctatttttcgggttgtcgggtacaggaaaaacaaccctatcagctgatccaaaccgcaaactcatcggtgatgatgagcatggctggtcggagcgtggcgtttttaacattgaaggcggctgctacgccaaatgtgttaacctatcctacgaaaaagaaccgcaaatttggaatgcgatccgctttggctccgttcttgaaaatgtcatcgttgacgaaaaaacagggctaccggattacaacgatacatcgttaaccgaaaatacacgggcagcttattctcttgaagcgattccaaacagtgtgatcccaagcgtcgcaggtcatccgaacacgattatttttttgacggctgatgcctttggcgtgctgcctccaataagcaaacttactcctgaacaagcgatgtaccatttcttatcaggatacacgagcaagcttgctggaacggaacgaggggtcacgtcacctgaagcgacattctccacttgctttggcgcaccgtttttaccattaccagcagctcgatatgcggagatgctaggggagaaaatagcccaatacgaagttcaagtgttcctcgtcaataccggttggtcaggaggaccttacggtgtcggtcaacgcatgaagctcagctacacacgggcgatggttcaagcagctcttcaaggggaattaaatacggttgaaacgatcaccgattcggtatttggcctgcatatcccaacgcgttgtcccggggtaccagactttgtcctccagcctcgaaacacatgggacgacaaagaaaagtatgacaaaaaagcacaggagctcgcaaagcaatttatcgaaaattttaaacggttcacgaacgtaagtgaagcgattcaaaaagcaggaccaagtatttag

SEQ ID NO: 41099 - DNA, 1428 bp, Bacillus halodurans
atgtttcgcggaaagctatatattgatgggacgtggactggtgatcttttagacacatttgacgtgaagaacccagcaaccggtgaggttgtcggggtaatgccgaacggaggaaaggcggaagctgctgcagcgattgaagcagcccagcgcgcttttcttaaatggcgtaagtacacggccgcagagcgtgcaaactttttgatgacatggcatgatttattgctacaacaaaaagaagagatagctgaaatgttaacgatggagatggggaagccgctagctgaagcaagaggtgagattgaatactcagcttcgttcattcgctggtttgcagaagaaggaaagcgagtctacggacggacggtccctgcttcagctgaaaataagcgaattcacgtgcaaaagcagcctgtcggggtcgtcgctgcgattacaccttggaactttccagctgcaatgatcgttcgaaaaatggctcctgcattagcggctggctgcacatttgtcggtaaaccagcagagcttaccccgctaacagcggtaaaaatagttgagctgtgtgaagaggctgggtttccaaaaggggtcgtcaatcttgtatgtggagatgcaaaagaaataggggaagaaatgacgagccatgagcatgtccgaaagttaacgttcaccggatcgacggctgttggaaaattgttgatgaaacaaagtgctggacgaatgttaaatttgtccttggaattaggtggtcaagcaccgatgatcatttgtgacgatgccgaccttgataaagccgtggcaggtgtcgttgcctcgaaatatcgaaatgcaggacaaacgtgcgtttgcggaaatcggatttacgtccaggaaacgatcgttgatgaatttgttaagaggctaaccggtaaggtagtacagctcaaggttgggaatggtctagaagagggagtacatatcgggccactcatcgagaagaaaggttatgaaaaagtgaaagctcatgtagacgatgcggttgcaaaaggggctcgtgtcgtgattggggggaaaggacaagaaggaaacgatagctatttctatgacccaaccattttgaccgatgttcatgatgaaatgctcgttatgcaagaggaaacctttggtccggtggcgcccattcaaacatttgcaacagacgaagacgtgattgaaaaagcgaatggaacacgctatggactagcggcatatttctttacagaaaattatgcacgagggattcgcttatccgaagcgttagattttgggattgttggttggaacgatggagcaccatccatagctcaagcaccgttcggtgggatgaaggaaagcggacttggccgtgaaggtggccaggaaggaattgaggcatttctggaaacaaagtttgtctctattggtctatag

SEQ ID NO: 41100 - DNA, 1392 bp, Bacillus halodurans
gtgaaaacagccattatactagcagctggtaaaggcaaaaaaatgtggccatataacgattattggccaaaagctgctttaccaataggaaaccaaggaaacattgttcatttagtaaatcatcttaaaagtttggcatttgaacgaattattattaccacatgttatttaagtcggagaattaaatctcttatatacgatgttgaaggtgttgaaatcattgaactttctgctacagaaggaacagcagacacattagaaaaggttgtgtatgaccttcaagatagtaacctttttattttatatggagacatatttattacccgagaacgattaagcagttttattgaagcttatgaaaaacaacgtgaaacgatggatgccgttattttatctaagccaatagaaaacgagcacgcccaagattggtttggaatcaaagttgggaaggataaccgtgtagaaaatatttttggtcatcctcgtccccattatgtacaggaaagagtgatgggggcatttgctttaaatactaacgtcttaaaaaaaatgctgaaccataatccaggattcatgaaaagtgtacctactggggttatgccacagcaagaagttgagttagagcaatgtttgcaatggttagttgaagtcggatataatgtttcgtcttatccagttaccgacggagtaatcgatatggacaaaccatggcaccttatgcaggcaaatcatctagccgtatctgagatgacacatgcacttaataataatgaaatacatgagacttgtgaaattgatccgaccgccgacatccaaggacatgttaagcttggcaagcatgtaaagataggaaaatatgtaacgattaaaggaaatgccgttattggtgattacaccaaaattgataacggtgtgatcattgaaggaaatgtcgttattggctccgattgtcgtatagaaaattattgtagaattggaccagatagcgtcattggaaataaaaatcggattggacattgtgctgaattcagaggtgttacttttgataacgttagtttcatacatttcggtgaagttttcggaatcattggggaatcaacggatatagctgctggagtcactgtaggcattactcgtttcgatgatcagcctcaaacccaaattgttaacaatcgtaaagaatttcccgaagaatttggaaatgccgtttaccttggggattttacccgtacaggtattttgagcctatatatgcctggaattaaagtaggtagtaattgtgtcattggatctggagttgcagtagagaaagatgtaccatccaaaaccttattgtataacaaacaaacccttattgaaaaaaattggggcccccaccgttatggatggtaa

SEQ ID NO: 41101 - DNA, 1164 bp, Bacillus halodurans
atgaatccgtttatgtttaaaaatccaacaaagctcgtgtttggtgttgatcaaacgaaccaattagaacatgaattaactcatgttgggaaaaacgtattgctcgtgtacggcggaggaagtataaaacggaacggtctatacgaccgagtgttggaacagcttgagcgtgcagggaaagcagtgatagagctttctggagttgaaccgaacccacggttaacgacggtacaaaagggaattgatctctgcaaagcacaaaatattgagtttattttagcagtcggtggcggaagtgtgattgatgcgacaaaagcgattgctgctggggctaaatatgatggtgatgtctgggatattattacgaaaaaaacaaccgcggaagatgcattgccgtttgggacgattttaacgctagcagcgacaggatcggaaatgaatgccaattcggtcatcacaaactgggagacaaaccagaagatcggctggagtagttctcatgtttatccgatgttttcaattctcgatccgaaaaatacggtaaccgtgccgaaagatcaaacgatctatgggatcgttgatatgatgagtcatgtcctagaatcatactttcatcccgtcagcaacacaccgctacaagatcgcatgtgtgaagctgtcctgcaaacagtgatcgaaacaggtccgaagcttgtaaatgatttagagagccttgagtatcgtgaaacgatcttgtattgcggtacgatggcactcaacggtgtgttatccatgggtgcgcgtggtgattgggcgactcacaatattgaacacgcagtttctgctgtttatgatattcctcatgcggggggacttgccatccttttccctcactggctgacatatagccttgatcaaaaaattgatcgtcatgtccaattagcgacgcgtgtctttggcgttgatccatcagggaaaagcgaggaagcgattgctcacgaaggcattgagcgcctttctgccttttggaccgaacttggtgcgccaaaccgtctagccgactatgacatcgatgacagtcaagtggagcggatggctgaaattgcgactgaacaaggagaactaggcaattttaaattgttaaagaaacaagatgtggcgaacattttgacggcggccctttaa

SEQ ID NO: 41102 - DNA, 1170 bp, Bacillus halodurans
atgaatcagtttcagcagtggccaattggagaaccatttctagaggctcttacaaaccaagggattacagaacctacggaaattcagcaacaagtaattccggaagcattggatgggcaaaatctaatcgtccattcacaaacagggacagggaaaacgttagcgtatttgcttccgatgctaacgaaaacggaagaactaccagagcagacgcaagcacttatattggcaccgacacaggagctcgccatgcaaatcgtcgaggtggcaaaacaactaaccgctaccacttcaatcacggtgctcccgctcatcggtggagcaaatataaaacgtcaggtcgagaaattaaaaaagaaaaaacctcatgtggcggttgggacacccggacgtattctcgaattaatggagatgaaaaagctaaaagtgccccatgtcaaaatgatcgtagtcgatgaggcagaccgaatgatggaagaaacgagcgcatggaacgcctttgagaatgtggcaaaacggatcgggaatgaagcgcaatatctgtttgtttctgctacctttgcttctcggtttaccgagcttgttgctccgtatgtcccttttatagaaacggtgtcagcccaaggaaacactgttcagcaggcagtaaaccattggttcattcgctgtgaaaaacgagagcgtatggatgtggtacgaaagctgattcaccatgagaacattcagcgcggcattgtgtttgtgaaccgtttagaacatgtagctgaaacaacagccaagttacaattcaaaggaattaaagcagtcgccttgtcatctgaccaaacaaaacaggaaagagagcgagcattgcaccaattgaaaacaagtgaagcgcaagtgctcattgcttccgatgtagcagctcgcggtcttgatgtggatgatgtcagccatgtgatccaactggagccacctacgacgagtgaagcgtacgttcatcgcgcaggacgaactggacgaatgggtaaagaagggaccgtgatcacattaacgagtgaacgggaaatgtataagctggaaaaaatcgaaaaaggcctaaatctttcctttgaagagcgggtactgtcccatggtaaactccatgctaagaataatggtttaaaagggcataacaaaaggaaaaaatga

SEQ ID NO: 41103 - DNA, 1182 bp, Bacillus halodurans
atgacttcttctacatctcaacggacacggttatcgacgagagtacaatcgattcaaccttcgggtattcgccgtttttttgatctcgcttcaaaaatggaaaatattatttctcttggtgttggtgaacctgattttgtcacgccgtggaatgtcagggaagcgagcatctcttcgatggagcgtggttttactgcgtattcagcaaatgctggaatcattgagcttcgggaagcgatctcccgttatttgtacgagcggtttcacataggttacgatcctgaatcggaaattcttgtgacggttggtgcgagtgaagcgattgacatcgggatgcgcgcgatcatcgacgaaggggatgaagtgatcgttgtcgaaccaagctttgtttcgtatgcgccacttgttacgatggcaggaggcgtcccggttccggttggtacgcatatcgataccgatttccaagtaacaccggcgcaaatagaggctgcgattaccccaagaacaaaagcgattattctttgttttccaaataatccgacggggtcgattatggggaaagaagagttagaggcagtggctaaggtgatttctggaaacgacctcattgtgttttcggatgaaatctatgcagaacttacgtatgatgggacccatgtttcattagcttcgatggacggaatgcgagaacgaaccgttcttatctctggtttttcgaaggcttttgcgatgacgggttggcggcttgggtatgtctgtgcaccagatgatattttgagcgcgatgctaaaaatccatcaatacagccttatgtgtgcaccgacaatggcgcagcacggtgcgttggaagcattagaaacaggaatggacgatgtgcatcgcatggttcaatcctacagacaacgacgcaattttgtcgttaaaacattcaccgaaattggcttaacttgtccaatgcccggcggagctttctatgcgtttccgtctgttaaagaaaccggacttacctctgaggaatttgcggaacgacttctcatggaggagcatgtggcggttgttccggggaatgtgttcggagaaggtggcgaagggcacatccgttgttcatatgccacatctatggaacatttagaaacggcactcgaacgaattggccgttttgtgcaaaaatgcaaacaatag

SEQ ID NO: 41104 - DNA, 744 bp, Bacillus halodurans
atgaggaaggcagtcatcttagctggagggacggggtcacgtctatctccaatcacccgagtgattaataagcacctactccccgttggctcctatccgatgatttattggtcgattttaaaagcaaaggaagccggccttcacgaaatcctgatcttaacttcacgagaacatttagccgccttcattcaactattaggtgatggaaaagatttaggggtgcatctccattatacgatccaagatcaagcggatggaattgcaagtgccctttctttagctgaacatttcgttggagatgaaaaatttctcgtattattaggagataacctgtttgctgatccactcaccgcctatgttcaacaatacgagaagcaaaaggagggtgctttcgttcttttaaaagaagtccgcgatccaacaagatacgggattgcgtttcttgatgaaacgaaacaaaaaataaagaagatcgttgaaaaaccaaatatgcaagggtctgcctattgtgtcacaggcatttatatgtatgaccgaaccgttttttcatttattgagcagattgctccttcagccagaggtgaattagaaattacagacgtgaacaatttttatattgatcaaggaacgatgggatttaacattttgcccgactggtggattgacgccggtactcacgaatcgttatttaaagcaaattgctatatgaatcaaacattagatttagcgggaggagagtcatga

SEQ ID NO: 41105 - DNA, 966 bp, Bacillus halodurans
atgagtaagcaaatactcgtaaccggaggcgctgggtttatcggttcacattttatcgaggcattgttgcagcataaaccaacgtatcacatcacaaatgtcgatgttttgacgtacgccggaaagatagaaaatatgtcaggatttactaaacatccgaattaccgttttatttcagctgacatcggggatgccgaccagctccttggcgcatttgatcgcacctatgatgtgattgtgcactttgctgcagaaacccatgtggatcgaagcattcacaatccaatggttttcttagaaacgaatattcttggaacgcacaatttactcctcgccgttttaaaaggctacgctaagaaaatcctttacatttctaccgatgaagtctacggttcattaggtatgaaggacgtccctttcacagaacagtctccgttagcagcaaataatccgtattcggctagtaaagcaggaggagacttattggctcgttccttttacaagacgtaccaagctcctgtgatcattacccgctgtagcaacaactacggaccgaggcaggacaaggaaaaactcattccaaaaattatcgcgaacgctctcaccaataaaaaaatccccctatacggagacggcttgcaaatccgcgattggctttacgtcaccgatcactgtcgggccttaaccaccattatggaacatggtgaaattggtgagatatacaacattggtggtggaaacgaacgcacaaaccttgaaatcaccaaacagatcctcaatattctcggaaaggatcacgacctaattaaccatgtggaggatcgtaaaggtcatgacaggcgttatgcgattaattggggaaagattcataaacagctcgggtggagaccgatggttgcctttgaggatgggctagccgaaaccgttcaatggtacaaatctcgattggcacaaggaggtcattaa

SEQ ID NO: 41106 - DNA, 750 bp, Bacillus halodurans
atgggggaaaaagcatcaaaagttttaatcacgtctgttcctaaatgcggtacacatttattgaagcaagttgttttaggagctcccttttataaaagaggtaaatggatttctttgcgagagagtatccgggagcaaatagataactgtcatgatcaaacgattatggttgggcacttagagtacagtgaggagatcgttcgttatttaaatgaaaaaggtattcgccgattgttcatttatagagatccaagggatatgctcatttcctatgtattttatgtaaaggaaattgctcctaaacatgagctaagaaattactttcttcatgtacttggatcagatgaagagagaattatgaaattaattactgggtttcattatcaagaggaaaatttaacgtacggggatttaactcttcactatcaaccgtttttaccatggattgaggataaggggacactggcattaagatttgaagatttagtaagttcaaatgaatgtaaagaacaaaccataagtaaaattgctgattatctctggcacggttcaacgtttgatcaatataataaagcagtgctcaagaaaagaatgcttgaaaatatacgacctagccactcaggaacgtttcgaaaaggagttagtggagattggaaaaactattttacggcccagcataaatccgtttttaaagaggtagcgggtcaattacttattgatttaggttatgaaaaagatatggattggtag

SEQ ID NO: 41107 - DNA, 627 bp, Bacillus halodurans
atgaaatcaaacagccaggatgctgccagtatcgtctggcatcctcagctcgtaacaaaacaagctcgaaaccaatcaaatggtcataaaagtaggatgatttggtttaccggattatccggatcaggaaaatcaacgattgccaatgccgtgcaagctgagctatttaaacgaggcattcaagtgtatgtgttggacggggacaatctccgtcacggattaaatgctgacctttccttttccatggaagatcgaaaagaaaatattcgccgaacagcagaagtagggaaacttttcgttgatgcgggtctggtcgttctcgccgcgctcatttcaccagtagaagaggagcggcaacgggcacgatcacgttttgcagaggacgaattccttgaagtgtatgttagctgtacgttgcaagagtgtgaaaagcgtgacccaaaaggactctacaaaaaggcgcgtaaaggggaaatccctcaattcaccgggattcatcagccatatgaagagccgaaaaaccctgacatttgtatcgatacgacagatcgtacggtggaacaatcagtgcaaatcattctgccgattatattagaaaaaatcgcgtggaaggagggagagcagtga

SEQ ID NO: 41108 - DNA, 1140 bp, Bacillus halodurans
gtgacactgagcattccccacggtggatcattaattgaccgtacgaaaacgtcgctagatgtgtccacactttcagcagagattgaactagattcgatcgctttctccgatttagagctcatcgcaaatggagcctatagcccgctaacaggatttatgaacaaaaaagattacgagtccgtggtgacgactatgcgcttagccgatggaaccgtttggagcctaccgatcacattaccaataacggaagaaacggctgagtccttacgcattggggatcaggtaaagcttacctacaatcagactgtctatggagtcttatacctaaaggaactttttgttccagataaaacattggaagccatgcacgtatttcaaacgaccgatcacgatcaccctggtgttcaacggttgtttaaacgcggagatgtttacgctgctggaccgattcacctcatccaacaaccagcacgaaacgatcaatggacacattattatcgttcgccaaaagagacacgagctgagttttcaagacgtcaatggaacagcgttgtcggctttcaaacgcgaaacccggtccatagagcccatgaatatattcaaaaatgtgcccttgaaagcgtcgatggtctcttgttgcatccacttgtcggtgatacgaaaaaggatgacatccctgctgccattcggatggaaagctatgacgtgttgttgaaacattattatgcgaaagatcgcgtttatttatcggtgttcccggcagccatgcgatatgcggggccgagagaagctgtttttcatgccattgtccgaaaaaattacggctgcacccactttattgttggacgcgatcacgccggggttggtgattattatggcacctatgatgctcaacaagttttcactcaatttcctcaagctgaacttgggattcacattcttccgttcgagcatagcttctactgtaaaaagtgtggaagcatggcgagcgcgaaaacgtgtccgcacaaaaaagaacatcacctccatttatcagggacaaaggttcgtgaaatgctgagatccggagtaaagccaccaccggaatttagtcgccctgaggtcattgacgtattaatgaaaggattaaggaacacgtaa

SEQ ID NO: 41109 - DNA, 996 bp, Bacillus halodurans
atgaaaaaaatcatgaacggaccagaaaagatcgttgatcaaatgcttcagggctttgcttttgcccgagcggacaaagtcgggtacgatccgttgcatcgcgtcctctatcaaaaaaccttcgatcctaaaagtgtgccaattattagtggaggcggtagtggacacgaacctggacatttagggtatgtaggggaagggatgcttgcggccgctgttcacggcgatgtgttcgttccgccgtcagctcaacaagttcttgctgcaattcgtcaaatggatcaagggaaaggcgtactgttgataatcaaaaattttgttgcagatttagcgacgtttttgtcagcagaagttcaagcccgagccgagggaagagatgttgcgcatgtgatcgtaaacgacgatgtatccgttgaaagcgatgcatcctttgagaagcggaggcgtggagtggcaggagccgttctcgtccataaaattatcggagctgcagccaaggaaggctattcactagaagcgttacaagagattggtgaacaggttgtaaagaatttggccactttaggtgtggctctcacccatgcagatttaccggagagacgtgagccccaatttctgttggaggagggggaagtgtacttcggggttggaattcacggtgagcaagggtaccggaaagaaaagcttgtgtcgtctgaactgctggccgtcgaactagtgaataagttaaagagcctttatcgctgggataaaaatgatcaatatgcagttctcattaatggccttggaggcaccccgttaattgaacaatatgtgtttgctaatgacgttcgccggttattagcgattgaaaatttacacgtttcctttgtgaaggtaggaactcaactgacttccctaaatatgaaaggcatttcattgactatgctgaaaatctgtgacgagcagtgggtgaaatggctgtacgcgccagttgatgttgcccactgggcctaa

SEQ ID NO: 41110 - DNA, 993 bp, Bacillus halodurans
atgaagaaaattctcaacgatccgcaaaacgttttggatgaaatgctcgatggatttgtatatgccaatggacatcttgttgaacgagtggcggggacaggtgtgattcgccggacatatgaagacaaaggcaaagtggcgttagttagtggaggcggtagcggacatgaaccgagtcatgctggtttcgtcggacaaggaatgctgtcagccgccgtttgcggagaagtgtttacgtcgccaacgccggatcaaatttttgaaggaattaaagcggcagatcaaggaggcggcgttcttctgatcatcaaaaactacacaggtgatgtgatgaattttgaaatggcaggagaaatggctgaagccgaaggaataactgttgatcacatcattgtgaatgatgatattgcggtggaagatagctcatttacagctggaagacgtggggtcgcaggaacgattattgtccacaaaattgtcggagctgccgctgaagcaggtctatcgctacaaagtttaaaagtgctaggtgaaacagtcattgagaacacgaagacgatcggtgtgtcgatcttgcctgcaaccgtaccagctgtcgggaagccaggatttgaactgggagacgacgaaatggaatatggtgttgggattcacggggagccaggttatcgtaaagaaaagctgaaatcgtccaaggaaatagccgaagagttgatcctcaaattaaaagaagcgtttggctggagcaaaggagataaatacggtgtgttagtcaatgggcttggagctacacctcttatggagcagtatgtgtttatgaatgatgtagcgaacaagctaacagaggaagggcttaacatccaatttaaaaaagtgggctcttttatgacgtctatcgacatggccggtgtttctcttactcttataaaaatcgtggaagaaaaatggcttgactattggaatcatgaagtgaaaacggtggactggatgtaa

SEQ ID NO: 41111 - DNA, 861 bp, Bacillus halodurans
atgaaatttacgaaaatgcatggacttggaaatagttacatttacgttgattgcttcaaagagttgttaaaagaagaagagcttcccgctttagcggtggccgttgccgataaaaataaaggaattggctctgacggaatgatcctcatttgcccctcagaccgtgctcctgtgaaaatgcgagtttttaacaatgatggttcagaagcaaaaaattgcggaaatggtcttagatgtgtcgcaaaatttgcatttgaacacgggtatgtaaaggaaacgtccttcgacgtggaaacattagggggactcgtgaaagcaacggtgcatccgaatgacaacggattggtagacacggtgaccgtgaatatgggggagccgaggctgggccgtgcccaaatcccaatgctcggtgaagaggcggcagaagttgtggctgaaccttttacaattggtgaaaaggaatacagattgactgctgtgtccatggggaacccgcacgcaattatgtttatcgatacgattgaagacgctccagtggaacaagtagggccgcttttagagaagcatgaagctttcccagattgggtaaacgtagaatttgttcaggtggttagtcctactgaaattcattttcgtgtttgggaacggggatctggtattacccaagcatgtggaactggggcgtgcgctgccgtagtggcaagcgtactcaatggatttacacaaaaagggcaggaagtcaccgttcatttgttaggcggtgatttaacgatcagttggttagaaaatggagatgtcctcatgactggtgcagcggaaacaatctgtgaaggtacgtatgtaaaagggttatcgtattag

SEQ ID NO: 41112 - DNA, 1296 bp, Bacillus halodurans
atgagcgaggtcttgaaggtaggcctattagggcttgggacggttggcagtggtgtggtgaaactgattgaaaatcaccaacaagagcttaggcatcaaattggcttgcctgttcaagtcgaaaaggtacttgttcgtgatcgatcgaaagctcgagatgtagtcctctcagaggagtcggtaacgctttacggagaagagattgtagagaatgctaacattgatgttgtcatagaggtcatgggcggcattacgttagcgaaggaatatattgtacgtgcccttaagaacggaaagcacgtcgtaacggcaaacaaagatttaatggctgttcacggagcagagcttttatctcttgctgcagagaacggctgtgatttgttttatgaggcgagcgtagctggggggattccgatcattcgcagtttaacggatggtcttgcagctgatcggattacgaaaatgatggggattgtgaatggaacaacaaattacatcctaacgaaaatgacaaaagaaggcctagactatgaagaagtgctcgcacaagcacaagcgttaggatttgctgagagtgatccgacggctgatgtagaaggattggatgcggcgcggaaaatggcgatccttgctacacttgggttttcgatggatgtggagctagatgatgttgtcgttcgtgggatctcgtcggtgacaaaaacggacttagaatattgtgaacagcttggctacacgatgaagctgatcggtttagcagaccgagacggggatcgtgtggaagtgagcgtccaaccgacattgcttcctaaggagcatcctttagctgctgtgaacgatgaatataatgcggtctatgtctatggggaagctgtaggtgagacgatgttttatgggccaggagcaggttcattgccaaccgcaacagcggtcgtgtcagatcttgtttccgtcttaaaaaacatgcgctatcgcgtaaacggtcatgacggcgcgaagccactacacaaaaagacgttaaaagcagacaatgaagtgtttgcgaaatactttttccgcttaaaagtattagataaagcgggaacattctcagcgattacatctctttttgctgaaaaggatgtaagctttgagaaattacttcagcttccgattaaaggggaggcagcagcagaaattatcatcattacgcacacgacggacaaggaaacgtacgagtatttgcatcgcacacttgcagcccttgatgtcgttcaatcggtagaaagcagctaccgagtagagggaggaaaataa

SEQ ID NO: 41113 - DNA, 1518 bp, Bacillus halodurans
atgagagaacaatggggaacaagagccgggtttatcttggctgctgttggatccgctgtcggattaggaaacatttggcgttttccttatgttgcctatgaaaacggcggtggggcatttttcataccttatttatttgcattgttaacagcagggattccattactaatcatggagtttacgattggacaaaaataccgcggttcagcgccattatcatatgcgcgcttgaacaaaaaagcagaatggatcgggtggtggcaagtcgcgatttcctttgtcattgccacatattatgccgtcattatcgcttgggcaatgtcctattctgtctttgccatcaacttaagctggggcgaggatacaggtggatttttgtttggtgagtatttgaagctcgacgttgatccaggacaaatcggatcgttagtaccgggcgtcttcatcccgttagtattagtctggattgttgcattaggtgtattatttgctggggttaagaaagggatcgaactggctaaccggatttttattccaacattggtcattatgtttttaattatcgtcattcgtgcagttacccttgaaggagcagctatcggattagacgctttcttcaaaccagattggtcagaaattctctcacctggggtgtgggtcgcagcatacggacaaattttctttagcttgtcgatcgcctttgcgattatgattacgtactccagctatttaccacgaaaggctgacgtcaacaacaacgcgttcattgctggttttagtaactctgggtttgaattgttagcaggtattggggtttttgccgtgttaggatttatggccactcaagcaggaacgactgttggagaagtagccgcaggagggatcgggctagcctttgtggtcttcccgcaaatcattaactccttacctggactaaatggacttttcggatttttgttctttgcatcactagtctttgctgggttatcatcgctaatttcgattgttgaaacgtttgtatcggcgcttcaagataaatttaagatttcacggacaaaggcggttctttttggtggagggttgtccgcgctaatctcccttctctttgcgacacaaggtggacttttcctacttgatgctgcagatcacttcattaacagctttggtgtggcgttagcaggtcttgtatcggttgttgctgtttcgtggttcttcaagcagcttaatccgctacaaaagcacggaaacgaagtgtctgatcttcgcacaggtacatggtggaaggtttgcttaggggtcatcacaccgatcgtgctcggctatatggcggtgcaaaacatcattaattccattagcgaaaattatgaaggttatccgacgagcttcctcctttatagtggttggggtgtagcggtaggcgcgatcattgtcggcttcatcctttcattaacgaaatggaaagctggtgatctggaggttccatctgaagatcaagaaaaaggagctgatttttcatga

SEQ ID NO: 41114 - DNA, 492 bp, Bacillus halodurans
atgatttcgtttattgttgcgatggacaagcatcggctcattggaaaagagaatgaccttccgtggcgactccctgccgatttggcccattttaagcgggtaacttcaggacatacggtgatcatgggacggaaaacgtatgagtcgatcggcaaaccgttaccaaatcgccgaaacgtcgtcgtcacaagatcgcaagcatacacagccgaaggggttgacatcgtccattctatcgatgaagctataaggctcacagaacatgaaaacgaaacgtttgtcattggcggtagcgaactgtttaaagctttttggccccatgcggatcggatgtatgtgacctacattgatgaggtctttgacggtgatacgtattttccagagattgatggacaggagtgggagcttgtgtccgttgaggcgggcactatcgatgaaaagaatgtctatcctcatgagttcagagtatatgagcgtcaagcgaaaaactag

SEQ ID NO: 41115 - DNA, 387 bp, Bacillus halodurans
gtgtcaaatttaccaaacgagttaaagtattcagaagagcatgagtgggtaaaagttgagggagacaaagttcgtatcggaattacggattttgctcaatcagagctaggtgatattgtctttgtagagcttccagaagttggtgatgaagtggaagcggacgagccttttggcagcgtagaatcagtaaagacagtctctgaactgtacgctcctgtttccggaaaagtagtagaagtcaacgaagagcttgacgataaccctgagtacgttaacgaatctccatacgaaaaagcatggatgattgtcgttgaaccatcagacgcctctcaagtggaagagctcatgagcgctgacgaatacaaggaaatgatcagcgaagaataa

SEQ ID NO: 41116 - DNA, 1785 bp, Bacillus halodurans
atgggaaacactgcagaacaaacagtaaaaggcggaagctttctactcgacgaaattgacgcagataaagtgtttacaccagaagattttacagaagagcatgagatgatcggaaaaacgacagaagagtttgttgtaaatgaagttgttccagttcttgatgaaattgaaaaccaccaattcgatatctctcggcgtttgctgacacaagcaggggagctcggccttcttggtgcagatgtaccagaggaatacggtggtctcgggctagataaaattagctcctcgattattacagaaaagttttcacgagcgggtggtttctccttaagctatggagcccatgtaggcattgggtcattaccgatcgtatttttcgggaacgaggatcagaagaaaaaatatcttccagaccttgcaacaggggcgcgaattgccgcctacgctctcacagaaccaagctcaggttcagatgctcttggtgcaaaaacgacggcggttctaaatgaagctgggactcattatgtgctgaacggtgaaaaacaatggattacgaactctgccttcgctgacgttttcatcgtttatgcgaaaatcgacggagagcattttagcgcctttattgtagaaaaagactttgaaggagtctctacaggaccagaagaaaagaaaatggggattaaaggatcctctacgcgcacgttaattttagaagatgcccttgtaccgaaagaaaatctcctcggtgaagttgggaaaggacatgtgatcgcgtttaacattttaaatgtagggcgttacaagcttggggtcggttgtattggcggctctaagcgtggaattgaattagcagctaaatatgcgaacgaacgaaagcagtttaaacagccaattgcaaagttcactcttattcaagaaaaattagccaatatggctgtcactacttatgcggcagaaagctccatttaccgcacaggtggactgtttgaggatcgccttggcggactgtctgaagaacagcaaaaagatggtcgtgaagtcgccaaagcgattgcagagtatgcgattgagtgctccttaaataaagttgtcgggtcagaagcgcttgattttgttgcagatgaagcggtgcaaattcacggcggctatggattcatggctgaatacgaagtggagcggatgtatcgtgactctcggatcaaccgtatttttgaaggaacgaatgaaattaaccgccttctcgttccaggaaccattttacgaaaagcaatgaaaggcgagcttcctttccttgaaaaggcaacagccttgcaagaggagttgatgatgctcatgccgcaagaagttggagatgaaccgcttgaacaagagaaatatctactgtcgatggcgaagaaagttttcttaatgatcgccggaacaggagcgcaaacgtacggtgaaaagcttcagcaggaacaagaacttcttgcaaacgttgcagatattgtcagcgacattttctcgatggaatcggtcattttgcgtacagaaaaagcgattcgcagaaacggcctagaaaaggcagagcaaaagctcgcacttacgcaagtcttttgccaagaagcattcaaccgtatcgaagcccatgcaaaagaatcattggttgccatgcaatcaggtgatacgttgcgtacgatgacgtctattttacgtaagcttacgcgccatacaccaatcaatgtgattgcgaaaaagcgggaaattgcagggcgtattttagaagctgagcgttacgttgtgtaa

SEQ ID NO: 41117 - DNA, 1182 bp, Bacillus halodurans
ttgagagaagccgttatcgtcgctggtgcgcgaacaccagtgggaaaggcgaaaaatggaacgctcgccaatgttcggccagatgatttaggagcgttaaccgtaaaagaaacgttaaaacgagctggtgactttgatcccgctcgaatcgatgatgtcattattggctgcgctatgccagaagcagagcaaggcatgaatatggcacgaaacattgctgccctcgctggaatgcctcatactgttccggcaattacgatcaatcgttactgttcatcagggctgcaaagtatcgcctacggggcagaacgaattatgctcggccaaggggaagcgattgtcgccggtggagccgaatcgatgagcctcattccgatgggggggcatgtgatcgccccgaacccgacgcttgtggagaaccagcctgaatattacatgggaatgggacatacagccgaggaagtggccagtcgttttggagtctcacgagaagatcaggacgcctttgccgttgagagccataagcgagcggcaaaagcgattgaggaagggaaatttgcagacgaaatcgttccagttgatgtgacgcttcgtcacgtggatgacaaccataaacttgtagaaaaacatgtcacgttctccgtcgatgaaggagttaggcctgaaacgaacatggagaccctttctaccttgcgcccagcattccatgcaaaaggtacggtaacggctggaaatgcttcacaaatgagtgacggagcggccgctgtcttgcttatggatcgagaggttgctgaacgtgaaggcttaacaccagtcgtaaagtttcgttcatttgctgtggctggtgttgcgccagaaattatgggtgttggaccagtagaagcgattccgaaggctgttaaaatggcagggctcgatttatcggatattggtttatttgaattaaatgaagcgtttgcgtcgcaagccattcaagtgatccgtgggttaaatcttgatcatgacaaagtgaatgtcaatggtggagccattgctcttgggcacccactaggatgtacaggaacgaaactaacgctttcacttattcatgaaatgaaacgtcgcggcgaacagtttggcgttgtgacgatgtgtatcggcggcggtatgggcgctgctggtgtatttgaattaatcggttaa

SEQ ID NO: 41118 - DNA, 2382 bp, Bacillus halodurans
atggctcgtcaaattcgcaaagttgccgtcattggatcaggagttatgggctctggaattgctgctcatctagccaatgttggcatcccatcacttttgcttgatatcgtgccaaaccagttgacggaggaagaacaaagaaaagggctaacgcttgaagatcgagcggttcgcaaccgtttggccacattagctctgaaaaaattgcagaagcaaaagccagcaccactttcacggaagagtcatgtccattacattcagccaggtaacttggaagatgatgtggaaaagcttgccgaggtcgattggatcattgaagtagtcgtcgaaaatttagacgttaaaaaacagctatttgaaaaggtagatcaataccggaagcaaggaacgctcgtaagctcaaatacatcaggaatttcaatcgaagcaatggcgaaagggcggtctgaggacttccaagcgcactttttagggacacactttttcaacccgccgagatacttaaagttattagagattattccaacgaaaaaaacaaagccagaagttacagcatttatgaaagcgtttgccgaggacgtgttaggtaaaggggtcgtcgaagggaaggacacacctaacttcattgccaaccgaattggtacttacggcttgcttgtaaccgtgcagaaaatgctggaaggtgggtattctgtaggtgaagtagactcagtgacaggtccgctcatcggtagaccgaaaagtgcaacgtttcgaacgctagatgttgttggccttgatacctttttacacgtggcgaaaaatgttcacgatgtggtggacggtgaagaaaaagatgtgtttgatccaccagtctttatgaaaaaaatggcggaaaacggctggatcggtagcaaatcggggcaagggtttttcctaaagcaaaaaggggaaaacgggtcagaaattttagagctcaacccaagcaccctcgaatatgagaaacgcaaaaaaatgaaagcgccttcgattgaacaagcgaaacaggcaaaatcgttaaatgaaaagctctcgattttgattcaagcgaacgatcgagcaggacaattactttggaatttaatgaagccggtgcttatttactcagcagaaaaagtatacgaaattgccggtgacattaaggccgtagatgacgcgatgaaatggggcttcggctgggagcaaggaccatttgaaatgtgggatgcgatcggcgtagcctcctctgtccagcggatggaagaagaaggagcaaccgttccttcttgggtgaaagagatgttaacgagcggccgagagcgtttttatcaagacggtacgttctatcaccatggtgaggcgaaagttattccaataaatgggaaaatcattcacttgaaggctctgaaaccagagcgtgtcattacgaaaaactctggtgctagcttaattgacctcggtgatgatgtggccttgttagaattccattcgccgaacaactcgatcgggtttgatgtcgtccaaatgattaataaagcagtcgatgaagttgaagcgaactacaaagggctcgtcattggcaaccaagggaagaacttttgtgttggtgcgaacttgatgatgatccttatggaagcgcaggatgataacttttttgaaatcgatatggtcgtgcgtcaattccagcaagccatggctaaaatccgttattcacaaaagcctgttgtttcagcaccgtttgccatgactcttggtggtggtacggaaatctgccttccgacagcaagcattcaagcgtcattagagacgtacatggggcttgtagaagttggagtcggggttattcctggaggtggcggtaacaaagagctttatttacgtcatcttgaacggttgcctgaaggggcgaacattgacttgcaaagtatcgccaataagacctttgaaacaattgcgatggcgaaggtttcgacttccgcccatgaagcgatggaaaacggcttcttgagcgaacgtgacggtgttgtcgtgaacggagatcatttactttatcaagcgaaacagcaggtgatccatcttcatgatgctggctatcgtccaccagcgcgcaaaaagatcccagtcgttggtgaaactgggtatgcgacgatgctccttggtgcaaagtccatgaaattcggtggaatgatttccgagcacgatttaaaaattgctgagaaattagcgtttgtgatcgcgggcggacgggtagcgaaagggacgcttgtcgatgaacaatatttgcttgaccttgaacgggaggcgtttttaagtcttgtaggagaaccgaaatctcaacaacggatgcagcatatgttaatgaaagggaagccgctgcgcaattaa

SEQ ID NO: 41119 - DNA, 747 bp, Bacillus halodurans
atgaagctcgtcgcaccaaagccatttacatttgaaggaggaacgcgtgctgtccttttattgcacggatttacaggcacaaccgccgatgtccgcatgcttggtcgctatttgcaagaaaaaggctacacgtgtcatgctcctttatataaaggacatggagtgccaccagaagagctcattcaaaccggacctgatgattggtgggaagatgttgaagacgggtatcaacatttgaaagaacaaggatatgaagaaattgctgtatgcggtctttcacttggtggagtgttttcattgaaaattggatacactctaccagtgaaggggattgtcccaatgtgtgctcccatgcgacctaaaaccgatgatgctatctataaaggtgtgcttgagtatgcagaggaatacaaacgacgggaaaaaaagagcgatgagcaaattgaggaggaaatggagcgattcaagtcagcaccccagacgacattatttggcttgaagcagctcattgaggatgtaagagatcacctcgatcacatctatgcccctgtgttcgtcgtccaagcacggcatgatgaaatgatcgatgttgaaagcgccaatgtgatccacgatactgtggaatcggacgagaagtctctcaaatggtatgaggactcaacgcatgtaattacgttagataaagaaaaagaacagctacatgaagatgtgtatcgctttttagaagggctgaattggtccgagtaa

SEQ ID NO: 41120 - DNA, 1290 bp, Bacillus halodurans
atgacaatcattactgatgtatacgctcgtgaagtattagattcacgtggaaacccgacggttgaagtggaggtttacttagaatctggtgcaatgggacgtgcccttgtcccaagtggtgcttcgactggtgaatatgaagccgttgagcttcgcgatggtggcgagcgctttttaggaaaaggtgtcttgaaagccgttgagaacgtgaacgaagtcattgcccctgagcttattggcttcgacgctcttgatcaaatcgggatcgatcaacatatgattgagcttgatggaacagaaaataaaggaaaacttggcgcgaatgccattcttggagtatccatggcggttgctcgtgcggcagcgaatgctcttgaccttccgctttatgtatacctcggcggatttaacgcaaaacagcttcctgtgccaatgatgaacatcatcaatggtggagagcacgcagataacaacgtcgatattcaagaatttatgatcatgccagtcggtgcggaaagctttaaagaagcgcttcgtacagggacggaaattttccacagcttgaaaaaagttcttaagtcaaaaggctacaacacagctgttggtgacgaaggtggtttcgcgccaaacctttcatcgaatgaagaagcgttgcaaacgatcatcgaagcgatcgagcaagctggttacactccaggggagcaagtgaagcttgcaatggacgttgcctcttctgagctttacaacaaagaagatggaaagtaccacctttctggcgaaggaaaagttctttcttctgaagaaatggttgccttctatgaagagcttgtagctaaatatccaatcatctccatcgaagacggccttgatgagaacgattgggaaggacataaaatgcttacagaccgtcttggcgacaaagtccagcttgtcggtgacgacttgttcgtaacaaacacgaaaaagcttgcccaaggaatcgagcaaggggtcggcaactcgatcctaatcaaagtgaatcaaatcggtacattaacggaaacgttcgatgcgatcgaaatggcaaaacgcgcgggttacacagctgttatctctcaccgctctggtgaaacagaagatagcacgatcgctgacattgctgttgcgacaaacgcaggccaaatcaaaacaggtgctccgtcccgtacagaccgtgtggcgaagtacaatcaacttctacgcattgaagatgagcttggcaatttagcacaatataacggtcttcaatcgttctacaaccttaaaaagtaa

SEQ ID NO: 41121 - DNA, 1533 bp, Bacillus halodurans
atgagcaagaaacccgttgcattgatcattttagatggctttgcgatgcgcgacgaggcgaaaggaaacgcggtggctcaagcgaataagccgaactttgatcgctattggaatcagtatccacacgcattattaaaggccgatggggaagcggttggcttaccggaagggcaaatggggaactccgaagtcggtcacttaaacatcggtgccggccggattgtttaccaaagcttaactcgtgtcaacctttccatccgcgaaggcgaatttttcgaaaatgaaacgtttttaaatgcgatgaaccacgtgaaggaaaaagggtctagtcttcacatttatggccttgtgtcagatggaggcattcatagtcacattaaccatctatatgcactgcttgaacttgcgaaaagagagcaggtggaacgggtgtacatccatggtttcttagatggtcgtgatgttggtccaacctcagcagaatcgtatctcgttgacctagaagcgaaaatgaaggagctcggtgtcggtgagcttgcgactctacatggccgttattatgcgatggatcgcgacaagcgctgggatcgtgtggaaaaatcgtatcgggcgatggtatatggcgaaggaccagcttattcatcagctcttgacgtcattaaggacagctatgaaaactcgattcacgatgagtttgttatcccttctgtcattacgaacgaagatggctctccagtagcgacgattgaagatgatgatgcaattattttcttcaacttccgtccagaccgggccatccaaatgtcacaagtgtttacgaataaagatttccgtggatttgatcgtggtgaaaaacttccgcaaaatgtatactatgtatgtctgactcatttcagcgagacggttcaaggagacgtggcatttaagccgaccaacttggataatacccttggtgaagtgttggcccagcaaaattacaaacaactgcggattgcggaaacggaaaaatatccgcacgtcaccttcttctttagcggtggacgagaggagccgttcccaggagaagagcgaattttaatcgattctccaaaagtggcaacctatgacttaaaaccggaaatgagtgcctatgaagtgacggacgctttgttaaacgaaattgaggcggacaagcacgatgtaatcattttaaactttgcgaatcctgatatggttgggcattctggtatgcttgagccgacaattaaagcggtagaagcagtcgatgagtgcttagggaaggtcgtggacgcgattctagctaaaggtggtgcagctgtcattaccgctgatcacggaaacgcagacgaggtcgtcacattggaagggaagccaatgacggcgcacacgacaaacaaagtgccggtcatcgtaacagaggaaggattgaacttgcgagaagatgggattttagccgatctttctccaacggttctcgacctccttggcggaaaacaaccagccgaaatgacaggaaaaacattaattaagtaa

SEQ ID NO: 41122 - DNA, 756 bp, Bacillus halodurans
atgagaaaaccgatcattgcaggaaactggaagatgaataaaaccgtaggtgaggcaaaagcattcgtggaagaagtaaaaggggcgatcccttcaagcgataaagtcgattccgtcgtttgttcaccagctttattcctcgaaggacttgtacaaaaagcagaaggaacagagcttcgcatcggtgcgcaaaacatgcattttgaagaaagtggagcgtttactggcgaaattagccctgtcgcactatctgacatgaaagtagactatgtgattcttggacattccgagcgtcgtgacatgtttgctgaaacggatgagctcgtaaataaaaagacgcatgctgcgtttgcccatggcttaacgccgatcgtatgtgtcggtgagacgctagaagagcgcgaggcgaatcaaacatatgatgtcgtaaaaacccaagtggaaaaaggcttggaaggcttaacagacgagcaagtaaaagtaactgtgatcgcatatgagcctgtttgggcgatcggaacaggaaagtcgtcttccgctgaggatgcaaatgatgtttgctcgtacattcgtaaagttgtgacagagaagttttcccaagaagccgctgacgcagttcgcattcaatacggaggaagtgtaaaaccagcaaacattgctgaatacatggcccaatcagatattgatggcgcccttgtaggtggtgctagcttagacccgcaatcattccttcaactgttggaggctgtaaaatga

SEQ ID NO: 41123 - DNA, 1185 bp, Bacillus halodurans
atgaacaaacaatctgttcgtgatgtggaattacaagggaaaaaagtgttttgtcgcgttgattttaacgtgccgatgaaagatggggtcgtgacagatgatacgagaattcgtgccgcgttaccaacgattcaattgttagcagaaaaaggcgcacgcatcattctcgcaagccatctcggtcgtccgaaaggagaagttgtagaggaacttagactcgatccagttgctgctagactgcaagagcttcttggaaagcctgtagcgaaagtcaatgtcgcccacggaccagaggcagagcaagcggcgaacgaactgaaagatggcgatgtgcttttacttgaaaatgttcgtttttaccctggggaagaaaaaaatgatccagagctagcaaaagcttttgcgtctttagcggatgtctatgtgaacgacgccttcggtgcagcacaccgtgcccacgcgtcaacggaaggtattgcacaccatgttacggctgttgcaggcttgctcatggaaaaggagcttgaggtgcttggcaaggcactttccaaccctgagcgcccatttacagcgatcattggtggagcaaaagtgaaagataaaattggtgtcattgaaaaccttttagataaagttgataacttaattattggcggcggacttgcgtacacattcatcaaagcgcaaggacatgagatcggcaaatctcttttagaagcagacaaaatggatttggctctttccttcatggaaaaggcgaaagaaaaaggagtcaacttctacgtaccacaagatgcgattgtagccgatgatttctcgaatgatgcgaatacgaaagcggtggacattgatcaaatcccagccgattgggaagcgctcgatatcggtccaaaaacgcgcgagacctaccgcaatgtcattcaatcctcaaagctcgtcatttggaacgggccaatgggtgtatttgagctcgatgcttttgctggtggcacgaaagctgttgctgaagcgcttgctgatgcaaacgatacgtattctgtcatcggcggtggagattcggcggccgctgtagaaaagttcggtttagctaaccagatgagccatatctcaacaggtggtggagcatctcttgagtttatggaagggaaagctttacctggcgttgtagcgttaaacgataaataa

SEQ ID NO: 41124 - DNA, 1008 bp, Bacillus halodurans
atggctacaaagattggtattaacggttttggacgtatcggtcgtaacgtgttccgtgcagcacttaataacccaaatgtggaagtcgtggcaatcaacgacttaacagatgcaaacatgcttgcacatcttctcaagtacgattctgtccatggcaagcttgacgctgaagtgaaagtggatggagatagccttgttgttaacggtcattctgtaaaagttaaagcagagcgcgacccagcacaactaggttggggagatcttggcgtagaggttgttgtagaatcaacaggccgtttcacaaaccgtgaagatgcagcgaagcatctagaagctggtgcgaagaaggtcattatctctgctcctgcgaaagatgaagacattaccgtcgttatgggtgttaacgaaaataaatatgacccagcgaaccatcatgtcctttcaaatgcttcttgtacaacaaactgcttagcaccatttgcaaaagtacttaacgataaattcggcattcgtcgcggaatgatgacgactgttcactcttatacaaacgatcagcaaattcttgatttaccacacaaagattaccgtcgtgctcgtgcggctgctgaaaacatcattccaacgacaacaggagcagcaaaagccgttgccctcgtcctacctgaattaaaagggaaacttaacggtggagcgatgcgcgtaccaacacctaacgtatctttagtcgacctagtagctgagcttgataaagaggtaacagctgaagaagtaaacgcagctcttaaagaagcagctgaaggcgatcttaaaggaattcttgcatacagcgaggagccgcttgtttctggcgactacaacggaaaccctgcgtcttctacaattgatgccctttcaacgatggtgatggaaggcaacatggtcaaagtcatctcttggtatgataacgagtctggttactctcaccgtgttgtagatctcgttgattatatcgcaaaacaaggcctataa

SEQ ID NO: 41125 - DNA, 636 bp, Bacillus halodurans
atgaacgttgatgatctaacatttgacgacaaggggcttattccggctgttgtccaagatgcgcaaagcaaggaagttgtaacggtcgcttatatgaatcgtgaatcgttcgaaaaaacggtggaaacaggagaaacttggttttacagcagatcgcgacaagagctttggcataaaggggcaacgtctggtcatacacaaaaagtggtcgacattcgttacgattgcgacggcgatgcattagtcgttttagtcgaactgaaagggccggcatgtcatacagggaagtattcctgcttttttgaatcggttttcggcaaaaaaatatatggagctagcgatcgatttggaatcatagcaacgcttgaagcgcttattgctgagcgagaagctgaaatgcctgaaggggcctatacgacctatttatttgaaaaaggtgtagacaaaatattgaaaaaggtcggagaagaggcaacagaagtagtcattgctgcaaaaaatcgcgatgccgaagagctgaagtgggaagtggctgacttgctttatcatttactcgtccttcttcgtgaacagaagcttcccgtcgatgaggtgctagccgtacttgaagaaaggcatcgcccaaaagaggagtga

SEQ ID NO: 41126 - DNA, 759 bp, Bacillus halodurans
atgctcacaaagcggatcattccatgcttagatgtgaaggatggccgggtcgtcaaaggggtgcaattcgttgacttacgtgatgctggtgaccctgtagagcttgctgccttttacgatgaacaaggagcagatgaactcgtatttcttgatatttccgcctcccacgaagggcgtgagacgatgattgatgtggtcgaaaaagtggcaggaacgttggcgattccgttcaccgttggaggagggatcaactccctagaggacatgaagcgcgtgctgcgtgcaggggcagataaagtatcgttaaatacagcagcggttacgcgtccagagcttattactgaaggtgccgactattttggctcccagtgtatcgtcgttgcgattgatgcaaaatacgatgaagcccttggatcttggcgtatttacacccatggaggacggacaccgacagaatgggaagtgtgtgactgggcgagagaagcagtccgtcgcggagctggggaaattttgctcacaagcatggatcaagatggtgcgaagacgggctttgaccttgccttgacgaccaaggtgagtgaagccgtgagcgttccagtgattgcctcaggtggtgccggagcaaaggaagattttgtggacgtttttatgaatgcttatgcggatgccgctttggccgcttccattttccattataaagaaacatcagttgctgaagtgaaaacgcatttgcgtgaagaaggggtggcggtacgatga

SEQ ID NO: 41127 - DNA, 585 bp, Bacillus halodurans
atgagaaaggcaacaattgagcgaaagactggagagacgcaaatttcactcacatttgcggttgacggcgaaggccaatcgaatctaacaactggagttccattcatgacccatatgctcgatttgtttacgaagcacggtcatttcaatttgacgatcgatgcaaaaggagataccgaagtggatgaccaccatacaaccgaggatcttggcatttgccttggtctagcgcttaaggaggcactcgctgataaaaaagggattcgtcggtacggtagcgcttttgtcccaatggacgaaacgcttgctcaagtcgttgtcgatttaagtaaccgtccccatctagagtttcgtgcggacatgccgagtgagaaagtgggcacattcgatacagagctcgtgcacgaatttttatggaagctagcgcttgaggcgagaatgaatcttcatgtcatcgtgcactatggcgaaaacacacaccatatcattgaggcgatttttaaggcgcttgctcgcgccctcgatgaagccacgacgatcgatccacgtgtcaaaggtgtaccttctacgaaaggaatgttataa

SEQ ID NO: 41128 - DNA, 1275 bp, Bacillus halodurans
atgaagatcgtaacaataaatgattcggttagcttaaaacgagatttagatacggggacggatatgcagcaaaatgccgtccattcaattattgcccaagtacgcgaacagggagatcaagccctttttacattaaccaagcaatttgatggtgccgacttgacaactttacgtgtgcagcaagccgagatcgaagcagcgtaccgagaaatggaggagcctgtacttcaagcgatcggcgaggcgattgaaaacattcgcgattttcatgaacggcaaaaaagaaattcatggatgacgacaaagtcggacggaacgattctcggacaaaaaataaccccccttgattctgtcggtctttacgttccaggtggtaaagcagcctatccatcttcgatcatgatgaatgtcatcccagcccaagtggcgggagtacaaaatattgtgatcgtttcaccaccgcaaaaagatggctccatcccggccggtgttcttgtaacagcggctgagttaggagttaagacgattttaaaagttgggggtgctcaggcgatcgctgccttagcctatggtactgaatcagtccctgccgttgataaaattacgggccctggtaacatttatgtcgctttagcaaaacgggctgtttttggtcatgtggacattgacatgatcgcaggtccatcggagattgttgtgttggctgacgaacgagcgaatccgcgctacattgcagctgatttattgtctcaggccgagcatgatgaacgtgcctccgccattctcgtcacgccatcaagagcgttagccgaagaggtggcagtagaagtggatcaacagctcacaactttaccgaagcgggaaattgcggctgcttccattcgtgattacggggcaatctacgtaacggaaacgttggaggaagccgtatctgttgtaaatgagcttgcgccagagcatctagaaattttagcagaagagccaatgtccttcttgggaaaaatccggcatgcaggggcgatctttttaggtccatacagctcggagcctgtaggtgattactttgccggaccgaatcacgtacttccaacgaatgggacggctcggttttcaagtccattaaatgtggacgatttcgtgaaaaaatcaagcattatttcctatagcaaagcagctctattggagaacggtgcaaaaatttctgcacttgcccggctagaaggactggaagctcacgctcgagcaattgacattcgattggaggatgaacgatga

SEQ ID NO: 41129 - DNA, 648 bp, Bacillus halodurans
atggaaattaatacagtgttatttgatttagacggaacgttaatcaacacaaatgagctgatcatttcgtcgtttttacacaccttcgagacgtattatcctgggaaatatggcagaaaagatgcgattgaatgcatcggtcctccgttaacggacagcttcaagcgtctagaccctgaacgagtcgaagagatggtcgctacgtatcgcaagcataatcatgctcatcacgacaagcttgttgaaccttatgaaggggtgtacgaaacagtcaaaacattgcatgagcaaggctttaagcttgcgatcgttacaacgaaaattcgggaaacggcgatgaaaggactcaaattgtttggcttagatgagtttttcgatgtaatcgtcgccttggacgatgtggagaacgtaaagcctaacccagaaccactcgaaaaagcgatgaacgccctcggggcaaaaaaagaagaaacgatcatggtcggagataactctcacgatatcctaggtggtaaaaatgctggtgtcaaaacagcggtcgtcggctacgcgattcgaggggaagactatgttcgtcaatttgatccggattatgtcctgcgctcaatgcccgacttgctcgacatcgttggagtgaaagcaagatga

SEQ ID NO: 41130 - DNA, 990 bp, Bacillus halodurans
atgccggatgttgttttagagttagacaagttacggactcatttttttacagatcaaggtgaagtaccggcagtagatggcgtgagtttgcggctgcatcaaggggaaatcattggaatcgttggtgaatcgggctgcgggaaaagtgtgacctccctctcgatcatgcaactcgtgccgaatccgccaggaaaaattatgtcgggtcacgtttattttaaaggagaagacttggtacaagtttcaccgaagcgcatgaaacaaattcgtggaaatgacattgcgatgattttccaagagccgatgacttcattgaatccattgtttacaatcggaaatcagctcatcgaagcgattcgcaaccaccgtaaaatgaccaagcaggaagcaagaaaacaagccgtgacgatgctcgaacgagtcggtatcccaagagcagatgagattgcctcagagtatcctcaccaattgtcgggcggcatgcggcaacgtgtcatgattgcgatggcgatgtgctgtgatccaaaagtgcttattgcagatgaaccgacgaccgctttggatgtaaccattcaagcgcaaattcttgatttaatgcgccatttgaatgaagcgcacgatacagccatcttgttaattacacacgacctaggggtagtggctgagttatgcaaccgtgtggttgttatgtatgcaggacaagtcgttgaagaaggggatgtcaggatgattttaaaacatcctaaacatccatatacaaaagggttgctcaagtcattaccgaaaattcatgaacagtcgaagcgactctactcaattcctggagtggtccctaagcctggaaccgtcggacacggctgtcggtttgcggcgcgctgtgaagtggcttttgaacgctgcaagacgactgcaccgcagctgcagcaagtagctacaggtcaccaatgtcgttgcttcctttatgaagagaggggggatgaggttgggtaa

SEQ ID NO: 41131 - DNA, 894 bp, Bacillus halodurans
atgcatgtaaaaaaagccatcatccctgcggcaggtctagggacaagatttctcccagcaacgaaagcgcaaccgaaagaaatgttaccgatcgttgataagccaacgattcaatatattatcgaagaagcgattgaatcgggaattgaagatattatcgttgtgactggtagagggaagcgtgcgattgaagatcacttcgataaatcctttgagttagaagaaacgctagaaaagaaaaacaagtctaaattgctagaagaagtaaaggcgatttcgagcatgacgaatattcattacatccgtcaaaaagaggccaatgggttagggcatgcgatttggtgtgctcgcaaatttatagggaatgaaccgtttgccgttctactaggagacgatattgtccagtcggatgttccatgcttaaagcagctaattgatgtttttgaccgctatcattcgtcggttgttggggttcaggaagtgcctaatgaagatgtctccaagtatgggattgtttctccgaaagggtcagagattgaagcgaacgttattcacgccgctggctttgtcgaaaagccaaagctagaagaggcgccttccaattatgcgattatgggaaggtatgtgcttcgcccggaaatttttgatattctagagaacctacctccaggtgctggcggcgagattcagttaaccgatgcgataaaggtcttgaatgaatctcaggtcgtgttagcctacaattttgacggtgttcgttacgacgtgggggacaagtttggctttattaaagcaacaattgatttagccttacaacgggatgatttgtcagaagatgtagctcagtatattaaggacatttatgaaaaacaagtgggtcagttaaagcaataa

SEQ ID NO: 41132 - DNA, 3219 bp, Bacillus halodurans
atgcgaaaaaacaaagcaagcaaagtgtcagttctatttatgatcgttctattggtccttagtctgtttacaccgatcatgccaatgcatgaggcgaatgcagataccgaagcggacaccttacgcatccactaccagcgcagcgatcaacagtttgaaaacttaggcctatggctgtggggggatgtccgttatccgtcggaaaattggccatctggagggacccctttcgagccagagaagatgaccgattacggcgcttatgttgacattgaactaaaagaaaacgcagaaaacatcggatttcttgtcttaaataccgcaacaggggataaagacgggaacgacaaacacgtccagctcctctcgcccgaaatgaaggaaatctggataaaagaaggctccgatgacgtgtttctctatgagccagtcgatcttcctgaccataccgtaagaattcattatgagcgctcagaccagagctatcatcattggggcttatggacatggaaggacgtagcatccccatctgaacattggccgtctggggcaaaccctttttcagatgagcaaacgagtcggtacggtgcttatctcgatgtcgaattggctgacgatgcgaacgagatcggatttctcgtggtcaatcgagaaaacggggataaagacggagatgataaaacattcgctgatttagccaaccatccacaattatttattcgccaaggggacgatacagtatatacgaacccttattatcaaaccattgaaggtctcgtgtcaggagaactgatctcccttacagaaatggaattgcgctttacgtccaccatctggctttcagaggacgatttagccgagcagattcacctaacggatacaaacggggcctctgtcgcttttgatcacgtgacgattcacgacgaaaaaacggtgattcttcatggatcgttcgacgctgagcttgctccataccatgtaacgtttgctgacaaaaccgtcgttgcccgtgccggctggagactaatcgatgcattgtacgggtatgacggagagctaggagccgttctccacgaagacggttcgagcacgttgacattttggtcgccccttgcagaccatgtatccgtcgttttatacgataaggacgatcagtatcgcataatcaaggacgacattgacatgacgaagggcgatcaaggggtctggcaagtcacccttcattcagaaaatacggggttggacaacctggcaggctactattatcactataagattgaaagggatggagacacgaagctcggcctcgatccgtatgcgaaatccatggccgcatggaacaatgaaggcagttactcaattgggaaagcagccattgttgacccttcttccattggcccagaactagattttgcagagattgaaggctttgaaaaacgagaagacgcgattatttacgaagtacatgtgcgcgactttacgtccgatccgggaattgaagaggaattaaccgcccagttcgggacctttgcttcgttcgtcgacaaattggattatattgaagacctaggcgtgacccacattcagctccttccggtcatgagctactattggggcgatgagctcgctaaccatgagagagagctagcgtattcctcgtcgggaaacaactacaactgggggtatgatccgcatagttacttttcgctttccggcatgtactctgagaatccggaagatccggaattaaggattaaagaatttaagcacctcattgatgaaattcatcgccggggcatgggcgtgattctagatgtcgtatataaccatacagcagctgttgaaatttttgaggatctcatgccaaactactatcacttcatggatgcagatggcacaccgagaacaagctttggtggcggaagactcggtacaacccataagatgtcacggcgaattctcgtcgattcgatcacctactgggtggaagaatataaggtggatggcttccggtttgacatgatgggagatcacgatgccgaaacgatccagatcgcttacgaccgggcaaaggaactaaatccgaatattgtcatgatcggggaaggctggcgaacctacgtcggggatgagcacggtggtgacatcatgccagccgaccaagattggatgcagcatacggaaagtgtcggggtgttctctgacgaatttcgcaatgagttaaagtctggcttcggtagcgaaggacagccgagattcattacaggtggagcgcgaaatatcgagcaaattttcgataatctaacggctcagccgcataacttcacagccacgaacccaggagatgtggtgccttatatcgaagcccacgacaatctgacgctccatgatgtgatcgcccagtctatcagaaaagatccggagtaccatcaagaagaaatccataagcggatccggcttggaaatacaatggtgttaaccgcccaaggcacggccttcctccatgcaggccaagagtttggtcggaccaaacaatttcgagccgacaccggggggcaagctccttacaagtcaacgtatatgacggatgaaaacgggaagccatttgtttacccttattttatccatgattcctatgactcctcagatgcgatcaataaattcgattggggaaaagcgacaaacaaggagaaatacccgattcaccatttaacaaggacgtacaccgccggcttaattgagcttcgccgttcgacaaatgccttcacccatggaacattagtggatgtgcaggcaaatgtccgcttgctcgacattcctgaaatcagtgaaacagatttagtgattggctatcgagccacatccactgacaacacgggtacctactatgtatttgtgaacgcagatacgaaggaacgcacgctttcgttaacggatgatctgacggagggagtcgtgattgtggatagcgatgaagctgggattgtagcagtatcagatccaagcgggtttgatctgacaccgaacgagatcacgatcgaccctttaaccgccgtcatcatccgagtaggaggagattttcaagaaaaccctcatgatggacaccctgggaaaggtggcggaaaggcaaaagggcgccctgaccacgcaggacaaccggggccaccgccacatgcaggcgaaaaaggcaaacctgatcatgctagtaaaaaaaaataa

SEQ ID NO: 41133 - DNA, 2019 bp, Bacillus halodurans
atgatcaacgaaaagctaccaaaaatttggtatggtggagattataatccggagcagtgggagaaagaggtctgggacgaagatatccgtatgtttaaactagcaggaattgatgtggccacattaaatgttttttcatgggcgttaaatcagcctgatgaagaaacctatgattttacttggctggatgagcaaattgatcggttgtatgaaaacggaatttatacttgtttggccacgagtacagcggcacatcctgcgtggatggcaaaaaagtatccagacgtcctaagggttgattatcaagggagaaaacgtgcatttggcggcaggcacaattcttgcccgaacagcccaacgtatcgaaagtatgcagaacggatggccgatcgattaggtgaaagatataaggatcatcctggcgtattaatttggcatgtgtccaatgaatatggtggctattgttattgtgacaactgtgctgccagctttcgaaaatggctccagcaaaagtacgggactttacaaaatgtcaataaagcatggaacactcgcttttgggggcatacgttttatgattgggatgaaattgtccctccgaatgcgttaagtgaagaatgggagggcgattctacgaatttccaaggcatctctttagattatcgcatttttcagtccgatagcttactagagtgctttaaacttgagagggacgcgttgaaaaaacatacgcctaaccttccagtaacaacgaatctaatgggtacgtataaagagctggattattttaaatggggtaaggaaatggatgtcgtgtcatgggacaactaccctgcgtatgatacgcctgtaagctttacggcgatggctcacgatctgatgagaggcttaaaaagcggacagccatttatgctgatggagcagacgccaagccagcaaaattggcagccttataattcgttgaaacgcccgggtgtgatgcgcttatggagctatcaagcggtggcccgtggggcagatacagtgatgttttttcaattgaggcgatcggttggagcttgtgaaaaataccatggagccgtcatcgagcatgtgggtcatgagaatacaagggtattccgagagacagctgcacttggcaaggagttgggcaacctttcctatgcattgctcgatgcacgtgtgcaagcgaaggtggcgatcgtgtttgactgggaaaaccgctgggcgacggagctatcaagcggcccatccaaggcattggattatgtaaaagaagttcacaactattacgccgccttatttgatgaaaatatcccggtcgacatgattggagtcgatgaggatttaagcaagtatgaaattgtcattgctcctgtattgtatatggtgaaatcagggtatgccgatcgtgtaaaagagtttgttcaaaatgggggaacgtttgtgacaacgttctttagtggaatcgtgaatgagcatgatcttgtcacccttggcggttatccaggcgaattacgggacctccttggaatatgggtagaggaaatcgatgctctaccgcccgaagaaaaaaatcagattgtgataacaaacgataccggtagtctaacaggtacctatgagtgccggttgttatttgatattattcattcagagggtgcagacgtgctggctgaatatggctctgatttttatgcaggtacacccgtcattacgcgtcatgcttatggaaaaggaaaagcgtattacgtaggaacatgccctgatcaagcctttttaacggatttcatgaagacggtttgtgcggaaaaggaaattgctccattattgaatgttccaaaaggcgtggaagtgacggagagacgaaaggacggcgcttcttacttttttatcatgaaccacaatgcatctacagtagaattggaaataggcgaaggaactgacctgttaacagggaaggaattaacaggggctacctcattggaggcttatggagtcatgatcgtaaagcggtag

SEQ ID NO: 41134 - DNA, 1167 bp, Bacillus halodurans
atgaatatcactatcgcaggaactggctacgtcgggctatccaatgctgtgttattggcgcagcataatgacgtgattgcctatgatattgtgcaagaaaaagtggatatgattaataaccgtaagtctccgattgttgatcgtgaaattgaggagtttctcgcgacgaaagagttgaatttaacggcaacgacggataaagaaaaagcgtttaaagacgcccaatttgtcgtaatctcgacaccaacaaactatgatccagaaaagaattactttgatacatcgtccgtagaagcggttatttctgacgtgttgtcgattaatccaaatgccgtgatggtgatcaaatcgacgatccctgtcggatatacgcgggaagtgaacgagcggttcaatacgaagaatattattttctctccagagtttttacgggaaggttcagccttatatgataatttacacccgtctcgtattgtagtcggggagcggacgcaacgggcgaaaatatttgcggctctgctcgtgcaaggggcgatcaaagagaacatcgacgtattgtttaccgattcgaccgaggctgaggcgatcaagctgtttgccaatacgtacttggcgatgcgagtggcgttttttaatgagcttgattcgtatgcggaattaaaagggcttgatgcgaagcaaattatcgatggggtcgggctggatccacgaatcggtacgcattacaacaacccttcgttcggctatggcggctactgtctaccgaaagatacgaagcaactgctcgccaacttcgaggatgttccaaataacatcattggggcgattgtggatgcgaacgacacgcgaaaagatcatgttgccaatatgatcttaaagcgggagccgaaagtcgtcggaatctaccgtctgacgatgaaaacgggctccgacaactttagacagtcagcgattctagatgtaatgacacggctcaacaacgcaggtgcggaagttgtcgtgtatgaaccagccttggatgcaactgaatttgacggttcaaaggtcatcgaagactttgctgagtttaagaagatgtctgatgtcattgtagctaaccgtttatcagacgatttaaaagaagtagcggaaaaagtttatacacgtgatttgtacacccgtgattaa

SEQ ID NO: 41135 - DNA, 882 bp, Bacillus halodurans
gtgaagaaaatcagaaaagcgattattccagcagccgggctagggacgcgatttctccctgccaccaaagcgatgccaaaggaaatgctcccaatcgtagacaagccgacgatccaatacattgtcgaagaagcgatttcatcaggcattgaagacattattatcgtcaccggaaaaggcaagcgagcgattgaagatcacttcgatcattcctttgagctggaacaaacgctcgcagaaaaagaaaaatacgatttgctagaaaaagtgaacgagtcgactaaggtcgacatccattacatccgacaaaaagagccaaaaggactcggacatgccgtctggtgtgcacggaaatttatcggcgacgagccgtttgccgtcttattaggggacgatatcgttcaagcggaaaccccgtgcttaaaacaactgatcgatcaatacgaacaaacagagtcatcggtcatcggtgtacagaccgtcgccgaccatgaaacccatcgctacggcattgtcgacccgatcgaccaaaagggacgaacgtatacagtcaagcagtttgtcgagaaaccaaagcccggaactgccccatccaacttagcaatcatgggacgctacgtgttaacgccagaaatcttcacgtttttggggcgccatgaaacaggagcaggcggagaaattcaactaaccgatgccatcgagcgcctcaacgaaatccaacatgtgtacgcctatgacttcgaaggcaaacgctacgacgttggtgagaagattggatttgtgaaaacaaccgtcgaattcgccttacacgatgaggcgatcaaggacgagtttgcccgctttctagaagcaatcctcgaacagaagaaggttaacttttaa

SEQ ID NO: 41136 - DNA, 954 bp, Bacillus halodurans
atggatgttgtcacgtttggggaaacaatggtcgtattcgaaccggtggagatgggcgccttacgctatgtggaccgctttaaaaaaggggtcggtggtgcggaatccaatgttgccattggtgtcgccaagctaggccattcggttggctgggttagcaaagtcgggaacgatgagcttggtaaatatgtgatttccgcgattcgcggggaaggggtcgatacatctcaagtcgtgttggatgacggggcaccaactggcctctacttaaaagaaaagcttcgtgacgatttcaatcgagtttattattatcgggcaggatcggccgcgagtcgtttaggcgtagaggacattaactgggcgtacatgaagcaggcaaaaattatccatatcactggaatcacgccattattgagtgattcttgctatgaactgtgtcatgctgtgctagactttgccaaagagaatgggattttcgcttcattcgatccgaacctgcgaatgaagctgctcgcaaatgttccagatgggaaggagaggctgctggcgttagcaagtaaggcagatctggtcatgccaggccgtgatgaagcagcgtttctatttgataccgatgagctagcgcaaatgttttcaaggctcttgaccggtcggacgacaagcgtcgtgattaaagatggggccaaaggggctcacttcatggaagaaggtaaagagccacaatttgtaccgagctgcccagtggataaggtcgttgatcccgttggggctggtgacgggtttgctgctggtgtccttgccagtttactcgaagggaagtcaatggaagaagccgtctcggtcggaacacaaattggtgcgctcgtcgtcatggcaaaaggtgacatggaaggactaccggagcgagagcagctggaagcattttcgcaagcccgttccgatgttttacgataa

SEQ ID NO: 41137 - DNA, 885 bp, Bacillus halodurans
gtgaaaacgcctaacattactgttgtcggtagcatcaatatggatatggtcaccataacggatgttgtaccggttcaaggagaaacggtcctcggtaaagatttccgcaccgttccaggcggaaagggggccaaccaggcggtagcagccgcacgacttggcgccaatgtgcgtatgatcgggcgtgtgggggacgatccgtttggccatgtcctcacagagaacttggccaaggaagggattatcaccgacagtgtgaaaccggttacagattgcacctctggtgttgccaccatcctattatcggaccgggataaccgaatcattgtcacaaaaggggcaaacgagcatgtcaccccggattatgtggcagcctttgagcaggagttagccgctagtgatgtcgttcttttgcagcttgaaataccactcgagaccgtcgcctatgtgcttgaattttgtgcgaaacatcacgtgacgacggttcttaatccagcgcccgctcagaagctaccggatgcggcttggacggatgcaacgtatatatcaccgaatgaaaatgagtgcttgcagctgtttggtgatgagccagacgctaaccttcgtcaaaaattgatcatgaccaaaggggcagatggcgttcagttttatgaaaacgatgaacaggttcaggtggagagctttcgcgtagaacctgtcgatacgacaggtgcgggagatacatttaatggcgccttcgccgttgcgctaggtgggggcacggtaaaagaagctgttcgattcgccaatgcagcggcggcactgtccgtgcagtcgttcggtgcacaaggcggcatgccaacaaaagcgcaagtccaatcgtttttgcaagagcaaggaggataa

SEQ ID NO: 41138 - DNA, 423 bp, Bacillus halodurans
atgcttaccattgaagacattaaaaaaattattccacatcgctacccgtttttactcattgaccgtttagaggaattagaagacggaaagcgagcggtagggattaaaaatgtaacggtaaacgaagacttttttaacggtcattttccagattatcctgtgatgcctggggttttaattgtggaagcgttggcacaagtaggagcatgcgcgatcttaaacgtagaagaaaataaaggcaagcttgccttttttgccggaatcgataattgccgcttcaaggaacaagtgaagccaggtgatcagcttcgtttggaagtggagattgtacgtatgaaaggtccggtcggtaaaggacgtggcgttgcgtctgtaaatgggaaaacagtggcggaaacggatttaatgttcgccattaaataa

SEQ ID NO: 41139 - DNA, 1323 bp, Bacillus halodurans
ttggaaaaaataattgtccgaggtggcaggcagcttagcggatctgtcaaagtagaaggggcaaagaatgccgtcttgcctgttatcgcagcatcaattctagctagccgcggcacgagcaaaatatatgatgtgccaaaattagccgatgtatacacgatgaaagaagttttacgcaatcttaatataaacgttgaatatgaaaatggcgagttcgttgtgaatgcaacaaaccccttaaagacagaagcgcctttcgaatatgtacgaaaaatgcgcgcctctttcttagtcatgggtccccttcttgcccgagttggtcatgcacggattgcacttccaggagggtgtgcgatcggctcgcgtccaattgaccagcatttaaaagggtttgaagccatgggagcgacagtggagattggaaatggttttattgaagcgaaggtcgaaggtcgactgcagggaacgaagatttatcttgacttcccaagcgtaggggctactgaaaacattatgatggcagcagccatggcagaaggaacgacgatccttgaaaacgctgctgaagagccagagatcgtttgtttggctaactatttaaatgccatgggagcaaaagtacgcggtgcaggaacaggtgttatccgcattgaaggtgttgatgaactagtaggagcggagcacacggtgatctcggatcgtattgaagctggcacatttatggtagccgctgccattaccggcggagatgttttcatcgaaggtgccgttgcagaacatctgcgtccattaattgcaaaaatgcatgaaatgggagtaaaaacgattgaagaggataacggcattcgcgtcattggcccagatgaattaaaaccagtagacattaaaaccatgccgcacccagggtttccaacagatatgcaatcgcaaatgatggcattgcttcttcgggcgaacggaacgagtgtcatcacagagacggtgtttgagaatcgctttatgcacgttgaagagttccgtcgaatgaacggcaatattaaaatcgaaggacgctcagccataatctctgggccgtgccaacttcaaggtgctgaagtaaccgcgacggatctacgagcaggtgctgctctcgtactcgctggccttgtcgcagatggtcatacgcgagtagttgaattaaaacatgtagaccgcggatatgttgatctagccggtaagcttgcgcgtctaggtgctgatattgaacgtgtggtggagactgagcatgaattggaaaatcttgatgctccagcaccattaaagttaaacacaaatttagtctaa

SEQ ID NO: 41140 - DNA, 1413 bp, Bacillus halodurans
atgaatacaggtcacattactcaggttatgggtccagttgttgacgttcgttttcaaagcggccaactacccgagctaaacaacgcattacgtgtcgaacaaaaaggggcggatcaaaatgcggttgatgtgaacgtaaccttagaagtggctttgcacttaggagatgatacggtacgcacaatcgcgatgggctcaacggatggtctcgttcgtggaactgaggttgttgacacaggtgcagctatttctgtccctgtaggggaagttacgctcggtcgtgtgttcaacgtactcggtgaatccattgaccttgacgagccgattccagctgatgctgagcgttcgccgattcaccgtgaagcaccaaagtttgaagagctctcaacaaaaacggaaattctcgaaacaggaattaaagttgttgacttgcttgccccttacatcaaaggtggtaaaattggtctcttcggtggtgccggcgtagggaaaaccgttttaattcaagaattaatcaacaacatcgcgcaagagcacggcggtatttctgtatttgccggagtaggtgagcgtacacgtgaaggaaatgacctctaccacgaaatgtccgactcgggcgttatcaaaaagaccgcgatggtgtttggacaaatgaacgagccgcctggtgcccgtatgcgtgtagccctttctggtttgacaatggcggaatatttccgtgacaaacaaggacaagacgttcttctgtttatcgataatattttccgctttacacaagcaggttctgaagtatccgcattgcttggacgtatgccatcagcggtaggttaccagccaacacttgcaacggagatgggacagcttcaagagcggatcacatcaacgaaggtcggttcggttacttctatccaagcgatttacgtaccagcggatgactacactgacccagcaccagcaactacgtttgcccacttagatgcgacgaccaaccttgagcgtaagctttcagagatggggatttaccctgccgtagacccactagcgtctacatctcgtgccctctcgccggagattgttggagaagagcattacaatgtcgctcgtcaagtacagcaaacattgcaaaaatataaagaattacaagacatcatcgccatcctcggtatggatgagctttctgaagaagacaagttaattgtcgcgcgtgcacgccggattcagttcttcttgtcacaaaacttccacgtggctgaacagtttacaggacaaccaggttcgtatgtacctgtaaaggaaaccattaaaggatttaaagaaatccttgaaggtaaatatgatgaccttccagaggatgcattccgtctcgttggccggattgaagaggttgttgagagagcgaaacaaatggtctaa

SEQ ID NO: 41141 - DNA, 858 bp, Bacillus halodurans
atggcttcattacgggacataaagcagcgtattaactcaacgaaaaaaacgaaacaaatcacaaaggcgatggagatggtttcggcagcaaagctcaaccgatctcaggagaaggcgcaatcgttcttgccatatactgataaaatccgggaagtggtagcaagcattgctgcaagcgatacggacgtttcccatcccatgctggaagagcgcccagtgaaaaagacaggatatattgtcattacatccgatcgtggtctggctggagcgtacaacagtaatttgattcgtgggttgctctatacaattaataagcgacacaagtcgaaagacgagtatggaatttttgccattggtcgaacgggccgagatttactgaaaaagcgccagttgccgatcatctcagaaatgacggggttgtctgaccaaccaacctttaatgatattaaagatattgccaagcaaaccgtcgacatgtttgccgatgaggtgttcgatgagctttacatttggtataaccactttgtaagcccgatcaaacaagatgtaacagaaaaaaaggtgctccctcttacggacttgtcggatacgaaagtgtcgacaacgtatgagtatgagccaaatgagcaagtcatcttagaagcgcttttaccgcaatatgcggaaagcctagtttatggggcgttgctcgatgcgaaagccagtgagtttgccgcgcggatgacagcgatgagtgcagcgactgataacgccacaaatctaattgatgagttgacgctatcgtacaaccgggcacgacaagcggccatcactcaggaaatcaccgaaattgtcggtggagcggcagccttagaataa

SEQ ID NO: 41142 - DNA, 1509 bp, Bacillus halodurans
atgagcatcaaaccagaggaaattagctctctcattaaacagcagattgaaaattttcagtctgatgttcaagttcaagatgtagggaccgttatccgtgtcggggacgggatcgcccttgctcatggccttgaaagtgtcatggccggtgagctacttgaattctcaaacggggttatgggtatggctcaaaacctcgaagagaacaacgtcgggattattattttaggtccatatagcgagattcgtgaaggcgacgaagtgaagcggacaggccggatcatggaagttcctgtaggagaggaacttttaggtcgtgtcgtgaacccactaggccaaccaattgatggtagaggtccaattgaaacgtcaaaaacgcgtccaatcgagagcccagctcctggggttatggatcgtaaatctgtacatgagccacttcaaacagggatcaagtcgattgactccatgattccagtcggtcgagggcagcgtgaattgattatcggtgaccgtcaaacagggaaaacgtcgatcgccattgacacaatcattaaccaaaaagaccaagatatgatttgtatctatgttgcgatcggtcagaaagaatcaacggtagctggcgttgtggaaacgcttcgtcaacacggtgcccttgattacacgatcgtcgtttcagcaagtgcgtctgagccagctcctctcttgttccttgcgccatatgcaggggtatcaatgggagaagagttcatgtataacgggaagcacgttcttgtcgtttacgatgatttaacaaaacaagcggcagcttaccgtgaattatcacttttgcttcgtcgtcctccaggccgtgaagcgtatcctggggatgttttctacttgcattcacgcttgctagagcgcgcagcgaagcttagtgatgcaaaaggcggcggttcaatcacagctctgccgttcattgaaacacaagctggtgacgtgtctgcctatatcccaacaaacgtaatttcaattacggatggacaaatcttcttgcaatcagatcttttctactcaggtgtgcgccctgcggtaaacgccggactctctgtatcccgcgtcggaggttcagcgcaaatcaaagcgatgaaaaaggtatctggtacgttgcgtcttgacttagcagcataccgtgagcttgaagcatttgcccagttcggttcagatctagataaagcaacacaagcgaagctaaatcgtggtcaacgtacggttgaagtgttgaagcaaggacttcatgagccgcttccagttgagaagcaagtggcaattatttacgctcttattaacggcttccttgatgacattccagttggagatgtccgccgttttgagtcagaactattcacattccttgaccataacaaaaaagaattgcttgatcatattcgcacaacaggaaacttgcctgatgatagcgagtttaaagctgcaattactgagtttaagcaaggtttcgtaacgacaaaataa

SEQ ID NO: 41143 - DNA, 552 bp, Bacillus halodurans
atgagcaaccatgcggtagcgaatcgttatgctgttgctctttttgagttggctcaagaaaaaggactgcatgaatcgtttgtttcagagttagagttgattaaggctgtatttcaagatacacctgagctcatgcaatttttgactcatccgaagacagagctaacgcaaaagcgtgaactattggaaaagacgtttaaaggaaaagtgaacgataccattttcaacacattagtcgtacttgttgagcgtaaacggatcgaccttatcattccagtcgttcaaaaatttaaatccctttcgtatgatgcgcaaaagatcgcagaggcgttcgtttattctgccaaaccactatcggaggcagaaaaggatcaactttctgtactatttgcgaaaaaggtaggaaaggccaagcttttgattgaaaatattgtggatccatcaatcattggcggcttgaaaatccgcattggcgatcggatctatgacggtagcattaaagggcagcttgatgtgcttcatcgggagcttgtaagcggtccgcgttcataa

SEQ ID NO: 41144 - DNA, 1287 bp, Bacillus halodurans
atggaaaagttgatgattgaaggtggaactccccttgaagggacagttcaaatcagtggagcgaaaaacagtgcagttgctttaatccctgcggccattcttgcagattcgacggtcacaatcgataacttacctgatatttcagatgtccgtctcctcggagagttgttaaaagaaattggcggtgaagtagagctagcagatcagaaaatggtgattgacccgtccaagatgtttgcgatgccactgccaaatggacgtgtcaaaaaattgcgggcttcctattatttaatgggggccatgctcggtaaattcaaaaaagcagtgatcggtttaccaggtgggtgcaaccttggcccgcgtcctattgatcagcacatcaaaggctttgaagcactaggggcaaaggtgacgaacgaacaaggggcgatttaccttcgagcagacgaactaaaaggtgcgcggatatacttagacgttgtgagcgtaggagcgaccattaacattatgcttgcagctgttcttgcgaaagggcgcacaatcattgaaaatgcggcgaaggagccagaaattattgatgtggccacattgttaacaagcatgggggctcgaatcaaaggtgctggtacaaatgtcattcgcattgacggtgtggagtcgttgcacggatgtcgtcattcgattattcctgatcggattgaagccggtacatatatgattttggctgctgcgatcggacaaaatgtgctcattgataacattattccattgcatgtggagtctctcattgctaagttgcgggagatgggcgtcgatgttgaagtattggatgatcaagttcgtatacgtaaccatcaggagaagaaaggcgttgatattaagacgcttgtctatcccggttttcctacggatctccaacagccagctacgactcttttaacacaggctcatggaacaagcattgttaccgatacgatttacaatgctcgtttcaagcatatcgatgaattgcgacgcatgggggccgatataaaggtagaaggacgttctgccatcattaacggaaaaacaaaactacagggcgcgaaggtacgtgcaagtgacctacgagcaggagcctcccttgtcattgctggcttgacagcagaaggaattacagagctttcaggtgtcgaacacattgatcgtggctatgaagacttagagcaaaagctgatcgggcttggtgcaaaaatttggcgagagcaaatgtcggatcaagaagaagagcaagtgaaaagctcataa

SEQ ID NO: 41145 - DNA, 864 bp, Bacillus halodurans
atgcctttagtttctatgacagagatgttgaacaaagcgaaggctgaaggttacgcagttgggcagttcaacttgaataacctagagttcacgcaagcaattttacaagcagcggaagaggaaaagtccccagtgatttgtggtgtttctgaaggggcagctcgctacatgggcggctttaaaacagtggtaggtatggttaaaaacctcatgcaagagtacaatgtgacggttccagttgcgattcaccttgatcatggttctagctttgagaaatgtgtcgaggccattcatgctggttttacatcggttatgattgacggctctcaccatccattagaggaaaacattgctttgacaaaacgtgtcgttgatgttgctcacgctcttggggtttctgttgaagcagagctaggtcgcattggtggacaagaagacgatttggtcgttgacgaagcagaagcagcttacgcgattccgtctgagtgtaaagagttagtcgaagcgacaggtgttgactgctttgcgccggctctaggatctgttcatggcccttacaaaggtgaaccaaacctcggttttgaccgcatgaaggaaatcaatgagcttgtaggtattccactagttcttcatggtggaactggaatcccgacaaaggatattcaaaaagccatctctttaggacatgcgaagattaacgtgaatacagaaagccaaatttcttctgctaaggcagtgcgccaagtgttagaggaaaagcctgagctttatgatccgcgaaaatatttaggccctgcacgtgaagccattaaagatacagtaaaaggtaaaatgcgtgagtttggctcttcaaataaagcgtaa

SEQ ID NO: 41146 - DNA, 1143 bp, Bacillus halodurans
atgaactttttgctaacagatgaacagcagatgattaaaaaaatggttcgagattttgcagagaatgaagttgcgcccacagccgaggaacgggatgaagaagagcggtttgaccgtgagatttttgatcagatggcggagctcggcctcacgggtattccttggcctgaagagtacggagggatcggggctgactatgttagctatgtcattgccgtggaagagctctcaagagtctgcgcctctaccggtgtgaccctttctgcccacctttcgttagcgagctggccggtatacaaatttggcacagaagagcagaagcagcaatttctacggccaatggcagaaggaaagaaaattggcgcctacgggttaaccgagcctggatcaggatcagatgcggcgaacatgaaaacgaccgctgttttagaaggcgatgactacattttaaacggatcaaaaattttcattacaaacggcgggattgccgatatttatatcgtgtttgccgtgaccgagccagaaaagcgtcacaaaggagtgtctgcctttattgttgaagcggatacacctggcttttccgtcggcaaaaaagaaaagaaactggggattcgctcctcaccgacgacggaaatcatatttgaagattgccgggtgccgaaggaaaatttgctagggaaagaaggcgacggcttcaaaattgcgatgatgaccttggacggtgggcgtaacgggatcgccgcacaagcggtcggcatcgctcaaggggcgctcgatgccgcggttgcctatgcgaatgagcgaaagcagtttggcaaaccgattggtcagcagcaagggatcgctttcaaactcgcagacatggcgacaaaggtagaagcgagccggcttctcacctatcaagccgcatggagagaaagcgaaggcctttcctacggtaaagagtcagcgatgtcgaagctgtttgctggagatacggccatggatgtcacggtggaggcggttcaagtgttcggcgggtatggctacacgaaagaatatccggtggagcgctacatgcgtgatgcgaaaattacacaaatttacgaaggaacaaacgaaattcaacgattagttatctcaaaaatgctgttggcggactaa

SEQ ID NO: 41147 - DNA, 1140 bp, Bacillus halodurans
atgaatctacgatggacagacgaacaagagatgatgcggaagatggttcgggattttgctcaagaacgcattgctccgttcgtggaagaaatggaaacgaacgacacgttcccgatgcacattgtgaaagaaatgggggagcttgggttaatgggaatcccgattcctgaagcatacggcggggccgagatggattttacgtcgtacattatcgctatccacgagctgtctaaggtaagcgctacggtgggggtgatcctttccgttcatacctcggtagggacgaatccgattcttttttttggcacagaggaacagaaatcgcgatttattccgaagcttgctaagggcgaatatttaggggctttcgggcttacggaaccgagcgcggggtcggacgcagccaatttaaaaacaacggccttgaaacaaggggatcattatcggttgaatggctcaaaagtgtttattacgaatgggggcgcagccgatacgtatgtcgtgtttgcctcgaccaatccaagtgctggtcgaaaagggatttccgcatttatagtcgagaaagagacaccaggctttacggtcggtaaaaaagagaaaaaaatggggctccacggctccaatacgacagagcttatttttgaagatgcccttgttccgaaagaaaatcttttaggtgtagaaggggacgggtacaagattgcgatggcgaacttggaggctggacggattgggatagccgcacagtctttaggaattgccgaagctgctttagaagcagcaacgtcatatgcgaaggaacgaaagcaatttggcaagtcgattggtcagcagcaagcgattgcttttaaactcgctgatttggcgacacaagtagaggctgccaaactattaacctatcgtgctgcacaattaaaacagcaaggtatttcatgcgcgaaggagtcttcaatggctaaactatttgcgtctaaaaccgcgatgaaggcggcgattgaagccgtgcaaattttcggaggatacggctacacgaaggaatatccagtcgagcgctacttccgcgatgcaaaggtgtgcgagatctacgaagggacgagtgagattcagcgaattgtcatccataaacatattagcgaatga

SEQ ID NO: 41148 - DNA, 855 bp, Bacillus halodurans
atggacattaagcaagtaatggtcattggtgcaggacaaatgggatctggtattgctcacgttcacgctttggccggcttcgaggtcatgttgtatgaccttgatcaggcttcaatagagaaaggaattcaaacgattacgaagcagtttcagcgccaagtggagaaaggacgtatgacagagggagaaatggacatcacccttagtcgtattcaccagtcgactgagttacaggacgccaaaaaagcggactttatcgttgaggccgtcgtggagaatatggaggtgaaaacgaacctttttgccaagcttgatgaccttgctcctgctgacacgattcttgctacgaatacgtcatcacttccgatcacagaaatcgctgctgctaccaaccgtccagaaaaagtcattggcatgcactttatgaaccctgtgcctgttatgaagctcgtggaaattatccgcggactagcaacagccgatgacgtgtacgaaaccgtagaggcactaacgaaaaagctgaacaaaacaccagtagaagtcaatgatttcccaggttttgtctccaaccgcgtgctcatgccgatgatcaatgaggcgatctatactgtgtacgaaggggttgcaactcctgaagcggtagatgaggtgatgaaactagggatgaaccatccaatgggcccccttacacttgcagactttatcgggctggacacatgcttatacattatggagaccctccatgaggggtttggcgatgacaaatatcgtccgtgcccgctactaagaaaatatgtaaaggccggttggctcggtaagaaaacaggtagagggttttacgtctatcacaagtga

SEQ ID NO: 41149 - DNA, 1179 bp, Bacillus halodurans
ttgaagacagccatcattagcggcgtgagaacacctttcgggaaatttggcgggagtctatcgacactaacagctgctcagctagggggacatgcaattcgtgaaacgttaaaaagggcaaattggcgtggggaacgagtagacgatctgatcatggggaatgtgttgcaaggggggcaaggacagctcccgtcaaggcaagcattaaaagaagccgacttaccatgggacgtgcgtacggagacgatcaataaagtatgcgcgagcgggatgcgtagcgtgacattggcggaccagttgatccgttcggggagctcaaaagtcgttgtagctggaggaatggaatcgatgagtcaagcgccctactatgtgccaaaggcgcgttggggtgcaagaatgggccatgtggaaatgatcgatggcatggtatttgacggactaacatgtgccttcacaggtgttcatatgggaacgtacggaaatgggaccgcacatgagttagcgatcagccgagaagcccaggatgaatgggcgtaccgtagtcatcagcgtgccattgcggccatcggagcagggcggctcgaagaagagatcgttccagtggaagtgccgcagcgaaaaggggaaccattgctcgtcgcatgtgatgaagcgccgcgaaaggatacgtcaatggagtcactgaaaaaccttcgaccggtgtttggcaaagaagggacgattacagccggaaatgctcctggagtgaatgatggtgctgccgcgatgttgctcatgtctgaggaggaggcgaagagcgctggcatggcccccttagccatcattgaagggcatactgcgctagcgaccgagccgaaggatttcccgaaaacaccgggccttgtcatccaaaagctattacaggacactgggaaaacgcctgctgagatcgatttgttcgaaattaatgaggcttttgccgccgttgcccttgccagtcagcaaatcgccgagattgaccctgaaaaagtaaatgtcaacggtggagccgttgcgttaggtcatccgattggtgcaagtggtgcacgcatcatccttacacttgcctacgaattgcgccgtcgaggcgggggactaggcattgcagcgatctgcagtggcggaggtcaaggggatgctgtacttattcgcgtaccgtaa

SEQ ID NO: 41150 - DNA, 1242 bp, Bacillus halodurans
atgagtttaacgaagaagattattattgccctcgtgttagggattctagttgggcttggtatgaataaatttgcaccagatttatttgtacctattgatacgtacgtctttacaccggtggggcaattatttcttagattaattatgatgctcgtcgttccccttgttttgttttcgattattctcggaactgcagggctaggagatccgaaaaagttagggaaacttgggtcgaaaaccgtcggcttttacttgctaacgacgatgattgctctcgtcatcggcctatcgattgcctatgtattacaacctggagagcctggactaatggggacagtcgaagaggagtttgaagcgacggaagcaccacctgtcatggagacgatcctcaacattattccgagaaacccaattgaggcgttagcttcaggacaaatgctacaaattattgcgtttgctgtgttagtcggtctcgcccttggtagacttggagagaagacgagcgggattttaaaactcgtggagcaggggaacgaagtgatgatgtaccttgtgagccttgcgatgaagttagctccatacggcgcatttggcttaatcgcctcagctctcggtaagctaggatttgatgcattaggatcaatggccatgtatgtcatagccgtgttacttgcgttgctgctgcatgcagtcattacctatggtggcttcctcgcatttgttgcgaagcgaaacccgctcgaatttttgcgaaacttcttcccagcgatggcgttagccttcggaacatcaagcagtagtgctgtccttcctgtctccatgaaaacagcacaagaaaaactcggtgtctctaagcctgtttctagctttgttcagccgttaggggccactattaacatggacggtacggcgatcatgcaagctgttgcgacggtatttattgctcaagtttatgctcagcagctttcgatgggtgatttgctcacggttgttttaacagcgacactcgctagtattggtacagctggcgttcctggcgttgggttaatcatgctagccatggtcttgcagtccatcggtttaccagtggagggaattgcccttgtccttgcggttgatcgaatcttggatatgtcccgtacagccattaacattactggagacgctacatgcgctgttgtaattgatgagtcagagaaaagaagcaaagcgaaagcagcctctacgtcagcaagcgcctaa

SEQ ID NO: 41151 - DNA, 837 bp, Bacillus halodurans
atgatacagtcgatacaagatcgtgtcaaactagccaatggcgttgaaatgccatggtttggccttggtgtatataaagcagccgaaggagaagaagtgataggggctgttcgagcagcattaaaagctggataccgaagcattgatacggcgagtctttatcaaaacgaggtaggggtcggccaagcgattcgcgagagcggaattccgcgagatgagatttttgtcacaacaaaagtatggaatactgaacaaggatatgacgaaacactcgccgcttttgagcgcagccgaaagcgtttaggacttgaggtcatcgatttgtatttaatccattggccggtgagggagaagtttctcgatacttggcgggcgctagagacgctctataaagagaggaaggtacgagccatcggggtgagcaactttaacattcatcatctagagacggtgatgaacatttccgatattaatccgatggtcaaccaagtggaatttcatccatttttgacgcaaaagccgttgcttacattttgcaaggcgcacgacattcaactggaggcgtggcgaccgctaacgaaaggggagatctttacacaccctgtcgtgcaagcgctcgcgaaaaagtacgggaagacgccagctcaaattgtgctgcgctggaatttagagcatcgagtcgtgacgattcccaagtcggtgcgagaagagcggattcaggaaaacgcaaacatttttgatttccacctgtcaccagaggatgtcgaagctctcgatggattaaatgaagaccgccgcctcggacaagatccagactccttctcctttgatttttag

SEQ ID NO: 41152 - DNA, 675 bp, Bacillus halodurans
atgtcaattttacataacgattgggcagatgtattggaagcggagtttcagaagccatattatgtgcaattgcgtgaatttctcaaacaagagtacagcacgcaaacgatttatccgtcgatgtacgatattttcaatgctttgcattacacaccacttgcagaagcaaaagtggtgattttaggacaagatccttatcacgggccgaatcaagcccacggtttaagtttttccgtgaagccaggggtaccactaccgccatcgctgcaaaatatctttaaggagctgcgggaggatctcggctgccccattccaaacaacggtcacctaaccccatgggcagagcaaggggtactgctcttaaacacagtgttaaccgtaagaaaagggcaggcagcctctcaccgtggaaaagggtgggagagctttaccgatcgggtgattacctgcttaaatgaacgggagaagcctgtaatcttcgttttgtggggacgtcacgcgcaagaaaagcaagcgctgattacgaatgatcgccattacatcctcacagcaccccacccgagtccattttcggctaatcggggctttttcggtagtcgccccttttcaacgatcaaccgtattctccaagaacaaggggaaagccagatccattgggaaattccaaatctttga

SEQ ID NO: 41153 - DNA, 681 bp, Bacillus halodurans
atggattgtccttttgaagctgttatttttgatatggatggggtaattgcggataccgtcggattgcactatgaagccaatcaacatattgcaaaaaaattgagcgttacgttctcagaagaaatgaatcaatcgcttcaagggctaagccgtgagaaaaccgttcgtgccatttgtgatttgacaggtgaggaggtcagcgacgagcaggtgaaacagctgtcagagttgcgaaatgaacagtatcagcgcttaatagccgagttaacaccagccgacgctctcccaggcatttactcattcattcgtgaattgaaagaaaaaaaggtttcaatcgcacttgcgtcggcaagtacgaacgcccctcgagtattaagtaggttgcaattgatcgatgcgttcgatgtgatcgtcgatgttcaaaaggtaaggagagggaagcctgacccggagatctttttaacggcagcccaattactaggtgtgtcatccaatcgttgtgtcgcaattgaagacggggaagcaggcctaaccggtattttgcaaaccgatatgttcgctgtaggagtaggaacccattcagctatgaaaaaagcccactggcaagtagcatcaactgaagagttatccataaaaagccttataaatgctgttgaaaaaaccagaaataaggatatttga

SEQ ID NO: 41154 - DNA, 1662 bp, Bacillus halodurans
ttgaacagacaatggtggaaggaagcggttgcttaccaaatttacccgagaagtttttgtgactctaacggggacggaattggtgatcttcaaggagttattgaaaaattagattatgtaaaagacctagggatcgatgtgatttggatctgtccgatgtatcgatcaccaaatgatgataacggttacgatattagcgactatcaagatattatggatgagtttgggacaatggaagattttgatcaattattacatgaggttcatcgccgaggtatgaagctcattatcgaccttgtcattaaccatacatcggatgaacatccgtggtttattgaatcaagatcgtccaaggttaacccgaaaagggattggtatatatggcgtgacccgaaagaggacggttctgaaccaaataactgggagtctattttcaacggttccgcttgggagtatgatcaggctacaggccaatattacatgcatattttctcgagaaaacaacctgatttaaattgggaaaacagggacgtgcgtaaagcgttatatcaaatgattaattggtggctcgaaaaaggaatcgacggatttcgtgtggatgccatttctcatattaaaaaagtaaaagggttaccagatttaccgaatccaaaagggctcgattatgttccttcttttgaggggcatatgaaccgtgaaggtattcatgaatacttgcaagagttgaaacgggagacgttcgatcactttaatattatgaccgtaggcgaagcaaatggggtaactgtggaacaagcggacgattgggttggagaagatcatggtgcctttaatatgatctttcagtttgaacatttaggattgtgggataaaggagtaaatggcacggttgaccttgctgaactcaagagcatctttacgacatggcagaaaggacttgaaggaaaagggtggaatgcgttatttcttgaaaatcatgaccaaccaagaagcgtatccacatggggaaatgataagggatattggaaagaaagtgcaaaagcattggggacgcttttcttctttatgcagggtactccgtttatttaccaagggcaggagattgggatgacgaatgtccgttttccttcaatagaggactacgatgatgtagggatgaaaaacttttatcgaattgaaacagaaaaaggacgctctcatgaagaaattatggagatcatttggcaaaagggcagagataattcccgtacgccgatgcaatggaacgatcaaaagcatgcaggcttctcaacagcaacggaaacatggatgggggtcaacccaaattataaacaaatcaatgtagagaagcagctaaaagaagaggattctgttctatcttattataagaagatgattgaattaaggaagtcatcggacctttttgtctatggcagttacgatcttgtcttgcctgagcataaacagatttttgcctataagcgtacactagagaaagagagcgcgctcattctggtgaatatgtttgctgatgaggtatcgttccaattcccactcaagttaattggggagaaggaacgtgtgcttggtaactacaaaacacaaggggcgaaagataagctacgtccttatgaagcaagggtataccgctggcaatcttaa

SEQ ID NO: 41155 - DNA, 1734 bp, Bacillus halodurans
ttgatcgctcgatttttttcttactacaaaccatataaaggtttgttttttcttgatttcttttgtgcggtatttgttggaatcttagagctggcatttccgttagcagtcaatcaagtgatcgatcgtctgctaccagaagggaactggcagattattttttgggcgtgtgtcggtttgctttttgtgtatttgctaaacacggttatgcaatatgtcgtcacttattgggggcataagctggggatcaacattgagtctgatatgagaaaaaagctgtttgagcacatgcaaaagctatcatttggctattatgacaacaataagacaggtcattccatttcgcgacttacaaaggatttggaggagattggcgaggtggctcaccacggtcccgaagacgtgttcgtcgcggttatgacactcgttggtgcctttgcgattatgctgtcgattcattggcagctagcggttgctcttttctgcgttgtgcctttcattatcatttttgcggtttactttaataaaaagatgacgacaacttttcgccgtatgtttcaagatgtaggcgatattaatgcacgggtcgaggatagcattgggggaattagggtcgttcaagcttttgcgaatgagcgctatgaacaggctcaatttgcgaaaaacaatcaacgttatcggaaaacaaagctcgcgtcctataaaattatggcgcaaaatgtaatggcgaactatgtgctgatgcgctcgattacgctgctcactctgctagtcggaacgtggtttgtcatctctggaagcttgacatatggagagtttgtcgcctttattttattatcgaacattctgattcagcccgtccaaaaaattaatgccgtcattgaaagttatcctaaagggattgctggatttaagcgatatacagaaattctcgataccgaaccggatattgaagatgctccaggagcgaaagaatggaacattcaggggaacatccaatatgaaggggtcaggtttggttatgacgggatggaggatgtactaaaaaatattgatcttaccattcgtgcaggtgaaacagtagcgtttgtcggcccttctggagctgggaaaacgacgctatgtagcttgctgcctcgtttttatgaggtgaaggacggaaggattgtagttgatgggctcgacattcgtgaaatgaaactcgagagtttgcgcaatcaaattgggattgtgcagcaagatgtcttcttattttcaggaacggtgaaagagaacattgcctatggcaatcttcaagcaacggatgaagaaattatggaggctgctcgcaaggcgaagttggatgattttatcctaagccagccagatggtctggaaacggtcatcggtgagcgaggagtcaaactatcagggggacagaaacagcggctatcgattgctcgaatgttcctaaaaaatccacctattttaattttagatgaagctacttccgcccttgatacagagacggagctcgcgattcagcagtcgctatcagaattaagcaaaggcaggacgacgctcgtcattgcacaccgtctggcaacgattaaaaatgctgatcgaatcatcgttgtcacgaaagaaggtattgcagagcaaggaagccatgagcaattgctacaaacaggtggaatttatgctcgtttgcaccgggcccaatttggagaatttcttgttcgaacacaagtataa

SEQ ID NO: 41156 - DNA, 849 bp, Bacillus halodurans
atggaacatgtcattgaagtaaagcacttgagaaaaacgtttgatggtaaagaagcattaaaagatgtctcattttcaattaaaagaggggagacgtttggctttttaggaccgagtggcgctggaaaaacgacaacgataaaaattttaacaggtcaggtccgctccttcgatggagaggttgctttgttcggcaagcccgtgcacagactcaaacggaaaacatttatgagtcaaattggggttttaacagataatagtggcctttatgagcggctaacagttcaagataacctctccatgtattgcaagctctattccgtacctgaacgacgaatccatgatgttttagccgaggtcggtttacgtgatgagagagcaaaaatcgtcagcaagctgtcgaaaggaatgaagcaacgtgtcattttagcgcgagcgatgctccataaaccagatttactatttttagatgaaccgacctccgccttagatccagcaagttctcatatgattcacgatagcttgcgccgtttgaaccgtgagggaacgacgatctttttaacgacgcacgatatgctggaagcggaaaaaatctgtgatagggtagcgttcctcgaccaaggaaagattcgagtcatggatactccagagcagctgcgattaacctacgctgattcaacgattacgcttctgctaaaaggggggcgtcgggagattgtagagaacaatctagacggggcgaacaccatttcacaggtgatgaaaaatggggaattgctctccattcattccaatgaacccactttaggcgatgttttcttgcgggtaacgggaaaggagcttatgtag

SEQ ID NO: 41157 - DNA, 741 bp, Bacillus halodurans
atgcgacttaacggaaaggtagcaatgattacaggagctggccgagggataggggcagcaacggctaaaaaatttgctagagaaggggcaaaagtgatcgtttgtgatgtgcgggaagaagaggtggcaaagacggtggccgaaattcaagacggaggtggtgaggcgttaggatcggtcgttgatgttacgcaacgcaaggatgtgaaaaacgttataaatcaagtgattgagcgatttgagacgctagatgtggtcgtgaacaatgcgggaatcacagccgatgcccagttaacgaacatgactgatgctcagtgggacgatgtgatcgatgttaacttaaagggggtgtttattgttacacaagaggtgacgaccattatgaaagagcagaaacgaggggtcattttaaacgcctcatccgttgtaggctcttacggaaactttggccagacgaattatgccgcttccaaatggggagtgaatgggatgacgaaaacgtgggcgaaagagctcggccgttataacattcgtgtcaatgctgtggcaccaggattcattctcacaccgatgacagaaaagatgccagaaaaagtattaaaggtgatggaagaaaaagcggtactcaaccgactaggcacagtagaggaagtggcgaacggctatgcctttcttgcatccgatgaagcgtcgtttattacaggaacgattttggccatcgatggcggtgtcgttatatag

SEQ ID NO: 41158 - DNA, 1188 bp, Bacillus halodurans
ttgaatgcagattggctacatgcgatagaggaaaagctcacgagattaaaagaccggggctcgtttcgccaacttgtgcccacatccgaggccgcgctcccttggttgacacgagagaactgcaggctccttaatttggcgtccaataattatttaggaattgccgattcaaaggaattcatcgaaagaaccgaacaactcgcttcatcctatgccattggctcgactgcttcccgtttaattatcggcaaccaccctctttatgaggaagccgaatacgagctgacaaagtggaaaaaaactgaagccgctctgattttcggtagtggttatatggctaatgtcggtattatatcctcgattgtagggcgcggagatgccgtatttagtgataagttaaaccatgcctccattgttgatggctgtcagctgagcagggccgatcatcttcgcttccggcataacgatatggatcatctcgaaaccctgctacaaaagtcaccccataaacagaagcttattgtagtagacgctctctttagcatggacggcgaccacgcaaaccttcatgatcttgtcacactaaaagagcgatacggagccattttaatggttgatgaagctcacagtggcggtgtgtacggggcaacaggcggcggacttgtggaggagctgggcttaaacgatcgcgtggacattcaaatgggaacgtttagtaaggctctaggtagctatggtggatacgttgctggggctaaaccgttcatcgagtatcttctcaaccatgcacgcagccttatttttacgacggccctccccccttacatcgtcgcatcccatctagcagctttgcaaatcgttcaggagcagccgtggaggcgggaaaaagttcaggtgctgggagagcgcctacgcaacggacttgagcagcttggattctcgttatgcggtagtgaatcctatatcgtgcctgtcctcattggcgacaaccatgacctcctccttgtgagtgaatcgttacaagcagcaggaatagcagcaattccggtgcggccgcctaccgttcctcgcggtgaaggtcgcattcgcttaacagtgaccgcctcccacacggagaaagacattgactgggcgattgaacagtttcagagattgccactcgtagggcgaagggagttaacaccatga

SEQ ID NO: 41159 - DNA, 1401 bp, Bacillus halodurans
atgacaaaagatactgttacttatcgctttccagaagggttttggtgggggtctgctacctccgcaacgcaaacagaaggagcgactcatcgtgatgggaaaggaaaaaatatttgggatcattggtacgaagttgagccgagtcgcttttttcaaggtgtcggcccacaagacacgtctcaattttacgagcggtataaagaagatattcaattaatgaaagaggtcgggcacaactcatttcgtttttccatctcatggtcaaggcttattcccgatggacgaggggaagtgaaccctaaaggagtagagttttataacaatgtcattgacgaactgctaggtcaagggattgaaccttttgttaacctctttcattttgacatgccgatggaacttcaaaagattggcggctgggcaaatcgcgaagttgtcgatgcatatgaagcttatgcgaaaacatgctttgaacgatttggggatcgcgtaaaaaaatggtttacgcataacgagccgatcgttccggtagagggaggatacttgtacgacttccattacccgaacgaagtagactttgaaaaggcgattcaggtaggttatcatacggtgttatcaagtgcaaaagcgattagggcttacaaacaattgaatcagggtggcaaaatcgggatcattttaaatttgactccttcctatccgcgaagtaatcaccctgcggacttaaaagcagcaaagatcgcagatgctttttttaaccgctcctttttagacccgtcggttaaaggggagttcccagaagagctcgttcaaatcttgaaagaagaaggctttatgcctattatagaagaagaagacttagagattattcgccaacatacggtggatctgttaggtgtgaattattatcaaccgagacgtgtgaaggcaaaagagaccctcccaaatccggatgcaccttttatgccagagcgctattttgatcactacgcgatgcctggtcggaaaatgaacgttcaccgtggatgggaaatctacgaaaaaggaatttatgatattctcatcaacctgaaggaacattacggaaacattgaatgctttatttccgaaaatggaatgggggttgaaggagaagagaagtttcgtgatgaaaatggtgtgatccatgatgactaccgaatcgaattcatccaagatcatttaaaatgggtgcatcgggcgattcaggaaggctctaacgttaaggggtatcacctatggacgtttatggataactggtcctgggcgaatgcctataaaaaccgctatgggttggtgtctgtcaatttagacaagaatggggaacggacaattaaaaagagcggaaaatggtataagaccctttcggagaataatggattttaa

SEQ ID NO: 41160 - DNA, 1107 bp, Bacillus halodurans
atgagcataaaacagccgttcgttcctggtttagatcgcgtgattgcagcagagaccgcgatatcttttcttgatacagaacgagaaaagattattattagaggtcatgacttaattgatttatccgtaagcaacgattatctagatatcgttcatttattattagacggaacattgccaaatgcctcagaaaaatccgcattggaagacacgctgaagaaacattacgacatcccttcatatgtcatggaaatattgagtttgttaccggagacaacacatccaatggacggcttacgcacaggattgtcagcgctttcttcagttgacaaagagatcgagaatcgctccactgaagcaaacaaagcacgggcttataaactgttagggaaattgccagctattacagtaaatagctaccggcttataaacggtctaaaaacggtacagcctgttccgactctttcatatagcgccaatttcctttacatgatcaccgggaaagagccaaagccatttgaagcgaagatttttgaccggtctttacttttatatagtgaacatgaaatgcctaactcaacgtttacggctagggtcattgcttcaacccattctgatctttatggagcattaacagggggagtcgcttcattgaaagggaatcttcatggtggtgccaacgaagccgtgatgtatatgttacagtcggttgattcagctgctgagttccagcaattaatccagaagaagctagtcaataaggaaaaagtaatgggctttggtcacagagtttatatgaagaaaatggacccgcgtgcactagaaatgaaggaatccttaaagcagctgtgtgagaaaaaaggagattattctctgttagatagatgtgaggctggagaaaaaacgatgcttgaggaaaaagggttgtatccgaacctagattactatgcagcacctgtctattggatgttagggattccaattgaattatatacacccatattctttacagcccgaacagctggtttggccgcacatgtcatggaacagcatcagaataatcgtattttccgtccgcgagtaagttatatcggggaaagctactaa

SEQ ID NO: 41161 - DNA, 933 bp, Bacillus halodurans
atggctattactaaaggaaacaaaattgtcttagttggtacaggtgcggttggttcaagctatgcgtatgcgttaatgaatcaagggatcagtgacgagctcatcctagttgacttaaatgaggagaaggcgaaaggggacgtattggacttaaatcatagcattgtgtacgcacctagcccaatggaaattaagttcggttcatatgaggattgcaaggatgcagcacttgttgtcatctgtgccggggctgcgcaaaaacctggggagacgagattagatttagttcataaaaatgtgggcattttcgaatcgattgtaggaaacatcatgaagtccggctttaatggcatctttctagttgcgacaaatcctgtcgatattttagcgtacgccacttggaaattctcaggcttgccgaaggagcgtgtcattggctcaggaaccgtgttagatacggcgagatttcgctatttgcttggagaagaaatgaacgctgcgcccacaagtgttcatggctacattatcggcgagcatggggattcacagctgccggtctggagctctgctaccattgcgggaacgccaattgctcctagattaaccgacgagaaaaagcaagaaattgctgaaaatgtgcgcgatgccgcctacaaaatcattgaggcgaaaggggcaacgtattatggtatcgccacagggttagcaagaattacgcgagcgattttaaaaaacgaaaatgttgttctccctgtcggtacgttgttagaaggagaaaatggtcatgacgatgtctatattggcgtaccagcgatcattaatcgtgaaggcgttagacaagtggtcgagctttccctaaacgacgaggaaaaagaaaaatttgctcgctctgttgaaacgttaaaagacattcaagcagccatttggtcgtag

SEQ ID NO: 41162 - DNA, 1548 bp, Bacillus halodurans
atgttaacaccttataagcatgaaccgtttacagattttagtgtagaagaaaaccgcagcgcgtttgaggctgccttaaagaacgttgaaggggaattagggaaagactacccgttagtgatcaatggggaacgtgtgacgaccgatgataaaatcgtttccgtgaatcctgccatgaaagagcaagtgatcggcgtcgtctcaaaagcaagtcgcgagatagtagatgatgcatttaaatcggcagagacggcatttcatacgtggaaaaacgtcaatcctgaagagcgagcgaacatcttaatcagagcggccgcgatcattcgccggagaaagcatgagttttcggcatggctcgtgaaagaagcgggtaagccttggaaagaagccgatgcagacacagcggaagcgatcgactttttagagtactacgcccggcaaatgattacgctaaaggatggaaagccagtcaatagtcgcgagggtgagcataatcgctacttctatacaccgatcggggtatgtgtcacaatctcgccttggaatttcgccttggcgattatggctggaacgacggtagcgccaattgtaacagggaacaccgtcttactgaaaccagctagcacgacccctgttgtcgccgcaaagttcgtcgaagttcttgaagaagcaggtttgccaaagggtgtggtcaacttcgtcccaggaagtggaacagacatcggtgactacttgatcgatcatccaaaaacaagcttgatcacatttaccggttcgcgtgacgtgggagtccggctttatgaaagggcagcggttgttcatccaggtcaacagcatttgaagcgcgtcattgtagagatgggaggaaaagataccgttgttgtcgataaggatgccgatctcgatttagctgctcaatcgatcgtgacctcggccttcggcttttctggacaaaaatgttctgcaggttcgagagctgtcatccatcaagacgtctatgatgttgtgttagagaaggccgtggccctcacgaaacaactctcagtaggcgaaccgacggcacctgacgtctatatgggacctgtcgtcgatcaaggagctttttcgaaaattatgagctatatcgaagtggggaaagaggaaggccgattgatggtcggaggtgaaggagatgattcaaaaggcttcttcattcaaccgacgatctttgctgacgtagatccccatgcgcgaatcatgcaggaagagattttcggtccagtcgttgccttcagtaaggcaagggattttgatcatgcgctagaaatcgccaataataccgagtacggtctgacaggagctgtcattacaacgaaccgtcaccatatcgaaaaagcgaagcgagacttccatgtaggaaatctatactttaaccggaattgcacaggcgcgattgtcggctaccacccattcggcggctttaaaatgtcaggcaccgattcaaaagctggaggacctgattatttggcccttcatatgcaagcaaaaaccgtctccgaaatgtattaa

SEQ ID NO: 41163 - DNA, 1263 bp, Bacillus halodurans
atgggggccattgcagaaaaaggaaaagagtctagcattctatcgtcaacgcaagatgtgattcaacaagcgttagggaagctaggctatgaagagggaatgttcgagttgctcaaggagccggtgcgaatgctaacggttcgaatccctgtgcggatggacgacgggaccgtcaaagtgtttactggctatcgcgcgcaacacaatgatgcggttgggccgacaaaagggggcgttcgcttccatccggaagtgacagccgatgaagtgaaggcgctctcgttatggatgacgttaaaatgcggaatcgttaacattccgtacggtggtgggaaaggcgggatcgtatgtgatccgcgaacgatgtcatttcccgaaatcgagcggttaagcagagggtacgtaagagcgatcagtcaaatcgtcgggccatctaaggacattccggcacctgacgtatttacgaactcgcaaattatggcgtggatggtggatgagtatagccggattcgagagtttgattcacctgggttcattacaggtaaaccgatcgtgctcggcggctcccacggacgggaaacagcaacagccatgggggtcacaatttgcattgaagaggcagccaagctgaaacagctggatttacgggaggccaccgttattatccaaggctttggtaatgcaggaggctacttagccaaaatcttgagcgatcgcggggcgaaaatcattggtatttccgatgcgtatggggcgctctatgatgaaacaggcttagatattgagtatttgcttgatcgccgcgattcatttggcaccgtgacgacgttatttaaaaacaccataacaaacgaagagctattagaaaaaaagtgcgacattctcgttccagcagcgattgctaaccaaattacagaggcaaatgctcgcgaaatcaaagcttcgatcattgtagaggcggcgaatggcccaacaacgactgaagcaacaaatattttaaccgagcgcggtgtcttaattgtgcctgacgtgcttgcaagctctggtggtgtcaccgtttcgtattttgaatgggtacagaacaatttaggttattattggtcggaagaagaagtgtccgagaaacttagaagtaaaatcgttgaggcgtttcatcaagtggtggaaacagcgacgcgttacaacgttgaccctcgtttggcggcctatatggttggcgtacgaaaaacagcagaagcttcaagattccggggctggatttag

SEQ ID NO: 41164 - DNA, 1203 bp, Bacillus halodurans
atgaaaatgcaatcgtcaacatctgctgtcattgagaagacggaaaagtacggggcaaaaaattatcacccgcttccaattgtcatttcagaagcaaaaggagtttgggtgaaagaccctgaagggagaaaataccttgatatgttaagtgcgtattctgctgtgaatcaagggcattgtcacccgaaaattatccaagcattaaaagatcaagccgataaaattacattaacctcgagagcatttcataacgatcaacttgcacctttttatgagaaggtatctaagctaacggggaaaaacatgcttttgccgatgaatacaggtgcggaggctgtcgaaacagctgtaaaagcagcgcgtcgttgggcttacgatgtgaagggtgtgcctgataatcaagccgaaatcatcgtttgtgaagacaattttcatggacggacgatgacggccgtctccctttcttcaaatgacgagtacaagcgaggattcggcccaatgcttccagggattaaagtgatcccttacggcgatttagaagcgctaaaagcggcgatcactagtcacacggctgcgtttttagtcgagccgattcaaggggaagcgggcattcgaattcctcaggaaggcttcttaaaggaggcgtatgcattatgtaagcgagaaaacgtcttgtttattgcggacgaaattcaatcagggcttggacgttctgggaaatggttcgcgtgtgactgggaagatgtgaagccagacatgtatattttagggaaagcactcggtggcggggtattcccaatttccgtcgtatgtgccgatcgcgacattctcggtgtctttgagcctggatctcacggttccacgtttggtgggaatccgctcgcttgtgctgtgtcaattgctgctctagaggttcttgaagaggaaaagctagtcgagcgttcctatgagtatggaaattacttgttaacgaaattaaaagagattgataacccgatcattaaagacgtccgtgggagaggtttatttatcggcgtcgagttacacgagcctgcgcgtaaatattgtgaacagttgaaagaagaaggacttttatgtaaagagacacatgaaactgtcattcgcttcgctccaccattagtgatcagtaaagaagatctagattgggcgattgaaaaaatttattacgtgttaaaaccatga

SEQ ID NO: 41165 - DNA, 906 bp, Bacillus halodurans
atgaacaaatttcaaaaagtttcgattattggagtgccaatggatttaggacagaagcgtcgaggggttgatatgggaccgagcgcgatgcgatatgccgggttaattgaagagattgaggcccttgggtttgaagtaaaagattatggggatattccgatcaatcgcccagcaacgagtgagactcaggaggggccgctcagaaatctggatgaagttgtaaaggtgagtgaggagttgtgcaaaggggttgcggcaatcgaagcagagcatagcttccctctcattttaggcggcgaccatagcattagcatcggttcgattgcaggtatcagaaaaagctacaataaccttggggtcatttggtatgatgcccatccggatttaaatacagaagagacatcaccatctggaaatattcatgggatgccgttggcggttaatcttggcatcgggcatgagcggttaatgaacatagggggcattactccgaaagtgaaacctgaacatattgtcattatcggggctcgctcgatcgatgagggagaacggcaactcattagggaacaaggcattaaagtttatacgatgcacgaagttgatcgaatgggcatgacgagagtgattgaagagacgattgactatctttctgcccgcaccgatggcgtccatttaagctttgatttggatgggattgatccagtcgatgcaccaggggtaggcacaccggtattaggggggatttcgtatcgggagagtcatttagccctggaaatgctcgcggaatcggaattgattacgtcagctgaattcgtggagattaatccaattctcgataacaaaaaccaaacggcaaacgtggcggttgcgttagtgacctcgcttttaggaaagaagctactctaa

SEQ ID NO: 41166 - DNA, 1047 bp, Bacillus halodurans
ttgcaggctttaagatggcatggagtaaaagacgtaagagttgacgacatcgcagaacctgcaacgcttaaagggaaagtaaagattaaagtgaaatggtgtggcatttgtggaagtgatcttcatgagtatgcggccggtccaatctttattccacaaaatagccctcattctctaacggaagaaaaagctccgattgtgatgggccatgagttttctggacaagtggtggaagtaggcgatggtgtgaccaaatgtgaagagggcgaccgtgtagtggtcgagccgatttttgcttgtggtacttgtaccgcctgcaagcaaggaaagtataatctttgcgagcaattagggttcctcggtttagctggaggtggaggtggtttctcggaatatgtgacagtagacgagcacatggttcacaaaattccggacactgtatccttcgagcaaggggccttagtcgagcccgccgccgttgccttatatgcggtccgccagagccagtttaatgtcggtgaccaagcggttgtattcggtacaggcccaatcggattattggttattgaagcgcttaaagcttcgggggcctcaaagatttacgcagtagaactctcaaccgaacggagacagagagcagaacaattaggtgccattgccctgaacccagcggaagtaaatgtagtggaagaaattcagcgtctaaccgatggcggtgctgatgtgtcctttgaagtaaccggtgtccctattgtcttaacacaggcgatcgagtccaccaagctaaacgggcaaacgatgattgtgagcatctttgaaaaagaagcctcttttcaaccaaacctagttgtcatgcgagaacgaaacattgcagggattattggctaccgcgacattttcccagcggtcatcagcttgatgaatcaaggctacttttccgctgagacgttagtcaccaagcggatcggcctacatgacattgtagagcaaggcttcgaggctttaatgaagacgaattgtaatattaagtgcgacaccacaaaataa

SEQ ID NO: 41167 - DNA, 1140 bp, Bacillus halodurans
ttgttcgttaaaatgcgttttgaagaattaccgacgccatgttacgtagtggatgaagcgctcgtggagaaaaacgtaaaaatcctaaacggcatcatgaagcgcacaggagcaaaaattgtgttggcgcaaaaagctttttccatgtcgaccatgtacccgctcatcggaaagtacttaacgggtacaacggcaagcggcttgtacgaggcacgattaggtcatgaggagatgggcaaagaaaatcatatctttgcccccgcctatcgtgaagatgaaatcgatgaaatcgtctcgatttgcgaccatatcatctttaattccttctctcagcttgagaagtttaaacagagagctcttgatgctgggagtaaagtgggcttacgcatcaaccctgaatgctccacccaagtgggccatgagatttatgatccttgttcaccaggctctagattcggtgttaaacaggaagatgttcgtcaggagctgcttgacggggtgtcaggacttcacttccacacactttgtcagcaaaactctgacgatttagaaacaacgcttgatgcagtagaagaaaagtttggccagtggctaccgcaaatggaatggatcaactttggtggtggtcaccatatcacaagggatgattacgatatcccgagattggaagcttgcattaagagaatgcaggacaaatacggtttggaagtctaccttgaaccgggcgaagcgatcgcgcttaacgcgggctatctcgtcacgacagtccttgacctccataaaaacggaatcgacattgcgattttggacacgtccgccacttgtcatatgcccgacgtcctcgaaatgccttaccgccctcctcttttcggatcaggggaaccaggcgaaaagccgttcacctatcgactcggaggcccgacctgcctgacaggtgacgtcatcggtgattattcgtttgaccagccattaaaaagcggcgaccgattagtttttggggatatggcgatttactccatggtgaaaacgaacacgttcaacggcatgccacttccagctattgccaccaaacatcaagatggcgattgtcaggttgtacgccaatttggctatcaagactttaaaacacgactagcgtaa

SEQ ID NO: 41168 - DNA, 774 bp, Bacillus halodurans
atgagccatacagccatttctgtaaaacggttaaaaaaatcttttaaaaacaaggacgttttaaagggggtggattttgcggtgcagcgtggtgaaattttcgcactgctaggctcaaatggcgcgggcaagacgacgacggtcaacatcctctcgacattgctgaagcccgatgagggtgaagccagtatttgcggctttgacgtccaacgtcaaccggatcatgttcgccagagcatcagcctgacaggacagttcgccgctttagacggtatgctcacagggcgggaaaacctgatgatcatcgccaagttgcgaggagttcctaatccctctcaagtggctgaccatttgcttgcaagattcagcttaaccgatgcggccaatcggcgggcggaccagtattccggcgggatgaaacgccggcttgacatcgccatgagcctgatcgggaagccagccgtcatttttctcgacgaaccaacgacaggactggaccccgaaggacggattgaagtctgggatgccgtcaaggagcttgcaggaggcggcacgaccattttgctgacgacacagtacttggaggaagccgaacaacttgcggatcgtatcgccatcctgcatgacggaaaaatcatcacgactggtacccttgctgaactcaaagaaatgttcccaccagcgaaagtggagtacgtcgaaaaacagccgacattggaggacattttccttgcgattatcgggaaaaaggaggaaaaagtaaatgaaaagtaa

SEQ ID NO: 41169 - DNA, 1602 bp, Bacillus halodurans
atggtgttgatatgtactattctattcatcttggcttcttgtgaatcagataaagaatttgttagtaaggattgggaaaagtcaacaacaattaaaattacaagcggctttgatcatgaaacaaggctttttaaggattactctattgaagatgaggtttttcaaagtgttgatgatatcagaaggcagattgaaattgccgagttaattaattatgaatatgacaaatctttaatttatgattcattaaacaggttaaaagatccagctctagataatgagtttgatgttagagaaaatttaattatgtattacttataccaggaagtattggaaattaccgatgaagacattgattatgtagcagtgactaatgatattattaaaaaaaaatcaaatgatgaagatgaaaaatatgtagacttagatattgtttacattgttgtgtattatttttctgaacaattgaaagaagatattaaaattaaaattattgattggcttgaaactaattgggatacatttgaaatagatataggatcaaccctttctgtacttgagatttctcatattttagacaaaccattaaatatagaatttgatagagagcactactcaaaattactaattgattcaacagagagtacaaacgatttattagaagtttattacttagtactcattaattcatttttggaaaatcagatagataaaaatgctgtaagagatacagtattaaaattttatagtgatgttgatggattttcggtttcctctgattactattttgatggtaatttgggtacttttatgggtttgaagatattaaaggaagttgattacttagagcttgtaaaggacgaaatatatgaactattcaaatatagcgaagaatcctatggtgggtttgtaaataaggccaatatagtatcaggttcagcaatagaaactattatggcagcatatgttttaactgagtttaacaacgatttggattacgacctatctgttttaatagaagtgagcgaactaagctggttttggtcatatcaatatataaagatcggtaaatatagcgaaaaagatctagaacaactaaaagacgatttaaaatattttgaacatgaagttgttaatattaaggaaagtgatatagaagagatacttaacattagtggattactgaatgaaattgaatatgcttcaaaactagccgcattgatagactataaatttaatgaggaatatatcgataaaatgtatactattttagcagaagctaatgagctttctataagtgagtttaccttggactcttttactcaagttgtttcaatgaatgaattttttgattttcaactttttagtattgaagaagttgagagctacatatctaaaattcttaagactaaagacgaattgaatttttatgatgtgtacaatatactaaaggtagctaaactttacaattttgatgaaggagaaatagaacaattaatgcaaagttatattaatgaaaatggcggtatcaacacagtaccttcagttaattcagacactttgcatacaacttttctttatatttacattatgtcaaattaa

SEQ ID NO: 41170 - DNA, 1287 bp, Bacillus halodurans
atgtcatcagttgttgttgtcggtacccaatggggagatgaaggaaaaggaaaaattacagactatctctctgagaaagcggaagtagtagctcgttaccaaggtgggaacaacgcaggacatacgattgtgttcaatggtgagaaatacaaactgcacctcattccatctggtattttttacagcgataaagtttgtgttattggaaacgggatggtgattgaccctaaggccctcgtggaggagcttgcttacttgcatgagcggaatgtggatacgagcaatttgcgcattagcaaccgcgctcacgtcattttgccttatcatttgaagcttgatatcgtggaagaagagcggaagggtgccaataaaattgggacgacgaaaaaagggatcggtcctgcttatatggacaaggcggcccggatcgggattcgaatcgccgatttgttagataaagaagtatttgaggaaaagctcgagcgtaacttagttgagaaaaaccgtctatttgagaaatattatgaagtaggtggtttcaacaaggaagacatcttagatgaatattatgagtatggtcagcaaatcgctcgttacgtgtgcgatacgtccgtcgtgttaaatgatgctctcgacgaaggccgccgcgtgttatttgaaggagcacaaggcgtcatgcttgatattgaccaaggaacgtatccattcgttacgtcttctaacccgattgccggtggggttacgattggatcaggtgttggcccatcgaaaatccatcacgttgtcggtgtatcgaaagcctatacaacacgtgttggagatggtccgttcccgacagagcttcatgatgagatcggtgatcaaattcgtgaggtcggaaatgaatatggtacgacgactggccgcccgcgccgtgtgggctggtttgacagtgtggtcgttcgccatgcccgccgtgtcagtgggattacggatctatccctcaactcaatcgatgtgcttacaggcatcaagacactcaaaatttgtacagcctacaaatatcgcggggaagtggtcgaagaattcccggctagcttgaaggtgctcgctgaatgtgaaccagtctatgaagaactaccaggctgggatgaagacattacaggggtaacctctctcgatgaattacctgtaaatgctcgtcattacattgagcgtgtctcgcaattaactggcattccgttaacgattttttcggtaggtcctgatcggaagcaaacaaatctcgttcgtggcgtatttgcgtaa

SEQ ID NO: 41171 - DNA, 2124 bp, Bacillus halodurans
atggctgaccaagcgaccgttgaagtgaagaaaacaacctaccgcgttcaagggttttcttgcgctaattgtgccaatacatttgagaaaaatgtaaaggatttacatggggtcgtcgaagcccaagtgaacttcggggcctcaaagcttactgtttacggtgatgccacagtggaagacttggaacgtgcaggggcgtttgaacatttaaaggttcgtcctgaaaacgaaaaggcgatagagacgaaggagccgttttggaaagcatacggccacgtgatcgtttctgccctcttgttgctagtaggtgtggtctcgtattttatgaaaggagaaaggcatctgtggactgtctctttatttgcctcatcgattgttattggcgggtactcattatttaaggcaggtttctataacctcatacggcttcgctttgacatgaagacgttaatgacggtggctgttattggggcggcgctaattggcgaatggctggagggggctgtcgttgtgatccttttcgcaattagtgaagcgttagagcgattttctatggatcgggcgcgccaatccatccgctcccttgtcgatatggcgccgaaagaagcgctggttcgccgtaacggggaagagctggtgattccggtggaagcgatcgaagtaggggacatcatgctcattaaaccagggcaaaagcttgccatggatggcattgttcgctctggtcgctcctcgatgaacgaggcggcgattacaggagaatccgtacctgtggaaaaaatggtcggagacgatgtgtttgcagggacgttaaacgaagaaggctttttagaggtagaggttacgaaacgggtcgaggatacaacgcttgcgaaaatcattcacttagtggaggaggcgcaaggagagcgcgctccatcgcaagcgtttgtcgatatgtttgcaaaatattacacaccggcgattatggtgattgctgctctcgtagcgacagtaccgccccttttctttgccggaagctgggaaacgtggatttaccaagggctagccgtgctcgtcgtcggctgcccgtgcgctctcgtcatttctacccctgtgtcgattgtgacggccattgggaatgcagcgcgtcacggcattctcgtgaaggggggcatctacttagaagaggcggcaagactgcgtgccgttgcctttgataaaaccgggacattaacaaaagggaaacctgctgtcaccgattatcaagtatacgatgctgacacggatggacgtgagctgttagcagctgttgccgctttagaataccgctcgcagcaccctcttgcagcggcggtcatgaaaaaagcagacgacgaacagctttcctatacagacatggaggtttccgagttttcttcaattacaggaaaagggattgccggcacagtgaatggaatcgctattaacgttggaaagcctgccttgtttggcgagttacctccagctattgaagcggatgtagctcgcttgcaagcagctggtaaaacgatcatgcttatcggagcggagcaaaaggttctcgccttactcgctgtcgccgatgaagtgagagaggtgagccgtacggctgtggagcgtcttcatgcgcttggcattacgaagacggtcatgctcacaggagataaccgcatgacggcccgcgccattggaaagcaagtcggtgtagcggaagtagaggcagagcttttgcctgaagataagctcggctttgtgaagggcttgaaggaggagcacggccgtgtggccatggttggggacggagtgaacgatgcacccgcgctagccgcctcttctgtcggtgtggcgatgggaggagcgggcaccgatacagcccttgaaacagccgatgtggctctaatgggggacgacttacggaagctaccgtttttaatccgccttagccgaaaagcattgctaataataaaagaaaatattgctttttctctcggaataaaactcgtcgccttgttcctagttgcgccgggctggctcacattatggatcgccatcttagccgacatgggagcgacactgctcgtcacactaaacggattacgactgttgcgaatgaaggacgaataa

SEQ ID NO: 41172 - DNA, 960 bp, Xylella fastidiosa
gtgtctggtgcgaccgcttcttttctttcaattcagactgccatgagcgatttcgaccgcgtccgcgattaccttactgccctacaagatcgcatttgcaatgtggtcgagaccattgatggtcaatcacattttcacgaagaccactggcagcgtacggaagggggcggtggacgtacccgtctcttgcgtgatggtgccgtcttcgaacaggcaggtattggcttctccgatgtctgcggtacacatttaccaccatcggccagcgtgcgccgtcctgaactggctggtgccaattggcgtgcctgtggcgtgtcactggtattccatcccaaaaatcctttcgtccctaccacgcatctcaatgtgcgctactttcgtgctgagcgtgatggaaaacaggttgctgcttggtttggcggtggttttgacctcaccccgttttatccctttgatgaagatgtcgtgcactggcacacagttgctcgtgacctatgcgccccatttggcgacgaacgttatgcagcgcataaacggtggtgtgacgaatacttcgtactgcgtcaccgcaatgaaacacgcggtgtgggcggcttattctttgatgaccttgataaggattttgagcgcgattttgcttaccagcgtgcggtaggggatggcttcctcgacgcttattttccgattgtgacgcgtcgtcatgacaccccctacggtgatcgcgagcgcgcgtttcagctgtatcgacgtggtcgctacgtagaattcaatttgttatttgatcgcggcacattattcggcttgcagagtggcgggcgtgctgaaagcatcttgatcagtctgccgccgttggtacgctgggaatatggttaccaccctttaccaggcagtgccgaagcgcgtttggctgactatctgttgccacgtgactggctgaatgaaagtcgcatttgcgaatga

SEQ ID NO: 41173 - DNA, 1143 bp, Xylella fastidiosa
ttgtctcctccgcttggtctatgtctaaatgttctgagattacatcccatgccaccatttaccgacgacctccgtatccgcaaaattgaaccactgacacctcctaaccagctcctattgcaactaccatgcgatgagcaggcatcgctgactgttgcgacctcacgcaacgcactgcacgatatcctgcacggccacaacgaccgtttagccgtcgtgataggcccatgctcaatccatgatccaattgcagccattgattacgcgcaacgtctacacccattgcgtgagatgtacaaggatgcactagagatcgtgatgcgggtttactttcagaaaccgcgcaccaccattggttggaaaggattggtcaacgatccggatcttgatggcagcttccaaatcaataagggcctgcatatcgcgcgcaacctgctacgcgatatcaatcatctcggcttacccgctggtgtggaatttctagacacgatttcgccgcaatatctggctgacttagtcgcctggggtgccattggtgcacgcaccactgagagccaaatacaccgtgaaatggcttcaggtttatcgtgcccgattggctttaaaaacagtaccagtggtgatgtgaaaattgctgctgacgcgattaaagcagcttcgcatccgcaccatttcctttcagtgacaaagacaggtgttgccgcagtcgtcgccacccagggtaaccccgattgtcacgtgattctacgtggaggcagggtcccgaattacgacgcaatcaatgtcgaagctgccagccaaacattgcttaaatccaagctaccggtgcgactgatgattgatgcgagccatgccaatagcggcaaaaacccaaacaatcaacccaaggtgatcgagaacatcgtagaacagcttgaagccggtgaacgccgcatcgtcggtgtcatgattgaaagccacattgttggtggtcggcaagaattagtccttggaaacacacttacctatggacagagcattaccgatgcttgcatcgactgggatacctcggtcgcaatgttagagcagctcgctcaggccgtacgcgtcagacagactctaccaacgaccgctacaactaacaaaacatcaaaaacccaataa

SEQ ID NO: 41174 - DNA, 1203 bp, Xylella fastidiosa
gtgcccttatttacagatgtggaattggttccaggtgatcccattctgagcctcaacgatacttataacgccgatacacgtaccaacaaggtcaatttgggtattggcatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagtcgactcccccttgttgacggctggccgtgtggcgacctcacagactattggaggttctggggcattgcgggtgactgctgaggtactgaagcaggtgctaccacatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtattgatctggcttaccaaggattcaatcagggcattgatgcggatgcttatgccatacgtttgcttgccgaagaaggtattagtaactatgtagttgccaactcgtactccaaatcgttctcgttgtatggcgagcgtgttggggggctgtcgatcgttgcttccaatacggagcaagcccaagcaatccagtcacaagtaaagcgtattatccgtacgatttattccagtccgtcggcacacggcgcctacttggtcgcaggtgtgctcaacagtcatgagctgcggacgctgtgggagcaggagttaacccagatgcgtgaacgtatccacgggttgcgtgcgggtttggttgctcgattgacggcgctgggtgcgccggagtttgatttcatacaacgtcaagcaggcatgttttcgtattcggggctgagcaagatccaggtggatcgtttgcgcgacgagttcgggatttatgcggtcagtagtggacgtatctgtgtggctgcgttgagtcagcacaaattggaatacgtggcgcaggctgtggtgaaggtgcatcaaggctga

SEQ ID NO: 41175 - DNA, 468 bp, Xylella fastidiosa
gtgcccttggattccaatagcatggctcatttgctgctgttacatggtcctaatttgaatttgcttggtacccgtgaacctgagatctacggtcgtatcacgttgccgcagattgatgcggccttagccgaacgcgccacggctgctggtcacggactgagtagtttgcagtcgaatgccgagcatgtgttgattgaacgtattcatgccacgccggaggatggcactgcgtttatcttgataaatcctggggcgtttacccatacctcagtggcgttacgtgatgcgctgcttgcagtagcgctcccgttcgtcgaaattcacctttctaacccgtatacacgtgagccgttccgtcatcacagctatctggctgacaaagcattgggcgtggtgtgtggttttggggtggacagttaccgtattgctctggagggagtgattgccagactcggctctgacgtctga

SEQ ID NO: 41176 - DNA, 1410 bp, Xylella fastidiosa
ttggccgttgccttaaggacgccgtacttcggaacctttctcatgttagacaaagtcgttattgccaaccgtggtgagatcgcgttgcgtattcttcgcgcatgccacacgttgggtatccgcacggttgcggttcactctaccgttgatcgcaatctgaagcatgtcgcgatggctgatgagtcggtgtgcattggctctgcaccctctgcggagagttatctcaatatcccggcgctgattgccgctgctgaggtcacggatgctcaggccatccaccctggctatggttttttgtcggaaaacgctagttttgctgaacgtgtggaacagtctggtttcattttcattgggccacgggcagagacgattcgtttaatgggcgacaaggtgcaggcgatccatgcgatgaaagcggctggtgtgccgtgtgtccctggttcggatggtccattgggtgatgacattgtcgctaacgtcaaaattgcacgtgagatcggttatccggtcatcattaaggctgccggcggcggcggtggacgtgggatgcgtgtggtacataccgaggtcggtttaaaggcggctatcgagaccacgcagtctgaagctaaagccgcttttggcaatggccaggtgtatatggaaaagtttctggagaatccgcgtcacgtggagattcaggtgctcgccgatggtcaggggaacgcgatccatttgggggagcgggattgttcgatgcaacgccgccatcagaaggtggtggaggaagcccccgcacccggtatcactgaggcgttgcgcaatgaaatcggtcaagtgtgtgtagatgcctgtattcgtatcggttaccgcggtgccgggacgtttgaatttctgttcgagaatggtcgtttttacttcatcgagatgaatacgcgcatccaggtagagcatccggtgacggagcgtatcactggtattgacttggtatgcgagcagttgcgtattgccgctggtcagccattgagtatcaagcagagcgatgtggtgttgcgtggccatgcgatcgaatgccgtatcaatgctgaggatgctgagacgtttttgcccaatccgggtttgattactgcgttccatccaccaggtggtccgggtgtgcgtatggatacgcatatctacagtggttacaaggtgccgccgaactatgattcgatgatcggcaagctcatcgtgcatggtccggaccgtgagacggcgattgcgcgcatgcatttggcgctgagcgaaatggttgtggatgggatcaagaccaatatcccattgcagcagcgcattatgtgcgataagggtttccagttcggtggacagaacatccattatttggagaagtgtttggcggagcgtaagaaccaaacgatcgggcggacctga

SEQ ID NO: 41177 - DNA, 2187 bp, Xylella fastidiosa
gtgaacgtctctcatgtgcttgatcacttaaatcagaaccagcgcgaggccgttgctgcggctcccggccactacctgatcctcgctggtgccggatcaggaaaaacccgcgttctcactcatcgcatcgtttggctcaacgaggtacatggagtacccacccacagcatgatggccgtcaccttcacgaacaaggccgccggcgaaatacaacaacggattgatctacaactgcgccacggcaaacgcggcatgtggatcggaaccttccatagcctggcgcatcgcttactgcgcctgcattggaacgacgcaacattacccgaaaacttccaggtcatagacagcgacgatcaattacgcctcgtcaaacgagtgatccagtccttgggattgaatgacaccctcttcccccccaaacaggcgatgtggtggattaatacacagaaagatgaaggacgccgccccgagcacatccagcccgagtcacacgacgattggatcgagacgcagcgccgcatctatgccgagtatcaagagcgctgtaaccgcgctggtttggtcgattttgcggaactgctgctgcgggcacatgaactgctacgcgatactcctgcactgctgacacactaccgttcgcgcttccgtgagatcctgatcgacgaattccaagataccaacgccatccagtacgcgtttgtgcgcatccttgccaatgagactggccacgtcatcgccgtcggcgatgacgaccaagccatctacggctggcgcggcgccaaagttgagcatgtacaacacttcctgaaagattttccaaacgtgcagaccatccgcttggagcaaaattaccgctccagcgccaatatccttgacgctgccaacgcaatcattgcccataacccagaccggattgggaaacgcctctggactgaatccggtgttggtgaatccatcgacctatacgccgcctacaacgagattgatgaagcccgctacatcgtcgaacgcgcctgccagtgggtacgcgacggcggcagctacggcgaaatcgcagtgctttaccgtagtaacgcacagtcccgcgcgtttgaagaagtactgcaatccgaacatatcccctaccgtgtttacggcggcatgcgcttcttcgagcgtgccgaaatcaaggatgccctagcctatctgcgtctgcttgccaatcgtagcgatgatgctgcgttcgaacgcgttgtaaatacccccgtacgcggcatcggtgagcgcaccttagatgaagtaagacacctagcacgtacccaaggcttagcactatgggatgcggcaatggcatgtacccaatcaaccacgctgaccgcgcgcgcacgtaatgccttggcgagtttcctcaatttactgcaacaacttgcggtggaaaccagccagatgggtttagccgaacggattgaccatatgctgctgcgttcggagttacgcgagcactggaagaaagaagcgcgtggttctctggatgccgaatcacgtcaagaaaacttagacgaacttgtttcggtcgcttcacgttttgtccttccgcaaaacgacgaagacacgcccatcatgaccgaattggacgcgttcctatcctatacatgcctggaaagtggcgatggtcaagtccaggccggggaggaaggcgtacaactgatgaccctacactcagccaaaggcttggaattccccctggtcttcttggtgggcttggaaaatggattattccccagcgcgcgttccctggatgaacacggtcgactggaggaagaacgccgcttagcgtatgtcggtatcacccgtgcccgtcacaaactcatcctcagctatgccgaagcacggcgtatccacggtaaagataactacaacatcccctcacgctttttacgcgagatcccgcgggatctattgcatgaagtacgccctaccatacaagtctcacgccagaccccattaggagcagtgcagcgtccagcccatgatgaacgcgacgcagcacctatcaagctcggcgtgaacgtcatgcaccctacatttgggtgcggcgtggtcgtcgactacgaaggcagcggcgcgcacacccgcgtacaaatcaaattcgatgacgtcggcacaaaatggttggtcatggcatacgccaaactcagcgtggtatag

SEQ ID NO: 41178 - DNA, 1938 bp, Xylella fastidiosa
atgaggatgaacgacttaaccaaaaatgtgttactgtgggtggtcgtcgccgtcgtgctgatggtggtatttcaaagtttttcgccacgtattggtggagtgataggcaacgaaccaatcacctatacacaatttctgaatgaagtggatagcggtcggatcaagtcggtgaactacaccgatgagagtggcctgactgtcaacgcgattcgcttcaaacgcaccgacggtagcgagggtttggtctacggaccacgcgacgacaaattggtcgacgtgttatacagcaagaacattgagatgacccggcaaaagccttccacaggcccaggcttttggtctctagtattgaattttctaccagtcatcttaattattggattctgggttttcatcatgcgccagatgcaaggtggtggcgctaaaggtgcgatgtcgtttgggaaatcccgtgcaaaattgcaaggcgatgaccagatcaaaatcacttttgctgacgtcgccggttgcgacgaagccaaagaggaagttggtgagctggtcgattttttgcgtgaccccactaaattcaccaagcttggcggcaagattccacgtggagtcttgatggtgggtcctccaggcaccggcaagacgttattagccaaagcaatcgctggggaagcaaaagtacctttcttttcgatttctggatctgacttcgtcgaaatgtttgttggcgtcggtgctagccgtgtccgtgacatgtttgagcaagccaaaaagcatgccccatgcattattttcatcgacgaaatcgacgcggtaggccgtcatcgaggtgcaggcttaggcggaggccatgacgaacgcgaacaaactttgaaccagctcctggttgaaatggacggctttgaaggcggtgaaggcgtgattgtgatcgccgcgacgaatcgccctgacgtgctcgaccctgcgctgctgcgcccaggtcgcttcgaccgtcaagttgtggttgctctaccagacgttaaaggccgtgagcagatcctaggtgttcatatgcgtaagttactgttagccaatgacgtcgagccgctcgtgattgcacgtggaacccctggtttctctggagctgacttagccaatctgtgcaatgaagcagcgttattcgccgcgcgtagcaacgaaaaggaagtcagaatgaaccatttcgacgctgcccgcgacaaaatactcatgggcactgaacgtcgctcaatggcaatgagtgaggaagaaaaaacccttactgcttaccacgaagctggtcatgccatcgttggccgcttagtacctgagcatgaccctgtatacaaagtcacgattatcccccgtggccgtgcgttgggcgtcaccatgtatcttcctgaaggtgacaaatactcaatcaataaagtggctattcagtcccaactatgctccttatatggtggccgtgttgccgaagaattaatcttcggtgaggacaaagtcacaactggcgcttctaatgatattgaacgtgtgaccaagatggcacgcaatatggtcaccaagtggggactctcggatgaactgggtccggttgcttatggcgaggaagaggatgaagtgtttcttggccgttctgtgactcaacataaaaatgtctcagatgaaacggcccgcaaaattgatgaggtagtgcgctctatcttggacaaagcgtacgctcgtacaaagcggatcttggccgataacttagataagctccacgcgatgtcccagctgctgctgcagtacgaaaccatcgacgcacctcagattgatgccattatggagggtcgtgaaccgcccccgccggttggctggggtaaaccttctgacaatggtagcgacgacgacatgagtaagcctcgcccattaactaccatcgttgttccagctgagcaggtttga

SEQ ID NO: 41179 - DNA, 2025 bp, Xylella fastidiosa
atgagtaacccactcctcgatttctcagaccttcctcgcttcgacgcgatcctccctgagcacgttgggccggccattgagcagttgctcgcagaggcggaggcggccgtcgcccacgcggaacaggtgacgccggtgacatgggagaactgcgtagtaccgctggacgatgccaccgagcggttgtatcgcgcgtggggtcaggtggcgcatttggaggcggtggtcaacacgccggcgctgcgtgaggcgtataacgtcactctcccgaaagtcacccgattcagcagtacgctcggacagaacctggcgctgtatgcgcagtacaaagcattagcgtgtgcgccggaatgggaccgtgataacgcggtacggtgcaaggttgttgataacgctttgcgtgatttccgtctcggcggtgccgagctggatgccgccgggaaagcccgtctggcagagatcaagcaggagctttcggcattgtctgcaacgttttcgcaaaatgtgcttgatgcgacagaagcatggtcctacaccaccgaagacgccgctgtgttatccggtctgccggcagagactgtcgctaccgcgcgtgccaccgcagaaaagaagggggtaccaggctggacgttcacgttacagatgccttgctatctgtcggtccaaagcgatgctgacgaccgcacgttacgagagcgctcatatcatgctagtgcgatacgcgcttcggaatttggcgatgctgcgttggacaatagtccgcacattcatcagatcctcacgctgcgttccgaattggccgcgctgcttggtttctcctgttacgcggcatactcggtcgcaaccaagatggcagaggatccggctgaggtactcagcttcctgcatgacttggcaggacgtgccaagccgcatgcgcaacatgatcgccgtgaactggaaacgttcgcacgcgaggcgctggggcttgagacgctggaagcctgggacattgcatatgccagcgagaagctcaaacaagcccgttacagtttctccgagcaggaagtaaagcagtatttcaccgaacccaaggtcctgactgggttgttcgaggtgatccactccctttatggactgcggatcgaagaagacgcagcgccggtctggcatccagatgttcgcttctaccgtctcattgatacgaatgggcaacgcgtcggccagttttatctggatctgtatgcacgggagggcaagcgcggcggggcatggatggatgattgccgtaaccgccgtgacaaaggcgatgaggtgcaaactccggtggtctatttggtgtgcaatttcggccgtggtagtgacggtgtgctccctacgttgcgtcatcaggaggtcattactttatttcacgaaatgggccatgggctgcatcaattactgacccggattggggaactgggcgtggctggtattaatggtgtggaatgggatgcggtggagttgcccagtcagttcatggaaaacttttgctgggagtgggagcgcgttcaagccatgacggcacacgtggagaccggtgcaccgctgccacgcagtctgttcgatcggatggtctacgcgcgcaattttcagagcggaatgttcaccgtgcgccaacttgagttcgcgctattcgacatgctgctacatagtgacttcgatccagcacaggacagcgtactggggctgttagaacgggtccgtgatgaagtggccgtcaaccggttaccggactggaatcgttttccgcaccagttcagacatatttttgctggtggttatgcagcgggatactacagttataaatgggccgaagtcctcagcgcagacgcttatgctgcatttgaagaggctccggatcaatttgccgaaataggggcgcgctttctcgacgaaatcctaagtcgtggcggcagtcgcagcgcagcagagaatttccaggccttccgcaaacgcgcgcctcgcattgatgccttgctgaagcgcaacgggatgacagaatag

SEQ ID NO: 41180 - DNA, 1830 bp, Xylella fastidiosa
atgtgcggtattgtcggtgccattgctggccgtgatgtggttcctgtgttgattgagggcctcaagcggttggaatatcgagggtatgattcttccggtatcgcggtgcttgagagcgggtcaatccggcgggtgcgtcgtactgggcgggttgctgagatggctgtcgccgcaacgcaagagggatttacagcatcgcttggtatcggtcatacgcgttgggcaacgcatgggggagtgaccgaggccaatgcgcatccacatgtgagccacggtgttgtgttggtgcacaacgggattattgagaatcacgaggttcagcgtgagcgtctgtctgccttaggttatgtcttccagtcgcagacggatacggaggtcattgcgcatctgattcattaccacatgcagcaaggcgatgatcttctgggggcgttgcagtgtgcggtgaaggcgctgacggggatctatgcgttggcggtgatgagtgaggctgaaccagagcgttttgtctgcgcgcggatggggtgcccgttactgattggtataggggatggtgagcatttggttgcttctgacatctctgcagtcatccaagcaacacgtcaggtgatttttttggaggatggcgatactgcggagattcgccgtgatggaatcagtattttcaatgcggaacagtgtccagtggaacgtccattgcatctgtcgaatgtgtcgctgtcttcgttggaattgggggagttccgtcatttcatgcagaaggagattcatgagcaacctcgggtgcttgccgatacgatggaggcggcgattgatgcggctggatttccacccatgctgtttggtgcgcaggccgagtcggtgttccgtggcattacgggtatccagattttggcgtgtggcaccagttactacgctggtttgaccgcgcgttattggattgaggcgattgctggtttgccatgtcacgtggagattgccagtgagtaccgttaccgtaaggcgtatgtcaatccacagcatttggtggtcacgatttcccagtctggggagacgctggacacattggaggcgttgaagtacgccaaagcattaggtcaccgtcatacgctgtcgatttgtaatgctcctgacagtgcgattccgcggatcagtgagttgatttgctatacccgtgcaggcccagagattggtgtggcttcgacgaaggcattcaccactcagctggtggtgctgttccagttggctgtggcattgggggtgctgcgtggggctgttgatgctgagcatgaagcggcgtatttggagcaattgcgtcaattgccttgcggcgtacagcaggcactcaatctggaaccgcagatcgctgcgtgggcggagtgctttgcgtcgcgtcatcatgcgttgtttcttggtcgcggtttgcattatccgattgcgttagaaggtgcgctcaaactgaaggaaatctcttatatccatgctgaggcgtatccggcgggtgagttgaagcatgggccgctcgcgttagtggatgctgatatgccggttgtggtgattgcacccaacgatagtctgttggaaaaggtgaagtccaatatgcaggaggtgcgtgcgcgtggtggggagttgtttgtgtttgctgatcaggacagtcactttagtgaatcggaaggtttgcacgtgattcgtacgctgcgccacacgggggtattgtcgccgttagtacacacgattcctgtgcagttgttggcttatcacactgcgctggtgcgtggtactgatgtggataagccacgtaatttggcgaagagtgtgacggtggaataa

SEQ ID NO: 41181 - DNA, 1887 bp, Xylella fastidiosa
atgacctggtctcaagatctcgcccataagacgtattcgatcctgcattgggctgatgggtatttcgaggtgaacgatgctgggcagatggtggtgatgccggtcggtcgcgatggtgtacggatctcgctcccggaggttgtggatgctgcgcgtgccgccggtgccaagttaccgctgctgctgcgtttcccggatattctggggcatcgtctgggtaaattgcaggcggcgttcgctcaggcacagtccgagtgggagtatgcgggtggttacactgcggtttacccgatcaaggtcaatcagcatcgcggtgtggcgggtgttctggcgagtcaccagggggatggtttcggtttggaagccggtagcaaaccagaattgatggcggtgttggcgttatcgcgtccgggtgggttgattgtttgtaatgggtataaggatcgggagtacatccgtcttgcgttgatcggacgcaagcttggtttgaagactttcattgtgatcgagaagccgtctgaattgagaatggtgcttgaggaggcgaaaacgctcggtgtattgcctggtttgggcgtccgggtgcgtttggcgtcgttgggtgccggaaaatggcagaacagcggtggcgataaggcaaagttcggtttgtcgccgcgccaagtgttggatgtatggaaggtgctgcgtggtactgagtatgccgattgtttaaatgtgatgcactttcatatggggtcgcagatctccaatgtgcgcgatatcgctaaggggatgcgtgaggcgacccgttactttgtcgagctttcgcgtttgggtgcgaagatcacgcatgtggatgttggtggcggtcttggcattgattacgagggcacgcgttcgcgtagtgactgttcgatcaattatggtttgcaggcgtatgccagtcatatcgtgcagccgctggcaagtgcgtgtgaggattatgatttggtgccaccacgcattgtcacggagtgtggtcgtgcaatgacggcgcatcatgcggtgctgatcgctaatgtgaccgaggtcgaagcggtgccggaggggcgggtgccaggggtgtgtgatgatgagccggcggtggttcgccacatgcgcgagatttacggggagttggatgcgcgtccggcaatagagttgttttatgaagcacagcactttcatgctgaggggttggcggcttacaccctcgggcagattgatttggtgcatcgcgcacgtattgatgatttgttttatgcgatttcgcatggggtgcgggagcgtctcagtcacgaggagaagagtcaccgtccggtgttggatgagctgaatgagcgcttggttgataaatattttgtcaatttcagtgtgtttgagtcgattccggatgtgtgggctatcaatcaaatttttccgattgtccccattgagcgtttgaatgaggcaccgacccgacgtggtgtggtctgtgatttgacctgcgattcagatggtacggtcaagcagtatgtggaaaacgagagtttggacagtgcgttgcctctgcatgtgttgcgtcatggcgaggcttacaggattggctttttccttgtgggtgcttatcaggaaatccttggcgatatccataatttgtttggcgataccgatgcggttgaggttgcagtcgacggcagggggtatcgtattgcgcagcagcgttgtggtgatacgaccgatgtgatgttggactacgtcggttatgcgcttgatgaggtgcgcagggtatatgcgcaacgtattacggcagcggggatgtctgctgctgagtccaaggcattgagcgatatgttggaagccggtctgacgggttatccctatttgtcagatgtgccgctggagtga

SEQ ID NO: 41182 - DNA, 756 bp, Xylella fastidiosa
atgactaaaaccatattgatcacgggagccacctccggcttcggcagagccgccgtgcatcgcttcgccaacgccggctggcgtgtcatcgccacaggacgccgcattgagcgcctggaagcactcgccgccgaatggcctcctggacacatccacatcaccgccttcgatatgcgggatagcgccacactacacaccgcgattcaaacgctaccagcagactttgccgacatcgacgtcctggtcaacaacgctggcctggcactgggcaccgcaccagcacaacacactgatctagcacagtggcgggagatgatcgacaccaacatcacctcattagtgaccctgacccatcacctgctaccgacactgatcgaacgcaaaggaatgattatcaacatcagctccgtcgccgcgacctatccctacacaggcggtaatgtttacgctggcaccaaggcatttgtgaaacaattctcactgggcctgcgctcagatctccatggcaccggcgtacgcgtgaccagcatcgaaccagggatggccgaaaccgagttcaccctagtgcgtactggcggcaaccaaaccgcttccgacgcactgtatcgtggcgccaacccgatcacagccgaagatattgccgagcaaatcttctacatcgccacactaccgccgcatctcaacatcaatcggctggaaatcatgtccgttaaccagtcgtttgctggcttccaagtcgcacggcaaccgcaatag

SEQ ID NO: 41183 - DNA, 1404 bp, Xylella fastidiosa
ttggaagcggtggttcaacccagtcttttccatgaagacgatatccacggtgtggttcctggcgagttgaacccaggtgtggcgaagttgatcggtcaagcgatcggcagtgcgatccaggtcaaaggtttgagtgacattgtgattggccgtgacgaccgcgtgtccagttttgaattgtctgcggcattaagtgatggtctacgtcatgccggttgcaatgtggtagacatcggcttggtgccgatcccggtagtgtatttcgctgcctgccatcttggcgttgggagttgcgttgcggtcacaggggggcatcatcctcatgattacaacggtttcaagatcgtgcttggtggtgagtccttatccagtgaggcgatgagcgatttgtatcaatgcatcaccaatggtcgcttatatgcgtccgttgactccggcaatttgagtgagcgtgatgtggttgacgattacattcagcgtattgctgatgatgtgcagttgaatcgtccgctgaagattgttgctgatcctggtcacggtgcggctgaagagatcctgtcacgtttattcaaggcgattggtgcggatctggtgtcactgtacggtgatattgatggtgtttcccttcatggtcatcctgattcggacgagctagggaatctgcagaagctgattcagcgggttgagcaggccgatgccgatttgggtcttgcttttgatggggatgcggcaagtctcagagtggtgactcgagaaggtgaggttattttatcggatagcgtgttgatgttgtttgcgacggatgtgctacagcggaatccgggtgctttggtgatctatgatgctgaatgtactagcaagttgtctgattgtgtattgcgcaacggcggcagcccgttgatgtggaagaccgggcatgcctccatcaaagctaagatgcgcgagaccggtgccgagttggctggtgaaatgagtggctatttcttcttcaaagaacgctggtatggttttgaggatgctctgtatgcggcggcgcgtttgctggagatcttagcgcagcgcgaagataatccgtcccaggtgtttgctgcactgccccatgcttatttcactgcccaaatggagcagtctgtcgagggtgatgcgcaggcatgtgtacagtcctttattgaggaagtgcagcgtagcgttgagggcagtgtgttcgatggtgctcgtttgttcgcctttgatggtttgcgtgctgatttcactgatggttgggggctagtacgcgtttctgacactgcatctgcactggtgttgcgttttgaggctgacacgcaggctggattggagcggattcagagtgcattccgcacgcatttacaggcattactacccggtcagatactggtgttctaa

SEQ ID NO: 41184 - DNA, 801 bp, Xylella fastidiosa
ttgagaatttccagttttaatgccaatgggttgcgatccgctcttagtaagggtttttttgattggttttctactcaggacattgatgtgctgtgtgtgcaggaaaccaaggcgcagaggcagcagttagttggaccggatttttttccggctggctatcatgtgtgttttcgggatgcgacgactaagaaaggttatagcggggtggcgatttacagtaggtgtgagccagatgagcttcgcactacgctgggttgggccgagtttgacgaagagggccgttatgtggaggcgcgattcggaaatttgagtgtggtttcgttttacattccttctggttcttcaggggagcagcgtcagcattataagtttgaggtcatgcgttggttgcgtccgattttgtgcgagtggttgctcagtggtcgggattatgtgttgtgtggtgattggaatattgtgcgtagtgcattggatatccgtaattggaaatctaatcagaaaaattccggttgtttgccgttggagcgcgattggctcaatggtttatgtgccgattctctacatgaggttaatgcggctcaggggcgaggctgggttgatacttaccgtgtgttgtatccgcaaggtgaggattatacgtggtggagtaaccgtggtgcggcgcgcgttaataatgtgggatggcggatcgattatcagtttgtttctccaggtttgcgtgaacgtgtgtcgcgttgtgcgatttaccgtgagcaacgtttttcagatcatgccccttacactgtggagtatgtgttgtga

SEQ ID NO: 41185 - DNA, 756 bp, Xylella fastidiosa
ttggaacatgtatctatgattactgataactctccaagattccgtgcactagtgactggcggcagtggtcatttgggtactgccatttgccgtcaattaattgcagatggtgcgcatgtcatcgtccatgcaaaccaccatcggtctcgtgctgataccctagtggaatgcttatgtgccgaaggggggagcgctgaggtaattgttttcgacgtcaccgccgcacaagccagcaaaacggcactggaaaacctgttacagactggcccaatccagatcatcattaataatgcaggcatccacgacgacgcaccgatggctggtatgtcatctacacaatggcatcgtgtcattgatgtgtctctgcacggctttttcaacgtaactcaaccgttactgctgccgatggcacgcacccgttggggacgtattgtctgtatatcatctgttacggcagttttaggaaaccgcggacagagtaactacgcagcagccaaagccgggttacacggtgcagcacgctcattggcccgtgagatggctaatcgtggcatcaccgttaacgtcgtcgcaccaggtgtgattgaaagtgagatggtggggaaaacgtttaccccggaaatgatcaagcaattggtaccaaccggtcgtcccggtcgtcccgaggaagtggctgctctgatcggatttctatgctcagagaaagcaggttatatcaacggtcaagtcatcggcatcaatggtggaatgggttaa

SEQ ID NO: 41186 - DNA, 435 bp, Xylella fastidiosa
ttggttaaactatctcctccttcccgatgtacttcttccatgagcgatatccctggcgacctcaagttcctcaaatcccacgaatgggtccggatcgaagacaacaatcgtgccatcgttggtatttccgaccatgcacaaaatctgctcggtgatctggtgtatgtcgaattacccaatattggcgatcacctggacgctggcaccaccgctgcagtcattgagtcggtcaaggcagcctcagatatctacagtccagtcaccggcaaagtgattgaagtcaatactacgttaagcgacaaacctgagacgatcaatgaagatccctacggtgaaggctggattatggtcattgagatgcaagcccctgaggagattagtgatctactttctcccgatgattacaccaaagtgctggaaagtgacgaacattga

SEQ ID NO: 41187 - DNA, 1461 bp, Xylella fastidiosa
ttgatgcatcacaatgttcatcaatctgaaatcctagcagatccatgcgatcttcagcgtgctgaacgctggctacaacgcgatttgcgcgtcctgtggcatccgtgcacgcaaatgcgtgagcatcccgacacgctgccattagtgcccatcgtccgtggtgagggtgcgtggttggtcggtcacgatgggcgtcgttaccttgatgctgtcagcagttggtggacaaatcttttcggtcatgcagatccccgtatcagtgcagcaatcgccgcacaggccaggacgcttgagcaggtgatgttggctggtttcagccatgagccggcggtgcgtctggccgaggccttgttgcggctcgcgccgcgccaggacgggcgtgagccgttgtcaaaggtgttttacgctgacaatggctcggctggggtggaagtcgcgctgaaaatggctttccattacttccgtaatcgtggtgaagagcaacgtacgcgatttatcgcgttacataacgggtatcacggagaaaccattggtgctctcgcggttggtgatatccccttgtaccggcgtgtttatgctccattgctcacggaggtattgtttgcgccctcgcctgatgcctatttggccgaaccaggtcaaagcgccgcagaatatgcattacaggccgccgaagcgttggaagtgctgttcaaacgttactccgggcaaatctgcgcgctgattttagagccacttttacaatgtgccggtggcatgcgcatgcaccatccggtgtacctacatcgtgtgcgggaactatgcgatgcacacggtgcgttgctgatttgcgatgagattgctacagggttcggacgcactggcacgctcttcgcttgcgagcaggcttgccccgtcatcctaacggatactgatgacaagcagcttggcatcatgccggacctgttgtgtctgtccaaggggctgacgggtggtttcctacctctggccgcagtgctgacaacgcagcaattgtacgaggaatttctcgatgacagccgcgaacgcgcttttctgcattcacacagctacacaggaaatccactggcttgtattgcagcgctaacgacactggatatcttcgaaaatgattgcatcatcgaacgcaatcaagtcactgccgcgcgtatgacgcaattggctgcgtcactgtctgggcatccgcacgttgctgacgtgcgccaggcggggatggtcgtggcatttgagttgactcgtgatggcaacaagcggacaccattcccgctacaggcacggcttggcttgcacgtttaccgtgctgcgctggcgcgtggagtgatcctgcgtccgcttggcgatgtggtgtattggatgcctccctattgcgtggatgaagagcaactgcatctgcttgctgagaccacgcgtgtggcaattgacgaagcgatcgcatgcgtttga

SEQ ID NO: 41188 - DNA, 1341 bp, Xylella fastidiosa
atgaacttcgaaactttgggattgttgccttccttactgcgtgctcttagcgagcaaggttacgaaatcccgaccccaattcagcagcaggcgattccattggcattagctggccacgatttgcttgctgccgcgcaaacagggacaggtaagacggctgcgttcggcttgcctgtattgcaacgattgatggccgcttcatctaatgttggtgcgggtaagccgcgtgctttggtgctgacaccgacccgtgagctggcgactcaggtctacgacagtctacgtggttacgccaagtatcaacgtgtatcaagtgcggtgatttatggtggtgtggggatggggaatcagttggatgtgctgcgccgtggcgtagatttgttgattgcctgcccgggtcgtttgattgatcatattgaacgtcgcagtgtggatttgtcaggcgtcgggattttggtattagatgaggctgatcgcatgcttgacatgggtttcctcccctcaattaaacgtatcctcggcaaactaccgcggcagaatcgccaaactctgctgttctctgcgacatttgctgagccgattaaacagttggcgttagagtttatgtgccgcccacgcgaggtgatggtggcgtcgcataacaccgttgccgagaccattacgcatcgtgtgcatccggtcgatgttagccgcaagcgtgaattgttgttgcatctgttggctcaagatagcagggagcagacactggtgttcgtgcggaccaagcatggcagtgacaagcttgctacgttcttggagaaatacggaatcaagacagcggcgatccacggtaataagactcagggccagcgtctgcgtgccttaaacagtttcaaagcagggcgagttaccgtgctggtggccactgacattgctgcgcgcggaattgatattgaccaattgccaaaggtgatcaattacgatttgcctatggtggctgaggattatgtgcatcgcatcgggcgtactggacgcaatggtgtgcagggagaggcaatttcattagtcactcaggaggacgctaagttattgcgtcagatcgtgcgtttgcttgatcgtgacatggatattcgcgatgtaccggatttcgaacctcaagtcccgatccgttggggtaacagtgctccgggaaagagtaagcagcctgctggacagcacccaccacgtaagagtcaacatcggcgagcattcggcaaagcgtctgtgcagacggcgcatgctttaacaaaacaatcaggcgtacaacatagcaatgggtcccgtaatcgtgatggaatgtttccggttcatcagcgtggttga

SEQ ID NO: 41189 - DNA, 1509 bp, Xylella fastidiosa
atgcacaatgggttcgatgctttgcagcttcatgccaatcgcttgcggggggtgacaattccagatctgttggcggctgagctaaaaagaccagagcaatatgccagacaagttggtccgttgtatttcaactttgctcggcagaagtatgactgtgtggcgttggaagcactgtttgcattggcgcgaaaccataatgtggctggtgcgttccagcgcatgttttgtggggagcaggtgaatgtgaccgaggggcgtgccgtgctgcatactgcgctgcgcggtgatcttagtggtacttcggtggcggttgctgcttacacggcggcggctaaagtgcgcgagcgaatgtatgcgttgattgccgggctggatgccagtgaggtgaccgatattattagtgttggtattgggggctcggatcttgggccacgtttagtggttgatgcgttgcgtccgatttcccaaggacgtttccgagtccattttgtctctaatgttgatggcgctgccatgcggcgtactctggatatgttggatccatcacgtacggcaggcattctcatctccaagacctttggtacgcaggagacgttgctcaacggtcgtattttgtacgattggttaggcggcagcgagcgcttatatgcggtcagtgctaatccggaacgggccgctcatgcgttcgacattgtacccacgcaggttttgccaatctgggattgggtgggtggacgctattcgttatggtcagcagttggtttcccgattgcgttggcgattggttcccagcgttttgaggagttgctggctggtgcggctgagtttgatgcgtatgccctgagggtgccgttagaagaaaatgttgcggtgttgcatgggttaactgcggtgtggaaccgtaacttccttggttgcgccacgtatgcggtgatggcttatgaccagcgcttggcattgctccctgcctacttgcagcaactggtgatggaaagtttgggtaagcgggtcaagtgcgacggaacgccagtggatagggatactgttccagtttggtggggtggcgtggggactgatgtgcagcatagttttttccaggcgctgcatcaggggacaaatatcgtacctgctgactttatcggtacgatccgcaatgatgatccgtacactgagaatcattttgctttgaatgccaatttgctggctcagattgaagtgttagcgaacggccagcttagtgatgatccgcatcgtgtttatccaggagggaatccgagtacgttgattttgcttgatgcattgactccacaggcattggggggattgattgcgatgtatgagcatagtgtgtatgtgcagtcagtgatttggggcattaatgcgtttgatcagtttggtgtggagctgggaaagcatttagccgttcaattactacctgcattaaagggggagagtgttgaagtggtggatccggtaacccgtgcggtgttggtgcgtttgcgtggttga

SEQ ID NO: 41190 - DNA, 2679 bp, Xylella fastidiosa
atgtcgcagcaaaccactattcgtaagcttgccgagctggtcaatacgccggttgagaaactgctagagcagttggccggggctggtatgaagttcagtggtcccgaccaggtcgtgactagtactgaaaagatgaagctgctcgggttcttacgccgcacacatggtaagtctgatgtgtcggttggagctgtccgtgaggcaccgaaaaagatcacgcttaatcggcgtcggctacaagaagtgactgttaacgctggccgcaacaagactacggtaaacgtggaagtgcgccaaaaacgcacttatgtgaagacgcccgagagcgaatatcatacgccgacgaaaccacccatagagctgggtgatgccgagcgtgttgaaatattgcgtaaacttgaagaatcacgccagcgcaatcttgctgagcagcagcgtttagctgaagttgaccgtcaacgtgttgaggagcaggagcgaaagcgccttgaagaagaacaggccgagcttgagcgccagaagactgaaagtcccgtagttgaggaggttcctgtccagtcagattccaattccgtcaaaccggtgtctaaaccaatctctgaagaccgcacgcgtgcgttgccgcgagcagtgcggccagcaccggctgcgcgcccttcggtatcgcgttcggatgaccgtaatagcaatagtggggtgcggcataagccccgtggttcgcacgtgattgtttcggacgaggatgattctgcgcgccgttttgcgggtcaaatgcacctgacggctgctgaacgtgctcgccgtggtagcaacacacgaggcaaaggaggtggttctcaccgtggcgctactcatcgaggtaacgagaacagtattcgttctagtggtgctcatggtttcgagcgtcctactgcggcagtggtgcgtgaagtcgctgtcggagacaccatcaccgtagctgatttggctcagaagctcgcgctgaaaagtggtgatatggtgaaggcgttgtttaagatgggcgtgatggtgacaatcacgcagaccattgatcatgacactgcagtactggtaagcgaggaactgggtcataaggtgactcgtgccagcagcagtgattttgaggatgctttacttgcccatactgaagaagtgcatggtgagccggttccgcgtccacctgtggtgacgatcatggggcatgttgaccacggtaaaacttcgttgcttgattacattcgtcgcaccaaaattgcagtgggggaggctggtggcatcacccagcacatcggtgcttaccatgtggagaccccgcgtggagtgatcagctttttggatacgcccggccacgccgccttcacctcaatgcgcgcgcgcggcgccaaaatcacggatattgtggtgctcgtggttgctgccgatgatggtgtgatgccacagaccaaggaggcagtacaacatgctagggcggctggtgtgccgcttattgtagctgtgagcaaaattgacaagtctactgctgacccacagcgtgtaaaaaacgagttgttaaccgagagcgtcgtagccgaggaatttggtggagatacgcagtttgtcgagttgtccgctaaaactggtgttggcgttgatgcgttgttggacgcaatttcgattcaagccgaggtgttggagctaaaggctgtgattgaaggtcgtgcgaccggtactgtgatcgagtcttcgctagacaaaggacgtggtccggtagcaacggtattggtgcagcagggacgtctgaaaaagggagattacttggtatgcggcactcattatggtcgtgtgcgtgctctgttcgatgaagttggtcaccaaccacttgctgcatctccatccattcctgtacaggtgctaggattgtctggcgtgcctgatgctggagacgatttcgtagttgttgatgatgaacgtcttgctaaagatgtagcgcagcagcgcgaggctaagcgccgtgagtctcgtctagttacttctgctggcaatcgcatggaagacatcttggctcagatgggtaaaggcgagaatcagcaagtgcttaacttgttgattaaagctgacgttcaaggttcgctagaagcgcttaaacaggcactggtcgcactgtccaacgacgatattagaattaatgtaattcatgttggtgttggaggtattactgaatcggacgccaactctgccgtgacctctaaggctactgtgattggcttcaatgtccgtgccgatgcctctgctcgtaagatcattgaggcgaatggcgtagatttgcgttatttctctatcatttacgatgttattgatcaggtgaagcaggtcgcttctggtttgcttggggttgagattcgtgaggagatcattggtgttgccgaggtacgggatgtgttccgtagctccaagttcggcgctgttgccggttgcatgatcattgagggtgtcgtcaagcgctccaaaccaatccgtgtcctccgtgataacactgtggtgttcgagggtgaattggagtcattgcgtcgctttaaagagaatgttgacgaggtgcgtaacagtactgagtgtggcattggagtgaaggcttacaatgatgtcagggttggtgatcatatagaatgtttcgaacgtattgaggtcgcgcgtaccttgtaa

SEQ ID NO: 41191 - DNA, 1845 bp, Xylella fastidiosa
gtgctctccggagttctcatgtcaaatccatcctctacgccgctgctgtttgcagatctcggcctctccgatgctgtgatgcaagccgtcacaaaaatcggttatgaaactccgtcgcccatccaggcggcgaccatcccagccttgctcgctgggcgcgatgtgctgggccaagcccagaccggcactgggaagactgccgcattcgcgctaccgttgctcacacgcaccgttctgaaccaggtcaagccgcaagtgctcgtactggcacccacccgcgaactggctatccaagttgccgaagcattccagcgctatgctgcctcgatctctggcttccgtgtcctacccgtgtacggcggccaatcctatggccaacaactggccgcactgaaacgcggtgttcatgtgatcgtcggtactccgggccgggtgattgatcacctagagcgcggcaccctggacctatcggaattaaaaacgctggtcctcgacgaagccgacgaaatgctgcgtatgggtttcattgaggacgttgaagaagtgctacggaagttgcccgcttcacgccaggtcgctctgttctcggcaaccatgccaccacagatccgccgtatcgcacaaacatatctacaagatccgattgaagtcaccatcgccaccaaaaccacgaccgcggccaacatccgccagcgttactggtgggtcagcggcctccacaagcttgatgcactcacacgcattcttgaggtggaaaccttcgacgcaatgattatcttcgtgcgcaccaaagctgccaccgaagaattggccgagaagttgcaggcacgtggcctgaccgccgcagcgatcaatggcgatatgcaacaagcgcaacgcgaacgcaccattcaccaactcaaagatggcaagctggatatcctcgttgccaccgacgtcgccgcacgtggtttggacgtagaacgtatcagccacgtactgaactacgacatcccttacgacgttgagagctacgtccaccgtatcggacgcactgggcgtgccggtcgcagcggcgaagcaatcctctttgtgactccacgcgaaaaaggcatgctgcgccagattgaacgtgccactcaccaaccgatcgaagccatgcaactgcccagtgtggatgcagtcaacgacacgcgcgtcgccaaatttttcggacgcatcagcaatgctttggtggtcggcgctgaaatcgacttctaccgcaaactgcttcaacgtttcgagagcgagcacaatgtccctgccattgagatcgctgctgccctggcacgactccttcagggggatagccccttcctgctgagtgtcccaacgcgcgcccaacgcgaacgcagcgagccaccatcggagcatgtcaaacgctcctcatccttcaagcagacagagcgcccaaaccacactgaacaccccaagcgcccccaacgtaacgcaccagcacgcaataccccggaattcggtatggagtcttaccgcatcgaagtcggccgcatacacggtgtgaagccagctaatatcgtcggtgccatcgccaacgaagctggattagagagccgctacattggccggatcgacatccgtgacgatcactcggttctagatctccccgcagagatgccacacgaaatcctgcaacacctaaaaaaggtctgggtatcaggacagcaactacaaatgcgtcggatcgacacaaccgaaacaaccgcaactgcacgggaatttaagtcaaaaccgggtggcgctggcaaattcccgccgaaaccgcatcacaacaaatcaaccaaaccaaaaccaccatacagcggttga

SEQ ID NO: 41192 - DNA, 1062 bp, Xylella fastidiosa
atgggattggcaacgtggctcgtgactggtggtgccggtttcatcggcggtaattttgtattgcaggcgattagcctcgggcatcgcgtgattaatcttgatgccctgacgtatgcgggtcatttggagacgctcgctttgcttgatgggtgcgcggagcatctttttgttcgtggtgatattggcgaccgtgcgttggtgagctgtttgctggatacgcatcgcccggatgcagtgctgaattttgctgctgagagtcacgttgatcgttcgattgatgctcccgctgcgttcattcagaccaatgtggttggcacgttgctgttgttggaggcggtgtgtgggtactggaaggcgttgccggaggcggcgcgtgctgcgttccgttttctgcatgtatccaccgatgaggtttacggcagtttgggggagacgggggcatttacagagaggacggcgtatgcacctaattcgccttattcggcgtcaaaggccgcgtctgatcatttggtccgtgcgtttcaccatacgtacggattgccggtgctgaccacgcattgttcaaataactatggcccatatcattttccggagaagttgattccgctggtcatcaccaaggcgttggccggtgagccgttacctgtgtatggcgatgggcggcacgtgcgtgattggctgtttgtcggcgatcactgtaccgcgctgtgtgctgtattggctggaggacgggtgggtgaaacgtacaatatcggggggcaggccgagcgtgagaatcttgaagtggtccgcatgatttgccgtttgcttgacgagcgccgcccgcgtgccgatgggcagagttatcaaagccagattgttcatgttgcagatcgtccggggcatgatcgccgctatgcgatcgacacgtccaagttggtgagtgagttaggctgggcgccggtgtatcgctttgagcagggacttgcgctgactgtggattggtatttgcagcatcaggattgggtgcgtgcggtgctccaagggcgtgaccgcgttgagggcctactgattgcggtgtaa

SEQ ID NO: 41193 - DNA, 1503 bp, Xylella fastidiosa
ttgagcactccaacatctaatccattcagccgcctcccactatcgctgcatacacacaaatactgcgctcttcgtgactcccagcaacctgttgcaacacctaaacaggctagctccagctacacttcaccatcatttagccaggagttactcatgtcactacccgccttcaaggcctacgacatccgcggtcgcgtgccggatgaattaaacgaggacttggcccgccgcatcggcgtcgcactggcgacacagttggacagagcagcccctgtggtcctgggccacgatgtgcgcctgacaagcccatcactacaagaggcactgtcagccggcctgcgtgccagcggccgcgaagtgatcaatattggcctctgtggcacagaagaagtctatttccaaacacaatatcgcaatgcggctggtggcgtgatggtcaccgccagccacaacccgatggattacaacgggatgaaactcgtacgcgagcaggcacgtccgatcagctcagacaccggcctattcacaatccgcgatgctgttgccgccgacatcgcaaccattacgccccccactgccgccgaacatcagtatctggacaagtcggcctacattacacacctgctgagttacgtcgacagcaacgcccttaaaccactgaagctggtcgtcaatgccggcaacggcagtgccggcctaatcgttgacctactcgccccacatctaccgttcgaattcgtgcgcgtattccacgaaccggacggccactttccaaacggcattccaaacccactgctgcctgaaaaccgcgatgccaccgcacaagccgtcaagcatcacggagcagacctcggtatcgcctgggacggagatttcgaccgctgctttttctttgatcacaccggccgttttattgaaggctactatctcgtcggcctgttagcctccgtcattttgtccaaacatcctggtggaaaaatcgtgcatgacccacgtctcatctggaacaccgtcgaaatggttgaggctgccggcggcatcccggtactgtccaagagcggccatgccttcatcaaagaaaaaatgcgtaaagaaaacgccgtatacggtggcgagatgagcgcccaccattatttccgcgaattttcctacgccgactcaggcatgatcccgtggttactgatcgccgaactgatctcacgcagcggccgctccctggccgacctggtcgaaaaccgcatgcagcaattcccgtgcagtggtgaaatcaactttaaaatcaccgataccaacaccgccaccgcacgtatcatggaccattacacagcacaatctccgacgatcgaccataccgacggaatcagcgccgactttggagattggcgtttcaacctgcgcagctccaataccgaaccgctactacgcctgaatgtggaaacccgcaacaatgcggcactgctaaaacagcgtactgatgaaatttcagcgctactgcgcgcctaa

SEQ ID NO: 41194 - DNA, 1710 bp, Xylella fastidiosa
atgagtcaaacacgtccttggctgcaacactatccatcgggaatctcaacagagattgatactgacgctttccgtactatcgctgatgtcttcgatacatcagtcatcaaatatcgtcattgtcccgcctataccaatttcgggaaaacacttacctacggcgaagtcgatctattaacaaaacaattcgccagctatctgctcaatgtgttgaaactcaaaaagggcgaccgaatcgcactgatgatgctcaactgtttgcaatatccagtagcgaccttcggcgcgctatgcgccgggttaactgttgtcaatgtcaaccccctctacacagcgcgcgaactcaagcaccaactggttgacgcagggagcactgtattggtggtcatggacaacttctgtacaactgtgcagcagatcattgctgacaccccaatcaaacaggtgattacgactgaattaggcgacctgctcgatttccccaaaagatcactgatcaattttgccgtcaagcacatcaaaaaattagtaccggaataccaactgcctcgctcaatccgcttccgtgaagcactcgcgctgggaagcaagcattccatgcctccaatccacatcgccagcgacgatttagcttttctacaatacaccggcggcacaacggggacacccaaaggcgcaatgctgacccacagaaatatggtcgcgaatatgcagcaggtgtcgcagtggctccaaacaagcaacagtctcaaagaaggctgtgaaacagtgctcactgctctaccgctgtatcacatttttgcgttaaccgcgaacagcttagtctttatgaaaatcggtggttgcaaccatctgattagcaatccacgcaacatgcgaacattcgtcaaagagttgcaacgcgtccgcttcactgtcatcactggagtcaacacactgttcaataaactccttaacaccccgggcttcgacaaacttgatttctcttctctgaagattgccctgggtggcggcatggtgatccagcgctccgtcgccgaacagtggaagcaagttactcatgttccgctgattgaagcttacggacttaccgaggcatcaccagaggcatgcatcaatccgctgaatctgcaagaacataacggttcgatcggtatgccgatccctagtactgatgtctgtattaaagatgacactaacaccgcattacctataggcgaaatgggcgaactgtgtattaaaggtccacaagtgatgaaaggctactggcaacgcccagaagaaacttcagaagtgttagatgcagacggttggctgcatactggggacattgtcaaaatggacaaacaagggtttctgtacatcatcgaccgtaagaaagaaatcattcttgtctctggcttcaacgtctatccgaaggaaatcgaagaagtcatcgcaatgatcccaggcgtggctgaagtcgctgcggttggagtcccggacgagcagtccggcgaagtcgttaaggtagtcattgtcaaaaaggatcccatgctgaccgctgaggaagtaaaggcgcatgctgcgaccaacctgaccagatacaagctaccacgcatcattgagttccgtgcaacactccctaaaaccgatgttggcaagattttgcggcgcgaattgcgagacgcagcaccggcatcaaccacattcacagctcaacccaagtag

SEQ ID NO: 41195 - DNA, 2727 bp, Xylella fastidiosa
atgcgcgattcgttctccacccatcgtcaattacacgtcgggaaccagtcttaccactattacagccttacgaaactgggtgagcacttcgacatatcgcaccttccctactcaatgaagatcttgctggagaatctgctccggcatgaagacggcggcgtcaccgtcagcaccgcgcatattgaggcagtggctaaatggaatcccaaagccgagccggacaccgaaattgcattcatgccagcccgtgtggtgctacaggacttcaccggagttccctgcgtagtcgacttggcagccatgcgtgacgcagccatcagactcggcggcactgcagagcagatcaacccacacatcccatcagaacttgtcattgaccactccgtacaggttgacgtttttggcaaaccggaggcattagaacgcaacggcaacattgagttccaacgcaacaaagaacgttacggcttcctacgctggggccaaaaagcattcaacaacttcaaggtggtaccgccgaataccggcatcgtccaccaagtcaacttagaacacctggctcgcgtggtcatgacgaccgaaaaagagggcgccacctgggcctatccagacaccgtgttcggtaccgacagccataccacgatgattaacgggatcggcgtactcggctggggcgtcggcggtatcgaagccgaagcggcaatgctgggtcagccctcttcgatgctgatcccccaggtggtcggcttcaaactcactggcacactccccgagggcgccacagccaccgatttggtgctgactgtcacccagatgctgcggaaacacggtgtggtcggcaaattcgttgagttctacggtgatggcctagcacatctgccactggctgatcgcgccaccatcggaaacatggcaccggaatatggtgccacctgcggcatcttcccgatcgacacagaatcattgaattacctacgcctgtcaggacgcagcgaatcgcaaatcgcactggtccaagcctacgcaaaagcacaggggctgtggtatgcgcccaacaccccgcctcccagttacagcaccacactggaactgaacatggacgacatcaaaccatcgttggccggtcccaaacgtccccaagaccgtgtgctactgcaagacgtgcaaaacaactaccgcgaacacgttcgcgcactgaccgcacatcgcaccaccaaagccaacgatcacgacacaccccccatcaagggacaagttgacctcgacatcaacggacaaacactacaactcaaggatggtgccgtcgtcatcgcagccatcacttcctgcaccaacacctctaatccggcggtgatgttcggcgctggcctgctggcacgcaatgccgttgccaagggactgcaacgccaaccctgggtcaaaacctcgcttggccctggttcgcgtgttgtcacggactacctggagaaagccggcctgctcaacgatctggagacactcgggttctacgtggttggctacggctgcactacctgcatcgggaattctgggccactgcccccagaagtgagcgcaggcatcgccaagggcgacttggtagccgccgcggtactgtcgggaaaccgtaactttgaagggcgcatccatccagaagtcaaaatgaactatctcgccagtccagcactggtcgttgcctatgccatcgcaggcacggtcaatagtgatctgacctccgagccattgggcaatggcaacgacggacagccggtttacctgcgcgacatttggccaagcaacaaacagattggagatgccatcgccgccacaatcggtccggagatgttccaacagaactacgccgacgtgtttaaaggtgacacccgctggaacaccatcgcctcaccaaacggagcgttgtacgcctgggacacccactcaacttacatcaaaaatcccccatactttgatgggatgacgatgcaaactgagcctgtcaaggacgttcgcggcgcgcgcgtgcttggcctgtttgctgattcgatcaccaccgaccacatctccccagccggcaacatcaaacaggattctcccgccggacgcttcctgcaagcacatggcgtacaacctgccgacttcaacagctacggcagccgtcgtgggcatgacgatgtcatggtacgcggcaccttcgccaacatccgcctcaaaaacctcatgctcaacggcgaagaaggtgggaacacatggtatcgccccaaagccggtgggccaccggagaaaatgtcgatctatgacgccgcaatgaagtacaacacagacggcgtcccgttggtggtaatcgctggaaaggagtacggcactggctcctcacgcgactgggcagccaagggaaccaaactccttgggattaaagccgtcattgccgagagtttcgagcgtatccaccgctccaacctcgtcggcatgggcgtactgccactgcaatttctcgacggccagaacgcacagacactgggtctggatggatcggaaatgttcgatgtgaccggtttggagggcactatcagcaaacatgccaccgtgagtgcaaaacaatccgatggcagcatcaaacagtttcaagtcaaggtcctactgctcaccccgaaggaagtggactacttcacacatggtggactgctccagtatgtgctgcgccatctgatcaacactggcaagcctgcttaa

SEQ ID NO: 41196 - DNA, 750 bp, Xylella fastidiosa
atgcgccccaagattgtggctgggaattggaagttgcatggtagccacgcgtttgcacaggcattggttgcgcaggtcgctgctggtttgccgcttcttggagtcagtgtgattatcttgcctccattgctgtatctgagtgatttggcgcagcgcttcaaaggggaaggtttggcgtttggtgcgcagaacgtcagtcaccatgataaaggtgcttacactggggaagtttcggcggcgatggtggctgatgtcggtgctcattacactttggttgggcattctgaacgtcgggagtatcaccatgaggacagtgagttggtggcgcgtaaatttgctgctgctctgagtgctggcttgcgaccaattctatgtgttggggagagtttgccacagcgtgaggctggacaggcagaggttgccattgcgatgcagcttgcgcctgtgttggctctggttggcccgcagggtgttgcccgtggcttgattgcctatgagccggtttgggcgattggtactggccgtcatgcggatccgagccaagtccaagcgatgcacgcttttattcgtggtgaaattgcgaggcaagatgctagaatcggcgattctctgttgattctatacggaggcggcatcaagccttgcaatgctgctgagttgttttcccagcaggatgtcgatggtgggttgattggtggtgcttcgttggttgctgatgatttcttggctatcgctcgtgcgacggtttag

SEQ ID NO: 41197 - DNA, 2235 bp, Xylella fastidiosa
atgagtaaccaatctgtgaatcctgaggtgcggcctgatcgtgtcaccattgaaattgatggccagaatttagttgtaccgaaaggttcaatgattattcaggctgcagataacgctggtattccgatcccgcgtttttgttaccacgagaagttgccaatcgcggccaattgcagaatgtgtcttgtcgatgtcgagaaggtgccgaagcctttgccagcctgtgctacgccggtgatggaggggatgaaagtccgcacccgcagtgaaaaagccctgcaatatcagcgtagcgtgatggagttcttgctcatcaatcatcccctggattgtccgatttgtgatcagggaggcgagtgcgagttgcaggatgtttcaatgggctatggtcgctcggtcagccgctttcatgagcgtaaacgcgtggtaccggatgaggacattggtccgttggtcgctaccgagatgacccgctgtattcaatgcacgcgttgtgtgcgttttaccgctgacattgctggtacctatgagttgggcggtatgtatcgtggagagaatctgcaaatcggtacttatgacggtaaaccacttattactgagttatctgggaacgtggtcgatgtgtgcccggtcggtgcattgacgaacaaggtatttcagttccgtgctagaccgtgggaattaatggcctaccagtcgttggggtatcacgatgcgatgggttccaacttatttctgcatgtgcgtcagggcgaagtgttacgtacggtgccgcgtgacaatgagtatgtgaacgagtgttggttgtctgatcgtgatcgttattcgcatcaggggttgtacgcggcggaccgtgcggtcaagccgctaaagaaggttggtgaccagtggttggaagtgagttgggccgagggtgtgtccgctgccgctgagatcttgagtgcgcatcgtggcgatgcgcttggtgttttggtgcatcctgctacgtcgaacgaagagggggcattgttggcacgtctggcagcgggtctgggcaccggtaacctcgatcatcggatcttcaaccgtgatttttctgatgttgctgtggccgagccgtttgcattgccgttggcagagatcggcaacgccgatctggtcgtcttattcggaagcaacatacgtcaggagttaccgttgttgcatgcacgcctccgcaaagcggtcacttgcaacggcgccaaggtgtacgcggtaaatccggtcgattttgacttcaccttctcgctgactgggaagtccatcgttcctccgtcgcagttagccaatgcattgaccgatgcggcgttgctcaatgcggcgaaagcggctgcccgtgtggtgattgtggtcggtgcactggctgagaatcacccgcaaggagccacgttgcgggcggcggcgcgtcaatttgctgaggtcacaggtgcggcgttgtgccgcatcccgcaaggagcgaatgcgattggacttacccagcacggtgtgttgccgacaggtcgtgatgctgctgcgatgcttgtcgagtcgtgtcaggcttatgtgttgtacggtattgagccgggcttggactttgccgacacggcgaccgcgcgtcaggcactgcatggtgccaaggtggtcgcgttcagtcacttcgcttgtgcctcaacccgtgatgtcgcggatgtcatcttgcctattggtttattacctgagattgatgggacattgactaatcttgatggtcgcactcaggcggctaagccaggcggcaaattaccgcttgaggcccgtgagggatggcgtgtgctgcgtgccttgggaggtgagttggggctatccggttttggttttctcgatttggtgggtttgcgtgcgcagctgcggtcgcaccccgtggttccttcgacatcggcacagccgattgcaacgcaggaggggttggaagtggcggcgacaccggcgatctatcgtacggatgccgtcgtacgtcgtgctgctgcattgcaggcgcatccgctgaatgttgctccagccctggcgttacatccagagcaggcgaagcaattgcaagtggttgctggccagatagtcaaagtgggtaccgctgctggcaaagcaacgctgccagtggtgttagacacgcgtgtcgccttgggtacggtctggattgaaacgggtcacggtgtcaccgtaccgattggtgctggtcgcgtcacgatggtggcggtatga

SEQ ID NO: 41198 - DNA, 741 bp, Xylella fastidiosa
atgacccttcgcatcgcctacgtcaccagcggcatgggcagtatcggaactgcaatctgccagaagttggcacgcaacggccataccgtggtggctggctgtggccccaactcgcctcgcaaagctaactggctgcgtgagcaacgtgaacttggcttcgacttcatcgcctctgaaggcaatgctgccgattgggattcaacggtatccgcctttgccaaggtaaaagccgaagtcggcgagattgacgttttggtcaataacgccggtaacaaccgcgacatgctgttccggcaaatgggccgtgaagactggaacagtgtcatcagcagcaacctcaattcactgttcaatatcactaaacaagtcattgacgccatgaccgcgcgcaattggggacgtatcgtcaacattggttcggtgagcgcgcacaaaggtcaaataggccaagtgaactacgccactgcaaaggccgcaatgcacggcttcacgcgtgcacttgcacaagaagtcgctacccgcaacgtcaccgtaaataccatttccccagggtatatcgccagcgctgcaatcagcagtttccccccagacgtccttgaccgtctcgccaactcagtaccaatgcggcgcctgggcaaagccgaagaagtcgctgggctatgcgcttggctggtttcagatgaagctgcctacgtcacaggtgccgactacgcagttaacggtggtttacgcatggagtga

SEQ ID NO: 41199 - DNA, 1386 bp, Xylella fastidiosa
atggacactcaattgcccgacgcactgatcactactctgtccactctcctaggctcggaaggctggcgcattgatgccatcagtcgccgccaatacagcgaagacgactcgcagtgctttgcatgtgccgatgcagtggcgctgccacgtgacctcaacgaggtagtggcaatcgtacgtgcctgccgtcaacatcgcgtgccagtgatcccacgaggtaccgggactgggaccgtgggtggtgcagtgccgctccatggcggcatcgttctgtcattggcacgtatgaaccgtatcgtcgcgctgcttccagatgatcgctgcgcagtggtacagcctggggtgatcaacaatgacttacaacaagcactggcaccacatgggcttttttggccaccagatccgtccagtacagcgatgtgcagtatcggcggcaatcttgcaacgaatgccggtggcccgcgtacggtgaagtacggtgcgacacgagataacgtgcttggcgtcgtcgcagtgaccggtgtcggcgatgtgatccgctgtggcggtgcttatacgaagaacgccaccggttacgatctggcacatttgttgattggcagtgaaggcacattagcaatcatcgtcgaagccacgttaaagctggcaccacaaccacaagctatcgctggcctgcgtgcgttctatcaagatacgaccgctgccgctgccgcagtgtcacgactgatgtcacaaccggcaataccagcaacgctggagttcatggaccacaaagcaatcgagctgctgtatcgcaatgatagcaatattcctatggccggcgcgatgctgctgattgagggagacggcaatcacgacacgcttccctatatattacaagcactggcgcaggccgcttcgggtgaggggctgatcgaccttgacgtggccatggatggagccgcacgcgatcaactatgggtggcacgcaagtcactatcgccaatgcttcgcacgattaaacctggaaaactaaacgaagacgttgttgttcccgtctcgcgtattcctgatttggttgctggcatagaagtattggctgccgagagcggattacccattgtcacctttgggcacgccggtaacggaaatctacatgtgaatatcatgtatgacgatcaggatgcggaagacattacgcgggcgcaggcaacgctaccaaagctatttaagttagtcttgactcttggaggcaccctgtcaggtgagcacgggattggcgtagccaagcgtgacttcatgacacaagcattcgatacaccaacgctagcagcaatgcgtgcggtcaaggccgcattcgatccagacggtattctcaatccaggtaaagtgctacccacagtctaa

SEQ ID NO: 41200 - DNA, 954 bp, Xylella fastidiosa
atgcattcagtcgtcgtcgtcggctccttcagtattgatcatgtttggcgctgcgacacattgcccacacctggtgcaacaattgccggccgctatagccgtggtccaggaggcaaaggcttcaaccaggccgtagcggcttgccgcgttggtgcacgcacctatttcatatgcgcactcggcaatgacaccgacggcaacatggcacgcgacatcgccacaaaagacggcttcacactgatcggcgaatccagcaccgaacccactggtaccggagggatctatgtcgacagccacggccataacaccatcgtcactggcgctggtgccaacgcagtactgagcacccacttcatcacagaacaacgcgccctaattacctcagcatggatcatcttggcgcaactggaatcaccgatagaaacactcgaaacggcgctcagcatggcgcgcgaagctggccgcttgaccatactcaatgctgcccccgccaatgcaaccgccacgatcaacctgctcaaattggccgacgtgctcacgctcaacgaaacggaattcgtcgccttgctcagccgtcacgtcggtgaaaggatcagtcccgacaacgtcgccaccaccgatggcaacacactacatgccttatgcaacaagctactgtccgacagtacggttgtcattacattaggctcagctggcgtattcgtttcacactcggaagaaaacctgcgtggtgacacccagccctactatcgcgtggccgccgaacaggcccacaccgtagacaccaccggagctggcgacgcatttaatggtgctttggcagcatccctggcacggcaaccaaacacagcgtttatccagcacatacgcctcgccaatagctatgcagcgcgctcgaccgaaacagaaggtggagccgtatcaatgccaatattaacgactaccccagactaa

SEQ ID NO: 41201 - DNA, 2586 bp, Xylella fastidiosa
atgcggatggataagcttacttcgcgtttccagaatgcgttggctgatgcgcaatcgctggccgtcggtcgtgaccatactattattgagccggtgcatgttttttcggcattgcttgatcagcagggggggagtacacgtccgttgctcatgcaggccggtgtcaatgtgccattgctgcgtgagcggttgaccgagatacttgaggcattgccgaaagtgagtggtcagacggttaatgtctcacccagcaatgaattgagtcgtttgtttcatcggactgataagttagcgcagcagcatggcgatcagtttatggccagtgagtggttcgtgttggctgtggtcgatgatagtggggggctgggccaggcgttgcgtgctgctggtgcggaaaaaaagaagattgaggctgcgattgataaattgcgtggcggtgaaactgtccagactgagaatgcggaggagcagcgtcaagcgttggaaaagtacacgattgatctgactgccagggctgagagtggcaagcttgatccggtgattggtcgcgatgaggaaattcgccgcacgatacaggtattgcagcggcgtacaaaaaataatcctgtgctgattggtgagccgggtgtgggtaaaactgccattgtagaagggctggctcagcgcattgtcaatggtgaggttccggaagggttgcgcagtaagcgtctgctctcgctggatttgggagcgttgattgctggggccaagtttcgtggtgagtttgaggagcgcttgaagggggtgcttaacgatctcgctaagaatgaggggcgggtcattttgttcattgacgagctgcataccatggttggtgccggtaaagccgatggtgcgatggatgctggcaatatgctcaagccggcgttagcacgtggtgagttgcattgtatcggtgcgactacgttggatgagtatcgcaagtacattgagaaggatgcggcgttggaacgccgtttccagaaggtgtttgttggggagccgacggtggaggataccatcgcaattcttcgtggacttaaggaaaagtatgcgttgcaccacggtgtggaaatcactgatccggctattgttgctgcggctacgctgtctaatcgctacatcactgatcgtcagttaccagataaagcgattgacttgatggatgaggctgccagtcgtattcgtatggaaattgactccaagccggaagagcttgatcgtttggagcgtcggttgattcagttgaaaattcagcgtgagatgctgaagaaagaaaaggatgaggcgagcaagcagcgtttagccgatcttgagcgtgatattgaggttctggaccgtgaattttccgatctggaggaggtgtggagatcagaaaaagccgcgctacagggggcgactaagatcaaggagtcgatcgagcaggccaagcttgatttggaagccgcgcagcgccgtcaggactacgccaagatgagcgagattcagtatggtgtactccccgcgttggagaagcagctggtggcagcaagtcaggcggaacagcacgattttacgttggtgcaggagaaagtgactgctgaggagattgccgaggtagtcagtcgttggactggtattccagtgagcaagatgcttgagggcgagcgcgataagttgttgcgtatggaagctgatctaggccgacgtgtggttggtcaagaggaggcgatcaaggtggtatcggatgcggtacgccgttcgcgtactggtttgtctgatccaaatcgaccgagcggctcgttcctttttctgggtccgacgggtgttggtaagactgagttatgtaaggcgctggctgaatttttgttcgacagtcaagatgcaatggtccgcattgatatgagtgagttcatggaaaagcattctgtggcgcgcctgattggtgcgcctccgggctatgtgggttatgaggaaggaggttatcttactgaattggtgcgacgtcggccttactctctgattcttttggatgaagtggagaaggcgcatagtgatgtgttcaatattctgctgcaagtacttgatgatggacgcttgactgatggtcagggccgtactgttgattttcgcaataccgttattgtgatgacatcgaacttgggttcacatcagatccaagaactcagtggagacgattctccggaggtgtatacgcaaatgaaggcggcagtgatggaggtggtgcaggcgcattttcgcccagagttcattaacaggttggatgatattgttgttttccacccgttggacaaggcgcaaatcaagcagattgcgcggattcaactgcaggggcttgagaagcgtctcgctgaatctgagttgaaactagatttggatgatcgtgcgttggaattgcttggtaatgtcggatttgatcctgtatatggtgcccgcccgctgaagagagcgatccaatctcagctggagaatcccttagcgcagcagatcttagctgaagcgttcgtcagtggagatactgtgcaggtgggtgttgatggagggaagcttgtattcgctaaggtgtga

SEQ ID NO: 41202 - DNA, 1212 bp, Xylella fastidiosa
atgtccagctacctttttacatccgaatcggtttcggaaggccatccggataaggttgccgaccaaatttctgacgcagtgctcgatgcgatcttggttcaggatccgcgtgcccgtgttgcttgcgagacaatggttaagacgggtgtagcgatcatcgctggtgaaattactaccagtgcctgggttgatctggaagcgttaacccgtaaagtgattgttgacatcggctataacagttccgacgttggtttcgatggtgctacttgcggcgtgttgaacttaattggtaagcagtccccagatattaatcagggagtggaccgtaaaaaggctgaggaacagggggcaggtgatcagggcttgatgttcggatatgccaccaacgaaactgatagctatatgccagcggcaattcacatatcacaccggctagttgagcagcaagcaaaaattcgtaaaaaaagcaactcgccattgccgtggttacgtccggatgctaaggctcagattactttgcgttatgaggacggtgtggccagtgcgattgatgcagttgtactatcaacccagcacgatcctggtatcaaacagaaggatcttgttgaagcagtgcgtgaggaaattctcaagcctgtgttgccttccaagtggttgcacaaaggaaccaaattccacattaatccaacgggtaaatttgtgattggtggtccggtgggcgactgtggtctgactggccgcaagatcattgttgacacgtatggcggttcagcccgtcatggcggcggtgctttctctggcaaagatccatcaaaagtagatcgttcggcttcttatgctgtccgttatgttgctaaaaacgtggtcgctgctggtttagctgatcgttgcgaagtgcaggtgtcctatgcaattggtgtggctgagcctatttctatctcagtgactacttttggtacaggtaagatatccgacgataaaatcgagaaactaatccgccagcattttgatctgcgtccctatggcattataaaaatgctagatttgattcatccgatatatcaaccgagtgctagttacggtcattttggccgtaagccgagagagttggcttacaccaacagcaacggtgaacgtgtggttgcgactgctttctcgtgggagaaaatcgataaggcagaagtactccgtgccgatgctaaactgaagtag

SEQ ID NO: 41203 - DNA, 1530 bp, Xylella fastidiosa
ttgaaacaaatttcaattttagtgagactctttattacgccatatgtgtcatatccgtgtggttttcttcactcatcgagacccgtaatgtcattcttgccatcgtttctaaagcgcaagtccattgatctaatcaccgtgcatgaagaaggacgacgcctggtccctacactgagctggccacatctgatcgcattgggcattggtgcaatcgttggcactgggatctacaccttaatcggagtcggggcagaaaaagcgggtccagcaatcctcctctcattcgtcatcgctggggtcatctgtgcctgcgcagcactggcatatgccgagatggcgacaatgatgccagtggcaggcagcacttatacgtacagctatgtggccctcggtgaggggattgcctggatcgtggggtggagtctcatcttagagtactcactggtggtcagcactgttgcggtgggatggtccgggtacatgagtgggtttctcaagagcgtaggggtcgatatgccgctggcgctcaccgccggaccgtatgctggcgggataatcaatcttccggcggtagtgatcacctgcgttgtggctggactgctgatcgtcggcacaaaagaaagcaccacactcaacgcggttctggtggtggttaagatcattgcgctctctgtgttcgtcgtgatcgcgctaccacattttgatatggctcatctgaaaccgttcatgccctatgggtttaccaagtcaatcgacaccggaggtgtggaacgcggggtgatggccgctgcagcaatcattttttttgctttctatggtttcgatgcaatctccaccgcagccgaggaaactaagaatccaagccgcgatctgtccatcggcatcatcggttcaatgatcggctgcaccttaatttacgtattagtggcactggctgcgatcggtgcaatgcactacaccgtgttcggtcccagtactgaaccgctggcgctgattctgcggcaacttgaccagggcaacaccgccaggctcatcggagcagctgcgattatcgcgctacccactgtactgttggcctttttatatggacaaagccgcattttgttcgtgatgtctcgggatgggctgctaccacgtggattgtcgacggtgaatgcacgcacaggaacaccgatcgccacgacactgttcactgcaattctcgtcgcaacggcagcagggttggtgccattgggcgagattgccgcgctggctaatgctggcacgctgactgcgttcatcgcagtggctttatgcctgctggtgctgcgggtgcgtgaaccacagcgcgtgcgtgcattccgtacaccactggcttgggtcgtcgggccaatcgcaattgctggttgtttgtatctgttctggagtctgccaaagatgacacagtccctttttctgctgtggaacgcactgggattgtgtgtgtatctggtctatgggcgccacaccagcctgctatcaaaggcggtaagcatcgacacgccaagataa

SEQ ID NO: 41204 - DNA, 1323 bp, Xylella fastidiosa
gtgccagaaaaatctgaggagttacccattatgggtcagtcagttgtcgtgctcggtgcccagtggggtgatgaaggaaagggcaagatcgtcgaccttctcaccgaggaaattggtgctgttgtgcgttttcagggaggtcataatgctggccacactctggttatcaatggtaagaaaaccgttttgcatcttattccatctggaattttgcggaatggtgtgctctgcctgattggcaacggtgtagttatctcgccagccgcattgcgaaaggagattgaggagctggaagataccggtttggaaatacgttcccgtttgaaaatttcgccagctgcgccgttgatcatggaatatcacattgcactggatcaagcacgcgagaaagcggctggcggtagggcgattggtacgaccggtcgggggattggtccggcgtacgaggacaaggtcgggcgtcgtggtattcgtgtcgctgaccttcattacccagaccaattggcggaaaagctacgtgatgcgttggattaccacaattttgtgttgactcgatattttggtgtggatgggatggatttccagcggatctatgacgagatgttagtgttcgctgaatacgtcgagccgatgaaatctgatgttgcgggtatcctccatgacctgcgcaagcaaggcaagcgagtgctctttgagggggcccaagggacattgctggatatcgatcacggcacctatccgtacgtgactagctccagcacgacggttggtggtgctctcagtggtgctggtgttggtgtccaggatatcgactatgtgttgggtattgctaaggcttatgccactcgtgttggaggtggtccatttccaaccgagttggatgatgaaattggccagggtatccgagatcgtggtgttgagtacggtgcttccaccggtcgtccgcgccgctgtggttggatggacattgttgcgctcaagcgtgctgttgccatcaatgggattaccggtctgtgtattaccaaattggatgtgctggacggaatggataagcttaagatctgtatcgcttatgagtaccacgataaacgaagtgagtacgctccgttggatgcgcaaggttgggaagaatgcaccccagtgtacttggaatttccaggctggaatgagagcacgcatggcattacttcgtgggagaaactccctccagcagcccgcgcttatctgtgtgcgctggaagagctggctggctgtccgattggtatcgtgagcactggcccagaccgagagcacacgatcatgttgcatgatccttttgcttga

SEQ ID NO: 41205 - DNA, 1005 bp, Xylella fastidiosa
atggcaatcaaggtcggtatcaacggtttcggtcgcattggacgcaacatattacgctctgcagtgcaaaacttcggcagtaacattgatatcgtagccattaatgacctgctcgaaccagattatttggcatacatgttgcagtacgactcagtgcatggacgctttaaaggagagatcgcaattgagggaactgcactcatccttaacggcaagaagattcgcctaactgccgaacgtgatccgggcaatcttcaatgggctgatgccggtgccgaaatagtgatcgaatctaccggtctattcctgacgcaggaaagtgccgggaaacatctggcagccggcgccaagaaggtcatcatctcagcaccttccaaagacgaaacgcccatgttcgtgtacggcgtcaatcacaacagctacaacggggagccaatcgtctcgaatgcttcatgcaccaccaattgcttggcaccactggctaaagtcatcaacgacaaatggggcattacgcgcggtttaatgaccactgtacatgcggccactgcgacacaaaaaactgtcgacggcccatccaataaagactggcgcggtgggcgcgggattcttgagaacatcatcccatcttcaactggcgcagcaaaagctgttgggaaagtgatcccatcactcaacgggaaattcaccggcatgagcttccgcgtccccacctcggatgtgtctgtcgtggacttgactgtccaattaaacaccccagcaacttacaaagaaatctgcacagaggtgaagcagcaaagtgaggggccgttgaggggcatcctgggctatacagaagacaaagtggtagccaccgacttccgcggtgaaacctgtacctgcgtattcgatgcggatgctggcattgcactagatccgacatttatcaaactcattgcttggtacgacaacgaatggggttattcaaacaagtgcttagaaatcgccaaggtcattgcagctaaataa

SEQ ID NO: 41206 - DNA, 426 bp, Xylella fastidiosa
atggtgcttgagcgtactctttcgattatcaagcctgatgccgtcgcgaagaacgtgattggcgatatctatagccgttttgagaaggctggtcttaaggtcgttgctgctaaatataagcagttatcgcgtcgtgaggctgaaggtttttatgctgtacatcgtgatcgcccgttttttaacgccttggttgaatttatgatctcagggccagtcatgattcaggtactggagagcgagaatgctgtggctcgtcatcgtgagttgttaggagcgaccaatccgaaggatgccgctctaggtacgattcgcgctgattttgctgagtcgattgaagccaatgctgcacatggttcggattcggtcgagaatgctgcgattgaagtggcttactttttcgctgctaccgaaattattttgcgatga

SEQ ID NO: 41207 - DNA, 1014 bp, Xylella fastidiosa
ttgccgatttgcatgcggcaagtgaggtcacgttcagtcacaatagcacgtatgaatcacacttctgatactgctctactgattgttaatcttggtactcctgaggcgccgactgcggcggcggtgcgccgttatctgggcgaattcctgagtgatcgccgcgtggtatccattccgccgttgttttggaagccattgctgcatatggtgattttgccgattcgcggcccgcgttcagccagcaaatacgccaaagtgtggttgcaggaaggctctcccctcagtgtgtatacccgccgtattgctgaagggctgacgcaacatctgcctgattggcgtgtggcttgggcgatgcgttacggtgctccagcattgacaaaggcgctagatgcgctgcaagcgcagcaggtacgccgcatcgtgatactgccgttatatcctcaatattcgaccaccaccacggcctcagtacaggatgtggtggaagcgtggtgtaagcgtactccgcaagtgcaggttgaatgcattcaagactatgccgaggactcagcgtgggtcgccgcggtggctgcttcgatccgtaggcattggcaagcacatggccgcagtgagaagttgatgttctctttccatggactgccgcagcgtgtggccaataacggtgatccctatccgcagcgctgccaggtgagtgcgtctttgattgccgcagcattggatttgaatgagagtgagtgggtgctcggttatcagtcgcgctttggtgctgaacgttggttacaaccatatgctgagccaacgctctgggcgcttgccgagtctggcatacgtcgctttgatcttgtctgcccaggtttttccgttgattgcctggaaacattggaggaagtggcgctcggtttttcagaaacgctggcagcgcgtggtgcaacgatgcgctacattccctgtctcaatgatgacccggcacatgtgcaggcgttggctggactggcgcaacgtgcgttgctgtga

SEQ ID NO: 41208 - DNA, 2103 bp, Xylella fastidiosa
atgccccataaatatcaatggttgcctctctccctcgctgttgcgatgactcttgcaagttgcaaccgtaacgcaccagcaccggtggcgatccctacacccaatccaacacccaagacaaacaccaacgacattgatctctccacgctaccgcccgtcatccgtttcaccgcatcggatctagatccgaccggcaacccctgcactgacctgcacacctatgtcaatggcaactggctgaaagccaatcctgtacctagcgaccgcacgagctggggcgcattccaaatgctggacgaacgctctaatgcgatccagcgtcaactgatcgaacacgccgccgccgaccctcaaagcagcggcattaagaaaatcctcagcgacctatggaacactggcatggacgaggccaagatcgaaacccaaggcatagacccactgaaaacggacttggctgcaatcgacgccatcaccaaccaggacacgttggtaaattacctacgcagcaccgctgccaaaggacagggcgagctattcacgctcagcgcatcccccgatttcaaggaccccacccgcaacatcgcctacatcagtcaaagcggactgggccttccagatccggagtactacaccaaaccagccaacaaagacaaactcctcgcctacaaagcacatatcgccaaggtattggaattatccggaatggcggccgccgatgctacccaacacgccgagaaagtgatcgcgtttgaaacgcgtctggccaaggtctctaaaacacaacaacaactcgcacgtgacacagcgctgcaatacaacccggtcaccccaacccaggcaaacaaattgaccccacattggtcatggactgaagcgttcaaggcccaaggcgtgccgctaccagacatgttctcactggccattccagcgttccacaaagaagtagaccggatgctggctgataccgacgtcgccatatggcgcgcctatctgcgcttccataccgtcgataatgcctcgccctacctgagtcggccattcgtggatgaacacttcgcattctggaacaacaccatgcgcgggcagaaagaaatcaaaccacgctggaaacgagtgttgaacaccatcaatgagcaaacaggtgaagccctaggccaactttatgtcaaggccgccttccccactgaatccaaagtcaagatggaagcattggtcgcccagttgcgtaccgcactcaaagcacgtattgagaagctggactggatgagtccagccactaaatccaaagcactggccaagtgggaaagcttcacagctaagatcggttacccagatcaatggcgatcctgggataacctccacaccagccgcgacagttatctaggcaacgtactgactgcacagcaattcaactacacatggaacctctccaagatcggcaaacctgtagacaagtcagaatgggagatgccgccacaaatggtcaatgcctattacgacccgcagaaaaacgagatcgtattcccagccgctatcctgcaaccaccgttcttcgatccggacgcaccattggaaagcaactacggtggcatcgttgcagtgatcggccatgaaatgacccacggctacgatgaccaaggcagccgctttggaccaacaggcaagttcgagcaatggtggaccaaagccgatgccaaagcgttctcgacacgtaccgcaaaactggtcgcccagttcaacagctaccgcactgaggatgggaaacaagtcaacggcttactgaccttgggcgagaacattgccgatttgggagggctaaatacagcctacgacgccatgaagaccgctaccgccggtcaagcggacccaaaaaccgacggcatgacccgtgagcaacgtttcttctataactgggcaacagtgtggcgtgcacaatacaccccagaagagcaggcaatgcgactgaaaaccgatccacatgccccgccgcatttccgcacaatcggtccgccatcgaatatgcccagcttcgccgaagcattcaattgcaaaccaggcgacgcaatggttcgccgtagtgatcagcaagtcgtgatctggtga

SEQ ID NO: 41209 - DNA, 1041 bp, Xylella fastidiosa
atgtgtaataaaagcgcggtcattacgggtattacaggacaggatggagcttatttagcgcagttgcttctcgaaatgggttatgtggtttatggtacgtatcgccgttctagctcattgaacttctggcgtattaatgaacttgggattgcacagcatcccaagttacatctggtcgaatatgatttgaccgatctctcttcgagtgtgcgactgctcgaattagccgctcctaaggaggtctataatcttgccgcacagagctttgttggcgtctcttttgaccagccattgaccacgacggacattaccggagtgggtgcggttaacctgttggaagccattcggattgttaatcctaagattcgcttctatcaggcatcgacttctgagatgtttggaaaagtccagcagactccgcagattgaggaaacacctttctatccgcgtagcccatacggtattgccaagttgtacgctcattggatgacggttaattatcgtgagtcgtacggtatctttgctgctagtggtattttgtttaatcacgaatcgccgttgcgagcgcgtgattttgtcactcgtaaaatcactcatgcgattgccatgattaaattagggaagctagacgtattgaagcttggtaatttggatgccaaacgtgattggggttttgcgaaggaatatgttgacggaatgtggcgtatgcttcaggctgatgagccagatactttcgtgctggcaaccaaccgaactgaaactgtgcgtgatttcgtcagcttggctgccagtgccgttgatatccagttggagtggaagggacaagccgaacgggaatgtggtgttgatgttgcatcgggaaaaactttagtcacaatcaatcctaagttttatcggccggcggaggtggatttgttgatcggtaatccggccaaagctagaacgaagctgggttgggaaccaaagaccacacttgaggagctttgccacatgatgatggaagcagatgtgcgccgcagcgaacgcgatttcccattctaa

SEQ ID NO: 41210 - DNA, 888 bp, Xylella fastidiosa
ttgacaggtagcagcggttttaccggtcgatatatgctggacgaacttcttcgccatggttacgaagtgattgcccttggtaagtctctcccggagacacaagatgattcggtgcgttggttgcaagctgatctgtgtgatctcgacgcgcttacccggagtgtggctgatgtgcgtccggatgttgtgattcatctggctgcgctggcttttgttgcacatggtagtgcaaacgatttctaccacgtcaatgtgatcggcatgcgtaacctattaactgctttaacccacggcgatgcaacgccagagtgtgtgttgctggccagcagtgccaacgtatatggcaatgcatccgaaggggagttggacgagtctacgaagccagcaccaaccaacgattatgcagtcagcaaactgtctatggagtatgccgctagcttgtggcgtgagcgtttaccgttggtggttacccgaccgtttaattacacagggattgggcaggcagatacttttcttatccctaaaatcgtcgcgcatttttgccgtcgctcccagcatatcgaacttggcaatcttgatgtgcaacgtgattttagtgacgtgcgttcagtcgttcaggcatatcggcgtttgattgaaaccataaacgcggttggaaaaacaatcaacgtatgttctggtgttgcttattccctgcgtgatgtgattgatttttgcagagatattactggacatgccattgcggttcagatcaatccggcctttatgcgtaccaacgaggtgcggattctccgtggaaatcattctctgttgcggcaattgattggcccttggagttctcccccattgagagaaacattggaatggatgctcaaaactgctgtttga

SEQ ID NO: 41211 - DNA, 1644 bp, Xylella fastidiosa
atggctgccaaagaaattattttcagtgaaaaagcccgttcacgtatggtgcacggggtgaacctgcttgctaatgcagtaaaagccaccttaggtcccaaaggccgccacgtagtgcttgataagagcttcggctccccaatcattactaaagacggcgtctctgtcgccaaagaaattgagctggccgacaagttcgaaaacatgggcgcacaaatgcttaaagaagtcgcgtccaaaacaaatgaccatgcaggcgacggcaccaccactgccacggtactagcccaggcgttgatccgtgaaggatgcaaagcagtggccgctggtatgaatccaatggatcttaagcgtggtatcgataaagcagtcattgccgcggttaccgaactgaagaagatctccaagccaaccagtgacgataaagccattgcccaagtcgcaacaatctctgctaactcagacgagtctatcggcaacattattgccgaagcaatgaagaaggtcggtaaagaaggagtgattactattgaggaaggtacgactctagaaaacgaattggatgtcgtcgaagggatgcagtttgaccgtggttactcttcgccatatttcatcaacaaccagcagtcccaaattgttgagctggataatccctacatcctccttcacgacaagaaaatttccagtgtgcgcgatttactcaccgtgcttgacgccgtcgccaaagaaagcaagccgttgctgatcgtcgctgaggaagtcgaaggcgaagctttggcaactctggtcgttaacaacatccgcggcatcatcaaagtctgcgcagtcaaagcacctggcttcggtgatcgtcgcaaagccatgctggaagatatggctgtgctgacaggcggcaccgtcatctcggaagaagtaggtctgtctctggaaaaggccacgaccagccaccttggcaaggccaagaaagtacgcgtctctaaagaaaacaccaccattattgatggtatcggtgacaacgatgcgatcaatggtcgcgtcaagcaaatcaagacccagatcgaggaaaccacctcggactacgaccgcgaaaaactgcaggaacgtgtagccaagctcgccggtggtgtagccgtcatcaaggtcggtgctgcaaccgaagtggaaatgaaggaaaagaaagcacgtgttgatgatgctttacttgcaacgcgtgcagccgttgaagaaggagtgattccaggcggcggcgtggccctgatacgtgcaatcactgcaatcagcaatctgaagggtgccaatgaagaccagacacacggcattcaaatcgcattgcgcgctatggaggcaccattacgcgaaattgttgccaacgccggtgaagagccatcggtcatcttaaataaggtgaaagaaggcaaggacaattttggctacaacgccgctactggcgaattcggcgatatggtcaaccttggcatcctggaccccaccaaggtcacccgttcagcactccagaacgctgcttcaatcgctggcctgatgatcaccacagaagcaatggtcgccgaggctccgaagaaagacgagccaaccccacctgctgctggtggcggtatgggcggtatgggcggtatggatttctaa

SEQ ID NO: 41212 - DNA, 849 bp, Xylella fastidiosa
atgcctgtgtcccgttttgctgtgtttggtcatcccattgctcactcgctatcaccgcgcatccataccgagtttggccgtcagatgggtgtcgcgctgaactatcttgcatttgatgttgccccagatgcgtttcgtgtttcgctggagcgttttgttgcggagggtggatgtggtgcaaacgtgacgttgcctcttaaggaggctgcatttgaggtgtgcacaactttaagtgcacgtgcacgccgtgccggtgcggtcaatacgctatctcgggttgacggtgtttggcatggtgagaataccgatgggacaggtttagtacgtaacttgacggagcggcatggtttggatttgcgtggtcgccgcgctttgctgcttggcgctggtggcgctgcacgtggtgtggctcctgcattgctggatgccggcattactgagatggtgatagttaaccgctcccctgagcgtgccgatatgctgtgcgatgcgcttggtgaacctggcagagtcagtgcacgctactggggtgacttgggtgatcttggaaattttgagttgatcgttaacgcgacttcgatcggaaacacatccgatatgcggactttctctctgccgcgttcgttgttggacagtatgactgcggcggtagacctgaattacggtagtgcagcagtccccttcctggcctgggcgcatgcggttgagacccgctatgtgatcgacgggttaggtatgttggttgagcaagcggctgaaagtttctctctctggcacggtcggcgcccggatactgatccagtgtatacggtattacattcagagtatggcgctcctggtcggtcatga

SEQ ID NO: 41213 - DNA, 1314 bp, Xylella fastidiosa
atgaagttgatctcggcttggttaggtatcccgttctggcaacgcgtggttgctggctttgtactcggggcgctagttggttgggtgatgggaccggccgccaagacttggtttggaccattgggcacgctgtatgtcacgttgatcaagatgatcgcaataccgctggtgttcttcgcggtgattaacgcgattgcggcgctgcacggacaacggtcggtcgccatgttgggcggacgcacgtttctgtggtttatcgtcaccgcagccttggcggtgtgtgtgggattgggtgtgggcacgttgctgaaaccaggtaatggtgacttcactgtgagtgtggatgcagcatgggcgccaccagaggtgccgagtccggtgcatgtgttgctggatgtggtgccatccaatccgttttatgcattgaccggcatcggtactcgcagtaatagcacgggggaaacgacgttggcggccggacgtggctcaattcttccagtaatctttttcgcggcgctgttgggcttggccattgtcaagcttggggaacgcgtgacggaggtacgcaagctgatcgggcagatgagcgagatcatgatccaaatcactcgctttgtgctggagatgacgccgctgggaacctttggattaatcgctacgttggtcggtagctatggttttcagaagttgctgccgtttggtcactttgtattggcactttatttggcatgtgcgttccacattgtggtggtgtacagcgggcttctgctggcacatggtttgagtccattgaagtttttcaggggtgtcgcgccagggatgcaggtcgcttttgtcagttcttccagctttgctgcgatgccagtggcattacgcgcgattacgcacaatctgggggttaacaaggactacgctgcatttgctgtgccgctgggcagtagcatcaaaatggacggttgcggggcgatctttccagcgttgtgtgcggtgttcatcgctcagtacaccggggtgccgctgaccgcgaatcaatatttcgtcatttttatcgcatcggtactcggcagttttggcacggccggggtgccaggtacggcggtggtgatggcaaccgtggtgctgagtgcagctcatttgccgctggaggtaattggttatctgtatgccatcgatcgcgtgttagacatgatgcgcacaatgacaaacgtcaccggacagatgttggtgccggtgctggtggcaaaagaaacgggattactgaatacagcggtttacgaggcagcgtccagtaacgttggaattgggacatcctga

SEQ ID NO: 41214 - DNA, 876 bp, Xylella fastidiosa
gtgagcgaagcgctgttcacgcgctggcgccaacgcaccgacagctacttagaacgaacgttatccatccccacccaagcgccacagcggctccacgccgcgatgcgatacaccgtactgagtcgcggcaaacgcatccgtcccttactggtttacgctgccggccacctgtttcatgtcgatgaacccctactcgacgtaccggctgcggccgtggaactgatccatgcctattccctggtgcatgatgaccttcccgccatggatgacgacctcttacgccgagggcgtcccaccgtccatatcgccttcgacgaagccactgcaatcctcactggcgacgccttgcagaccctggcgtttgaatgcttagccgatgccccatccgacacctccctgcgtatcgcgtggctacagacattgacacacgccgcaggggttgccggcatgtgtggcggccaggcaatagatattgacgccactggccaatcccagacactcaaagcactggaagccatgcatgcgttgaagagcggcacattgatgcgagccgccgtgagaatgggtgccctggctggcgacccttccgcggaagatctgcactccctggacacctttgcggccacccttggattagcattccaagtgcgtgacgacatcctggatatcgagtccagttccgaacaacttgggaaaacggccggcaaagatgccatacagcagaaatccaccttccccgccctcttgagcgtagaaggtgccaaatgctatctacaagaattggcagaacgcctctacacccaattgcacccttacggcgaacgtgctgcccccctgaccgcactggcacgcttggctgtagaacgtgctcactga

SEQ ID NO: 41215 - DNA, 954 bp, Xylella fastidiosa
atgatgcctgtgacagagtctgctttcgctttcgttttcccaggtcagggttcccagtctcttggcatgctctccgagtttgctgtgctctatccggagattctcgacactttcgctgaggcatctgagggagctggtgtggatctttggacgttgtcacaacgtgggcctgaggagatgttgagccgtactgagtacactcagccagcgttgttggccgccggtgtggcgctatggcggctttggcaggctcgcggtggtcgtgcaccggatctgcttgttggtcacagtttgggggagtacagcgctttggtagcggctggtgcattgtcattgaaggatggtgcttacttggtaaggttgcgcggtcagctaatgcaggatgcggttcctgtgggtgtcggtgcgatggccgcggtccttggtgctgaggatgctttggtggttgaggtctgcgcgcaggttgcgggaagcgagattgtcgtcccagctaattttaattcgccggggcaggtggtgatcggtggtcatgccgcggcggttgatcgtgcgctggtgttgttggcagaacgtggtgtgtctaaaacagtcaagttggtagtgagtgtgccgtcacatacgccgctgatgcgtgatgctgcgcatcgtctcgctgaggcgatgcttgggttggtttggaaggtgccgcggattccggtagtgcagaatgttgatggcagagtgcatgacggtgttgaagcgatctgtgaggcgctggtcaagcagctttatttgccagttcagtggacggattgtgtgagagagttggtcacatgtggtgtggtacgtatcgctgaatgtggtcctggtaaggtgctgatgggactcatcaggcgtatcgacaaaacattggatgtccgttcgttggcgactccaacggggttctctgatgtcttggacgagtggggtttttga

SEQ ID NO: 41216 - DNA, 744 bp, Xylella fastidiosa
atgaacaaacccttacagggtgaggttgcgttagtgactggtgctagccgtggcatcggtgctgcagtggctgatcttttggctgatcatggggctaccgtgattggtacggcgacgtctgtttctggtgcgcagttgattggtgatcgtttggctctgctggctggtcatggtcgcgccctggatgtgaacgatactgctgcagttggtgcattggttggggagattgccgaacaattcggttcggtctcgattctggttaataatgctggtatcactcgagacaatctgttgatgcggatgaaggatgaggattgggagtcgattgtcgacactaatctgagcagtatttttcgtaccagcagggcggtggttcgcgacatgatgaaggcgcgcaagggccgtatcatcaacattgcttcggttgttggcgtgactggtaatgccggtcaggcaaactatgctgcggccaaagctggtgtgatcggattcacaaagtcactggctaaggaagttggcccacgtgggatcactgtcaacgtggtcgctccggggtttattgataccgacatgactcgtgtgctgtctgagggtgtacgcaatgatatccttaaccgcgtcccgcttggtcatctcggtgatccggtggatatcgcgcacgcggtggcttttctggctgccccagcagcacgctacatcactggtgagacattacatgtcaacggtggtatgtatatgccgtga

SEQ ID NO: 41217 - DNA, 258 bp, Xylella fastidiosa
ttgcggagtgataagccaatgagtgacatcgaagcgcgcgtcagaaaaattgtcgccgagaaactcaatgtcgatgaagaaaaagtaactaatacctcgacgttcgtcgatgaactgggtgcggattcgttggataccgtcgagttggtgatggccttggaagacgagttccaatgtgagatcggtgacgaggctgctgagaagatgacttcggtgcaacatgccatcgactacattaagagtaatgctaagtgctaa

SEQ ID NO: 41218 - DNA, 1236 bp, Xylella fastidiosa
atgaatcgtcgggttgtcgttactgggatggggatggtgtcgccattgggcaatgatttgaccacaagttgggatggcatcgttcacggacgttcgggtatcgctcccatcgtccagattgatgcttctaagttatccacgcagattgctggcgaaatcaagggattcgatccaatgaagttcgtatccgcaaaggatgcgaagaaaatggattcgttcatttactatggtataggcgcagcgtttatggcgctggatgatgcaggtttggagattaatgagatcaatgctgagcgtgttggtgccttgatcggttctggtattggtggcgtgtttggtattgaggaacagaccatcaagttctatgaggggggcgtacgcaagatatcccctttctatgtgccatcgacgatcatcaacatgctgccaggacagttgagtgttttgaaaggcttgaaaggcccgacgttctctgcggtatctgcctgcgcgacttcaaaccactccattggtatggcaatgcgcatgatccagtatggtgatgctgatgtcatgttggctggtggttctgagcgcgcttcttcgccaactgcgattggtggcttttgtgcgatgagggcgatgtctacgcgtaacgatgatccaaccggcgcttcgcggccgtgggacaaggggcgcgatggctttgtgcttggtgatggtgccggcattctagtgctggaagagtatgagtatgctaaagcgcgaggcgcacgcatctatgctgaattggctggtttcggcgccacttccgatgccttccacatgacgatgccggtcgaggatggtgaaggtgcagcgcgttgtatgcgcatagcgttgcaggatgcgaaggttactccggagcaaattgattatctcaatgcacacggtacctcaactcctttgggcgatctgtgcgaaaccaacgcgatcaagacggtattaggagatcatgcctacaaagtgatggttagctcgaccaaatcaatgaccggacatctactcggtgcggccggtggtgtggaagcaattttctcagtgatggcgttgcatactggcatcgttccgccgacgattaatctcgaagaaccagacgaaggctgtgatcttgattacgtgccgcatgtggcgcgtgaggccaaactggatgtggtggtttcaaacggttttggtttcggtggtactaacggcacattagtgttcaagcgtatatga

SEQ ID NO: 41219 - DNA, 1002 bp, Xylella fastidiosa
atggtaatcaatgacattgaatccctgacagaccaagcattggctgacgtggcggccgcgcagaacttagatcatttggaagttttgcgcgtagcgcttcttggtaaaaatggcagcatcaccttgcagctcaagcaacttggtaaattgccagttgagcagcgtaaggcgattggcgaaaaggtcaactgcgtccgggatcttatctcggtggcattaatggatcgcaaagctgcgttggaaagtgcagcgttgagcaagcgcctcattgatgagcgcgttgatgtcaccctcccagggcgccgaggtgaacgaggaggcttgcatccagtcacccgtactttggagcgtattaccgagatttttgcccggctgggttacgagctggttgaaggtccggaaattgaggacgactggcataattttgaggcgctgaacttcccattgcaccatccagcgcgtgctatgcatgacaccttttattttggtgacggtcgtttgctacggactcatacttctggtgtacaggtgcgttacatgagtgaccaccggccgccgctgcgtatgatcgctgctggcaaggtttatcgcagtgatagtgatcagacgcactcgccaatgttccatcagatagaaggattattgattgacaagcatgccacttttgttcacttgaaagggaccttgtccgagttcttgagagcgttttttgagcgtgattttgaggtgcgttttcgcccaagttatttcccgtttgtcgaaccgggtgcggaagttgatattgcttggcaacagtccgacagcagcgttcgatggctggaggtgctgggttgcggcatggtacatccgaacgtgctgaagaatgttggcattgattcggaatgctatacaggctttgcctttggactaggtgtggaacgttttgcgatgctgcgttacggcgtcgacgacttacgtgcttttttcgagaatgatgtgagatttttacgccagttttcttga

SEQ ID NO: 41220 - DNA, 1860 bp, Xylella fastidiosa
atgccaatccgtcagctacccgagattttgattaaccagattgccgccggggaggtggttcagcgtcccgcctcggtggtcaaagagttggttgagaatgcaattgatgctggtgcaacgcgtgtggacattgagttggaagcagcaggggggcgcttgatccgcatccgtgacaacggccacggtatggctgctcaggaattgccgctggcagtcttgcggcacgctaccagcaagattgcctcattggatgatttggaagcggtcgccacgctgggtttccgtggtgaggcactgccttcgattgtttcggtgagccggtttaccttgatgtcgcgtcgtgctatggatgaacacggcgcggtattgcagattgagggaggcacgctgggcgaggtgatcccccatgcgcatgcaccgggaaccaccgttgaggtgcgtgacttgttctataacgtgccggcgcggcgtaagttcctccgtgctgagcgcaccgagctgggtcatattgaggaatgggcacgttccctggcactggcgcatccagatttagaattgcgtctctcacataacggcaaactttcgcgtcgctataagccgggcgactggtattcagatgcgcgcttgatcgagattttaggagaagattttgcgcatcaggcattgcgtgtagatcacagtggtgcagggttacgtctgcatgggtgcattgtgcagccgcattactcgcgctcgaataccgatcagcaatatttgtacgtcaatggacgtgcagtccgtgatcgtagcgttgctcacgccgtcaaacaggcttacagcgatgtgctctatcaggggcgtcatccggcgtatgtgctgtttctggagttggacccggcacgtgtggacgtgaacgtacacccggccaaacaggaggtgcgtttccgcgatgcacggcttatccatgattttgtctaccgtactgttcagggcacgttggcacagacgcgtgcgggtacgccgccgctggcggtgggtgcgggtgatgtggggggggagggtgcaaggcctcctgtccgtcatgcggtgtcgttttcagggcggcgtggtggtgcctcgcatgtgctggggagctactctgccagcacggctcctctgatgcagagtgcgccaagcgtgtctgtcgctgacgcgcccgcagcgtatgcagccctgtatgctgcgccaccgacacaggtaatagatgcagtgccacagatgcagacggggctgccgctggctgctggggcgggcgacgtaccgccacttggctatgccatcgcacagctgcatggcatttatatcctggctgagtgtgccgatgggctgatcgtggtggatatgcatgcggctcacgagcgtattggttacgagcgcctgaagcgcgcccatgatggtattgggttacgtacccagccactgttggtgccgatgacgttgatggttgccgagcgtgaggctgatgttgctgagtgtgaagcggagacgttggccagtcttggctttgaagtgacccgcagtggtccgggttcgttacaggtgcgtagcatcccggcgttgcttgcccaagcggagccagaaatattactgcgcgatgtgctcagcgatctgagtgaacatggccacacccggcgtgtggccgaggcgcgtgatacgttgcttgcgacgatggcttgtcatggtgccgtgcgtgctcagcggcgcttgagcatttccgagatgaacgcgttgttgcgtgatatggaggctacggagcgctccggtcaatgtaatcacggacgtcctacctgggcgcgttttagtttggctgagatcgatcgttggtttcttagggggcggtga

SEQ ID NO: 41221 - DNA, 1779 bp, Xylella fastidiosa
atgtcgttttccaaacacttcggcaaactcatgttggccacgtgcctatccttatctgcggcaccagtattcagttacagcatcagccatgggaaggtcattgatgacaaaggcaaccaaatacaattaaagggcggcagctggtttggttttgagaccacaaatcacgtggtacacgggctgtggacacgcaattggaaagaattcatcacacagatacagagcatgggattgaacgcagtgcgtctaccgttctgcccagctagtctgaacagcaacacatcaccgagcagcatcgattacaaccgcaatccggacttacaaggcttgagctcgctccaaatcatggacaaggtggtcaaagagctgagcgaccgaggaatatatgtgctgatggatcaccatacgccggactgcgcagcaatttctgaattgtggtacacggactcatacagcgaaaaacagtggattgatgatctacgcttcgtcgcacaccgttacgccaacgtacccggcgtcatcggcttggacgtaaagaatgaaccacatggcagagccacttggggcaccggagatccaaaaactgattggaacaccgcagtcgagcatgcggcagcagcgatcttggaggccgcaccaaaatggctgatcggagtcgaggggattggagagaatcccagctgctccagcaccattgggcatttctggggcgagaacctggaaccgatggactgtacgccactgaaagtccctgccgaccatttgctattgataccacacgtctacgggccagatgtctacgtacagccgtacttcaatagtcccgatttcccaaacaacatggcagcgatctgggataaacacttcggacattttgcgaaagccggctacgcgatggcgattggtgagttcggtggtaagtacggtgaaggtgatccacgcgatgtcgcttggcaaaacgctctggtggattatctaatcagtatcggtgtgacggataccttctattggtccataaacgcgaacagcagcgataccggtggcctgtttcgcgatgactggaatcacgtgcgcgaagacaagctcaccctgctgaagaaactgtggaatggtaaagatggttccggtggtggtggtggctccggtggtggtagtggctccggtggtggtagtggctccggtggtggtagtggctccggtggtggtagtggctccggtggtggtagtggctccggtggtggtagtggctccggtggtggtagtggctccggtggtggtagtggctccggtggtggtggtggctccggtggtggtagtggctccggtggtggtagtggctccggtggtggtagtggctccggtggtggtagtggctccggtggtggtagtggctccggtggtggtggtggctccggtggtggtggctccggtggtggtggtggctccggtggcggtagtggctccggtggtggtagtggctccggtggtggtagtggtaccggtggtggtggctccgatcctacaaagagcaagatttctgttaataccatcgtggacagcgattggcatactggttactgcgaacggatccaagtgactaatatcagcaacagtcccactacctggacggtgacgatttcgatcaggggcaatatccagaccctatggagcgcgcgttggtcagtgaagggtaacgcgctcaccgcttctggtatggactggaataagacgcttgatccgaaaggcacgactgaattcgggttctgttcaaactattga

SEQ ID NO: 41222 - DNA, 1404 bp, Xylella fastidiosa
atgacgtgccgcacccgctttgcccccagccccaccggttacctgcacattgggggcgcccgcaccgcactgtattgctggctggaagcacggcgccgcaacgggcaattcctactgcgcatcgaagacaccgaccgcgaacgcagcactcaagccgcgattgatgccatcctgcatgcaatggactggctgggactggactacgacgcccccccggtctaccaaacccagcgcatcgaacgctacaaccaggtggctgcgcgtctgcttgccgaaggcaaggcgtactacgcttacgactccaaggacacattgaacgccatgcgtgaagcagctctgcgcactggcgaaaaaccacgctataacggcgctgcacgtgaagccaacctgccataccgggatgatcccaaccgggttatccgcttcaaaaatccgcacaccggcaccgtggcgttcgacgatttgatcaaaggccgcatccagatcgccaacagcgaactggacgacatggtcatcctgcgtcccgatggttacccaacctacaacttcgccgtggttgtggacgactgggacatgaacatcaccgaggtgatccgcggcgacgaccacatcaacaatacgccacggcaaatcaacctctatcacgccctgggcgcaccactacccacatttgcgcatctaccgatgatcctggacgaacaaggcgccaagttgtccaagcgtaccggcgcggctgatgtgatgcagtacagagatgccggttacctgccccatgcactgattaactatctggtacggctgggctggtcacacggcgaccaagagctattcaaccggcaagcgctgatcgacctgttccaaatcaacgatgtcaactccaaagcagcgcgccttgacatggcaaaacttggctgggtgaaccagcactatctgaagaccgatgacccggcgacgcttgccccgccattggtctggcatctggaacaacgcggtattgatgtcagcgccggtcctgctccgacggacgtgatcctggccctacgggaacgcgtccagacactgaaagaaatggccgagaaagcagagatctggtactgcccattacagcgctatgatgaaatagccgtcgccaagcatctcaaaccaggtgccgacacggccctactgcacgcacgtaccctgttagccgcacttcccacgtggactgtggacaacgtggacaccgccttgcgcacaactgcaacaacactagagatcggcatgggcaaagtggcacaaccactgcgggtagcgatcaccgggacccaggtcagcccggacattgcctataccgtttacctcaccggccgcaacgaagccttgaaacgcattgatgcggcactgataaaaatctctacggcttga

SEQ ID NO: 41223 - DNA, 1503 bp, Xylella fastidiosa
gtggatggttgggtggtggtggccgtcgcgctgatggttccgcaggcgcgatgcatgatgtcgtttgcctgtgtggggttgggtggcgaggagaggaggggcattgcaagggatgcgggcatattttggtgtgttgcgcgcggtatcactgacacagggggtgtgagtgatggccgtttgcccgttttggcgggtgttggcactgcatggcggtgctcgcaggctgttgctgtcatcggaggtaggttggtgggatggacgcttggtgtttacctactgccagatgaaccgggacaatggcgttttgtttctataaaggaaatcgagatgtccatcgtccgcatgactgatctcgctttatccggtaaacgcgtactgattcgtcaggacttgaatgtaccgattgatcagggtcgtattacttccgagcagcgcattattgcttcgcttccgacgatccgtgtagcgctggagcgtggtgcggcggtcatggtgacttcgcatctgggccgtccgaaggagggcgtgtggagtgaggaggattcattggcacccgtggcgaagcgcttgtctcaattgttggggattgaggttccgttgcgtcgcgattgggtggatggcgtgcaggttgcgccagggcagttggtgttattggaaaactgccgaatgaatgtcggcgaagctgagaatgacgaggcgttggcaaggaagtatgcggcgttatgtgatgtgttcgtgatggatgcgtttggcactgcgcaccgtgcccaggcatcaacgcatggggtgatctgttgtgctgcgattgctgccggcggtccgttgttgatggctgagttggatgctttgagccggggattggagcatccggtgaagccgctgctggcgattgtggggggcagtaaggtatcgacgaaactggagttgctttccaatttggtgaataacgttgagcaattgattacggggggaggcattgccaatacgttccttgccgcagccggttactccatcggtaagtcactgtatgagggggatttgatcgagactgctcgggagattattactgcggcgaaagcgcgtggcgctgagattccgttacccacggatgtggttgttgccaagcagtttttgcctggagtcacggcaacggtgaagacggtggatgcaatcgttgcggatgatcttattttggacattggtccgcagacggcacggcactatgctgccttgattgaaacggcggcgacggtggtctggaatggtccagtgggtgtgtttgagttcgatgccttcagcaaggggaccgaggtgttagcgcgggccgttgctgcctcgtctgcgttttcgattgctggtggcggcgataccttggctgccattgataagtatggtgttgcggaccagatcagctacatctccacaggcggcggtgcttttctggagtttttggaaggtaagacgttgccggcggtggctgccttgcaggcgcgcagcggataa

SEQ ID NO: 41224 - DNA, 1506 bp, Xylella fastidiosa
gtgttactttggctagcttctgtgaaagaggctttctttatgtctgaacgccagcgccgtaccaggattcttgccactctcgggccagcgacagatccgcccggtgtgcttgatgcgctgtttaaggcgggagttaatgtggtgaggctgaatttcagccatggcgatgcttcggatcaggccaggcgtgctgctgaagtgcgtgcggcggcggcgcatgtgggcgttgagattggcattcttgcggatctacccggtccgaagatccgtattggacgttttaccgaggggaaagtgcggcttgtggctgatgcgcgctttgatctgcttgccgatagcaatgcaccgctgggggatgcgactcaagttggggtcagttatctggggttgccgcaggatgtcgccgccggagacgtgttgttactggatgatggcctcatgcaattgcaggtggtgcaagtgcagggcgcacggattgtgacgacggtgcttaacgatggtgtgttgtcggaccgtaaggggttgaataagcaaggcggcggtttgtcgctgggtgcgctgacggatcgtgatcgcgaactgattggcatcgtttccaggatgggggtcgactttattgcagtttcgttttgtcgtcatgctgaagagatgcatgaggcgcgtcgcattgctcgggagtgcggctgtgatgctgcgctggtgtctaagatcgagcgtgctgaggctatcgtgaatcttgccgagattgttgcggcttcggatgtggtgatggttgcgcgtggtgatttaggtgtggagattggtgacgctcaattgccgggcttgcaaaaaaagatcatcaaagaagcgttgctacagaacaaggtggtgattactgccacgcagatgctgcaatcaatggttgaaagtccgatgccgactcgtgctgaggtgctggatgtggccaatgcggtgattgatgggaccgatgcggtgatgctgtcggctgaaacggcgacaggtgattatccagtcaaggcagtagaggcgatggcgcgtatctgtctgggagcggaacaccagtttgagtttgatactgattatgagatggcgcagcgtaatttgcagcgtgcagatcatgcgattgcaatggcaacgatgttcttatctgagcacatttgccttggtggtgtggttgcattgacggagtccggtacgacgccacggtttctctcgcggttccggtcgcacgtcccgatctatgcgtttacgcgtcacgaggatgtgcggcggcgcatggtgctgatgcgtggtgtatttccgatgcgttttgacagccgtggtttgacgccgcgtgaggcagccagggcgacaatccgtcttttggtggaatgtggttgtatgagtccgggggatcgtgtggtgttcacgagcggcgagcatatggaaacgcttggcgcaaccaatacgctgcgtttacttgaagtaggcgctgatgggggtgtcagtggtctgtgggaactctaa

SEQ ID NO: 41225 - DNA, 1005 bp, Xylella fastidiosa
atgagtattgaacagcttgcagaaaccgctcaagcaatggtcgcctcgggtaaggggatcattgcgattgatgagtccgccggcaccattgccaagcgtttttccagtgtcggtatcgaaaatattgaagagaatcgccgtgcttaccgggagttgctgctgacgacccctaaattgagtgattacatttctggggcgattctattcgacgagaccattcgtcaatcgacgaaggccggtgtcccgtttccgaagtacatggccgaccatggcatcatcccagggattaaagtggataagggcgcatatccgttagcagggtgtcctggtgagttggtcacggaggggttggatgggttgcgtgcacgactggaggagtattacaagcttggcgcacgttttgccaagtggcgtgctgttatcaacattggtgatgatattccgtcagggatgtgcatcgatgccaatgtacacgcgctagcgcgttatgcagcgttgtgtcaggagcagggcttggtgccgatggtggagccggaggtcattatggatggtaaccacgacatctcggctgcttatgaagtgaccgaggcgacgttgcgttccctgttcaatgcgctgtatgagcagaatgtggtgcttgaaggaaccattctgaaggcgtctatggtgatccctggtaccgactgtgaggagcaggccagtattgatgaagtggctgaatccacggtgatgtgtttgaaatcgacagtgcctgcgatcctgccgggtattgtgttcttatctggtggacagacggatgcgcagtccacggcacatttgaatgcgatgaatcaattggatcccttgccgtggccattgagcttctcttatggccgtgcgatgcagcaggcggcattgaagttgtggtcacaggatatgaagggcaacttcgccaaagcgcagcaggttgtgtacgagcgggctaaggaaaatggtctggccgctcttggtaagtggaaggggtga

SEQ ID NO: 41226 - DNA, 1839 bp, Xylella fastidiosa
atgctgcgtcacctgctcacgttgccactgatattcgtaatcgcgctgcccattggagttaacgctgcgccttggcctgctttttcaactcggggaacgcaattcatccgtgatgggaggccgtatcagttgatctcgggtgccatccacttccaacgcatcccacgggcgtactggaaggaccgtttgcaaaaagcccgagcaatggggttgaacacggtggaaacctatgttttctggaacctggttgaactccgtgaaggtcaattcgacttcacagggaataacgacattagtgcttttgtgcgtgaagcagcgtcgcaaggtctgaacgtgattctgcgtcccgggccgtatgtgtgtgcagaatgggaggcaggggggttcccagcgtggctgttcgccgatccgacgctacgggtgcgcagtcaggatccacgttttcttgatgctagtcagcgctatctggaggcactcggcacacaggtcaggccgctgctcaatggcaatggcggtcccatcattgcggtgcaggttgaaaatgagtacggctcttatggggatgatcatggctatctacaggctgtccgcgcgctattcatcaaggccggtttgggaggcgcgttgttgtttaccgccgacggggcgcagatgcttggcaatggcacgctgccggacgtgctggcggcggtgaatgttgcaccgggtgaggcgaaacaggcgctcgacaagctcgccacattccatcctgggcagccgcagttggtgggcgaatattgggcggggtggttcgaccagtggggcaagccgcacgcgcagactgatgcaaagcaacaggctgatgagatcgaatggatgttgcggcaaggccattcgatcaatctgtatatgtttgttggcggcaccagttttggtttcatgaatggtgccaacttccaaggtggtcccagtgaccattacagccctcaaaccacaagctacgattacgatgcggcgttggacgaagccggacggccgatgccgaagttcgtgctgttccgcgatgtcatcacccgcgtgaccggtctccagccgccgccattgccagcagcaacccgttttatcgatctgccgaacacgccattgcgcgcatccgcttcgctctgggacaacctgcctgcagcggtcgccaccacagcagatccgcagccgatggagcgctatgggcaggcctacggttacattctgtaccgcaccacgctccacgggccacggaagggcacgctgtatctgggtgaggtgcgggatgacgcccgtgtctacgttgatcgtctcttcgtgggtcgggcggaacggcgtcggcagcaggtctccgtagaggtcgacattccctccggtgctcaccgtctggatgtcttggtagaaaacagtggacgggttaactacggtccgcacctggctgacggtcgcgccgggctgatcgatccggtgatgctcaatcatgaacgcgtcaacaattgggaaacgtttctgctgccgttgcagacgcccgaagcgatccacggttggacaaccgcaccgatgcaaggacctgcctttcatcgtggcacgttgttgatccgcacgcctggagacacatttttggatatggcggctttcagcaagggagtgacttgggccaatggtcacctgcttggccgctactgggacatcggcccgcagcgggcgctttacttcccgggggcgtggcagcgtcaaggggagaacacggtgctcgtcttcgatgtgagtgatacggcagcagcacaggtacgcggtgtgcagcagcaacgctggatcactccaaggacggggaagtaa

SEQ ID NO: 41227 - DNA, 1218 bp, Xylella fastidiosa
atgagtattcatgatgtgcacgaaggcacgtgtcacgtgaccacttccgcggtgcgtgctgggatcgattccgacactgctcatggggcagtgacgccaccgattgtgctttcatccaacttttcgtttgaacgtttcggtcataagcgtaagtacgattacacacgtagtgctaatccaacccgggatctgctcggtgaggcgcttgcggagttggagggtggtgtcggtggtgtggtcacggcgactgggatcgctgcgattatgttggtgttgcacgcattgctccggccgggtgatcgtttggttgtgccacatgatgcttacggtggcagttggcgtttgttcaatgcgctggctcaaaagggacattttgaattgatcacggtcgatttgacggatgcacgatcagtggttgaggcattggcactaccaccgaagttggtattgatcgaaactccttccaatccattgttacgtattactgatttgggtgcggtgattgaggcagcgcaccgtgttggtgctttgactgtggtcgacaatacgtttatgtctccggtgttgcagcgtcctttagagttcggcgctgacttggtattgcattcgactacgaagtacatcaatggccacagtgatgttgtcggtggcgttgttgtggcacgtgatgttgcccactatcagcagttggtgtggtgggcgaatgcgctgggtctgaccggctcgccattcgatgcgttcttgacgttgcggggggtgcgcacgctggatgcgcgtttgcgtgtgcatcaggagaatgcgcagatgattgcagcgttactggaggggcatggtgtggtgaagcacgtgcattacccaggcttggcttcgcatccggggcatgtgctggcggggcggcagcaaaaagggttcggtgccatgctcagtttcgagttgcagggtggggaagcggcggtgcgggcttttgtcagtggcttgcgttatttcacgctggctgagtcgctgggtggggttgagagtttgatcgctcatccggcttcgatgacgcatgctgccatgacgccccaggcgcgtgctaaagcgggtatctctgatgggttgttgcgcttgtcggtggggattgaggccagtgaggatttgatcgttgatctggtggctggtttggggcgtgctcaggcggtgtgtgatggggcggcgcgggaagagtgcaacgtgtga

SEQ ID NO: 41228 - DNA, 1812 bp, Xylella fastidiosa
atgacggtgattgaaatcaaagttcccgatatcggcgattacagcaaggtcccagtcatcgaagtgctggttaccgttggcgaccacgtggtcaaaaaccaagggatcctcacactagaatcagacaaagccaccttggaagtgccatcgatgaataatggcgtggtcaaggaactgaaagtcaacgtcggcgatttgctttcacaaggcgacgtgatcctcctgctggagaccgaagacaccaccgcccccccctcaccaagcaacacggcgacatccgacaccacctcaccgcccccgccatccccccaaccagccgcttccaagccgacagcccccgatcaacaacacgccgacatcacgtgccgcatggtcgtactcggtgccggtcccggcggctacaccgcagcattccgcgccgctgacctcggcttggatacagtcctcgttgaacgctatcccaacctaggtggcgtctgcctcaatgtcggctgcattccttccaaagcattactgcacgcagccgccgtcatcgacgaagctgcacatgccagcacctttggaattgattttggcaaacccaaaatcaccctagacacactgcgcgaatacaaacaaaacgtagtcaacaaactgactgccggcttggccgggatggccaaacaacgcaaggtacgcaccgtcaccggcatcgcgcacttcgtctctcccaacacactggacattaccactgctgacggcagcacccaacgactccatttccaacaatgcatcattgctaccggctcacacccagtgaagctaccaaacttcccttgggacgacccgcgcatcatggactccactgacgcactggaactggccgaagtgccaaaaaaactgcttgtcgttggtggcggcatcatcggcctagaaatggctaccgtgtacaacgccctgggcagccacgtcaccattgtcgaattcatggaccagatcatccccggcaccgacaaagatctagtgaagccactggcggaccgcatgaaaaaacaaggcattgaaatacacctgaacaccaaagcgagccacgtcaaagccgacaaaaaaggaatcaccgtctcattcgaagcacccacccaaggcacacaacccgcattaaaaacatcgacctatgatcgcgtccttgttgccgtcggccgtacaccgacaggcaacaacatcggcgctgaaaaagcaggcgtcaacgtcaccgaacgcggcttcatcccggttgatcgccaaatgcgcagcaacgtaccccatatctttgccattggagacattgttggtaacccaatgctggcgcacaaagccacacatgaaggcaaactggccgccgaagtcgccgctgctgaaacagagtccggcaaacatcgggaatgggttgcccgcgtgatcccatccgtggcctacaccaacccggaaattgcctggatcggtatgactgaaaccgaagccaaagcgaaaagcctgaacatcggcgtcgccaaattcccctgggctgccagcggtcgcgctatcggcatcggacgcactgaaggcttcactaaactcatcttcgacgaagacacacaccgcatcattggcggagcgatcgtcggtgtccacgcaggcgacctcttggctgaaatcggactcgccatcgaaatgggtgccgaagccgaagacatcagccacaccatccacgcacaccccacactaagcgaatcgattgccatgagcgccgaagtctacgacggcaccatcaccgacttgtatctccccaaaaaacccgccacttcagcaaagtaa

SEQ ID NO: 41229 - DNA, 1656 bp, Xylella fastidiosa
atgaccgaaatcaaggaagcttttgtccccgatatcggtgactacagcaacgtcccagtgattgaagtgctagtcgctgttggcgataccgtctccaagggccaaagtttgatcaccttggaatctgacaaagcaaccatggaagtaccctcgtcaacggccggtatcatcaaagaaataaaagtgaaggttggcgataccttatcccaaggccatgtcgtcgcattaatcgaagtctccgaagagactgccggagtcaccacacccatgaccgttaacacgccagccacgcgtgctcacaacgctgcacctccagaagacggaggcagcttaatcgaagtgcgtgtccccgatattggcgattacagcaacgtcccagtgatcgaagtcctggtgactgttggcgataccgtctccaaagaccaaagtctaatcaccttagaatctgacaaagcaaccttggaagtgccctcctccgccacaggtgtcatcaaacaactcaaggtcaacgttggagacaccttgtcgcaaggcgacatcgtcgtcgtgcttcaaagcgcagagagcaccccactcactccagccacaaacaaaccagcattgccacccaattccagccctgcacgcgatgccatctccgccccagcatcccctgcagggacaccgagcaccccaccgatcaccttcgacgccaacaccgtgctaccgtccaagatcccctatgccagccccgcagtacgcctgcttgcacgccagttaggcgtggacctgagccgcatcaaaggcagcgagaaaaatggacgcattacccgcgaagacgtacagaaattcgtcaacgccaccgtaggtactggtattcctgaaggcagaacaccctccgcttcaatcaccacaaatggtggcctcaacttactcccttggccgaatgtggatttcagcaaattcggcgaaattgaaacccagcctttatctcggatcaaaaagatttccggtgccaatcttgcccgcaattgggcgatgatcccgcacgtcacccaattcgatcaggccgacatcaccgaactggaagccctgcgcgtacaaatcaataaagagaatgccgcacccaacaagaacggaaccggcattaaactgactgttctggctttccttatcaaagcaagcgccgcagcactgaaaaaatttccaacattcaatgcctcccttgatgccactggcgaaacgctcacactcaaaaaatacttccatatcggttttgccgccgacacaccaaacggactcgtcgtcccggtgatccgcaacgtagaccaaaaaggcatcgtagagatcgcacaagaaaccagcgatctcgccaaaaaagcacgcgatggcaaactcaccccagcagacatgagcggtggttgcttctccatcagctcactcggtggcatcggagggaccgcattcacacctattatcaatgcacctgaagtagctatcctgggtgtctccaaatccctcatccaacccatctgggatggcacacaattcgcacctaaaatgctgttgccgctgtcactgagctacgatcaccgcgtcattgatggtgccttggccgcacacttcaccacttatctcagccagatactcgccgacatgcggcgcgtactgctgtga

SEQ ID NO: 41230 - DNA, 786 bp, Xylella fastidiosa
ttgaggacgatgacccaatcccgttggcgtttggatggccgtacggctttgatcacgggggctagtacaggtatcggtctggctgttgctcgtgagttgttgggcctgggtgccgatgtgctgttggtagcgcgtaatgctgatttgctggggcgagtacgcgatgaactggcagaggaattccctgagcgtgagttacatggattggctgctgatgttgctgacgatgtggaccgccgtgcgattctggattgggtcgaagattgcagtaatggtttgcatgtgttgatcaacaatgctggtggtaatgtgacgcgtgcagcgcttgaatatacagaagacgagtggcgtgagattttcgagatcaatctgttctctgcgttcgagttgtgtcgttacacgcagccgttgctggcgtgtcatgcaagtacggcgattgtcaatattggcagtgtatctggcttgacgcatgtgcgcagtggagtgccgtatgggatgagcaaggcggcgttgcaccaaatgacccgcaatttggctgtggaatgggctgaggatgggatccgtgtcaatgcggtagcgccttggtatatccgtacgcgtcgtacgtcggagccgctctctgatgtgtactattacgagcaagtcattgaacgtacgccgatgcgccgcattggagagccggaggaagtagctgcggcagtggcatttctttgtttgccagcgtccagttatgtgaccggcgaatgtattgcggtggatggcggttttatgcgctatggtttctga

SEQ ID NO: 41231 - DNA, 957 bp, Xylella fastidiosa
ttgtacttcaaagctgttgtcctcattaattttaagagtattactgtcttgtcactttccgggattattactgcgctggtcactccgtttgatcgagatggcgcgtttgaccgtgatgcgtggattcgtctgctggatctgcaattagcgggtggcgtgcagggcgtggttattgctggttccaccggcgaagcagcgacgttgaccgatgctgagtatgacgagatgctgtgctcggctgtggtccgagttggtgggcgtgtgccggtgttggcgggtactggtttgtctgggactgcgaaaacgatttctcaaactaaacgcgcggccgacaatggtgcaggctatgctttggtggtgacccctccgtacatacgtcccaaccaaggtggtctgaaggcgcattatttggctgtggctgaccaggggggattgccagtcgtgctgtacaatgtgcctagccgcaccggctgtgatctgttgccggagactgtcgctgatttggcggggcaccctaatattgtcggcattaaggaggcgtgcgctagtcgtgagcgtgtccaggcgctgcttgctttgcgtcgtccaggctttactgtattcagtggtgatgacagcagtgctgcgcgctcgatgttggacggtgccgatggtttggtttcggttgcttccaacgtattgccgtccgcttatcgtcatctatgtgatcttgctcgggcgggtgagcgtggtgctatcgatctgtggaatgcgcgtctgtctgattttcacgcattttgtggtctcgactccaatccgattccaattaaggcattgttacagcgtatcggcattggttatggattgcgtctgccactgctacccttgtcggtatgccatcatgacattgccgatcacttggctgaccaagtggcggcattggaagcactttctagccgtaaaatagttgcggcctga

SEQ ID NO: 41232 - DNA, 1473 bp, Xylella fastidiosa
gtgtgtcgatctttacggaggttagtaccaataggttatctgcatgactacgccatccttcgagaattgcaccatttgaagcccgcactacgcggttccgttttgtctaccggagtttgtttcatgcatctcagctctcgggccaatgcgcctgccccgcataaaccttataaccctttttatttacagttgtatttctgggtgatcatcgcgattatcctgggggcgctgttaggccattgttatcctgttgtgggtcagcaactcaagccgttgggggatgcctttatcaagctggtgaagatgattatctcgccagtgatttttctgacaatcgtgaccgggatcgctagcgttgcgcatgtggggacggtggctcgcgtatttggtaaggcgatggtgtatttccttttcttttccacgctagcgttgctgctgggtttggtcgttgctcatgtggtgcatccaggtgtgggcatgaacattaatccagcggatctccatcagggggagatcgcaagttatgtggagaaatcacacgatttgacgttggttggctttttgatggacatcatcccgaagacactgttgagtccgtttgttggggacaatattttgcaggtgttgtttgtggcagtgttgttcggtattgcgttggcgcttgctggggaacgtggtaagccggtgctcaatttactggatgcgttgaccttaccagtattcaagcttgtccagatgttgatgaaaatggctccgatcggtgcattcggagcgattgcgtttacgattggtaagtatggagttgattcattggtgaatttggggtggttggttggctcgttctatctcacttcgctgttgtttgtgttggtgattctgggggcggtgagttggttctctggtttttcgatactgaaactgatccgctacttgaagtcggaactgttgttggtgttgggaacttcatcttcggaggcggcgttgccgtcgctgatggaaaagatggtgcaagcagggtgtaaaaagtcggtggttggattagttgtgccgactggttactcttttaatctggatggcaccaatatttatatgaccttggcagcgttgtttattgctcaggcgaccaacacggagctgacaccagcgcaccaacttgctttgtttttggtggcgatgttgagttctaaaggggcagcgggtgtgtccggtgccggctttatcactttggcagcgacgttgaccgtggtgccggaagtgccgattgcgggcatggcgctaatcctgggggtagatcgttttatgagtgagtgccgttcactgaccaattttattggcaatgcagtggctacgctggtagtttcgcgttgggagaatgcgttgaaccatgagcagctcaaaattgcactggatggcagtgaacctgcataccagtcactacatgctaaggatgctgagccgtctgtgtcgcgttga

SEQ ID NO: 41233 - DNA, 1914 bp, Xylella fastidiosa
atgaccctcgaagcagacaaacaaacccacggcttccaaacggaagtgaaacagttactgcaactgatgatccactccctgtactcaaacaaggagattttcctacgcgaattaatctccaatgctgccgatgctgccgacaaactgcgctttgaagcattgagcgcacccgcattactggaagaagatcccaacctgcgcatccgcgttgagtttgataaacaagcacacaccatcaccattgatgacaacggcattgggatgagccgtgatgaggccattgcacacctgggcacgattgccaagtcaggcaccgcggatttcctcaaaacactgtctggggatcaacgcaaagacgccaatctcattggccaattcggtgtcggcttctacagtgcctttattgtcgccgaccacgtcgacgtctacagtcgccgcgccggactgacagcagccgagggtgtgcactggtcgagcaaaggtgaaggcaactttgaagtggccaccattgataaaccccaacgcggcacccgcgtcgtgctccacctgaaagaaaatgagcaacactttgcagaaggatggaccctgcgcagcaccctgaaaaaatattccgaccacatcggcctacccattgaaatggtcaaggaggaacaccacggcaaagaggaagaaaaagatgcccccaaagaagccgagtgggaagccgtcaacaaagccagcgccctatggacacgccccaaaaatgacatcaaggatgaggaatatcaagaattctacaaacacatctcacacgatatgaccaacccgctcgcctggagccataacaaggtcgaaggcaagctggaatacacctcattactctacgtcccaacacgcgcaccattcgacctgtaccaccgcaatgctgccaagggactgaaactgtatgtacaacgtgtcttcatcatggatcaagcggaacagttcctgccgctctacctgcgcttcatcaagggcgttgttgactctgccgacctctcgctgaacgtctcccgcgagatcctccaatcgggcccagtcgtggactccatgaaagccgcactgagcaaacgcgccctggacatgctggaaaaactcgccaaagacgccccagaagattacaaaaccttctggaaaaactttggccaggtactgaaagaaggacccgccgaggactacagcaaccgcgagaaagtcgccagcctgctgcgctttgcctcaacctacgacacctccggtgatccctccgtcgcactcgccgattacatcgcacgcatgaaagaaggtcaggacaagctctactacctgaccggagaatcctacgcacaaatcaaggacagcccatacctggaagtattccgtaaaaaaggcattgaagtactgctactggtagaccgcattgacgagtggttgatgaactacttacatgaattcgacggcaaatcctttgtagacattgcacgcggcgatctggacctcggaaacctcgacagcgaagcagacaaaaaagcacaagaggaaatcgcaaaaaccaaagaagcattagccagccggatcaaagccacactgggagaagatgttgccgaagtgcgcgtctcacatcgcctgaccgattcacccgcagtactcgccatcggcgaaggcgatctcggcctgcaaatgcgtcagttactcgaagccagcggccagaaagttccagaaacaaaacccgtcttcgaattcaacccaagccacccactcatcgaaaaactggacgccgaacaagacatggaccgttttgcggacctgagccacatcctgttcgatcaagccgcactcgctgctggagacagtttaaaagacccggccaactacgtgcgccgcctcaacaaactcctactggaactatcggcctaa

SEQ ID NO: 41234 - DNA, 1011 bp, Xylella fastidiosa
atggccttgaaacactttttgaatacccaggactggagttgctctgaacttaatgcactgctgacccaagcacgcgcgttcaagcacaacaaactggggaacggcctgaagggcaagtccatcgccttagtatttttcaacgcatccatgcgtacccgcagcagctttgaactgggagcatttcagttgggcggtcacgccatcgtcttgcagcctggcaaagatgcctggccgatcgagttcgataccggcaccgtgatggaagcagagaccgaagaacacatctgcgaagttgccagagtcctgggtcactacgttgacctcatcggcgtgcgtgcgttcccgaaatttttagactggacttacgaccgccaggacatcgtactcaacggctttgccaaatattccccagtgccggtgatcaacatggagacaatcacccatccctgccaggaactggcgcatatcatggccttgcaggagcactttggcaccacagacttgcgcggcaaaaagtacgtattgacctggacctatcaccccaaaccgttgaatacggccgtggccaattccgcactgaccatcgcgactcgcttgggcatggatgtcaccctactgtgcccaaccccggattacgtccttgatgagcgttacattgattgggcacagcagaacattgcagacactggcagcacctttcaagtgagccacgacatcgacaacgcctaccgtggtgccgatgtgatctacgccaagagttggggcgcactcccgttctttggcaactgggccatggaaaaaccgatacgcgaccaatacagacactttatcgttgacgaagccaaaatggcgttgaccaacaacgccgtcttctcgcattgcttaccactgcgccgtaacgtcaaggcgaccgatgcagtgatggatggacctaactgcattgccatccatgaagctggcaaccgcctgcatgtacaaaaggccatcatggccgcactcgcttcccaataa

SEQ ID NO: 41235 - DNA, 1206 bp, Xylella fastidiosa
atgagtaagaaaaacattgtcttggccttctccggtggactcgacaccagcttttgcatcccctacctgaaagaacagggctatgccgtacacaccgtatttgccgacaccggcggtgttaacgaagaggagcgcgacttcattgaaaaacgtgctgccgaattaggcgtggccagccacctcaccgtggatggcggccctgccatctgggatggtttcgtaaaacagcttgtctggactggcgaaacctaccaaggccagtaccccttacttgtttctgatcgctatttaattgtggatgccgtactacagcgtgccgatgcactgggcacctgcgccgttgcccatgggtgtactggcatggggaacgaccaagtccgcttcgacctggcgatcaaagcacagggcaactacaccatcattgccccgattcgggaaatccagaaagagcacacccagacccgtctctacgaacaaaaatacctagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccgccgatcccctcacggtggctatcaaattcgttgaaggcgaagccgtcgccgtagatggaaaacccctttccggccctcagattctgatgaaactcaacaaactcttcgcctcctatggcgtgggacgcggtatttacaccggcgataccgtcattggcctaaaaggccgcatcgtatacgaagcccctggactcaccgcactgctgaccgcccaccgcgccctggaagacgccgtgttgaccaaacaacagaaccgcttcaaaccgcacatagcccgtaaatgggttgaactggtgtacgaaggatttttccatgaccccttgaagaccgacctagagaccttcttaaaatcctcccaagctaacgtgaatggtgaaatcgtccttgaaacccgaggtggtcgagtcgatgccgtcgcagtacgctcaccgcacatcctcactagcaaaggcgtcacctacgcccaaaccgctgactggggtattgaagaagccgaaggatttatcaaactctttggcatgagctccaccctatacgcccaggtaaatcgttccctgcgctcatga

SEQ ID NO: 41236 - DNA, 1338 bp, Xylella fastidiosa
atggacaccccccccatgccctccctgctctggcacaaacccggcgtggcgatcgacgccaacatccaaaccttcctggcagccgatgatgtccttctggaccgcgaattcttcctctacgacatcacagccagcacagcccatgcccaagcattacagcgcatcggcctcctcacccccgacgaactcgacaacatcctccgagaactgcaacacctcaccgacgaataccgcaacggcaccttcctcctagatacacagtacgaagacggccactccgccattgaatcccgcttgaccgaacgcctcggagagaccggacgcaaaattcacaccggtcgcagccgcaacgaccaaatcctagtcgccacccgcctatggctgaaagaccgactcacccaactgagcaccttgaaccgtgacattgcccaccatgcattacagcgtgccgcggccgaacaacacctccccatgcctggctacacccacctgcagcgcgccgttgtctcatcggccggcatgtggtgggccggctgggctgaatccttcatcgacaacgctgtacgcgccgccgatacccacgccctgatcgactgcaaccccctcggcaccgccgccggctatggcgtcaacctccccctggatcgcccccacaccaccgctgcactgggctttgcacgcctccaggtcaaccccatctgcgcccaactttcccgcggcaaatttgaactggccgcactcgaagcactcggcagcgccaccttagacctccgccgtatcgcctgggatctctccctatttaccaccagcgaatttgcattcatcaccctgccgcccgaatacagcaccggcagctccatcatgcccaacaaacgcaacccagacgtcatcgaactcatgcgcgccacccatgccagcgttgccgccgcccgcaccgaaatcgaacaactcctctccctcccgtccggctaccatcgcgaccttcagaacagtaaaggcgccatcgtccgcggcttcaaacgcggcctggccgccttagaactcttacccgcactcctgtcccgcctacagtggcgcccagacaccctccgtgccgccattgatcccggcatgtatgccaccgatgccgctattgaagccgcaatcgccggcatccccttccgtgacgcctaccagatggccgccaaaaccgctgacaccgccgcccaaggtcgcaccccagaaaccagcctcaccgcacgccgctcccccggcgctgccgctgatttatgcctggagaccctccgtgcccgttggcacaccttgacccaacccacctccgacccagacccgcggtga

SEQ ID NO: 41237 - DNA, 1455 bp, Xylella fastidiosa
ttgcaccccctgcctactacaaccgtcgatgccccccgcctgcagaacatatcccaccgtttgccttctcaccccctgagcacatccagcacagcaaccacccatcccccccaccatctcctcacatctcagcccctgcgctgccccgtgccacactgccaacaccccccgccaacacctatccccttgcacccacggccctacctgatgtcccacatccgacaccttgcccaacaatgccgcgacgccgcccgccgcctggcgaccttatccaccgacgccaaacgccgcctccttgaaacaatggcgaccgccttgaacaccgatgccgcaaccatcctcgccgccaatgctgccgacctcgacgccgcccgcacccaacaggttggcaccgccatgctcgacagactcgccctagacccccaacgcctcgccgccatggccgatgccttacgtgacattgccgcattgccagaccccgtcggccaagtgacccgcgacgaccagcgccccaacggcatccatgttcagaaaatccgcgtcccactgggcgtcattgccatgatctatgaagcaagacccaatgtgaccgccgatgccgctgcactctgcatcaaagccggcaacggcatcatcttgcgtggcggttccgaagccatccgctccaacatcgccattgccaccgcactacagcgcgccttgcgcctcgcctcactgcctgaaaccgccctgattctcgtccaagacatggcgcgccacaccatgctggaactcctacaactcagcgaccttattgacctggtgatcccccgtggcggcgaaggcctcatccgcttcgttgccgaacatgcacgtatccccgtcattaaacattacaaaggcgtctgccatcagtttgtcgatgcctcagccgacatcgagatggcaatacgcctgctgattgacggaaaaaccacccgtccggctgcctgcaacgccctagaaaccttactcgtccataccgacatcgccccacgcttcctccctgccgccgccgctgccttacgtccctatggcgtccagctgcgtggtgaccacgccacctgcaccttgcttcctgatgtggtcctggccacggacgccgactacgccgccgaatatctcgacttaatcctggcaatacgtattgttcccaacgtagatgccgcacttgaacatatacgccgctacggctccgatcacaccgaagtcatcgtcaccgccgaccccgcacatgccgacaccttcgtacaacaactgtattccgccgtcgtcatggtcaacgcctcctcgcgtttttccgatggtggcgccctcggactgggcgcagagattggcatttccactacacgactccacgcctatggccccatgggattagacgcactcacagtagaacgctttgtcgtccgcggccaaggccaagtccgccactga

SEQ ID NO: 41238 - DNA, 2613 bp, Xylella fastidiosa
atgccaaaaaagaactccccactcctcccgaaagaaacgacgcctactcaatccagcgttgacacctcgggatcatccaatctgacctggcccgtctctgaacacacgatacgtcgcccgctgtgggcgcgcctgcttggccagatacttgatccttggttggatctctccatagagccagaacactgcgttcaatatccagaacactgcgttcaatataacgatggccgccccatcatctacgtgctggaagactatggcctgtgcaatacactgatcctggacaaagcctgccgcaaaaccaagttgccatcgccattgataccgcttccaggcaatccactacagcgcaagcgtgcttacttggccctgtcgcgacgtagctccagcaactcactgatccctaaccagcgcggcggcaaaacacactccgactcgctagccaatctactccaagcacaccgtatacgtgacacccttgatgtgcatttagtgcccgtatccatcttcattggacgtacaccagatcggcaaagtggctggtttgcagtgcttttctcggaaaattgggcgctcgttggccgcttccgacgcctcctggcggtattactcaatggacgcaacaccattgtgtgcttcgcaccccccatctcagtacgtcaaacactgaacgaaggtttgccgcctgaacgtactctgcgcaagctacaacgtgtattacgcgcccacttccgccgtattcgggaaacagtgatcggtccagatctgtcaacccgtcgcttactggtagacaatgttctggcaacagaagcagtgcgtgaagccattgcctcccaagccaagcgcgacggtaccgatctgtcggaaacctggcgcaaggcgcaagcttacgcctgggaaatcgctgccgactattccagccctgtcatacgttcggccgattttttgttcagccatgtctggaaccgcatctatgccggcgtactgatccaccacgtggatagcttcaaagaaaccgcaccagggcacgaggttgtgtatgtacccagtcaccgcagccatattgactacctgctactgtcgtactgtttataccaatgcggcatcgtgctcccacacatcgtagcgggcatcaacctcaatctgccgatcgttggcactctgctgcgcaaatgcggcgcatttttcatccgtcgatccatcaaaggcaatatgctgtattcgatcgtgctcagcgaatacgtagcacaactggtggcaggtggttattcgctggaatattttatcgaagggggacgctcgcgtactggccgcctactacaacccaagggcggaatgatcatgatgacgctgcaagcgttcttgcgccaaccacgcaggccggtgctgttccaaccaatctatatcggctacgagaagctgatagaaggcaccagctacttagatgaactgtccggagaacccaaaaagaaagaatcgatttggaggctattttggaatattcccaaagtgctcaaacagaagtatggccaagttgtggtgaacttcggcgagccaatcgcactcaacgacgtactcgccgaactagccccagaatgggaaggtcaagcactcaacgaaaatgagaaaccagcttggttatcaaacaccgtcaaccatctcgctcggcaaattcagactcgcatcaacagcgccgctgacgtcaacccaatcaacttattggcacttgcactgctatccacacctaaacatgcgatgggtgaagctgacctgatcgcgcaaattactctgtgcaaaaaaatactgcttgaattgccctattcaaaccgagtgaccgtcactccacacaccccagaacgcatcattgcccacgccgaacaaatcaacatactcacccgtgtccaccatccacttggcgatgtattgagagtcgatggagacaatgcagtcctgctcagttacttccgcaacaacgtgttgcatctatttactgcctccgcgtgggtggcctgttgcttcaaaaacaaccgacgcataagccgcattgctctgatccgtctgggggttggtatgtatccattcctacaagccgaattattcctaccatggactgaggaccaatttgcccaacacatccaacaggtcattgaattatttgtccgggaagggcttctcctgtcagccggcgatgaggaagaagacccactcacacgcaacacaagccagaccgacgaagtcttccgcctacgggcgatcagtcattcattgcaacaagcattcgagcgctactacatcaccatttcaatattggtgaaaaacggccctggcaccctcagcgcatccgaattggagagcctgtgccagctcgctgcacaacgcttaagcctactctatgcgtcgaccgcaccggagttttttgataaaggactgttccgcggcttcatccaaaaacttcgcgaactgaacttagtatggccagacacatatagcaaactgctatttgacgaacgtctagacacatccgccaaagacgctcaagtgatccttggccgcgaactacggcacacgatcgagcgcatcagtccggaagcaacgaaacctgcaccaaaataa

SEQ ID NO: 41239 - DNA, 1341 bp, Xylella fastidiosa
atgccgggactcatgtccattcgccgcaaatatgccagcaaacaaccactcaaaggcgtacgcgtgaccggctcgcttcatatgaccatccagacagccgtactgatcgagacactaaaagatatcggtgccgatgtacgctgggcctcgtgcaacattttttccactcaagatcatgccgctgctgcgatcgccaccagcggcacacccgtgttcgcctggaagggagagacattagaggaatactgggattgcaccctgcaagcactcaccttcaccctgtcggatggcacactgaccggcccagaattgattgtggatgatggcggcgacgctaccctcctcatccacaaaggctatgaattagagaacggatcaacctgggtcgatgaacccagtgactcacttgaagaacaggtgattaaacgcctgctcaaacgcatcgccattgagcgccccggctactggacccgagtcgtcaacgactggaagggcgtgtctgaagaaaccaccacaggtgtacaccgcctgtaccaaatcgctgcaaccggcaggctgctcgtacctgcaatcaacgtcaatgattcggtcactaaaagtaaattcgacaacctatatggttgccgcgaatcgctggctgatggtttaaagcgtgcaatggacgtgatgttggccggtaagttagctgtggtatgcggctatggcgatgttggcaagggttcggcacatagtttgcgcgcctacggtgcccgcgtgatcgtgaccgaaatcgatccaatctgtgcgttacaagccgcgatggagggttttgaagtcacaacggttgaggacacactcggtcaggccgacatctatgtcaccaccacaggtaacaaagatgtcatccggatcgaacacatgaccgcaatgaaagaccaagtgatcgtctgcaacatcggccactttgacaatgaaattcaagtcgatgcactcaatgccctggctggggtacaaaaaatcaatatcaaaccgcaggtggataaattcatattacccaacggcaatacactctttcttcttgcagaaggacgcctcgtcaacctgggctgcgcaacgggtcatcccagcttcgtcatgtctaacagcttcgccaatcaaactctggcacagattgatctgtggcaaaacaaagacgtttacgaaaaaaatgtttaccgcttgccaaaaaaattggatgaagaagtcgcacgccttcatctagagaaaatcggcgtgaaactcaccacactcacggctaaccaagccgcctatttaggcatatcagtagaaggaccattcaaacctgagcactatcggtattga

SEQ ID NO: 41240 - DNA, 483 bp, Xylella fastidiosa
atgagcgattcacccactaccgctcacactcgtctggaattaccaatcgatatcattaaaatccaagcattgctgccacaccgctatccctttctattggtcgaccgaatactggaactagaccagaagcaaaagcgtatcgttgctcagaagaatgtgtccatcaacgaaccattctttcaaggacattttcctgaacatccagtcatgccaggcgttcttatcattgaagcacttgcgcaagccggcggcgtgatgactcaactaaaccttagccataatgggcattccagcctcttgttttatatggttagagtcgacaatgcccgcttcaacaaacaggtggtgcccggcgacatcctgatcctggatatgacgatgaaacgccggatccgcaatatgggctgctactacggcgaagcgcgggttaacggcgaagtcgtcgcttgcgctgatatcatgtgtgctggtgtcaagtcttaa

SEQ ID NO: 41241 - DNA, 1434 bp, Xylella fastidiosa
atgcacaacaccctcttattgtttggcgccaccggcgacctcgcccaacgctatctcttcccctccttactgcacctgtttactgatggcttattgccacaagacttccgcattcgtgctctggccttgtcgccccataacaccacacaattccgcgacatcctgcgcccgcgcttggaacaagcactacccatcgccaacactgcgcacatccaagccctactacaacgtgtcgactacctttccgtagacttgaacgacccaacatcaatcgccgaagcagtccgagatctgacggaacatccctgcatcagctacttggcaatcccaccaggcctgtacaccaacaccgccctaggattggcacagggaggggcactgcagacaccacaccgattgatgctggaaaaaccgatcggacgcgactcaataaacgcacgcgaaatcctaaacaccatcggcacactgattgacgaagatcgcatcttccgcgtagaccactatctaggcaaagcagcagtgcagaacctcgtcgcactgcgcttcggaaacaccctgctagaagcggtatggaaccgaaaccacattgagtcagtacacatcctcatcgccgaaaccgaaggcgtcgatggccgcaatgcttactacgcacgtgctggcgcactacgcgacatgatgcaaagccacatcctgcaactcctatgcctggtcgccatggaacccccggcctctctggaagccgaccgcatccgcgacgaaaaagtcaaaatcctgcgcgcactacgcccactgaacgcccaaaacgccgcaatgcacagcgtgcgtggacgctacagcgcgggcaccattaacagccaaccagtgccagcctatcaaccaccggaaggcagcaatgtagagacctttgtcggtgtcaccgcatacatcgacaactggcgctgggcgggcgtaccgttccacctatgcacaggaaaacgcttggccgaacgctcaacccagatcgtcgtcaccctcaaacccgtcacacactggctatttgaacgtccagaccggaacaatgcagcaccaaaccgcctgtgcttcaaactacagccccaggaaaatatcgaactaaacctgatgagcagcctggccggccccgaatggggaaccctggaactgcaaccgctggaattggagctatccgtcccgaccggaaaacatcgccacatcgcctatgagcgcctattcctcgacgcattcaacggcaacccggcgctatttgtacgtcacgacgaagtcacagccgcctgggattggatcgacagcgtcagcaatgcctgggaactgtccgacttaccactgcaaccctaccccgccggcagctggggcccacctcaagcccaccaatttctgccgccattggggattgatggccatggaaacgacgcatga

SEQ ID NO: 41242 - DNA, 1791 bp, Xylella fastidiosa
atgtccgcttatacaattaccgaacacaaatatgacatggttgtcgttggtgctggcggtgctggtctacgtgccacgttcggtttggctcagaaaggcttgcagactgtctgcctgacaaaagtattcccgacgcgttcgcataccgtcgctgcgcaaggtggtatctccgctgcgcttggtaacatgggagaggatgactggcgctaccatttttatgacaccatcaaagggtcagactggctgggtgaccaggatgcgattgagtacatgtgccgtgaggcaatcccggctgtgatcgaactagaacactatggtgttccgttctcgcgtactgcacaaggcaagatttaccagcggccatttggtgggatgacgacacgttacggtgaggggccgcgggcagagcgtacctgcgctgcagctgatcggaccggccatgcgatgttacataccttgtaccagcaagcattggcgcacgacgcgcgtttcatgattgagtactttgcacttgatctgatcttcgacaacgagggtgtgtgttgcggcgtgttggcgttggacatggccgagggatccttgcacctgtttcgtgcccatggagtcgtgttggcgaccggtggctacggtcgcacgtacttcagtgcaacttctgctcatacctgtactggtgatggtggtggcttggtgatgcgtgccggtttaccaatgcaggatatggagtttgtgcagttccatcccacaggaatctatggggctggctgcctcatcaccgaaggagtgcgtggtgagggaggaatcttgcgtaactctaacggggagcgcttcatggagcgctatgcaccgcactacaaggatctggcctctcgtgatgtggtgagtcgctcaatgattattgagatccgcgaggggcgcggcgttggtgaacacaaagaccatattttgcttgatttgactcacttgggtccgagcatgatccaagaaaaattgcctggcattgccgagagtgcccgcatctttgctggcgtggatgtgaccaagcagccgattccggtgctcccaacagtgcattacaacatgggtggtattccaaccaattaccatggtgaagtggtgcgtaagattggtaatgatcctgatgcagtggtgccggggctatatgcggttggtgaagcggcttgtgtatcggtgcacggtgccaatcgtttgggatcgaattcgttgcttgatttggtggtattcggtcgtgcggttgccaatcgttgtgctgaaacaatcaagccaaatcagccgcataaggtgttgccgtcggatagttgcgacaaggcactgggcttgcttgataaacttcgccatgctgacggttccacgccgacagcggtgattcgtgacaggatgcaacggaccatgcagtctgatgcttcggtgtttcgtacgagtaagacgttgcaagaagggtgcgaaaagatgaatgaaatctttgccttgtttgatgacgtcaaggtttctgatcgttcacttgtttggaattcggatttgatcgagacctacgagctgcacaatttgctgttaaacgcactggctacgattaactcggctgaacagcgcaaagagagccgtggtgctcatgcgcatgaagattatccagatcgcgatgacgagaattggttgaaacacacattggtcagtgtcgacgaaaagggcacatgcagttttgactaccgcccggtgcacatgtacacgctcagcaaagacgtggatgtgatacctcctaagccgcgcgtctattga

SEQ ID NO: 41243 - DNA, 786 bp, Xylella fastidiosa
atggcagagttcactctccctaagaattcgaagatcggtaaggggacgcatttccccgccaaaagcggtactaaaaatgctcgcacctttaaggtctaccgttggaatccggatgatgatgccaatccgcataccgatacctacgagattgatctagatacatgcggcccgatggttttggatgcgttgatcaagattaagaatgagattgacccgactctgacgttccgtcgttcttgccgtgagggtatttgtggctcatgtgcgatgaacattgatgggaccaacacgttagcttgtaccaaggcgattagtgcctgcaccatatctgagatcccgatctatccactgcctcacatgaacgtgatcaaggatttgatccccgacttgactcacttttatgcgcagtacgcttctattaagccctggatgcgtactcagaccccgccgccgcctgatcgtgagcgattgcagtctcctggggaccgcaagaagcttgacggtttgtatgagtgcattctatgtgcctgttgctcgacgagttgtccgagttactggtggaatggtgatcgctatttgggtccggcgatcttgctgcaggcttaccgctggattatcgattcacgtgatgaagatactggcgcgcgcttggatgatctcgaggatccattcaagctatatcgctgtcataccatcatgaattgcacgcgaacctgtccgaagggattgaatcccgctcaggccattgccgagatcaaaaaactgatgatgctgcgccgtgcctga

SEQ ID NO: 41244 - DNA, 1770 bp, Xylella fastidiosa
gtgaacgtcttatcaggggctatgcgttatgccacgccctggcggacgtaccgtcgcttgctgtcgtatgcgcgggagtatcgttggttactcgttgttgcggcgtgtggtgctttacttgaggcagttgctggttctacctttctggcgttgatgaagcccatcaccaacgaaacctttatcgagcgaaaccgtgaggtggccctgtggctgcctcttggaattgtcggtttgtttttgttacgcggtattgctggctatatcactgatatggcgatgggccgcgccgcgcgtagcattgctcgcgattttcgtgtgtgtgtcctgaccaaatattttcgtttgcctggtagccgttttgacggtgagccagtggcttcgatgttggtgcggctcggttcagacagtgagcaagttgcgcatgcggttatcgacgcgatgaaggtgatggtgcagcagacgcttcaggtgattggtgcgttggttgtgatgttgtggtacagctggacagtcacgctcgccatccttttggtcgctccgttgctggcttgggtcatgcagcgggttgctaagcgttaccgtcgtatcagccatcacatccaagagagtaatgcgcagctcatgcaagctgccgatcaagcgttaagcaactaccaggacgtcaaagtgtatgccgcgcaagagagcgagttggagcgctatgctcggttggccaatatcaatttgggtttggcgataaaggttgagtcgacacgtagtctctcttcggcggcggttcagttgcttggtgcggttgggttggcaatgttgttgctcattgccggccatgaagctttggccggtcgcctcagtccaggcgattttgtctcgttgatgacttcaatgatcgcggttattcccgcgttgaaacagttgaccaatgtacagaacatgttgcagagcggtattgcttctgcacaacgtctgttctcggtactagatagtcctgatgagcttgatactggcagacgaccgttggggcgtgccagaggattcatcgagttccgcgggatcaccgcacgctatcctggtcggtctgctcccgtgctggatagtgtcagctttgttgctgcaccgggcacggtcactgcgattgttggtcgttcaggaagcggtaagtcaagtttaatcaagttgattccgcgtttttacgagccggagtctgggcagatattgttggatggccatccattacaggattatcttttagctgatcttcgccgtcagattgcattggtaggacagcaggtcatgttgttcgatggcagcatcgcggaaaatattgcttatggtgagatgcgtcaggtcgtttctgaggagattgaacgtgtcgtggttgatgcaaacgctcaggactttgtgaaccaacttccagagggattacagtttcaggttggggttaagggggggcgtctttctgggggacaacgtcagcgtttggccattgcgcgcgcgatgctgaaggatgcgccgattcttatcctggacgaggccacggctgcgcttgataacgaatctgagcgcttagtgcaggacgcgttgcagcgcttgatgccggagcgcaccacacttgtgattgcgcatcgactgtcaacgatcaagcatgcggatcaggtgttggtgatggaccaggggcgcatcattgagtctggtacccatgtcgatctgttggcacgtgatgggttgtacgcttatttgtacagcatgcaatttcgcgaacgtccaacatga

SEQ ID NO: 41245 - DNA, 714 bp, Xylella fastidiosa
gtggattcttttcttagacttcttattcatggcgcttccgggcgcatgggacaggcgctgttgcgactggcctcagaagatccttcgtttcaggtggctgctgcggtggtcgggcaggcaccggatcgccatgtgagcgatggtgtgccattttttgcggctgctgaattggcggctgtgccggcgtttgatgttgcgattgatttcagtttgccgcaggggttttcgtcgttgctggcattgtgtgtagcgcgcgcggtgccgctggtctcggggacgactggtcttgattcgaggcagcatgaggctttggtcatggcaggggcgcagattcctctggtgtgggggtccaatttcagtgtgggtatggcggtgttggtgaatttggttgaacgtgccggtgatgcgttgtcaggttgggattgcgacatcgtcgagtcgcatcacgtccacaagcaggatgctccgtctggaagtgcgctgacgttaggtgaggcggttgcctgcaaggggatcgcgccgcgctatacaagcttgcgtgccggcgacattgttggtgaccatctggtgcagtttacggggttgggtgagcgcattgagctagtacaccgcgccaccaatcgtgatgttttcgcacgtggtgcgttgtacgtagcccggcgtgtggtggggcgtgtgcctgggtgctatcgggtgcgtgacttgattatgtga

SEQ ID NO: 41246 - DNA, 1200 bp, Xylella fastidiosa
gtgttcgagctttcctgcaacctgatttcaggcggcggcatcggtgtcccaggcagccagagcgagactccacccgtgacagaacccgcaatcctagttctcgaagacggtaccgtattcgagggcgatgctgtaggcgctaatgggctttccgttggtgaggtggtctttaacacatccctcactggttatcaggaggtcctaaccgatccttcgtatgcgtaccaattggtcaccctgacttatccgcatattggcaatacgggttgtaccgatcaggatgatgaggcgaataaggtatgggcggctgggctgattgtgcgggatgtgccgcgtcgtccaagcaattggcgcagtcagatttcgttgtcagattggttggccgcacgcggtgtggttgctattgctgggattgatacgcgcaaactgacccgtattcttcgtgagaaaggcgctcagcatggtgcgttgatggctggtgagattgatgttgacagggctcaggatgcggcccgccaatttacaggcatcaaaggtatggatttagccaaagtggtcagtaccaaacaggcgtactcttggtacgaaggccagcttgacttggatcgtaacgaatggaagcgcgccgcgccgcaatataaggttgtggcctatgactacggcgtgaagctgaatattctgcggatgttggcggagcgtggttgtgatcttacagtggtgcctgcgcagactccggttgacgaggtgttggcgctgtgcccagatggggtgtttctttccaatggcccaggtgatccggaaccttgtgattacgccgttgcggcgatcaagacgttcatcatgcgacgggttccaatcttcggtatttgtctgggtcatcagttgttggcccagactgttggtgccaaggtcgtcaaaatgaggcatggtcaccatggcgcgaatcatccggtgcaggacttgcgcagcgggcgggtaatgattacgtcgcagaatcatggctttgctgttgacgaggcaacgttgccaagcaatgtcagggtgacgcatcgttcgttgttcgacgggaccaatcaggggattgagttgcttgatgtgccggcattctcgtttcaagggcatccggaggcttcccctggtccgcacgatgttgatgtgttgtttgacaggttcattacaatgatggcggctcaatcctga

SEQ ID NO: 41247 - DNA, 3243 bp, Xylella fastidiosa
atgcccaagcgcactgaccttcgtaccatacttatcatcggtgctggcccgattgttatcggtcaggcttgtgagtttgactattctggtgcccaagcctgtaaggcgttgcgtgcggaagggtttcgtgtcgtcttggtgaacagtaacccggcgacgattatgaccgatcctgatatggccgacgctgtgtatatcgaaccgattcactggcggacggttgagaagatcatcgccaaagagaagccagatgcgctgttgccaacgatgggtggtcagacggctttgaactgcgccttggacttggccgatcacggtgtgctggagaaatatggtgtcgagttgatcggagccaagcgcgaggcgatccgtatggctgaggatcgtgagttgtttcgtgtggcgatgcaggagatcggcttggagtgtccgaaggccgaagtggctaaaagtttggagcgggctttggagatccaggccaaagttggttttccgacgatcatccgaccgagcttcaccctgggcggtaccggaggggggattacttacaatcgccaggagttcgaggaaattatcaagcgcggtctggagctttccccagtacatgaggtgctggtggaggagtccgtcctaggctggaaagagtttgagatggaggtggttcgtgacgcctcggacaattgcatcattgtctgttcaatcgagaacttggatccgatgggggtacatactggggattcgatcacggttgctccggcgcagacattgagcgataaggagtatcagcgtttgcgtgatgcttcgattgcggtactgcgtaagatcggcgtggatactggcggttcgaatgtgcagtttggtattgatccgcagaccggccgtgtggtggtgattgagatgaatccgcgcgtgtcgcgttcttcagcgttggcttccaaagcgactggtttcccaatcgctaagattgcggcaaaactggcggtgggctacacccttgatgagcttaagaacgagattaccggcggtaaaatgcctgcttcgtttgagccatccattgattacgtggtgactaaaatcccgcgttttgctttcgagaagtttccgcaagcggatgcacgtctgactacgcagatgaaatctgtgggtgaggtgatggcaatggggcggacctttgcagagtcgttgcagaaggcggtgcgcgggctggagaccggcaaggttggcttggagccgactggtttggatttgagcagcgaagatgatttggttgtcctcaagcgcgagttgaaagcaccgggggctgagcggttgttttatgtagccgatgcatttcgtgccgggttcgcagtcgctgatgtttacgcgttgtcttatatcgacccatggtttttggatcagattgaggagattgttgctgctgagggccgactggttaccgatggtcttggttcgatagatggggcgcgcttacgtcagctcaagcgtataggtttctctgatgcgcgtatcgcgcagttaaccggcacgaatgaggttgcggtgcgggcgttgcgccgtgtgctcaaggtcaagccggtgtataagcgtgtcgattcttgcgctggtgagtttgccactggcactgcctacctgtattcaacatatgaagaagagtgtgaggctgcgccgagtgatcgccgcaaaattatgatcttggggggggggccgaatcgcattggccaaggcattgagtttgattactgttgcgtccatgccgccttggcgttacgtgaggatgggtttgaaaccatcatggttaactgtaatccggagacggtatctacggattacgatacctctgaccgcctttactttgagccattgacgttagaggacgtgttagaaatcgttgaggtcgaacaccctgtcggagtgatcgtacagtacggtggacagactcctctgaagctggctaaagcgttggaagccaacggtgtgccggtgatcggcacgtctccggaatcgattgacttggcggaggaccgtgagcgcttccagaagctggttcagcaacttggtttgaggcagccgccaaactgtacggcgcgtaccgctgaggaggcattggtattggcgcgtgagattggttatcccctggtggtgcgtccgagttatgtgcttggtggccgtgcgatggagattgtctacggtgaggccgatttggcgcgttatgtgcgtgatgcggtgaaggtatccaacgattcgcccgtgttgcttgaccgtttccttgacaatgcggttgaggtcgatgtggatatcattgctgatcgggaaggtcaggtactgatcggtggagtgatggagcacattgaggaggctggtgtccactcaggtgactcctcatgttccttgccgccctattcgttatcggccgcgactcaggacgatttacgtcgccaagtcatcaggttggcgcaggcattgaacgtcattggtttgatgaacacacagtttgcgatccaatccaatgatgatggcagtgacatcgtctatttgctggaagtcaatccacgtgcttcgcgcaccgtgccgttcgtctctaaagcgacgggggtgccgcttgccaagattgccgcgcgttgcatgactggcaagacattggtcgagcaaagtgtgacttgtgaggttgtaccggcatattatgcggtgaaggaagcgatcttcccgtttgctaaactacagggcgtggacccgattctcggcccggaaatgcgttctacaggtgaagtaatgggggtgggccgcagttttgccgcggcgttcgcccgtgcgcaggaagccggcgatatccgtgccccgcaaccaggcagggcgtttgtttcggtgcgtgatcctgataaaaagcgtgtgttgccagttgtcttggccttggtggagcgcggcttcggtgtggttgctactgctggtacttatgcttggttgcagcagaatggagtggcctgtgaggttgtgaataaagtggccgaagggcgtccgcacgtcgtcgacttgattaagaacggcgagattgtttacatcatcaatactacggaagggcgtgcggcgattgccgactctttctcaatccgtcgggaggcactgcaacattgtgtgacctactcgactactattgctggcgctaaggcgttggtgaattcactcgagttccgcggtaccggcccggtttggtcgctacaggaactccacaaggagctgcaggtatga

SEQ ID NO: 41248 - DNA, 1989 bp, Xylella fastidiosa
gtgctgctctccgatcttggtgtgtcgctggcgctgatgcttgcgattgtcatgcatccgcagatctcgcacgtgcggcgttgtattggcatcattgccgactacacatcactgacggtgctgatgttgctgatgggcgaggcgggttcgccgctgtatgtcctatgtttgtgggtaaccatcggtaatggcttacgttatggctgtgcgtatttgctggtcactacgacccttagtgcgttgagtttcctgatggtgatcctcgtttcagcgtactggaagtcgaatccgtttctggcttggggattactgattggtctgattgccatcccttggtattttcagtcgctgctgaaggcattgatccaagcccttaaggatgcacgtcatgctaacgaggctaagagtcgcttcctggccaatatgagccatgaatttcgcacgccgctgaatggtttgtcgggtatcacggaggtgctggccacaacgcgtttggatgccgagcaaagggaatgcttgaaagcgatccaggcatcggtacacagtgtgttgtccttgattgaggaagtactcgacatctcaagaattgaggcaggtaagatccgtatcctccacgatactttctccttgcaggaggtgattggcagtgttggtctgatcctgcaaccacagatccgcaataaagtgttggaatatcgtgtcgatgtggggttggatgttcccgaatggttgttcggcgatgctggttatgtccgtcaggtgttattgaacattgtcggtaatgccgtcaagtttaccgagcgtggtgggattacattatgtgtcagcgtgttgaaccgttctagagagcgcagtgtggtgttgcgttttgaagttgcagatactggcattggcgtgccattgggaatgcgggctcggctgttcgacatgttcgagcaggctgatgttggtttggatcgtcgttatcaaggaagcggactgggtaccgcgattgctaagggtttgattgaattgatgggtggaagcatcgggttcgaggagaacgtcccttgtgggagcttgttttggttcgaattgccgtttgaacttggaaaggaaccggtggtcgcgcaagagctacccgaagcatcgcagtgtacggaagcgagtaatgtcattgcgttttccaatccattcctacggcatcgtgcccgtgtcaagagcctgcgcgtgctggtcgctgatgaccatgaaactaaccgcatggtgttatccagaatccttgataaggcgggacacaagctgttatgcgtggacggtgcggaagcagtgttggattgtttgatcagtatggaattcgatgttgtgatcatcgatctgcacatgcctggaatgagcggtttggagatgctcaaacagttgcgggtcatgcaaagtgctggtctgccttatacaccggtgctggtgctgagtgccgatgcggcgtccgattcgatccgctgttgtaaagaggcaggggcgcgtgccttcctgtccaaacccgtgcttgctaccaagctgctggatgtacttgccgaaattgctgaaggggatggtggtgcattaccttacgctgcattatcgcaatcctcagttcagcagcatcaggtgttcgatccgacgggtttggatgatctggctgagttggatatggacgatggtttcgaagagcggttcatagtgcagtctttgcgagatgccgaacactgccagcagacaatgttgtctgccgctgaaactaaccagtggcaggaggtgcgggaacaagcgcatgcactgcgtggtgtgctcggtcatcttggtttaatgcgcgcttcgtcgctggcggcagagttgatgcgtatcccagattggcagttgcaatcggagtggtgtgctcgtgtccaagtgctgtatgaagaactccggtctggtcgtgatgcgcttgaagcgcgccggcaggagcgccggcgcagtggcattttacaatga

SEQ ID NO: 41249 - DNA, 2607 bp, Xylella fastidiosa
atgtccgcttcccctacagccgagcgctggatcgttctaaaatttggtggtacgtccgtatcgcgtcgtcatcgctgggacaccattgcgatggtggtgagaaaacgccttgaagagcatggaacacgtgtgctgatcgtggtttcggcgctgtctggtgtgacgaatgaactgacggcgattgctcaaggtgtcgttgacagtgcccagcgcgtcgctgccttggagcagcgtcatcgcgattttttggctgagcttgggttagatgcgcaagcagtgctcggcacgcgtttcaccgtgttgtgggatcttctgcaagatgcgcgtgcggtgacgcggtcactggactggcaggctgagttgttagggcaaggtgaactgttgtcttccacactcggtgcggcctacttgggtgcttcgggtgttgacatcggttggatggatgcgcgtgactggctgaccgctttaccaccacagcccaaccagagtgaatggtcgcaacgtctttctgtctcctgtcaatggaagtctgatgtggagtggcgtacacgtttcgatgcccaacgtgctcaggtattgatcactcaagggtttatctcacgtcatcaagatggtggtaccgccatcctgggacgtggtggttcggacacgtcagcagcgtattttggtgcgctacttggtgcggcgtgtgttgagatctggactgatgtaccagggatgttcagtgcgaacccgaaggaggtccctgatgcgcgtttgctgacgcgcctggattactacgaggcacaggagatcgccacaactggcgcgaaggtgttgcatccgcgttcgatcaaaccatgccgtgatactggcgtgccgatgctgattctggatactgagcggcccgatgtattggggacccgtattgatgctgaagttgagccggtgcttggggtcaaggcgattagccgtcgtgatggcatcgtattagtgtcgatggaagggatcggcatgtggcagcaggtgggttttcttgctgacgtatttacattgttcaagaaacacggattgtcggtggacctcatcggatcggcagaaaccaatgtcaccgtgtccttggacccctccgagaacctggttaacaccgacgtactgactgcattgtcaaccgatttatcacaggtctgcaaagtcaaaattattgtgccttgcgctgcgatcactttggtcgggcgtggcatgcgttccctgctgcataaactctctgaggtatgggctacgttcggtaaagaacgtgtccacatgatctcgcagtcttccaatgatcttaatctcacctttgtgattgatgagacggatgcggacggattattggcggtgctgcatttcaaattgatcgaaagcggcgcaatgcctgtccaagagcgtgccgtgtttggttcgccttggcgcgagatcatcggacacgtacgtacgcgggtcatgccttggtggcacagtgcccgcatgcgtttactggccatgagagatgaagagggcattggtccttgctacgtctaccatttgccgacagtgcgcgaacgtgcgcggcaattgaatgcagtggctgccgtggatcagcgctactacgccatcaaggccaacccgcatccggccattctccgtaccctgattgaagaaggctttggactggagtgcgtgtcgttgggtgaattgcgtcacgtgtttgcagtagtgccacacctggttccgtcgcgtgtgttattcactccaagtttcgcctcacgtgtggagtacgagcaggcattcttactaggtgtcaatgtgaccttagacaatgtcgaggccttgcgcttatggccggaggtattccgtgaccggacgttatggttacgtatcgatctgggttacggcgatggacatcacgagaaggtcaccaccggtggtaagacatctaaatttggcctttcggtcacgcggattgatgaatttatcgatgttgccaagacactgaacataatcgtgaccggcctgcatgcccatcttgggagtggcgtggagagaggcgaccattggtcccgcatgtacgatgaactggctggttttgcctcccgcatcgggagtgtgtctaccctggatatcggcggcggtttaccgatcccgtaccggcctgatgatgaaccatttgacgtggaggcatggggagtcagtttggctgaagtcaaagccttgcatcccaaattgcaattggtgatcgagccgggccgcttcctggtggccgaggcgggggtactcctgacccgggtcacccaggtgattgagaaagatggtatccgtcgggttggcctggaggctggaatgcataccctgattcgcccagccctttacgatgcctggcacgacgtggagaacctcagccgcttagatgagataccacatgtactgtgcgatgtcgtgggtcctatttgcgagtcatccgatgtgtttggccgttgccgtcaccttccagccgccaccgcctccggtgatttgatgctgattgcagatgctggcgcctatggtttctcgatggccagcacctacaatctgcgcggcctgccggccgaggtcgtgcttgatgcttga

SEQ ID NO: 41250 - DNA, 1059 bp, Xylella fastidiosa
atgaatgtaatgggcttcgctgctctatcggctactggcccgcttgaacggttcgctttcggacggagagctcccaggccggatgacgtcgtcatcgatatcctttactgcggtgtctgccacactgatctgcatcttgcccgtaaccacggcggctttactacttatccaatcgtgcccggtcacgagatcatcggttgtgtacgcgaaatcggcaagacagtcacccgcttcaagcgaggcgatctagttggtgttggttgcatggtcgattcttgccagcactgccagccttgtctcaaagggtgggaacaggactgcattgaaggttcgaccttcacctataacagtactgatcggcgggatggcagtatcacctatggtggctattcagatgtcattgtcgtgcgtgataagttcgtgttgtcgttgcctgatggtctcgatccagccggagccgcgccgctgctttgcgcgggcatcacgacatggtcgccgctgcgtcgctggaatgtcggcaaagacagcaaggttgcggtggtcggtcttggcggtctcggacacatggccttgaagctggctaaggctcttggagccgatgtgacgttgttcacgcgttcttccggcaaagagggagatgccttccgtcttggagccgaccgtgttgtgttgtccagcgatctggagcagatgaaagctgtctatagccgctttgacgttatcatcgataccgttccttatgatcacgacgtcaatccctatatgcccacccttgtacttgaaggtgtgctcgtactcgtcggctatatgggaccgctcagtatgcctgtgaacgctggaggtgtggtacgtggccgtagggccatttcggggtcgttcatcggcggtgtgcctgaaacccagcaaatgctcgatttctgtgggcagcacggcattgtctcggatgtcgagatcatccccatccagaaaattaacgaggcctatgagcgtatgttgaaaagtgacgttaagtatcgtttcgtcattgacatgacttcgctcacatcatcaggagcttga

SEQ ID NO: 41251 - DNA, 1401 bp, Xylella fastidiosa
atgaatcagggtaagatcgttcagatcatcggcgcaattgtcgacgtcgaattcccacgaaacaatgtcccaaaagtatataacgcgctgaagatcgacggcacagccatcatcttggaagtgcagcaacagcttggcgacggcattgtacgcactatagcacttggctccacagacggtttaaaacgcaacctcattgccacggacaccggccatgcaatcacagttcccgtaggcactggcacattaggccgcatcatggatgtactaggcaacccaatcgacgaagcaggtccgatcacttatacagatcaatgggaaatccatcgaaacgctccttcctatgaagatcaagcctcaaccactgaactgctggagaccggaatcaaggtcatcgatcttatgtgtccatttgctaaaggcggcaaagtcggattattcggtggtgccggtgtcggcaaaactgtcaacatgatggaattgatcaataacatcgccaaggcacatagtgggctgtccgtattcgcgggtgttggcgagcgaacccgcgaaggtaacgacttctatcacgagatgaaagactccaacgttctcgacaaggtagcaatggtgtatggccagatgaacgaaccgccgggtaaccgtctgcgcgttgcgctcaccggtctcaccatggccgagtacttccgcgatgagaaagacagtagcggcaaaggcaaagatgtacttctattcatcgacaatatctaccgctacaccttagctggcacggaagtatccgccctactcggtcgcatgccctcagcagtaggctaccaaccaacccttgccgaggaaatgggcgtactacaagagcgtatcacctcaaccgcaaatggctcgatcacctcgatccaagcagtgtacgtacccgccgatgatctgactgacccatcacctgcgacgacctttggacatctggactccacagtgacactatcccgctcgatcgccgcattaggcatttacccagcagtggatccactggattcgagcagtcgccagatggatccgctgatcatcggcgaagaacactacaataccacccaacgtgtccaacaaactctgcaaaaatataaagatctgaaggacatcattgcaattttaggcatggatgaactttccgaggacgacaaactagccgtgtcacgtgcacgcaaaatagaacgatttttcagtcaaccattccatgtcgcagaagtattcaccggtgccccaggtaaatacgtcccattaaaagagacaatccgtggtttcaaagcaatcgtagacggcgaatatgaccatcttcccgaacaagccttctatatggttggtaacattgaagaagtcatcgaaaaagccaacaaaatgacagcatga

SEQ ID NO: 41252 - DNA, 864 bp, Xylella fastidiosa
atggcaagcggacgcgaaatcaaaagcaagatcaaaagtgtgcagaacactcgtaaagtgacccgtgcattagagatggtctcggcctcaaaaatccgcaaagcacaggaacaaatgaagatctcgcgcccgtatgcgcaggcaatgaaacaaatgactgggcatttagctcaggcaaatactgactacctgcatccatttctgatcgcacacaagcaagttaagcgaataggctatatcgtgatctcatctgaccgtggcttggctggtggtctcaacaacaatctgttccgcaagatgcttggcgaaatgcgccagtggcaagataagggggccgaagtcgacatcgtcacgattggtcagaaagcatccgtattctttcgcaggattaaagtcaacatactcggcagcgtgactcacctaggagacacaccacgcctagaacagctcattggtgtcatcaaagtcatgcttgatgcatacactgaagaaaagcttgatcgcgtctatttggtctataaccgtttcatcaacacaatggttcagaaagcgagcttcgaccaactcctgccactgctagcagctaaagacaaggtcgcacaccatgattgggattacttatacgaacccgatgccgcaacagtgcttgaacacgtgatgagacgctacatagaatcgcttgtataccaagcgatgctagaaaatatagcatctgagcatgcagcgcgtatggtagcaatgaaggctgctagcgacaacgccaacaagctgattggcacactacaactggtctacaacaaagcacgtcaggcagcgatcacccaagagatttcagaaatcgtcggcggtgccgccgcagtatga

SEQ ID NO: 41253 - DNA, 1548 bp, Xylella fastidiosa
atggcaaccacgctcaacccttccgaaataagcgaattgattaagactcgcatcgaacaggtcaaactatccgcagaatcccgtaacgaaggcaccgtgaccagcgtttccgatggcattgtgcgcatttttggcttggcagatgcgatgcaaggagaaatgatcgaattgcctaacaaaacctatgcactagcactgaatttggagcgtgattcagttggtgccgtggtgctgggtgattacgaacatttacgtgaaggagacatcgctaaaacaaccggacgcatccttgaagtgccggttggcaaatcgctgttgggccgcgttgtcaatgctttaggtgaaccaatcgatggcaaaggtgcactaggccccactcaaactgcaccagtggagcgcgttgctcctggtgtcatctggcgcaaatcagtcaatcaaccagtacagaccggttataagtcagttgatgcgatgatccctatcggccgcggccaacgcgaactcatcatcggagaccgccaaactgggaaaaccgcaatggcaatcgatacagtgatcagccagaaagacaccggtatcaaatgcgtttatgtagcgatcggccaaaaagcttctactatcgccaatattgttcgaaaactcgaagagaatgatgcgctggaccacactatcgtcgtagccgcaaccgcatctgaatcagccgcacttcagtacatcagtgcctacgctggctgcaccatgggcgaatacttcatggaccgtggcgaggacgcactcatcatctatgacgatttgtccaaacaagccgttgcctatcgccaaatctcgctactcctaaaacgtccccctggccgagaagcttacccgggcgacgtattctacctgcactcgcgtctgctggagcgtgccgctcgtgtgtctgaagaatatgtcgaaaagttcacccaaggtgaggtgaaaggaaaaacaggatccttaactgcactaccaatcatcgaaacacaagctggcgacgtatccgcctttgtaccaaccaacgtaatttcaattactgatggccagatcttcctggaaactgatcttttcaatgctggtatacgtccagctgtcaacgccggcatctccgtatcgcgcgtcggtggctcggcacagactaaaattatcaagaaactgtccgggggcatccgcatctcactggcacaataccgtgagctggcagcattcgcgcagtttgcatctgacctagatgaaacaacccgcaagcagctcgagcgcggccaacgtgtcactgaactgatgaagcagaaacagtacacctcaatgtccgtcgccaaccaagcgttatcaatctacgcagtcaacgaaggctaccttgacgacgtaccagtggacaaagtactcaccttcgaagaaagcttacacgcccatttttccaacactcaaagcgcgctgatcgacaagatcaatacctccggtgactgggacaacaacattgaagctgctttcaagaaacacattgaagaatttaagaccacgggcagctggtaa

SEQ ID NO: 41254 - DNA, 828 bp, Xylella fastidiosa
gtgccgttaataaaatttaaaccaacttctccaggtcgccgttctgctgcacgcgtggtcactccaaatattcataagggatctccgcatgctgccttgttggaaccacaaagtaaaactggtggccgtaatcatcatggtcgtattactgttcgtcacataggtggtggttgcaagcagcgctatcgtgttatcgattttaagcgtgataaagaagctattcctgcgcgtgtagagcggatcgaatatgatcctaatcgtactgctcatattgctttattatgttacgtggatggtgagcgttgttacattatcgctccaaaggggttaaaggaaggcgataaaataatttctggcccgaatgtacctattaagcttggtaattctcttcccctacgtaatatccctgttggtactactgttcacgctgttgaattgaaaccaagtaaaggtgcccaaatggcgcgttctgcgggttcttctgttcaattggtggcgcgtgaaggtgtatatgcgacgctgcgtttgcgttctggggaaatgcgtagagtgctggctgagtgtcgagccactatcggtgaggttggtaatgaagaacataatttgcggaaacttggtaaggctggtgctaaaaggtggcttggggttcgtcctactgtgcgtggtgctgctatgaatcctgttgatcatcctcatggtggcggtgaagctaagtcaggccagggtaatcctcatcccgttactccttggggcgttcctactaaaggttataaaacgcgtaaaaataagcgtactcagcaattcattattcgtggtcgcagaggttaa

SEQ ID NO: 41255 - DNA, 1302 bp, Xylella fastidiosa
ttgagtagcatggttgctgataagcaaggggagccaacgttggcacgcatcgccgtggttggactagggtatgtgggattgccgttggcggttgcgtttggtcgacagcgtccgacacttgggttcgacattgatatatgtcgggtacagcagttgtgtgccggtcatgacatcacttgtgaaattgagcttgaggaactccaagctgcgcgacatttgcgttatagcagtgatcctcgggagttgagtgactgtcagattttcatcattacggtgcctacccctattgatgtggctgagcaaccggatttggggccgcttcgttcggccagcatgttggttgcgtcggtacttaagcctggggatttagtgatctatgagtccacagtttatccgggcaccacggaggaagtctgtgtgccattgctggaggttgggtctgggttgtgctttaatgtcgattttcattgtggttacagtcctgagcgtattaaccctggtgatcgtaagcgtcggctacaggacatctgcaagattatttcaggttccaccccggatattacagctgtcgtggacgcgttatattcgcagatcatcgttgctggtacttggtgtgctccgtcgatcagagttgccgaggcagctaaggtggttgagaacattcagcgtgacgtgaatattgcgttggtcaatgagttggcattgatctttaatcggctcggtatcgacaccttggacgttctcgaagcggcagaaaccaagtggaattttttacctttccgcccgggtttggtgggtggtcattgcatcggtgtggatccttactatttgttgcacaaatccgagagtgtggggtattacccggatttgattcatacggcacgtcgcgttaacagtcgtgttagttggcatgttgtggaccgtgttgtggctttacttggtgagcttagtgtgccgatgacacgtgcggtggtgcttgtgttgggtgttaccttcaaggaggattgtcccgatttacgtaacagccgtgctttggatttggtgcgcatgttcaggactttaggtgcgcaagtcgatgtttgcgatccttgtgctgatccgcagcaagcgttggagcatgaggctgtcacgttgtgtacggagcccaaggccggtgcttatgatgcaattgtgctggcggtggcgcatgcccagtaccgaatgtacgatgtagcgactattgcagctctaggtaagccgcaggcggtggtttatgatgtcaaatcagtgtggccgcgtgcagcggtaactgatcgtctatag

SEQ ID NO: 41256 - DNA, 2547 bp, Xylella fastidiosa
ttgcccgaatggcctcataacggggccattggcttttctgttgccgtaaattcaatgcattacactggagtgctaatgactcagtcctctcaaaaaacccttgatctgcaggtattgccgctgcgtgacgtggttgtattcccgtacatggtaattccattgttcgtaggtcgtgaaaagtcaatgcgggcgcttgaaaaggcaatggacgctgataagcgcatcttgttggttgcacaaaaaatggctgacattgacgatcctggtgcggttgatttgcataccatcggtacttatgctcaggtgttgcagttgttaaagcttcctgacggcacgattaaggtgttggtcgaaggcctaacccgtgtgagtgtggatcaagtagtcgagcatgatggtgcgttacgaggttgtggtatcgaaattgcctcgactcaggagcgcgaagaacgtgaaattgaggcaattgttcgatctctgttgtcgctcttcgagcagtacgttaagaccaatcgcaagctccctccagaattgttacaaactttgagtggtattgatgatccaggtcgtttagctgataccattgctgcgcacctgagtgtgcgtttggcgtataagcagcgtctgttggaaactatcgaaattggtgaccgacttgaaatactcattggactagtcgatggtgaaatcgacgttcagcagatggaaaagcgtatccgtggtcgagttaagtcgcagatggagaagagtcagcgtgagtactatctcaatgagcagatgaaggcgatccagaaggagttgggtgacttcgacgatcttccgagtgagttggaggagttggctcgtaaaattgccgaaatcgggatgccaaaattagtccagagtaaggctaagagcgaactcaacaagcttaaacagatgtctccaatgtcagctgaggcagcagtagtgcgtaattaccttgactggttgttgggggtgccttggaagaagtgcactaaggtacgaaaggacttgaaagtcgctcaatctacgctggatgatgaccactatggtcttgataaggtgaaagaacgcatccttgagtatcttgcggtccagtcacgagtcaaacagatgcgaggtccgattttgtgtttagttggccctcctggtgtaggtaaaacttccctcggtcagtctattgctaaggcgaccaatcgcaagttcgtacggatgtctttggggggggtgcgtgacgaagctgaggttcgggggcatcgacgtacttatgttggctcaatgccgggccgggtcgtacagaatctcaacaaggttggcagtaaaaaccctctgtttgtgcttgatgagatcgataagatggctatggacttccgaggtgatccttctgcagcgctcttggaggtgctcgatcctgagcagaataatgcgttcaatgatcattaccttgatgttgacctggatttgtccgaggttatgttcgtggcaacctctaattcgctgaacattcctggtccattgcttgatcgcatggaagtgattcgtataccaggctatactgaggacgaaaaactcaacattgctacccgttacttggtacctaaacagattagagccaatggtttggctgttgaggaattggcgattggagaggacgcgattcgcgacattgtgcgctactacacgcgtgagtctggagtgcgtaaccttgagcgcgagatctctaaaatttgccgtaaaattgtcaaggagattgctttagttggtgtgaagcctgttgctaagaagtcaaccaagtctaaggtattgttcgcggtgacttcgaaaaatcttgaaaagtatcttggggtgcgccgctttgactttggccgtgctgaggaagctaacgagattggcctagtcactggtttggcttggacagaagtcggtggagatttgttgcaaatcgaatctactcttgtcccgggtaagggtaacctgattttgactggtcagcttggtaacgtgatgaaggagtcggcgtcggcggcgttgacggtggtccgttcgcgtgctgatcgcttctgtattgacgtggactttttgcataatcaagatgttcaccttcatgtgcctgacggtgccacgccgaaggatggtccaagtgccggtattgccatggtcacatccttggtgtcaatgcttaccaaggtgccagtgcgtgctgatgtagcgatgactggtgagattactttgcgtgggcgagtttctgtgattggtggtttgaaggagaaattgttggctgcattacgtggaggtatccgaacagtattgatccctgaaggaaatcgtagagatttggctgatatcccggctaatgtgacacgtgctttgacgattgttccagtaaagtggattgatgaagtgttggatttagctcttgaaagtccacttgcacctaaagttgcggcccaattaggtaagagcaaaccgcgtaaggcccattcgcgtgtgtctactgtgcgtggcaagtccaagggatcaagcaatgctcgtgtcagacactga

SEQ ID NO: 41257 - DNA, 2493 bp, Xylella fastidiosa
atgattcccaaagagcaatttgctgcggctatcgctgattctttacccaatcctggccatgtcgctgggtctgttccgcctgttgcgttatctgtcttccatcctgatgaaccggaggacgaggtgcctatcccacgccaaactgccatgatgcatactcgggctgtggaagaagccaatgtgtctacctggattaccaaagaagcgggtaaccgccgtatgccgttcgactgtgcgcgtttggagtgcgctatcgatacgattcaccaagaattcccacaattggacgtggctgaatataagcgcgcggtgttcgggttcgtcgaacgtaaggatagcgttaatgctgatgacttggttgatctgttgatccgtgaggctgaggcacgtgttgacctgactgcgccggagtgggagtacttcgctgcacgtttgtatctgcgtcgcttatacaagcgtgccagccgcaatcgcttctacgatgccagccagaaatacggctcgtttgtcggtttacaggagagtttggctgaccgcaatatctattccaacgatattttgcgcagctactccaaggaggagttgatcgaggctggtcagatgatcgatcctgagcgcgataagctgtttacttataacggcttgtacttattggccacacgttacttggcgaccgatgcttctcgcggcgtgtttgaattgccacaagaacgttggcttaccatcgccttgtatttgatgcaagacgagtatggcccaggtaaaggtggacgtgagcgccgcatgcaactagttggcgaagcgtactgggcactgtctaacttgtacatgacggtggcgactcccaccctgggcaatgccggaaaaatcaatggccagttgtcttcgtgcttcatcgataccgttgacgacagtttgcagggtatttacgactccaacaccgatattgcgcgtgtgtccaagcatggcggaggcgttggtgcttatttgggttacgtacgctcctctgggtcaatgattcgtggtgtagctaactcttctggtggtgttgtgccgtggatcaaacagctcaacaacaccgctgtctctgtggatcagcttggtcagcgcaagggtgcgattgcggtttatttggatatttggcaccgcgatattgaagcgttcttggatttgcgtctgaataacggcgatcagcgtttacgtgcccatgatgtgtttacctcggtctgcattcccgatttgtttatggaagcggtcgaacgtcgcggcgattggtatttgttcgacccatatgaggtgaagtgcgttaaaggttggtacctgcaggatttctatgacgagaagaggggtgaccccaacggcagcttccgccgtaagtacgaggacgttgttgctgacgagcgtatcagccgtaagacggtcaaggccattgacatctttaaacgcatcatggtcagccaattagagacgggcaatccattcatgttctaccgggatgaagtgaaccggaagaatcccaacaagcatgttggcatggtgtattcgtctaatctctgtactgagatcctgcagaacatgacgccaacccggctcatacaggagatgatcagtggcaatcagatcgttacgaccaagcaggctggtgatttcgtcgtgtgcaatctgtcttcgatcaatcttggtcgtgcaatcacggtgcaggctgatttgcttggcgccgatgtactggagcgtctgatcccgattcaggtgcgtatgcttgataatgtcattgatctgaatctgctgcccgtcccacaagcgaccattaccaatcagaaataccgtgcgattggtttaggtactttcggctggcatcacttgctggctcagaaggcgattcactggaattcgccggaggccgagcaatacagcgacgcactgtatgaacgcatcaattacctgacgattcgcgcaagcatggaattggctaaggagaagggcacctatgcagtgtttcccggcagtgactggcagaccggcgagtatttccgcgcgcgtgactacaacagcccacaatggcttgaattagctgcccaggttgctgtcaatggcgtgcgtaatgcctatatggttgcggtagcgccgaacatgagtactgcgcagattgccggttccactgcgtcaatcgaccccatctatagcgcgttttactacgaagagaagaaggattaccgccgcccggttgtggcacccggattgtcgctggatacgtggccgtattatgaaaagggtgcttataagctcgaccagttcgcgagcatacgccagaatgcccgccgccagcgtcacgttgatcaatcgctcagtttcaatttctatgtgccgagtaccatccgtgctagcacgttgttggatctgcacatgacggcttggcgtgagggcttgaagacgacttactacgtgcgctctaacgacattgacatcagcgaatgcgagtggtgttcaagctga

SEQ ID NO: 41258 - DNA, 1041 bp, Xylella fastidiosa
atggctatctcattagatcgcatcaagattttggaaccccgtaatcctaatcgttcgacagggattattaacgggaaaaccagcggcatcctgaattggaacgacatcccgtacccatccttctaccgggcgtacaaagagttgtcgaccaacttttggatcccggacgaggttgatatgaagatcgacaagcgccaatacggtgaactgtcggcacgcgagaaaaacgcttatgacgccatcatcggtttgttagctacattggattcaccgcagacacgtttcatctataacgttgctgagtacatcactgatccggcggcacatgccaatgctgcgattattgggcagcaagaagtcattcacaacgagagctacagctatgtgttggcctctatcactgacttggccaaccagaaccgtgtgtttgagatcgctcggacccatccgaccattctcaagcgcaacgccccaatcatgcaggcctatgacgacttcatgcgtgagaaaactgctgagaccttgctgtactcgctgattcaatcctcgattcttgagggcattaatttttattctggctttgcctatttctacaacttggtgcggcagaaccgcatgactggcactggcaagatcatcagctttatcaaccgcgatgaattggcccacaccaagttcatcagtgaggtgattcgcgccattgttggtgaaaatccggaattgcaaaccgatgcgttgaccgattacgtgcatcaagcatttgcgcatgcgattgagctggaaacacagtggactggtgaggtacttgatggcattgacggtatcgacgtagaggagatgatccgctatgtgaagtaccgcgctaataaaatggctggcatgcttggtatccagacgctgtacaccgagactactgataacgtcatgccctggatcagggcctatgcagacaattttaccgagacaaaaacggatttcttcgagatgcgtaatgccagctataagaagactaacgtagacaactgctttgacgacttatag

SEQ ID NO: 41259 - DNA, 681 bp, Xylella fastidiosa
atgacggtgagtgctccgttgtcattcatgcccgaggcggtgatcttcgacatggatggtctgatgcttgatagcgagcgcgtgagcatcgaatgtcggtgtcgtgctgcgtttgatcttgagcagcaaattgagccggattactggttgcagatggtcggggtgagcgatatcgcttgtcacgcgcagctgagcgcacgcattggtgctgtaccagcgacagcgttgttggcacgcagtgatgcgttatatgaggcggtggttacgaagggggtgccgcatcggcccggcatcgttacgttactggagtggctgttcgcgcgtggtattccgtgtgcggttggtacgtctacgcggcgtccgttggcgctgcgtaaattgaatacggcaggcttattgtggcgtttcaatgcggtgtgtactgcgagtgacgttgcgcaggctaagccagcgccagatatttatttattggctgcgcacacgcttggtatcgttccggggcgctgcttggtggtggaggattcaccgattggggtacgtgccgcattggctgcaggtatgacgccaattcaggtgccagatttgctgatgccggatgctcaggtaagcgcgctggggcaccggattgtggcttcattgacagaggtgcagagcctgttggaagcgtgttttgatgtctga

SEQ ID NO: 41260 - DNA, 1008 bp, Xylella fastidiosa
ttgagcacagggaaacatcctatgaaatcacttgttcgtgttgctgtgaccggcgctgcaggccaaatcggctactcattgctatttcgcatcgctgctggagaaatgtttggcaaagacaggccagtgatactccagatgctcgaactccccgacgagaaagcacaagctgcccttaagggcgtgatgatggaacttgaagactgcgcgttcccactactggctggcatggtcggtaccgataatccagacatagcattcaaggatgccgacgtcgcattgctggtaggctcccgcccccgtggccctggcatggaacgcaaagatctgctgatggaaaacgctaaaatttttaccgcccaaggtgcggccttaaacaaagtggctcggcgcgatgtcaaagtgctggtcgttggtaatccagccaacaccaacgcctacatcgcaatgaagtcggcccctgatctaaacccgaaacactttactgcgatgctgcgccttgaccacaaccgcgcattgagccagttatcgaccaagctaagtaagcctgtcgccaacattgaaaaactcattgtatggggcaatcacagcccaaccatgtatccggattaccgtttcgccacagccgatggcactccaattattgaggcgattaacgaccaagcatggaacgctaacagcttcattcccaccgtcagcaagcgtggtgccgcaatcatcgaagtacgtggcttgtcttcagcagcttcggcagccaacgcagccattgaccacatgcgtgattggctgcttggcagcaacggcaagtggatcacaatgggagtgccatcggacggttcctacggcattccggagggaatgatatttggtttcccagtcacgaccaccaatggcgaatacagcatcgtcaaagatcttcccattgacaccttcagcaaaacatacattgacaaaacgctggccgaactggaagaagagcgtgccagtatcgcgcatctgttacgttaa

SEQ ID NO: 41261 - DNA, 2124 bp, Xylella fastidiosa
atgagacctgttttgcaatctgaggtcagtgagtgtggtttggcttcgctggcgatggtagccaatgcgcatggtaagcatctgaccctatcccagttgcgtcagcgttttccctcatcactcaaaggcgccaaactgactcatttggtccatattgcacagcagctaggcttttctacgcgtccactacgcctggatatggaagatctgggtaagcttaagttaccttgtattctgcactgggatctcaatcactttgtagtactggcaaaagttgggaccactaaggtcaccgtttacgatccagccatcggtaagcgtaagctttcactcaatgaagtgtcaaagtatttcactggcatagcgcttgaattgacaacaacgaccgaattcaagcagcagaaaccaccgccttcaatttcagcacgtcagttgaccggtccaatccgagggttgtggagggcattggcgcagattctgttgctctcgctggcgttacaggtctttgtagtgctctcgcctttctacatgcaatgggtcgtggatcaggtactggtctcggctgatcgcgatttactggtggtactggggttgggcttcggattggtattgttgcttcagatcgctatcggtttgttccgtagctggtcggtgatttacctgtcgtcaaggcttggtctgcaatggatgggtaacgtattcgcacatctactgaagcttccattggagtactttgaaaagcgccatcttggagacttgacttctcgcatgtcttcggtgcaatcgatccagaaaacgctgaccaccagttttgttgaagcgattattgatgggctgatgacgctcgtcacgcttggtttgatgctcgtttacagttggaaactggcgttggtaaccttggtagctgtggcgttgtacatggttatccgtgctgtttcttattggccagtacgtgactgcaccgaacagcaattagtcgttggagcaaaacagcagacccatttgctggaatcattacgtggtattcaaagtttgaaagtggcatgtgaagagtctctacgtcgttctacttacgagaatctactcaatgacacggttaaccaagaagtgcgtctggcacgcatgtcattgggtttctcaaccgctagtcagcttgtgttcggtctggagcgtattgcagtgatctggtacggtgccacattggcattgagcaatgtgttctcggttggcatgttgattgcctatttatcctacaaagatcagtttgctagtcgaatctctagcttgattgataagtgggttgagttccgtatgctgcgtctgcatggtgaacgtttggctgatatcgtcttgacccctccggaggaagattatgaattgccggaaatgcagctaccgaaaaaagaaccagatattgaagtggaaggattgtcgttccgttatggtgaagacgaaccatgggtgctgaaagattgcagcttcaaggttgccgctggcgagtcggtggctattatcggtgcttctggttgcggtaaaacgacattgatgaagttgctccttgggttgctcaaacctaccgcaggtaccatacgtatcagtgggcgtgatttgcataaattcggtacacgcaatgtacgttcgattgttggtgcggtgatgcaagatgatcaactctttgcagggagtgtcgctgataacattagtttctttgatcctgatttcgacctggagcgtattgaagcggcagcaaagctagccgcgattcatgaagacatcgccgcgatgccaatgggataccacgcgttgatcggtgatatgggcagtgcgttatccggtggacagaagcaacgtgtgattctagctcgtgcgctttatcgtcagcccaagttgctgttcttagacgaggcaacgagccacttggatgttatgcgagagcgtttagtgaatgatgcagtacaccagttaaaactaaccaaagtcatcgttgcacatcgccccgaaaccattgcgagtacggatcgtgtcgtgatcttggatcatggacgtatcgtgcaaacagtggcaatgccagaagatcgtgatgactcaatcgaaatagtgcataacacgatacagagtacgtga

SEQ ID NO: 41262 - DNA, 2502 bp, Xylella fastidiosa
atgaaccaccacgctctgccaattgatccgctactaccagcgataacaacgagcttatccaatcatccacgcctgattttggaagccccaccaggggcaggcaaaaccacccaagtaccgctggccttacttgatgcgccgtggctgaacggacgcagcatcatccttttggaaccacgccgggtcgccgcacgcaatgcggcactgttcatggcacgccaatgcggtgaagaggtcggtgggcttgtcggctatcacatccggtttgagagtaaagtctctgcacgcacccgcattcaggtcgtgacggaaggcatcctgacccggatcatccaggatgacccgctgctggatggcatcggcgcgctgctgttcgacgaattccatgagcgccatttggccagcgaccttggcttagcgttggcactggacgtgcagacacagctacgtgaagatctacgtattgtcgtgatgtcagcaaccctgcaaggggaacgcttggcgcaatttctcgatgcaccacgtctgaccagcgaagggcgtgcctaccccgttgcgatcactcactttcctgcgcgccgtgatgaatcacttgaaacacacgcacgccgcgccattcagcatgctctggacacacaccaaggtgacgtgctgaccttcctccccggccagcgagagatcgccaggttacaggccatactggagaaaacactctccccagaattgcacgtgatgccactgcacggtgaactgccgctgaaagagcaagcacgtgtgctggaaccagatcaacatggaaggcaacgcatcgtgctagccaccaatgtggctgaatcctcaatcaccttaccgggaatatcggtggtgatcgacagcggattagcacgtgaacctgcctacgatccgaataccggcttcacacgcctagatgtggtgagcatcacgcaagcttcggctgaccagcgcgccgggcgtgccggtcgcctcgccccaggctgggcctatcggctgtggccgcaatcacaacgactggaagcacaacgccgaccggaaatgatccaaaccgaattatctggtctggccttggaactgacagcctggggcagcagcacactgcgcttcatcgacccaccacccgctggcgcgttgagcgctgcacgcgaattgctacaacgactgggtgcgatcagtaacacctccaccctcactcccctgggtcagcgcatgctggcactgggcattcatccacgtttggccgccatgttgctggccccacacgatccacaggaacaggcgctggcctgcgatttggccgcattacttgatgcgcgcgatccacttcgcggcagcggcgacgcgctgattagtcgctggcgtgccttagccgaattacgcagcagctgtctcccccacgacaccagacgcagcacactaagagccatcgacgccgcaacgcaccaatggcgacggcgcatccgctgtgacaccacaccaccggatgcgatcgaagcacataccctcggcaacctactcacacatgctttccctgaacgcatcgccgcacgtcactccagtgacccgctgtattacgtattagcgaacggccgccgtatgcgcctgttcgacaacagtgcgctgcatggcgaaccttggatcatcgcgagcgagttacatcacgggatcaaagacatccaactgctctgtggtgcccctttggatgagagaaggttgcacgctgacttccccgaacgcttcatccaacacgatgtcatacgctgggaaacagataaacgcgccttggtggcgcaacgtgaatcctgcttcgaccgcatcgtcctcgacgtacgccccgccggacgcattgatccagtacaggctgcaaacgtattaaccggagccgtacgcacgctcggcctggatacgctctcgtggacagaacacctacgccagtggcaggcacgcgctgtagcactgcgtcactggatgccggagcttgaacttccagacctttccaatacaacgttactagcaacactggacacgtggttaacaccagcattcgcagggaaaaccagactggatgcactggatgaagcggcattcgagcaagcagtcaaatcgctactgtcgtggacacaacacgcactcatcgaccgtcacgcacccgcccgcatcatcgtaccgtccgggatggagcgccacattgactatggattggccgacgatggcacgccgcagccgccagtccttgcggtcaaactacaagaattatttggtctgcccgataccccacgcatcgcaaaaaaccgtatccctctcaccctacacctactctcacctggcgggcgcccactgcaagtgactcaggatttaaagagtttttggactaacacgtatccggaagtgaagaaagaaatgaaaggacgctatccaaaacacccatggccggacgatccatggactgcaaccgccacccaccgcacgaaatcacctgggaagtaa

SEQ ID NO: 41263 - DNA, 1512 bp, Xylella fastidiosa
atggccatgatccctcgcatcgctcttttgtcgctcctcgtttccagtagtgttcccctggcttacgcaacggcaacgccccccaagcccgacaaggaaaccaccacacctgctaccaccctccccgcactaccagccaacacacagatacggcaaagcatccgcatcggtaaccgcaccctaagctacaaagccatcattggtgctttaccggtacaagacgacaaaggcaagacgatcggcgaggtgatgttcaccgcctacatcatgaaaggcaacaaccgcccggtcaccttcgctttaaacggcggtcccggagcctcctcggtttacctcaatatgggcgcgatcggccccaaagtggttcacttcggcacccaaggcaccagcccatccgaccccgcgatactgcacgacaaccccggcacttggctggactttacagatcttgtattcatcgacccaatcggcaccggcttcagccgtgctcgcattgaaggcgaggaagccaaaaaacaattcttcaaccccaaggccgacgtcgactacttatcacgcacgatctatgactggctggtcgccaatggccgtctcctctcccgcaaatatttggtgggtgaaagctacggcggcttccgcgctccacgtattgcacacaccttacaaacccagatgggtattgcactcaatggactggtactggtctcgccctacctcaacccgactctggacgacaatagtgatgtttcaccgttagcctggataatgaccctgccttctatcgccgccgcacacctagaacgccaacatcagttaagcgaagcaaagatgcgcgaagtgattgagtacacacgtggcgactatgccagcacactgatgaaaggccgctctgatcctgcggccaccgaaacgatgctacagcaagttgtacacctaaccggattggatccgacttatgtacgccgtgctggcggacgtctggaaacgcaggcctacctacgtgaagtattccgtgatacaggcgaacttgggagccgctatgacattaacgtcactgcattggacccgtttccctacgattctgagcagcgcaccaacgacccgctactagacagcatcatcgccccaaccaccacagccatggtcgacttcgtcacccgaaccgctgggtggaaagtacacgaacgctatcaagcgctgaactacgatgtaaatcgacaatgggactggaacgaagagttgcgtaaaggctcagtcacacaactacgccaatcggtagccattgacccaaaactacgcgtgttgatcgcacatggctggaacgacctttcctgccccttcatgggatcggtattgaccatcgaccagattcccaaaatgggcagcgatccaacccggatacaagtacgcgaatatcctggcggccacatgttttacaaccgccccgacagccagtcatcattccgccaagacgtacaagcgatgtacgaacatccccaggacaccccctga

SEQ ID NO: 41264 - DNA, 888 bp, Xylella fastidiosa
ttgcgtttgtcgtttttttctgtgttgctcgtgattcctaaacaatcaggtgatgtgatgaagctttgtggttttgaagtcggtcttaaccagccacttttcctgattgccggtccttgtgtgattgagtcgctacagttgcagttagatactgccggtgtactgaaggagatcacttctaagcttggtttgaactttatctttaagtccagttttgataaggcgaaccgaacttcggggagtagttttcgtggccctggtttggaagaaggattgaaggtgttggaggcggtgaagacgcagattggggtgccagtactgacggatgtgcacgagtacacaccaatagacgaggtagccactgttgttgatgtgctgcaaacgccagcgtttttggtacgtcagactgatttcatacggaatgtctgtgcggtcggtaaaccggtcaacatcaagaagggacagtttttgtcgccatgggatatgaaacctgtggttgagaaagcaaagtcgacgggtaattcgcagattcttgtatgtgaacgcggcgcttcgttcggttacaacaacttggttagcgatatgcgttcactggcggtgatgcgcgagaccggctgtccggtggtattcgacgcgactcattctgtgcaacttccgggtgctcagggtggtcgttccggtgggcaacgcgagttcgtaccggtgttggcgagggcggctgtggcggtgggtatttccggattgttcgctgagactcacccagacccacccaatgcattgtctgatggccccaatgcttggccgttgcacacaatggcgatgttgctggaaaccttggtggagttggatgcggtcaccaaaaaacgaggtttccttgagcaggattga

SEQ ID NO: 41265 - DNA, 1386 bp, Xylella fastidiosa
ttggggccggagctattttgcgagtcgcgctaccgcgatgataatccgatggttctctggtattgctcccttctttggttgttgactggacccatgaccgctattgccaaaatttatgctcgtgagattcttgattcccgtggcaaccctactcttgaagcggaggtcactctggagaatgctgtctgtggccgtgccgcagtcccttcaggtgcttcgactggtaccaaggaagcggtggaattacgtgatggtgacaagacacgttacttaggcaagggggtgcgtgcagcggtggataacgtcaatggtgttattgctgcggcattggtgggtttcgatggggctgaccaaacaggcttggaccatcgtttaatcaatctggacggcaccgagaataaggggcgtttgggggctaacgcgctgctcggtgtttcgttagcaaccgcacatgcggttgccgccgcgcgtaaacagccgctatggatgtatttgtccacgcttggtgaatccaaggtatcgttgccggtgccaatgatgaacatcatcaatggtggtgcgcatgcggataacaacgttgatttccaggagtttatggtgttgccggttggttttgcttcgttttccgaagcactgcgtgccggtaccgagatctttcatgcgctaaagtcagtgctgaagggacagggtttaagtactgcggtgggtgatgaagggggttttgctccggacttgcgcagcaatgttgaggcactggatgccattcttgaggcaatcggtagggctggttatatcgctggtgaggatgtgttgttaggtttggatgttgcctcttccgagtttcgcgacaacggtaagtacaacttggttggtgagaacaagcgtctaaccagtgagcagtttgttgatttcttggatgactgggttacgcagtacccaattatcagtattgaggatggtttagccgaggatgattgggcgggttggaagcaattaactgaacgtatcggccataaagtacagttggtgggcgatgatctgtttgtgactaatcctaaggttttccaggaagggatcacttctggcatcgcgaatgcgatccttataaaacttaaccaaatcggtacgttgacggagactctggaatcaattgcgatggctcatcgtgctcagtatgctgctatcgtctcgcatcgatcaggcgagactgaggatacatccattgcggacattgcggtggcgaccacggcaacccaaatcaagaccggctcgttatgccgttctgatcgtgtcgccaagtacaaccagttgttacgcattgagcaggcccttggtgtcggtgcgcgttatgctggtcgtgatgcgttcgtttccctgaagtcctga

SEQ ID NO: 41266 - DNA, 1065 bp, Xylella fastidiosa
atgctcaaaaacgatcgcctactgcgcgccctacaacgcgacaccgtggaccgtaccccaatctggctgatgcgccaggccggacgctatctgccggaataccgtgctgtccggcaacacgccggcagcttcctcaagatggcaaaaactcctgaactcgcctgtgaaatcaccctgcaaccactgcaccgcttcccactagacgcggcgattctgttctccgacatcctcatgatccccgacgcgatgggcctagaactgcacttcattgaaggtgaagggccacgcttgggcaaaccaatccgcgacgccgcagccatcacacaactcgccgtgccggatatggaaaccgaactacgctacgtcatggacgccgtgcgactgatccgtaaagaactggacaacagcgtcccgctcattggtttctccggcagcccatggacactggcctgctacatgatcgaaggaggaagcagcaaagaatacgcacacattaaggccatggcattcaacgcaccggacgtactacatcaactgctaaacaccgtcaccaacgcagtgatcagctacttggcggcacagcgcgccgctggcgcacaagcactacaggtcttcgatacctggggaggcatcctgtcgcccacgatgtaccgaacattctcgctgccctacttaacgcggattgcacgcgaactagaacgcggcaccggtaccgaacgtacccccctggtgttgttcggcaaaggcaacggaccctacatcgcagaactcgccatgagcggtaccgaagccgtcggcgtggactggaccatcgaattagaagacgccgcacgccgtagcaacggccaagtggcattacaagggaacctcgacccagccacactgtacggaaccccaaacaacatcgcgcatgaagtacaacgcaccctagacagctacgcagccggtaacggtggctcacgcgagggacatgtcttcaaccttggtcacggcatgacccctggcatggacccggatcacgtcagcgcgcttgtcgaagccgtgcagcgcttgagccgtcgttga

SEQ ID NO: 41267 - DNA, 1185 bp, Xylella fastidiosa
atgaccactctcacaccactacgcagcgtcaccgtcaacaacacctacccctataccatcgccattggtcccggcctattgcacgatcctctacgcctggccgccaccatccgcggtcgacatgcacttattctcagtgattctgaagtcgccccccgttatgccgcacaactgcaggaaacgctactgcgcgcacgccccgatctacacctcaacgtattcaccctgccagccggcgaaacatccaagtccctagaaaacttcagcgccgcaatcgcccaactcgccacactcggcgccacgcgtgatgcctgcctctttgcactcggcggcggcgtcatcggagatctggcaggctttaccgccgcctgctggatgcgtggcatcgactacgtacaagtgccaaccaccttattggcgatggtcgactcttccgtcggcggcaaaaccgccgtggacatcccccagggtaaaaacatggttggcgccttccatccgccacgtgcagtgatcgccgacaccgacactcttgccacactcccgctacgcgaactacgcgctggtctgagcgaagtcatcaaatacggcgcaatccgcgaccccgtattcttccactggctccaaaccacacgcgaagcacttctagcacgtgaccccgccgcactggcccaagcaatcgcacgtagctgcgaacacaaagccgatattgtcggacgtgacccactggaaaaaggggaacgcgtcctgctcaatctcggccataccttcggccacgccatcgaaacagcacagggctacagcacaccaggaagcaacaacctcaaccacggtgaagccgtcgccgtcggcatggtacttgccgcacgcttgtcaaacgcattaagtctggcacccgcacaagacaccgagacgctgaaaaacctactggatgcctacggcttgcccactgtcctgccctcgggtctaacacctgaaatgctcctggagcgtatgcgcctggacaaaaaaaacattgccggtcgcttacgcttggtcctatggcgcggcattggccacgccgaagccgtctccgacgttgatgaagcaaccgtgcgacagatcctggccaactcaaccaatcaacatacgacctacagcccccatcagcatgcgaccaccaagccaccaaaccgacgcccccattga

SEQ ID NO: 41268 - DNA, 543 bp, Xylella fastidiosa
atgaatcccgctcccaatcttgtgatgatcggcccgatgggtgccggaaaaagctccatcggacgacgcattgccaaacacttcagcctacacttcgcagatacagatcacgccatcgttgaacgcgccggcacgaacatctccgctatcttcaaatattccggcgagccagaatttcggcgcctggagcgcgaagtactgcacgacttgctgaatcacgaaaaccaactcatcgccaccggtggcggtacgatcctggatccagagaaccgccgctgcatgcaagaacgcggcttcgtcgtgtttctaaagatcaacgtgaatacccaattggagcgactggcacatgaccgctaccggccattactgcaacaaatcgaccgcaaacaggtgctgagcgatctctacgccacacgccaaccgctctaccagcaaatcgcagatatgattgtgaccaccgaccacatgtcgcctaacacagccaccgcccagctcattctggacttaacagcccactggcagaaatcaagcaacgccgcatga

SEQ ID NO: 41269 - DNA, 1743 bp, Xylella fastidiosa
atgtccgaaatcaccagcaccgacgcccgagcccagcctgagaagaaagactttatccggcagatcatcagagaagacttagcccacggcacacacactcacatccgcacccgtttccccccagaacccaacggttacctgcacattggccacgccaaagcaatctgcctggattttggcgtcgccgcggaattcggcggacactgcaccctccgcatggacgacaccaatccgagcaaagaagaccccgcgttcgccgctgcaatccaggacgacgtctcttggctaggcttccattggaacgcactacgacatacatcggattatttcgaagtgctgtacctggccgcagaaaaactcattaccgatggaaaagcctacgtctgtgacctcaatagcgaacaggtacgcgaataccgcggcaccctgacagaagcgggccgtccctcaccatggcgtgaacgcagccctgatgaaaatttagaactattccgacagatgcgcgccggcacgtttccagacggaacacgtaccctgcgagccaaaatcgacatggctagcggcaacatcaacctgcgggacccagcgctctaccgcattaaacacgtcgaacatcaaaacaccggcaacacctggccgatctaccccatgtatgacttcgcacacgcactgagcgatgcgatcgaaggcattacccattcattatgcaccctcgagttcgaagaccaccgccccctgtacgactggtgcgtcaaccacgtcgacctaccgaacaactcacacctactcaaaccgttactggacaaaggctttcctcaagaacccagccaacctcggcaaatcgagttttcgcgcctgaacatcaactacaccgtgatgagcaaacgcaagctcaccgcactggtggacgaaaaactcgtcgaagggtgggacgaccctcgcatgtacactctgcaaggcctacgccgccgcggctacaccccagcggccatgcgcctattcgtagagcggatcggcatcagcaaacagaactcgatcattgatttttcagtactagaaaactgcttacgcgagaacttggacaccattgcaccacgccggatggcaaccattgcaccactgaaactcgtgctgaccaacctacccgaagaccatgaagaacagctgattttccccaaccatcccaaagacgacacacaaggcacccgaacaatgccgttctcacgcgaactatggatcgaacgcgacgatttttcagaaatcccccccaagggctggaaacggctggttccaggcggagaagtacgcctacgcggcgccggcatcgcacgtgtagatgaggtggtgaaaaacgcagcaggcgacatcatcgcactacacggctggcttgatccgacctcacgtcccggtatggaaggcgctcaccgcaaagtcaaaggcaccatccactgggtcagcgcaccacacgctgtagcagcagaaatccgcctgtacgaccggctgttctccgttgaaaaacctgacgacaacaccgacggaaaaacctaccgcgacgtcctcaacccagattccaaacgcgtcgtgcatggctacatcgaaccagcggcggcacaaaccgcaccagaacacgcattccaatttgaacgcttgggctacttcgtcacagaccggcatgaccacgatgccgcacaccccgtctttaatcgcagcgtcacgctacgcgacacctggcaacgcgactga

SEQ ID NO: 41270 - DNA, 1206 bp, Xylella fastidiosa
gtgatccgacccgatttgaatgaacgcatactgtcactgcgcaaactgcgtctagcacaatgccgcacccgcacgcgacgcacgatcgaaaggcgtaacggcgttcggctcgaaatcaacggaagctggctggtcgaattctgttccaacgactacctaggactcgcgcaacacttcgaaatcatcgcggcactacaggatgcagccgcccgcgatggcatcggcgccactgcttcgcatctgatctgcggccaccacgcaatacataaggcactggaatatgaactagccgaatggctgggctacccacgcgcattgctgttcggtaacggcttcaccgccaacttggcagtgcaacaagccctgctcaccaaggaaaacgacatctgcgttcaagaccgactcaaccatgccagcctgatagacgctacccgtctggcaggctgtcgcctccgccgctacccgcaccttgatgtggatggagcggcgcatcaactcaagaacgcacctgaaggtgcagcgatgctagcaaccgatggcatcttcagcatggatggtgacatcgctccattacgcgccctcagcctagtcgcacgcacccaacaagcactgatgtatgtcgatgacgcacacggcatcggagtaaccggcccccaagggagcggctgcgtcgcagctgcttggctcagtgtagaggaagtccccttgcaattagtgaccctcagcaaagccctaggtggctacggcgcggccttactcggctctgccacactgatccaacacttggccgaaaccgcacggccctacatatacaccactgcactgccccctgcccaagccgccgccgcactgacagcgatccgtattgcacggcgtgacgaatggcgccgccagcgcctacaggaacttgtggagcgtttccgcgagaatagccgccgtcacggcctggagatcatggattcagagacacctatccaacccttgcaatgcggagatgaaaccacaacgatggccatgtccgcggcattggaacgcgaagggttcctagtcaacgcaatccggccacccaccgtacccgaggggaaatcacggttacgcgtgaccctgtccgcactgcataccactgaacaaatcgacacattagtgcaagcgcttgcccgctcccgcgatgccctcgcgaccgaagccgcacctgtacaagtataa

SEQ ID NO: 41271 - DNA, 882 bp, Xylella fastidiosa
gtgaatttcgtcaccaccctgacctatcttctgccacatcgcatgctgtcctcgctagcacgccacgtcgcctattgccagcatccactgatcaaacagtggttgatcgacacagtcatcgcaaaattcgatgtcaacctgagcgaagcggcggagccggatgcccatgcctacccaagctttaatgcctttttcacccgatcacttaaaaccggcatacgcctccctgatccgaatccggacacattgctcatgccagccgacggacgcatcagccaactcgggccaatccgcgaagggcgcatctttcaagccaagggccaatccttcactgcaaccgagttattgggcgataccgctgctgctgctgccttcaccaacgggctgtttgccactgtctacctatcgccacgtgactaccaccgcgtgcatatgccttgtacgggtcagctgctcaaaacagtgcatgtaccaggccgcttattcagcgtcggcccagatgcagtacgccaaattccacgactgttcgcacgtaacgaacgactggcatgccattttgacactgcattcgggccgatggtcttagtgatggtcggagcgctgcttgtctctggtgtggaaacggtttggggtggtgtggaaatccccgcttatggcgatcgcatcacacacaaggactaccaaggacgcaatatcgccatagagcgcttcgcagaaatggcacgcttcaactatggttcaacagtcatcgtgctgttgccaccaaatgtcttcaccctcgcccctcacctcacagcagaaagcccggtcacactcggtcaagcactagcacaccgcctttctttaaatcactcaacacaggcacctacacaagaaaaataa

SEQ ID NO: 41272 - DNA, 1125 bp, Xylella fastidiosa
ttgttcatgggggcgaacacgtttggaaagttactggcggtcacgaccttcggtgaatcacatggccctgccattggctgtgtgattgatggctgtcctcccggattggaactcgctgctgaggagtttgcccacgacttgcagcgtcgcgctaccggtaggagccgtcatacctcggcgcggcgtgaggccgatgaagtcgagattctctccggcgtctacgaaggccgtaccacgggcactcctattgcactgttgatccgcaataccgaccagcgtagtaaggattatgcgacgattgcccggcagttccgtccgggccatgccgattacacctattggcagaaatatggtatccgtgatcctcgtggtggtgggcgttcttcggcccgtgagacaacaatgcgtgtggctgctggggtggttgctaaaaagtggctgaagcagcgttatggtgtgattgtgcgcggttttttatcccagcttggtgagatccgcccggaaggctttgcttgggatgcggtcgaagataatccttttttctggccgcaggcggctcaggtgccagagctggaagcctacatggatgcattgcgcaaatctggaaattcggtcggtgcacgcgtggatgtggttgccgaaggcgtgccgccagggtggggtgagccgatttacggcaagcttgatggtgaacttgctgctgcgttgatgagtatcaacgcagtaaaaggtgtggagatcggcgctggtttcggcagcactgtacaaaaaggaaccgagcaccgtgatttgatgacaccgttaggttttctcagtaaccatgctggcggcatcatcggtgggatcaccactggtcagccgattattgtttcgattgctctgaaaccaacatctagcctacgtttgcctggcgagacggtggatgtggatggccaccctgtccaagtgatcaccaagggacgtcatgatccttgtgtggggattcgtgcccctccgattgctgaagccatggtcgcgttagtactgatggaccaggcgctgcgccaccgtgcccagtgtggcgatgtcggtgagatgtctccgtgcatccttgagaatgtgggtttcaggaatgccgatgattga

SEQ ID NO: 41273 - DNA, 1035 bp, Xylella fastidiosa
atgtcttcatccaaatcagatcgttgttttaacattgccatcgttggcgctactggcgcagtgggcgaggccatgctttcgatcttggaagagcgtcatttcccagttgcgaagctgattcctcttgcttcggcgcgctcggcgggttctcagatcacctttaagggcgagagcatcaacgtattggagctggagcactttgatccgcatggtgtagatattgcattgttttctgctggcagcagagtctctgaagcgtatgcgccaaagtttgcggctgctggtgtggtagtcatagataattcttccgcgtttcgttacgaggaggatgtgccgttagtcgtatcggaggtgaacccgcatgcgttgaagcagcggccgcgtggcatcattgctaacccgaattgttcgaccatgcagctcatgccggtgctggcgccaatccacagggaatatcgcattgagcgtatcaatgttgccacctatcaatctgtgtctggcggcggccgctcggcgctggaggaattgggacagcagactgcacagttattggcgtttaaagagatcaacccacagcgatttcctgtacaaattgctttcaacttgattccgcatatcgacgattttcagtctaacggctataccaaagaggagatgaaattgatttgggagacaaagaagatccttgaggacagcagcattcaggtgaatccaacggcggtgcgtgtaccagtgttttttggtcattccgaagcggtcaatatcgaaacgcaaaagaaagtcactccggagcaggcacgtgcgttgctggccagtgcaccaggtgttgaggtcgttgatgagtggcagcctggtggttatccgacccctgtgacccacgcttccggcaaagatcctgtgtttgttggccggattcgtgaggatttatcacatccacgcggcttgaacctgtgggttgtcgccgacaacatccgtaagggggccgcgcttaatgcaatacagcttgctgaactggtgacgggcgagacgatttga

SEQ ID NO: 41274 - DNA, 690 bp, Xylella fastidiosa
gtggcacttgcctatggaagtgagtgtatgaacatttccccttaccgtacccgtatcaagttttgcggtatgacccgcgtcggagatgtgcggttagccagcgagcttggtgtcgatgcggtgggactcatttttgcatcgggcagctcgcgtctgctgacagtttccgcggcatgtgcgatacgccgaaccgttgcgccgatggtcaatgtggttgccctcttccaaaataacagcgcagatgagatccacacggtggtgcgcacggtacgtccgacgttgctccagttccacggtgaggaggaagacgcattctgtcgtaccttcaacgtgccctacctaaaggcaatcccaatggcgggtgctgaagcaaagcgcatctgtacgcggaccttgtatttgaagtacccgaatgctgctggtttcattttcgacagtcatctcaagggcggcaccggccagacgttcgattggtcgcgtctccctatcgatctgcagcatccctttctacttgccggcggtattactccggaaaacgtgtttgatgcgattgctgctacggtcccttggggtgttgatgtttctagtggtatcgaattgcagccgggcatcaaggatggcgacaaaatgcgtcaatttgtcgaagaagtacggcgtgccgacggccgcaggctgtttggagtggcctga

SEQ ID NO: 41275 - DNA, 4437 bp, Xylella fastidiosa
atgtactgtcatgcgatcttctgcaatttacgattgatgagcgttatcgaacagaacattttgggccaattgcgtcagcatcgtcgtgcgattgacgatgcgatgacccgtgatcgtggcaggttgctgggcctatggtcgcgttggcagagtcagccgcgtgatcatgaggcgcgtgctaacttccagcgggtgttatctgcatcacgggcacagcgtcaggtccgtgagaataatcagccagtggtcacagtggatacccgtttacctattgcacaggaagcagagcgcattgtcgcgctgatgcgggcgcatcctgtggtaatcattgctggtgaaactggttcgggaaagaccacgcaattaccgaaattgtgtctgtccgctggacgtggcattgccggtacgattgggtgtacgcaaccacggcgtattgcagcgcgtgcggtggcaacgcgggtggctgaggagctgcaaacgcccttgggaatggtggtgggctttcaggtgcgttttaccgagaaggtcagtgatgcctcaaggatcaagttcatgaccgacggtattttactggcggaggttgccagtgaccgttggttgtcagcctatgacacgatcattattgatgaagcccatgagcgcagtctcaatattgattttttactcggttatctcaagcagttactgaaaaagcgtgctgatttgaaggtgatcgtgacttcggcgacgatcgacacggcacgcttttccaagcattttgatgatgcgccggtgattcatgtggctggacgtacctacccggtggaggtgcgttaccgtccgttggatgcgatgtgggcttctgatgatcgcccgggggaaccctacggcggaactgagtccccggctgtgaatcgttgggtgggaggatctggaggtgacggcgcgttgtcaaagcccatcgaggtggtgcctcaagaggatcagcgtactgtcaatgatgcgattgtggcggtgatcgacgagatcacccgtgaggacccgcacggtgatgtattggtgtttctgcccggtgagcgtgagattcgtgagctgtatcgggtactggagcggcgtaagtatcgtgagacggaactgctgccgttatacgcgcggttgtcggctcgcgatcaagatcgggtgttcaaccccggctctgggcgtcgcctggtgctgacgaccaacgttgctgaaacatcattgacggtgccccggatccgctatgtgatcgatccgggctatgcgcgtgtgaagcgctacagtgcgcgccagaagttggaccggttatacattgagccgatcagtcaggccagtgccaaccagcgtgccggtcgttgcggccgcattgccgatggtgtttgttaccggctctatagtgaggaagactttcttgcacggtcggcattcaccgatcctgaaattcggcgctcctccctggccggggtgattttgcgcatgttgcagttgggcctgggacggattggtgggagtgctgcttccttgagcgagcctgtttcagggccggagcagcaacacacctcctggatcattgaaagtttctcgtttctggagccgccggatgaacgggcggttgccgatggctggcaacaattggtcgaattgggggcggtggatagtcagcatgcattgactgcgatcggccgcgagatggcacggttgccggtggacgtgaagttggcgcgcatgctggttgctgcgcgccagcacggctgtgtgtatgaaatgacggtgatcgccgcttttctgggggtccaggatccacgcgagcgtcctccggatgcgcgtgaagcggccgacaatgcgcatgcgaagtttgccgatgcacgttcggagttcgttggtatcttgcgtttatgggaggcttaccgccagatccgtgggcatatgactcagtccaagttacgccagtggtgccagcgtcattttctgggctttcttcacatgcgcgagtggtgcgagttgcagctgcaattgtcgctgttgtgtgcgggggagcaggcggagcagccacgcaaggggcgagtggcggcggcctttccgaaggagggatgcttaccgtctcagcgatcaaagccaggggccgaggcagggaaggtcaacgagttaccttcaagtgcgactgtgttgcaggcactgttagcggggcaggggacctctactcagagtgaacatcgtggtcatacaccgagtcgtggtcagctgcatcgtgcggcgcgcttggcgcgcgagcgtagcgcggttcccaaggtgactcagaacacccagagtgtgaaggcggttgcagggcagagtgtttctcatgccggtatgcaggcgcagtttgcggtgccgcctaatgatgcaccgcatatcggtgagcgtgagcgtgcggctgcctatcaggcgttgcatcgtgcgttgctgactgggttgccgatccagattggccatcgtaccgagaagggagattttcaggcgccgcgccagcgccgttttatgttgtttcctggttcgatgttggcgaagaagccgccaccgtgggtgctcgcagcgaacttgctggatacacaaaaggtgtggggcttgacgaatgctgcgattgagcctgattgggtgattgctgaattgccgcatctgttgctgcgcaagcatttcaatccgtattggtcccgtacccagggccgagtgttggtgtctgagcagattagtttgtttgggttgctgttggcgccgaagaagccgatgcactatggccgcattgatcccgtggcggcgcatgatctttttgtacgccaagggttggtgatgggggagatcaacacgcgtgccggttttgttgctgacaatctcaaggtgttggagcaggcgcatgaggaggaggctaagttgcgtcgtgccggtattgtggccgatgaggattggcaggcgcgttggtattttgaccgggtgccgagtgacatccatacagccgatgcactggattcctggtggaaggggctgccagtggagaagcggcacggtctgtattggtcattgatcgacttgttgcctggcgaagggggggaggaggatcgttatccgaagtattttgcactcggggatgtgaggttgccgctgcactattcgtttgatccaggtgcagtggatgacggtgtcactttggatgtgcccttgcatctgcttaatgcgctggatccggtacggttgtcgtggttggtgcctggttttgtcgccgataaagcggcggcgctgatccgttcgttaccaaaggcgctacgccgcagttatgtgccggcgccagattttgcccatgcatttgctcaagcgttccagcagccttcggccgatgagatgcgtggtgagttagcacgctttttgtcgcgtattaccggggtacgggtggcggcgatcgattttgatgaacagacattggaaccttatctgcatctgcgtgtgcgtttgcatgatgagtctggtcaggttttggcagagtcgcgcgattttgatgcgttgcgtgcccgttttggtagccactcgggcgaggcgttcgtagcccgtgccgggcgcacgctcatcatggaggagctacgcgagtttcctgctgtgtcgattccgcttcagctcactggtgaggctggggttccgatgtacccggcgttggttgacgatggtgagatggcggtgttacggatttttgctgatcccactgaagccgcacaggtgcatccacatggcgtacggcggctcttggagatcgccttagccaacaagatcaagcaggcgcgcaagcagttgccggtgtcttccaagagtgggctgttatatgcggccattgagtcaaaagaatgtttgcgtgatgaccttgtcaaggcggcattgaatgcggtgttggctcatgggttggagtcgatccgtgatcctgttgcgtttgcgcagtgccgtgatgtggcggcgcagcagcttttttctgaggcgatggcgcgactcagtttggccgaggagattttggctgccgtggctgagctgaagccgttgctggaagcaccgttgatgggctgggcgcgtggcaatctggatgacatggaacggcagttggcgcagttggtgtatccaggttttttgcgtcaaacacccgccgatgtgttgacgcagtatccgcgctatctgaaagcgatgatgatgcgcagcgagcgcgctaagcgcgacccgtcgcgcgatcaggcgcgtatgctggaactcaagccatttttagatgctctggaagtggcaatggcacagggtgtctccgacacaccggggtgggagacattgcgttgggatgtggaggagttgcgggtttcactgtttgcccaggaattgggtgtacgttcggggatttcggtcaagaaattggcgcagcggttatccacgctgcgctga

SEQ ID NO: 41276 - DNA, 999 bp, Xylella fastidiosa
atgagcattgccaccactctccatacagccctaagccttccccagattcaatccttcgcagcatcagacatggctgcaatcgatacgctgatccacgaccgcctgacctcagacattgtgctgatcaatcaaattgccgatcacatcatctgctcaggtggcaaacgcctgcgccccatgctaacgatgttagctggccacgccatcggccccacaggccctcatcaccaccaactggcggccatcattgagttcatacacaccgccacactgctacatgatgatgtggtcgacggatcggaactgcgccgcagtcgcagtaccgcaaatgcactatggggcaatgcacccagcgtcctcgtcggcgattttctatattcgcgcagcttccaactgatgaccgaattggccaacctagaagtcatgcagatattggctgaaaccaccaaccgtatctctgaaggtgaagtactgcaattgttgcacgtacacaacccggataccgacgaaaccacctacctacgcgtgatcgagcgcaaaacggcaatattgtttgctgccgcagcacaactcggagcactcgcatcccatgccgatacgcaaacacaaacacgtatgtacgaatatggaatgcaattgggctatgcattccaaatcaccgacgatgtactcgactacaccgccaacaatagccaactgggcaaaaatctcggtgacgatctcgccgaaggcaaagccaccttaccagtgatccatgcgatgacacactcagacgcagccacatgtgaacgtttgcgcatgatcatcagcaaaggcgatagggatgcaatgccagaagtgctgaacgcgatccgtacaactggcagcttggactacagtcggcaacgcgccagcgcgtatgcggccaccgccgaacgcgcactagacggcctgctcgaaaccgaagcagtggccgcgttacgcggcttggcccgctacgctatccaacgaacctactga

SEQ ID NO: 41277 - DNA, 1773 bp, Xylella fastidiosa
atgccccactccgctcatcgccccacccccacactacacacacagatgaatgtgcgcctccagggccacggcgcagcacgaggtgctgcactggggcgcgcctgggtccgtcagatgaacgtcatggaaatccaggataaatacatcactgacactaacgccgaattacatagcttgtaccaagccatgagcgcagcgcgtcaggaaatacaagtactgcgagaacgcatgcatggcaccttgtcccacgaagtcggcgagtttctcgacctacacacactgttgatcgacgacccggagctactacggagcccgaacgaactcatcctcactcacaactacagtgccgaatacgccctgaaaatacagcgcgaccgcctcaccacagaattcgaagccatggaagaccactacctgaaaagtcgcatggacgacctgaatcacgtgctcggacgcatccacgccttcctaaaaaaacactcccccgaacccaaagatgctgcaggtgaaatcctcatctgcaacaacatcgccccatccgaattggcccaagtacaagcccaaggcattattggcatcgtcatcgcggctggcaatacactctcacacagcgccatcctggcgcatagcttgcacctgccactgatcgttggtgcaggagacctgcagctacaaaagatcaccaacggcgacatgctgatcatcgatggcaacagcggagaaatcattgtcaatccatcgccacaggacctgcgtcactaccatagccgactgcgcgaacgcgccaaagaacaacgtgagctggaacaactacgctctaaacacagccgcactcgcgacaacgtcgacattgtcgtacaggccaacgcagaatcaccggacgatgtctcccaagcatacgcactgggcgcggccggtgtgggcctgtaccgcactgaattcctgtttctgcaacgcaacaaactgccggacgaagaagaacagttccaaacataccgcgacactgtactacgtatgaacggacgcccagtcaccatccgcacattagatctgggtgcagataaaaccgactgtaccggcctgactctcagtaacgaagaaaacccagcaatgggcctgcgtgggatacgcctgtcgatggcacaccccgcagtggccaacacacaattacgagcgatcctgcgcacctccacctatgggcatgtccgtatcctggtccccatgattagctgccgagaagaaatcatccttctacgcaagcagatcaaagcgctcagcatccaattgcgcaccgaaggccacgacattgccgagcaggttcccctaggagcgatgatcgaagtaccagctgcagcaatcgcactcaacagctttatcaaagaaatcgacttcctatcgatcggtaccaacgacctggtccaatacctattggccgccgaccgtaacaatgcggcaatcagcgaaatatactccccactccaccctggcgtcctggcagtactggctcagatcatcgtcaccgcacatacacatgccacccctgtcgccatctgcggtgaaatcgctggcgatccacactacgtgcccatgcttctggcattaggcctcacagaattcagccttcacccagccacattacttgaagtacgccgtgcaatccgcaacagtgacctgggcgcattgaaaacaagcgcaaccacactgctccacgcacgcgaccggaagagtatcgaagaatggatggcggcacacgccaacacgacaccgacataa

SEQ ID NO: 41278 - DNA, 1278 bp, Xylella fastidiosa
atgtcaaaaatcgtagttgctggtggtaccccgctgtgtggggatgttcgaatttccggtgccaagaatgctgtccttcctattttatctgccacgttgctcgctgatgccccggtggagatcagcaacgtgccctatcttcatgacgtgatcaccatgatcaatttacttcgtgaattgggagcgggcgtcaccatgaatgaaggcattgaggcgaaaggacgttcgattacggtcgatccacgctgggtacgtcagcacatggtgccgtatgacttggtgaagaccatgcgtgcttctgtgttgctgttgggtccattattggcctgctacggtgccgctgaagttgcacttcctgggggatgtgcgattggttcacgtccggtcgaccagcacatcagaggattgcaatcacttggtgcggagatcacggttgagaatggctacatcaaggcttctgtcagtcaggggcgattgaagggcggtcgtttcgtgttcgacgtggtgagtgtgacaggcactgagaacttgttgatggctgcagctgtggctcaggggacgagcgtcattgagaatgctgcgatggagccggaggttgtcgatttagccgagtgtttgatcgctctcggtgcgcgtattgagggtgctggtaccccacgtatcgtggtcgaaggggtggaaaggttaaagggcgggcagtatgccgtgttacctgaccgcattgagacaggtacttttttggtggctacagcgatgactggggggcggatcagcatgcagcaggtgcgcccgcagactctggatgcggtgctgggcaaactgaccgaggccggagcgtgcatcgaaataggtgaagatagtatccgtttggatatgcaggggcggcgtccatgttctgttaacctgacaaccgcaccttaccctgggtttcccactgacatgcaggcccagtttatggcgcttaattgtgtggcagaaggtgtcggtgtgatcaaagaaacgatcttcgagaaccgtttcatgcacgttgatgaactgttacggctcggtgccaaaattcagattgagggccataccgcgattgtgcagggtgtcgagcgattgagcggtgcaccggtgatggcgaccgaccttcgcgcctcggcctcattgattctggctggtttggtcgcggagggggaaacaatcattgatcgcatttaccacctggaccgtggttacgaaaatattgaggggaaactcggagcgctgggtgcatcaatccggcgtatgacatga

SEQ ID NO: 41279 - DNA, 1236 bp, Xylella fastidiosa
atgagcgctgtgtctgagtctgtgttatcgctgtctcgctattatttgccggtctatcgtccatgccaggtggtgttggtgcgtggtcaaggcagccgtgtatgggatgagcaggggcgcgattatcttgatctggctgcggggattgcggtgtgttgtttggggcattgtgatccggatttggtcgctgctttggtggagcaggcaggtcgtctgtggcataccagcaatgtgttttatagcgagccgtcgttgcgcttggcgcaggagttggtggatgtttcacggttcgctgagcgggtgtttctttgcagttccgggactgaagccaacgaggcggcaatcaagttggtgcgtaagtgggctgctgcgcaggggcgtttaccggagcatcgtacgattgtgacgttccatggtagtttccacgggcgtactttggctgcagtgacggcgacggcgcagcctaaatatcaggagggctatgagccgttgcctggggggttccgctatgtcgatttcaatcatattgaggcgttggaagcggcgatggtcggtggtgatgtcgctgcggtgatgttggagccgattcaaggagagggtggggtgatgccggtggtgtcaggatatttggcacaggtacgtgcgttgtgcgatcgctatggggcgctgttggtattggatgagattcagtgtggcatggggcgtactgggacgttgttcgcctattggcaagaagaggtggtgccggacattgtgacgttggccaaggggcttggtggggggttcccaattggtgcgatgttggctggtccgaaggttgctgaggtgatgcagttcggggcgcatgggacgacgtttggcggtaatcctatggctgctgctgtggcgcgggtggcgttgcgtaagttggcttcggttgagatcgcggccaatgtgcagcgtcagtcggtcgcgctacgcgctgggttggaagagatcagcgaggcattcggtggggtgtttacgcaggtgcgcggtcgcggtctgatgctgggcgcggtgttggcgccgctgtatgcagggcaagccagtgcgattcttgaggtggcggttgagcatggtgtgttgttgttacaggctggccctgacgtgctgcgttttgtgccggcgctgaatgtgagtgatgaggagcttgccgatggtttggtccggttacgtgcggcgttgggggattatgtgtcgcgtttcggtggttaa

SEQ ID NO: 41280 - DNA, 2277 bp, Xylella fastidiosa
atgttcagcaaagatctcgagcaaacaataggtcagtgctacaagcgaacgcgtgaggcgtgtcatgagttcatgaccgttgagcatctgcttctttcattgttggataatccattggcgcacgctgtgctaaaggcttgcggagcggatgttgccaggctgaagcgtgaccttgagcaggccattgaggtatctattacccgcttggatgccgatgacggccgtgatactcagccgacgcttggtttccagcgagtgctgcagcgtgctgtttaccatgtgcagtcttctggtaagaaggaggtgaccggcgctaatgtactggtggctatctttggtgaaaaggattcgcatgccgtctactttctgaatcagcaggacatcagccgactcgatatcgtcaattatttatcgcacggtattacccgtatgggcgatgagagtgacatcgggcaagctgctgagaatgaggccaagggggatagtgaggcgaataagggggatgctcttgctgaatatgctattaacttgaatgaacatgcacggaatggacgaattgatccattggttgggcgcaaagatgagattgaacgtacgatccaggtgctatgccgacgtcgcaagaataacccgctctatgtaggtgaagcgggcgttggtaagaccgcaatcgctgagggtttggccaagcgtattgttgatcgtagtgtgccggaggtgcttgccgatgcggtgatctactcgttggatcttggcgctctggtggctggtaccaaatatcgtggtgactttgaaaaacgtctgaagggtgtgttaagcgcgttgcggaaaacccctaacgcagttttgtttattgatgaaatccacaccatcatcggcgctggttccgcttcgggtggcacgatggatgcgtctaatttgatcaagccagctttagcttcaggtgagttacgttgcattggttcgaccacgtttcaagagtatcgcggcatcttcgaaaaggaccgtgctttggcgaggcgttttcagaagatcgatatcgtcgagcccaccgcgggcgaggctttcgagattctacaaggactcaagcctaagtatgaggcacatcacggcgttacctatgctgatgacgcattgcgcgctgcggttgatttatcggtcaagcacatcggtgatcggttgttgccggataaggcgattgatgtgatagatgaggcaggcgcgcgtcagcgtttgttgccggagaaagaacgcaaagagctgatcgatattgaggagattgagaccattgttacgaagatggctagggtcccggcgaagcaggtgagtgtgagcgataaggacgttttgaaacacctcgaacgcaatttgaagatggtgatctttggtcaggagccagcgattgagatgttgtcgtcggcaattaagttggcgcgcagtggcctaggcaatccggataagccgattggcaacttcctgcttgctggcccaaccggggttggtaaaactgaggtgactaaacaattagcacaccatcttgggatcgagttggtacgttttgacatgtctgagtacatggagccgcattcggtgagtcgtctgattggcgcgcctccgggctatgttggttttgatcagggaggcttgctgaccgagaagatcgtcaagactccacactgcgttctgttgttggacgaggtggagaaagcgcatatggatgttttcaatattctcctacaagtcatggatcgcggtgtgttaacggataccaatggacgtgaggcgagttttaaaaatgtgattctagtaatgacgaccaatgcaggtgcgtcccaatcatcacggcgtacgattggtttcactaagcaggaccataccagcgatgcgatggaagtgatttgtcgcagtttcagccctgagttccgcaatcgtcttgatgcgattgtgcagttccagcccctgggtttcagtcacattctgcgggttgtcgacaagttcatcattgagttggagatgttacttcaagagaaacgtgttgttttgtcggctacgccgattgctcgcgactggctggctcagcatggttttgatccgctgatgggtgctcgtccgatggcacgtgtgattcaagagaaaatcaaacgcccactcgcagacgaattgttgtttggtaagttgctcaacggtggtcgggtcggcattgatgtgcgtgacaatgagttaattgttgagacttattcggaaccagagcggttgtttccggcgaccgtggagtaa

SEQ ID NO: 41281 - DNA, 738 bp, Xylella fastidiosa
atgtcagatccctctaaagtcgctctgatcactggtggcgcacgtcggatcggcaaggcgatcgtgcatcacctgcatgcacatggttatcgcgtcgccgtccacgcacaccagtctggccacgaactgcatgcatttttaactgagctagaacgcacgcgtccatccagcacactcgcattgctcggagacctacacgaaaacgcagtcccagaaatgctgatcgcacgctgtgctgggcacttcggacggctggacgtgctcatcaacaacgcctccaatttctatccaaccccactgggcgaagtgaccccagcacaatgggatgatttatttgcaatcaatgccaaggcccctttcttcctcgcgcaagcagccacaccactgctgcgcaaacatcgcggggcaatcatcaacctgacagatctacatggcacgcagccactgcgccgacatgccgtctataccgcagccaaagccgctctggagatgttgactcgatcactcgcactggaactggcaccgcaagttcgagtcaatgctatcgcacccggggcgatcctatggccaacgcaaggcatagcggaagcagcgaagcaggcgctgctggcacgcaccccattagcacgtaccggcacagtggaagagatcgccgaagcagtgctatggctactagaaagtgccaatttcatcaccggacataccctgcgcctggatggcggccgcacgctgacatga

SEQ ID NO: 41282 - DNA, 1347 bp, Xylella fastidiosa
gtgagggtgtccaggtattttggtaccgatggcatccgtggccgcgttggccaggggttgatttctgctgattttgtattgcgcctgggtaacgcgcttggtcgagtgcttgctcagggccgtgatacccgtccgatggtgttaattggtaaggacacgcgtatctccggttatatgtttgagtctgcccttgaagcgggtttggtggccgctggcgctgatgtgcagttgatcggtccgatgccaacacctgcgattgctttcctcaccaatacgctacgggctgatgcgggcgtggtgatcagcgcatcccacaatcctcatgatgacaatggcatcaagtttttttccgcgatgggtgaaaagcttgacgatgcgacagaagcggccattgaagcggcgattgaggcgccattcctgaccgttgactctgaatatttggggaaggtcaagcgtacacgtgatgcaattggccgctatatcgaattcagtaaggcaagtgtgccgcgtggttttacgttgcgcgggttgaagttggtattggattgtgcacatggcgccacgtatcacatcgcaccgatgctgtttcgcgaattaggtgcggagttagtggcgattggtgttgatccggatggtttgaatatcaatgccggtgttggctctactcacttggagactctcgctgccacagtgcgtgagagcggtgctgatttgggcattgccttcgatggtgacggtgaccgggtgctgatgacggatgcccaaggccggactgtggatggagacgacctgttgtatgtgctggcgcgtgcttggcgtgccagtggtcgtttaaagggcacggtggttgggacgttgatgagtaactatggtttagagcaggcgttggggacccttgggatcccctttatacgtgcgaaggtgggtgaccgttatgtgcatcaggcattggttgagagtggaggggtgctaggcggtgaggcatccggtcacttgttatgtttggatcgcgcaaccacaggtgatggtatcgtcagtgcattacaggtgttggaagtgttgcgtcatgaggggctgacgttgagtcaggcactgctgggtttacataaggtgccgcagaagacggtcaatgtgtgttggtctggtccagccagggctgcagtcgagatgccggaagtacgtcaagcattggttgaagcgcaagcggcggtgcagggccggggacgggtgtttttgcgtccttccggcaccgagccggtggtgcgtatcactgtcgaagccgatgacgtcgtactcatgcagcagacgcttgataggcttgccgatgtggtgcgtgacgcggcgtga

SEQ ID NO: 41283 - DNA, 855 bp, Xylella fastidiosa
atgggggttgagagcgtgcgctgtcctttgcatttcaccaagatgcaaggggctggtaatgacttcgtcgttttggatttgcgtgatgggacgccgccgccggatgtggcgttggtcgcttggttggctgatcgccactttggtattgggtgtgatcaggtgatcgctattgagccgccgcgtggtgtcggggtgtttgccgcttaccgtatctggaatgcggatgggtctgcggcgcagcaatgtggtaatggtgcacgttgcgtcgctgcttggttggtgcgagatggttccgttgcggatgagcatttcttgattgacagtccggtacaggcgcatttggttcgctgcataggtaaagatgagtatgcggtggagatgggtctgccagtgttcgaacctgagcgtattcctctgtctggatttcctaatgcctgtggagagtatgtgttgtcgctacagggtgaggtgttgcgttgtggtgcggtatcaatggggaatccgcatgcagtagttgaggtcgatttgattgatgtggcaccggtcgaacggatcgggtcgctcttgcagcagcatgttgcgtttccggagtcagtgaatgtcggttttgtccaggtgattgatcctggtttggtacggttgcgtgtgtatgagcgtggtgctggagaaacgttggcgtgtggcagtggtgcttgtgcggcggcagttgtgctgatgcagcgtggcagggttggacgtgatgtgcgcgttgttctaccagggggcacgttgcgtgtgcagtggccagtttccggtgggccagtgacgttgtctggtccggcaaagtgtgtgtttgatggagtgtggtacggatga

SEQ ID NO: 41284 - DNA, 2016 bp, Xylella fastidiosa
atgcgcgcgaattacacctctggagtagaatcgccggtgttccctgtatcggtgttgttcatgtgtcttttgatcccgcgcctttttgggcttgcagcaatcgttatggtgggttgctcgaatcagcccgcgtctatggtgccgtctccgatgtcggcacatgtcgttgctgttgggaaagccgatactcgccgtcatgatgaaagttcttatgctgaatcagataaggtcgtcattaagcatttggcattggaccttaagttggattttgataagaagacgctggctggtaccgcggcctattcccttgactggaaggacaaggatgcgaagcaaatcgtgcttgatacccgtgagctgagcatcgagaagattgaagctgacgacggccaagggcacctgaatcagcttaagtttgctttattcccagccgacaaaatattgggtagcaaactggttattgagacccccgcgcagcctacccagatccgtgtcacttaccggactgctccgagcgcctctggcttgcaatggatggagccggcgatgacggagggcaaacgcttgccttttatgttcagtcaatctcaagcgatccatgcccgcagttgggtaccgctccaggacaccccaggtgtacgttttacctacacggcccacatcgtttcacgtccagatgtgatggtgttgatgagtgccgacaacgaccccaacgcagtacgcgatggcgattaccgcttcaaaatggctgaaccgatcccctcttatctgttggcgatcgctgcaggtgatttggtcttcaagcccatttctgcgcgttctggtgtttgggccgagccgatgatggtggataaggcggcaaaggagtttgaggataccgaaaaaatgatcggtaccgccgagacgctatacggtcagtatcgttggggacgttacgacatgttggtattgccgtcgtcgtttccatttggtgggatggagaatccgcgtctgacctttgtcactccaacggtgattgtgggtgacaaatccctggtttcgttgattgcacatgagttggcgcacagttggtctggcaacttggtgactaatgcttcgtggaaggatatttggctcaatgaaggtttcacgacctatgtgcaagcgcgcattactgaggcgctgtacggtcagacgatggccgacatggagcgtcaagtcgatcaaatggatatttttgcagcgttgaaggatattcccaaagccgatcaaacattggtgttgtcgacattgaccaagcgtgatccggatgatgcactgagtcctatcgcttatgtgaaaggggcatggttcctacagtttcttgagcaacgtgttgggcgtgaggtgttcgatccgtttctacgtggttggtttgacagccatgcgtttcaaagtgcgacaagcgaagattttgttgtttatctgaagcagcatttgttatccaaagatcccaatgcgattactgccgaggaattgtatagttggctgaacgcgcctggtattccgacaattgctcagaaggtgcgttcgctgagtttcgccaatgtggatggtgcacgtattgcctggagtggtagtggtctcttaccgaatagtcaggtgactgatggttggggtacccagcagtgggtctattttcttagcagaatgggtgagacgctcaagcttgagcaactcaagcagcttgaccaagcctaccacttcaccggtacgccaaatggcgagattgcgatgcgttggtatccattggcgatccgtagtggttataccgctgcgtggccggaggcgggtgccttcatagggcgtgtgggtcgactcaagctgatcttaccgatttacgctgagttgtcgaaaacaccaaagggattactttttgctaaacaaatttttgcaaaatttaaatctcgttatcatccaatcaccatcgtatcggtggagagtgtgttggtgagagagcaagttgcacaggcagcgaaagcttctaagggaggctga

SEQ ID NO: 41285 - DNA, 714 bp, Xylella fastidiosa
atgaccgtacttcccgccttacctcctctggacgatctggaaacgctcaacgtccacctagaaacgctgagtgctgaaaatcgcgtgtgctgggcactggagcgcggtcctgaccaccctgcactgtcttccagcttcggcgcgcaatcggccgtcatgctgcatctactcacccggtttgcaccggatattccggtgatcctggtcgacaccggctatcttttcccagaaacctaccgtttcgccgacacgctgaccgaacgactcaagctcaatctgaaggtataccagccgctgcgtagcggcgcttggacggaagcccgtcatggtcgactatgggaacaagggatcgacggaattaatcaatacaacaccctgcacaaggtcgaaccgatgcgcagggcattagaggaattgcaagtcggcacctggtttaccggcctacgtcgcggacaatccagtacccgtacccaaacatcaatcgtgcaacagcgtgacgagcggtacaaaatcagcccaattgcagactggaccgaccgcgatatctgggaatacatgaaacaccatgatctgccctatcacccgctttgggaacagggctacgtttcaatcggcgacattcacacgacacgccccttggaaccaggcatgcgcgaagaagacacacgcttcttcggattcaaacgtgaatgcgggattcacgagaacatctaa

SEQ ID NO: 41286 - DNA, 1761 bp, Xylella fastidiosa
atgtcgccccaaacatccttgtccatcctcctccatccgggatcgcctgcacccatgagttcctcctccattgaagacatcaagggcaagagccaccgcctgcgggggtccctgttggagagtctcgcaaacccaaccaccggcgcgctccacgaaagcgaccaaacgctgattaagtaccacggcagctaccagcaggatgatcgcgatctacgtgaggagcgccgtcggcaaaaactcgaacctgcttaccaattcatgatccgcacccggacacctggcggcgtcatcacgccgcagcaatggctgcagttggatgccatcgccacgcgctacgccaaccactcattgcgcgtcacaacacgtcaggcattccagttccacggagtcatcaaacgcgaattgaaagcaacaatgcaggcaatcaacgcggcattgatcgatacacttgcggcctgcggcgatgtcaatcgcaacgtacaggtcgctgccaatccattgctctcgcgtgcccatgcagacctttataccgacgcagcgcacctgtctgagcatctgctacccaacacacgcgcttactacgaaatttggctggatgaaaaaaaggtcgctggtgccggtgaggaagaggaaccaatctacggcccgcactatctaccgcgtaaattcaaaatcggttttgccgcaccaccaatcaacgatgtcgatgtattcgccaacgacctggggtttatcgcagttatcgttgacaacactttgcttggctataacgtcgctatcggcggcggaatggggacaacgcatggtgaccccgacacgtggcctcgcgtcggcaacatcatcggcttcatcacccgcgcggatctgatcgcaatcagcacggccatcgtgaccacacaacgcgacttcggcaatcgaacgctacgcaagcgcgcccgcttcaaatacaccattgatgaccgcggtctagattgcatcgtcggcgagatccagcagcgtgccggcatcacactgcaaccagcacgaccgtttgtattcgaacacaatggggaccgttacgggtggattgaaggtgaggacaggcactggcatctgaccttatcgctaccagccggacgcatcgccgataccgaaagcagccccctgctgagtggcttccgagcaatcgcgcaactcggcatcggccaattccggatgacaccgaatcagaatgtcgtgattgctggcatctctcccggacagcgcgccacaatcgacgcactggtcacccagtacggtctggataccggcaaccgtgcgcccacagccctcgcacgtcacgccatggcgtgtgtcgcactcccgacctgcggtctagcgatggccgaagcggaacgttatctgccggacttcaacgtgaagctacagcccatcctggaaaaatatggacttgctgagaaacccattctgctgcgcatttccgggtgtccaaacggctgctcccgcccctatctcgccgaaattgcgttggtcggtaaagcccctggacgctataacctcatgctcggaggcgatcaacgcggccagcgcctcaacacgctgtatcgggaaaacatcaccgaaactgaaatccttgcggcactagaaccattgctgggccgctatcaacagaaacgccttccgggcgaaggctttggcgattttctacatcgcaccggcatcatcgcacttcccccataccccacccaccgacacgtgatttcctcaacgctgcaagcatga

SEQ ID NO: 41287 - DNA, 1983 bp, Xylella fastidiosa
atgattgctcggatggtgaacgtgaaacgcgcgtttgactggtcagaggcaagcacaagtgtggatgcgttgccggttcctgagactgtcacctatagcgacaacaaacggatgcagtctgtgattgccgacttgaagcagcaggagataaagcctctgctacgcttcatcacatgtggcagtgtcgatgacggtaaaagcacgctgattgggcatctgctgtatgacagtcagtgcttggctgaagatcagttggctgatcttatggtggatagtcagcgttacgggactcagggcgagcatattgattatgcattgttgttggatggtttggccgcagaacgtgagcagggtattacgatcgatgtggcttaccgttactttgatactgagaaacgtaaatttatcgttgccgattgtcctggacatgcgcaatacacgcggaacatggccaccggtgcctctacggcggatgcagcggtggtgctggtcgatgcgcgtaaagggttgctgacccaaacgcgcaggcatagttatatcgttgcgttgttggggatccgccatgtggtgctagcggtgaataagatggacttggttggctacgatcaggagacatttgaagcgattgcctccgattacctggcgctggctgccaaactgggcatcaatcaggtgcagtgtattccgctgtcggcattggaaggcgataatctttccaagcgttcggcaaggatgccgtggtatgtcggccccagtctgcttgagtatctggaagcgttggagccagctgatgtcgatctcgcggctgcaatgtgcttgccggtgcagtgggtcaatcgtcctgattcgcagttccgcggtttcacggggacgttggccgccggtcgcgtgcggcctggagatgctgtcgtggtgttgccttcgggctgtgtttcacgtgtggtacgtgtcttcaatggtgatactgaggtacacgaagctgttgccggccaggcggtgaccttgaccctggccgatgagattgacatcagtcgcggcgatgtcattgccgctcttgatgatccccccgaggttgccgatcaagtcacagcttacgtgttgtggatggacgatactgcgttgttgcctggccgacgttattggttaaagttgggcgcgcggatggtcgctgccagcgtcagtgacatcaagcaccgggttgatgtcaatacacaggaacagcgagtagcgcagcgtttacagctgaatgaggtgggttactgccaactgtcgctagatgcgcctgtggcgtttgtaccgtatgcgcgcaaccgtgtgttgggcagttttattctcattgaccgtcactccaatgctaccgttggtgccgggacgttggattctggggtgcatcgtgccagcaatgtgcattggcagcctctggatattgatcatgtcgctcgtgccaggatcaaggggcagacacccaaggtactgtggttcaccggtctatccggtgctggtaaatctgcaattgcaaacattgtggacaagcgtttgcatgccttgggttaccacacgtttattttggatggtgataacgtgcgccacggtttaaatcgtgatttgagtttcacggtagaagatagggttgagaacattcgccgtgttgccgaagtcgccagactgatggttgatgctggtttggtggtgctggtgagttttatttctccgttccgggatgaacggcagttggcccgcgagcgcttcgccgctaatgagtttgtagaagtgtttgttgatgtgcctttggcggtggctgaggcgcgcgatgtgaagggcttgtatgcgaaagcccgtgcgggcttgatcaccgattttacggggattgattccccttatgagccgccgccgcacccagaactgcatctgcgtgccgaccaaggaacgcctgaacaactggcatctcaggtgttgtcgtttctaggggtggaagcgaactga

SEQ ID NO: 41288 - DNA, 1473 bp, Xylella fastidiosa
ttgacgttgcaattaaacaagaacaggaaaacagcaatgagtgaacattacgacgtcgttgttatcggagccggtccagctggctatcacgctgcaatccgcgccgcccaactgggtctgaaggtcgcttgcgtcgatgcagcactcggcaaggacggtaagccagcgcttggaggcacgtgtctacgcgtgggatgcatcccttccaaagcactgctggactcctcccgccagtactggaacatgggacatctattcaacgaacatggcatcagttttaaagatgccaagattgatgttgccacgatgatcgctcgcaaagacaaaatcgtgaaacagttcacgggtggcattgcgatgctcttcaaagcaaacaaaatcactccctactatggatttgcccaattgcaacctggcaacgtagtcaaagtaaaacaacacgagggtaagaacatcgaactgaaaggcgccaacgtgatcctggcagccggctccgattccgttgaactgccatttgcaacgttcgacggtgaaacgattgtcgacaatatcggtgccctggactttataaaagtcccaaaacgcttggcagtgatcggtgccggagtcatcggtctggaattaggcagcgtatggaaacgcctaggtgcggaagtcactattcttgaagcaatgccagactttctagctgcagttgacgccgatgtcgccaaaaccgccgccaaggaattcaagcaacaggggctggacatcaagctcggtgctaaggtctcccgaaccgaaatctcaagtaaaaacaacaaaaaagaagtcatcgttacctacactgacgcctccggtaagcagacatttactgtcgacaaactattagtggctgtcgggcgcaaggccgcaaccaagggattgcttgcagatggcaccggggtacagctcaacgaacgtggccagatcgtggtggacgaacactgtcataccggtgtcgacggtgtctgggccattggcgactgtgtacgtggcccgatgttggctcataaaggcttcgaagaggggatcgcagtagctgaattgatcgcgggcctgccaggccacgtgaactttgaaaccatcccatgggtcatctacacagagccggaaatcgcctgggttggtaagactgagcaagaactcaaagcaaacaacattccttacaaagctggatccttcccgttcgccgcagtcggccgcgccgttgcgatggctgagccatctggttttgtgaaagtcctagcgcatgcggaaactgaccgcgtgttaggtttacatctgatcggtgtgaacgtctccgaattggtacatgaaggggtattggctatggaatttagtggctcagctgacgatctcgcccggatctgccacgcccacccaaccttatcggaagcaatccacgacgcagctatggcggtcagcaagcgcgcaatccataaagcaaactga

SEQ ID NO: 41289 - DNA, 1176 bp, Xylella fastidiosa
atgaccatcgaagttaaagtcccggtattacctgaatccgtttcagacgccaccattgccagctggcacaaaaaagcaggtgaaattgtgaaacgcgatgagaacatcgtcgacctggagaccgacaaagttgtattagaagtcccctcccccgtcgacggcgtcttgaaagaaatcaaattcgacaccggcagtactgtcaccagcaatcaagttctggcaatcattgaagaaggcagcatcgttgctgcaccctctccagcaccctctccggtgattgatcagaaaccggttgctgtatccgctccagccgccaaatccagcgttgacagtctgcctccaggtgctcgtttcacggcaacgaccgaaggtattgacccagcccagatcgaaggaagtgggcgccgtggtgccgtcaccaaagaagatatcatcaactttgctaagcaaaatggagctgcccgcgccagcggtacgcgtttagaagaacgcgtcccaatgacccgtatccggcaacgcatcgccgaacgcctcatgcagtcgaagaattccactgcgatgctgaccacctttaatgaaatcaacctggccaaagtctcaaacatacgcaaagagttacaggaagaattccagaaagcccacggtatcaaattgggcttcatgagctttttcgtgaaagcggccgccaatgcactgcagcgcttccccttggtcaacgcatcaattgatggtacagacatcatttaccacggatatagcgatatttcgatcgcggtatccaccgataaaggcttagtcacgccagtactgcgcaacgtcgaacggatgtctttcgccgatatcgaacatcacatcgccgattacgccaagaaggcacgcgacggcaaattaagcctggaagagttacagggcggcaccttcaccgtcaccaacggtggcacctttggctcattgctctcgactccaatcgttaacccaccacaaagcgcgattttagggatgcataccatcaaagagcgccccattgctgagaacggccacattgtgattgcgccaatgatgtacgtggcactgtcatatgatcaccgcatcattgatggcaaagattcggttcaattcttggtagacatcaaaaatcaattggaagcccccgggcggatgctgttcggcttataa

SEQ ID NO: 41290 - DNA, 2904 bp, Xylella fastidiosa
gtgactctaggacgtcgcctagacatatccgtgcattgcagacgtagccaatccccatcgacccgactaagcatcgtggacaatctaatcaagcagtttacccaatcctctcctctggccggcggcaatgccgcctacattgaagatctttacgagcaataccttgtctcgcccaacagcgtcgatcccaaatggaaagcttacttcgacggttttaagggacgtgatgcaggtgacatcccacactcggcggtcatcgctcatatcaccgacacagccaagcaaagtgtcaaggccaagtccaggcaagacgcaagcgacgaacgggaacgcaacatcggccgtctcatcaccgcttatcgctcacgtggccatctcagtgcccgaatcgatccactggggctgactccgccaagtaacccgcccgatctagatctgccatttcatcatctatcgcaagccgatctcgacaatgaattcagcacgggtggcatcggtggccagccacggatgaagctgcgcaatctgctcgcacacttaaaagcaacctataccgataccatcggcacagaattcatgcatatctctgaattcgaacagcgccagtggatctatcggcgtctggaaaatgtcggtggcaaaattgctagtaacgcgaccaaccgcaaacgcatcctcgagcgtctgaccgccgcagagggcctggaacgttatctgcatacgaaatatgtagggcagaaacgcttctctctggagggcagcgatacattgattccgttgatggacaccttggtgcgtcaagccggcaacaatgatgtcaaggatatcgtagtcggcatggcccaccgcggccgactaaacgtgctggtcaacacgttgggcaaaaatccacgcaaattgttcgacgagttcgagggcaagttcgagcacgcccatcacgaccgcgctcacaccggtgacgtgaaataccatatgggcttctcggctgacatcgccgtcggcgatggcaagcaagtacatttggcgctcgccttcaatccatcgcaccttgaaatcgttgatccagtcgttgcagggtcagtacgttcgcgtcaagagcgcttcggagacacagaacgcaaaaccgtgctaccaatcctgatccatggcgacgctgcattcgccggccaaggtgtggtcatggaactgctccagatgtcacaggcacgtggcttcgcagtgggcggcactctgcatgtgatcattaataatcaaatcggcttcaccaccagtgcgcgggatgacgctcgctccactccatactgcactgatgtcgccaaaatgattggtgcaccagtgttccacgttaacggtgacgatccagacgccgtcgttttcgtagcgcaactggcctacgaattccgtcagcaattcaaaaaagacgtggtcattgatctggtgtgctaccgccgctggggacacaatgaggcagatgaaccagctgcaacgcaaccagtgatgtaccagaccatccggaagcacaaaaccacccgcgagctttatgcaaccaagctagaagccgaaggggtcattgcggcaggcgaagccaaagcaatggtagatgactaccgagccaaactggactcaggtaagttcaccactgagctggcaagcaaacacacggatgaattcgtcatcgactggtccaagtatctgtccggcaaactggacgatacggtcaagaccagcgtgaagcgtcagacgttgaacaagttggccgcactcatcaataccattccagccactgtggaattgcacccacgtgtcgccaagatttatgaggaccgcatcaaaatggctgctggcgaacagccgggtgactggggctttgccgaaaacctggcctatgccacgttgctggctgaaggccacaagctacgcttggtcggccaagacgccggacgcggcacctttttccaccgccatgccattctgcacgatcaaaaaaccgacagctattatctaccgctgcgccaactggtcagcaacccggacgatgcgacggtaatcgactcgctgctcagcgaggaagccgttatgggcttcgagtatggttactcgaccaccgatcccaacacgctgtgtatctgggaagcgcagttcggcgattttgccaacggtgcccaagtggtcattgatcaattcatcgctgccggtgaggtcaaatggggtcgaattagcggcctgtcgctattcttaccgcacggttatgagggccaaggtccggaacatagttccgcacgtttagaacgtttcctgcaattgtgtgcactggaaaatatgctggtctgcgtgcccaccactccagcgcaagcatttcacatgatccgtcgacagatgcgcatgtccacgcggaaaccgctggtcgtcatgacgcctaaatcactgctacgccacaagctggcagtctccactttggacgaactggctaacggtaagttccaacacatcatcccagacgatgcagctgaccctaaacacgtcaagcgcatcgttatgtgtgccggcaaggtctattacgacatattggaaaaccagcagaaacgaagccaaaacgacttagccatcatacgtatcgagcagttgtatccgttcccgcgtgcgttgctagccagcgaactgaaacgcttcaacaaggctaccgatgtcgtttggtgccaggaagagccgcaaaaccaaggtgcgtggtaccaaatcaagcatcacctacaagccgtattggcacatgctcagaggcttcactatgctggtcgctcaagctctccctctccagccgtcgggcacatggcagaacatatggccgagcaagaaagcctcgttgccgatgcactgttgaatccgttcaacgatcatctcgctgaataa

SEQ ID NO: 41291 - DNA, 1422 bp, Xylella fastidiosa
gtggagatgcagatgagcaacagtgatcgttacagaattgaacacgacagtatgggtgatctacgggtgccgatcgatgcgttgtggggtgcgcagacgcaacgtgctatcgagaactttccgatttccgggcggtcaatgcctcagggatttatccacgcattggggtttatcaaggcggctgcggcgaaggttaacgctgagctggggttgttaccaaagccaatggccaaggagattgaggccgctgcattggatgtcgctgcgggccgttatgatgcggattttccagtcgatatttaccagactggctcaggaacctcgtcgaatatgaacgctaatgaggtgattgcgacgctggccatgcgtgccaccaaggagcctatccaccccaacgaccatgtcaaccttggccaaagttctaatgatgtggttccaacagcgattcggatttccgcaacgttggcggttcagggacgattattaccggcgctcaagcatttacggaaaatgattaacaagcgtgcccgtggtttgggcagtgtggtgaagaccggccgtacccacctgatggatgcgatgccgctgacgttcgctcaagaattcggtgcctggtcggcacaaattgtctctgcggaggcgcgcttgaatgacaccctgaaacggttgcatcggctgccattgggagggacagcaattggtaccggtatcaatacggatccacatttcggccgcaatgcggtgaaggtactgtcagcattaacagggattcactttgagagtgcgaacaataagttcgagggattggcagcgcaagatgatttggttgagttatccggccagttcaatgcgttagcagtggcgttgatgaagattgctaatgatctacgctggatgaacgctggaccacttgctggcttgggagagattgagttgcccgcgttgcagccgggaagttcgatcatgccaggtaaggtaaatccggtgattccggaagctgtggtgatggtcgcctcgcaagtgattggccatcacactgcagtgaccgtggctgggcagagtggcaattttcagttgaatgtgacgttaccgctgattgcttacaacctattggagtctgcgacgttgcttggaaatgtggtgatgctgttggctgataaagtcatcgttggtctgaaggtgcgtcaggatcgagtgcaggaggtgctggagcggaatccgattttggtgacagcgttgaatccgatcattggctatgagaaagctgcggtgattgctaagcgtgcttataaggagcaccggccagtgcttgaggtcgcctgcgaggagagcaacctaaaccctgtggagttggcgcgcttactggatccgactgcgttgactgagggtgggatttatgtcgtcgggggaggtggtggataa

SEQ ID NO: 41292 - DNA, 1353 bp, Xylella fastidiosa
atgcgtgttgcgattttcggtactggttatgtcggtctcgttacaggaacttgcctcgctgaagtcggacatgaggtgctttgtgttgatatcaaccaagcaaaagttgatggtctcaattgtggggttattcctatttatgagcctgggttggagccgatggtcaaggccaaccatgccaccggacgactgcgttttacgaccgattcggttgcggccattgctcatggtgaaattacttttatcgctgtcggtacgcctccggatgaagatggtgctgcggatttgcagtatgtgttagcggtggcacgtaccatcggtcagtgcattgataggtcgacgattgtggtcaataagtcgacagtgccagtggggactgccgatcaggtgcgtgctgccatccagcatgagatggatgtgcgtggcgtggacttcaagtttgaggtggtttctaatccagagtttctgaaggagggtgatgcagttgctgactgtatgcgtccggatcgtattgtgatcggtgccagaagtcgggatgcagtggttcgcatgcgtcgtctgtatgcgccttttaaccgtaatcatgaccgtattgttgagatggatgtgcgttcggccgaactgaccaaatatgcggctaatgcaatgttggccactaagatcagttttatgaacgaagttgccaacattgctgagtatgtgggtgctgacattgaatatgtgcgtaaaggtatcggttctgacccacgcatcggttggtactttatctatccaggtgttggctatggtggttcgtgttttcccaaggacgtcaaggcattggcacgtactgcacagcaatatggtgtggacccgaagctgcttaacgcggtggaagatgttaatcatgcacagaagggacatctgtttgaactcatgctgcgtcactatggatgtagtggtgagagcacggtgttggctgggaaaacattcgcagtgtggggattggcattcaagcctaatacggatgatatgcgtgaggctcccagttgccgattgttagtgcaattgtggaaggcaggtgctcaagtgcgtgcttatgatcccgaggccatgcaggaggcgcgcaggatattcggtgaacgtgatgatctggtgttttgtgagaccgcgtatgcggcgttgcaatgtgctgatgctttgattgtagtgactgagtggaagcagtttcgcagcccggatttttttgttattcgagacgctttgaaagatgctgtgatctttgatggtcgtaatctttatgatccacaggaaatcgaagaagcagggttggcttactatgggatcgggcggggccgttcgttgcatgcatga

SEQ ID NO: 41293 - DNA, 1017 bp, Xylella fastidiosa
gtgagcgttgccctgtctattgatctgtctaaaaagaaaacgattctttgttttggcgaagcattgatcgatatgttggcgcagcctccggtaaagaagggaatgccacgtgcgtttctgcaatgtgctggaggtgcaccagccaacgtcgcagtggcggtcgccaggttaggtggtgcggtgcagtttgttggcatgcttggtcgtgacatgttcggtgattttctgttcgacagttttgccgaggcgggtgtggtgactgatggcattgtgcgtaccagtgcggcaaaaacagcattggcttttgtggcgctggatgcacatggtgaacgtagtttcagtttctacaggccgccagcggctgacttgttatttcgtgctgagcattttcaagatgcgagtttttccgatgcactgatattccatgcgtgttccaatagcatgacggatgcagacattgccgaagtgacttttgaagggatgcgacgtgcgcaggccgctggtgcaatcgtcagttttgacctgaattttcgtccgatgttatggccgaatggagaaaatccggcatcgcggttgtggaaaggtttgtctttagctgatgtggtcaaactatctagtgaagaattggattatttagccaatacgctcgctgcggatgcgaatgcggtgattcagcaattatggcagggcagggcgcagttgctgttggttactgatgccgctggtccggtacattggtacacgcgtaccgcgagggggcaagtaccgacattccgtgtccaggtacaggacagtaatgcagcgggtgatgctttcgttggaggcatgttgtacacgtttgcacagcagtttgatgatgccgccgcgctgattgatttttgccatgatcccgagtcgattgcgagtatgttgcgttttgccgctgcagtgggtgcgcttgccgtgacgcgtcatggggctttcactgccatgccgatgctttctgaggttctttctttgattcaagagcaatcatga

SEQ ID NO: 41294 - DNA, 675 bp, Xylella fastidiosa
atgctggaaacgatagagcacgagactgcccctatgccgcagtggagtgtgttgtggttacatggtttgggagcggatggtcatgatttcatgcccatcattccagagttggtgcgtccacactggccagctttgcgttttgtgtttccgcatgcttcggtgaggccgatcacgattaataacggtgtaccgatgcgtgcttggtacgatcttgtcagttttgatttcaatcaacgtgccgaccaggctgggattgaggctgcagttgcgcaggtccaggcattgatgatgcgcgagcagcaacgtggcattgcgtctgaacgcttgtttcttgccggattttcgcagggaggagcggtggtgctcagtatcggtttgcgttgtaaggcctccttggcaggcttgattgcattgtctacgtatctaccggatcttaacgctgtcactaccgctacagggttgcttccaggcagcaatgcgcaaccgttgtttattgcccacggacattccgatccagtggtgccactggtacatggtcagtgtgctgctgaggcgttgcgtaagctaggtttcgctgtggactggtatacctacccgatggcgcatcaggtttgccaagaggagatccaggccttggcagactggttagagcgccgttttgcgatttcctcttaa

SEQ ID NO: 41295 - DNA, 918 bp, Xylella fastidiosa
atgcctttacttcgtattgctacccgcaaaagtttacttgctatgtggcaaagcgagtatgtcgctgcgcgtttacgtatgctgcgccctgatttagatgtggtgttggtgccgatgagcactcgtggcgatgagatcctggaccgctccctggctgcaattggtggtaaagggctgtttctcaaggagctggaactggcgatgttacgtggtgatgctgattgcgcggtgcattcgctgaaagatgtgcctatggatttggagcccccatttatgcttgcggcggttttgagtcgcgatgacccggccgatgcgctgatttctaatgtctacctttcgctagagtcactcccaattggggcgcgtgtggcgacttcttcgctgcgccgacaagcccagctacgcttttatcggcctgacctgcggttgtttgacttgcggggtaacgttaacacgcgcttggcgaagcttgataacggagattacgatgcgattgtgctggcttgtgcggggttacgtcggctgggattggagcaacgcatgacggctcggctagcaccgccagaatggttacctgcgccaggtcagggggcgattgcggtggagtcactgaccgaggatgctcggatcggtacattgttggctggtcttgacgatctgccaacgcgccaatgcgtggtggctgagcgtacgatgaatcgtgctcttcatggtagctgccatgtgccagtgggggcttatgcatcctacgaagttggtggtatgcgattacagggcttggtgggttgtgttgccgatggtcgtctcgtgcgtgcggagctgtgttcggcaaaggatgagggcgatatgctcggcagggcagttgcacagtgcttgttggatgctggtgcggctgagttgctagccgccactgcatag

SEQ ID NO: 41296 - DNA, 1200 bp, Xylella fastidiosa
atgcctcctatcgctatcaccgccttcaccgctaccactgcggtaggtcatgggcaagccgcactgaatgaagcactacgcacacgtcgtagtgggctacgccgcaatgattttggcgtacatccacttaagtgctggatcggggacgtggaggggttggaaaccatgacgctccctcaagcattgcatccctgggagtgccgcaacaatcggctggcttggctggcactgcagcaagataacttttccgaagcagttgcaaacgcacgaacacggcatggaaaaacacagatggcggtgatcatgggcacctcgacatccagcatcggcgcaagtgaagaggcgtatacccgactggaatacgatgccgagggcgcacgcttcccagacgatctgcaaagagccgtcatccacgctccgcattcactaggcaactttgtacaacacgccacggacctgtgcggtccctgcgttaccgtagcgaccgcctgctcctctagcgccaaagtattcgcacaagcagcacgcctaattacctcaggcgtagtgagcgccgccctagttggtggtgtggacaccctatgtggcagtgtgctgtttggcttcaacgcacttcaattagtttcaccagaaccatgccgtccgtttgatgtacatcgggccggtctgtcactcggtgaagcaggaggctttgcactactggaaagactcgacctagcacccgatgcggatctgttgctgtgcggttacggcgaatccagcgatgcctatcatatgtccgcaccacacccggaaggattaggagcccgcatggccatgcaagaagcactggccagagccaacgtagatgccagtgaagttggctatctgaatttgcatggcaccgccagtcctgccaacgacagtattgaagccgtggcaatagccgcactgttcccgccgacattgcatgccagttcgaccaaagcctggaccggccacaccctcggcgcttctggcatcgttgaatcgaccattgcactcttggctttgcgaggaaacatcctgcccggcaccatgaatagcgaacagcttgacccagtgtgcggaccgcagatccgttgcgaaaacgcacatacaccaatcctgtacgcgatgaataactctttcggtttcggaggtaataattgcgcgttgttattcaaaagagcggacgcatga

SEQ ID NO: 41297 - DNA, 768 bp, Xylella fastidiosa
atgaatccaacttatgacttcaaaggccaggtggccctggtaacgggtgcagccgccggcatgggcctggcgaccgcacgtggcttcgctcagggtggcgcatcggtggtgctggccgaccgcgacggcgagcgcgccgcccaggaagcggcggcgatcgtcgccgaagggggcaccgccatcggtctggcctgcgacgtcagcgacgaggcgcaggtcgccgcactggtcgagaagaccgtcgccgaatatggccgcctggacttcgccttcaacaacgccggcgtcatggccaagatcgccccgttcgccgaggccaccagcgaagaattcgaccgggtgatcggcatcaacctgcgcggcgtgtggctgtgcatgaagtacgagttgcagcagatgcagcgccagggcagcggcgtcatcgtcaacaacgcctcggtcggcgcgctgaccggcaacgtcggcatcggcgcctacatcgcttccaagcatggcgtcctcggcctgacccgcgccgctgcgctggagtactgcaagaagggcatccgcgtgaacgcggtcaaccccggcaccatcgacacgcagatcgcccgcgacgtggtgggcggcagcgacgaagcctttgccaagctgggcgcgagcgcgccgatcggccgcgccggccgtcccgaggaaatcgcttcggccgtgctgtggctgtgcagcccgggtggcagctacgtcatcggtgaaggcctcaccgtcgatggcggctacgtcgttccgtaa

SEQ ID NO: 41298 - DNA, 876 bp, Xylella fastidiosa
atgaaacttgatgccagcctttccggccagtttgccatcggcggcgacctgacggtcaaccgcctgggtttcggcgcgatgcgcatcaccggccccgacgtgtggggcgaaccggaagaccacgacgaggcgatccgcgtcctgaagcgcttgccggagatcggcgtcgatctgatcgacaccgccgacagctacgggccgttcgtcagcgaacagctcatcgccgacgcactgcatccctacggcgggatcaagatcgcgaccaagggcagtctcgtgcgctaccccggcaactcgaccaacccgtcctggccggtgatcggcgacccggcctatctgcgccagtgcgtttacatgagcctgcggcgcctgaagctggaacagatcgacttgtggcagctccaccgcatcgacccgaaggtcccgcgcgccgagcagttcggcgccatccgcgaattcatcgatgaaggcctgatccggcatgccggcttgagccaggtgtcggtcgaggccatcgaagaggcgcgcaaggtcttcccggtggcgacggtacagaaccgctacaacctggccgaccgggcggacgaggacgtgctcgactactgcgaggcgaacgggatcggcttcatcccctggttcccgctcgcggcgggcgatctcgccaagcccggtggcgcggtggacgcgctcgccaaggcgaagggtgccacggccggccagatcgcactggcctggctgttgaagcgcagccccgtgatcctgccgattcccggcaccagcaaggtcgcgcacctggaggaaaacgtggccgccgcggcgatcacgctgagcgacgaggaattcgccgaactcgatgccgccgccccacgcggttga

SEQ ID NO: 41299 - DNA, 1047 bp, Xylella fastidiosa
atgaacgcctccggctacgccgcctattcgcccaccgagccgctgcggcccttcagcttcgagcggcgcgccccgcgccccgatgacgtcgcgatcgagatcctgtactgcggcgtctgccacaccgatctgcacttcgcgcggggccacaagggcggaaccttcccgctggtgcccggccacgagatcgtcggccgcgtgaccggcgtcggcagcgaggtcacccgcgtccaggtcgggcaggtcgtcggcgtcggctgcatggtggattcctgcggccactgcgcggcgtgcgatggcggccacgagcagcattgcctgcaggggatgacgcccacctacaacggcaccgaccggcatgacggcagcaccacctacggcggctattcggaccgcatcgtggtgcccgagcatttcgtgctgaacgtccccgaccagctcgacctggccggcgtggcgccgctgctgtgtgctggcatcaccacctggtcgccgctgcgccgctggaaggtaggcccgggtagccgcgtggccgtcgtcggtctgggcggattgggccacatggcgctgaagctggcgaaggccatgggcgccgaggtgacgctgttctcgcgctcgccgggcaaggaagccgatgcgcgccgcctgggcgcggaccacgtggtgatctccaccgacgccgagcagatggccgcgatcaagggcaagtacgacctgatcgtggacacggtgccctacgaccacgacctgaatccctacgtgcccacgctgtccttccacggcacgctggtgctggtcggctacatgggaccgctggacgacaagctcaacacgctgccggtcgtgttcggcggccgagcggtcgccggttccttcatcggcggcatccccgagacgcaggcgatgctggatttctgcggcgagcacggcatcgtgtccgatgtcgagctgatccgcatgcaggagatcgaggacgcctacgagcgcatgctcaggagcgacgtgaagtaccgcttcgtcatcgacatggcttcgctgaaggcttga

SEQ ID NO: 41300 - DNA, 744 bp, Xylella fastidiosa
atgatcaaagacaaagtcgtcatcatcaccggcgcatcgtccggcatcggcgaagcgaccgccaagctgctcgccagccagggcgccaaggtcgtgctcggcgcacggcgcaccgacaacctcaagcgcatcgccgacgagatcaagcaaagcggcggccaggtggcctatcaggcgctggacgtcaccaggcaggaggacaacgaccgcatcgtcaagctggcccaggacaccttcggccgcgtggatgtcatcttcctcaacgccggcctgatgcccaactcgccgctgtcggcgctcaagaccgacgactggcaccagatggtcgatgtcaacgtcaagggcgtgctcaacggcgttgccgccgtgctgccggccttcaccgcgcagaagtcgggccacgtcatcaccacctcgtcggtggccggcctgaaggcctacccaggcggcgccgtgtatggcggcaccaagtggttcgtgcgcgacttcatggaagtgctgcgcatggaatcggcgatggaaggcaccaacatccgcaccgcgacgatctacccggccgccatcaacaccgagctgctgaccaccatcagcgacaagacttcgcgcgagcagatggagagcacctacgacaagtacggcatctcgcccgaccgcatcgccagcatcgtcgccttcgccatcgaccagcccgaggacacgacggtcaacgagttcacggtcggcccggcgaaccagccctggtga

SEQ ID NO: 41301 - DNA, 1050 bp, Xylella fastidiosa
atgaccgtcaaagcctacggcgcctatgccgccgacaagcctctcgaatcgctggacattacccgccgcgcgccgggcgcgcacgacgtgcagatcgacattgcctactgcggcgtgtgccactccgacctgcaccaggtgcgtgccgaatgggcgggcacgcaattcccctgcgtgccgggccacgaaatcgtcggccgcgtctcggcggtgggtgcgcacgtctcgggcttccaaccgggcgatctggtcggcatcggctgcatcgtcgatagctgcaagcactgcgacgactgcgccgaggggctggagaactactgcgacgagatggtcggcacctacaacggcccgacgccggacgcacccggccacacgctgggcggctactcccagcagatcgtggtgcatgagcgctacgtgctgcgcatccgccacgacgaatcacaactggccgctgtcgcgccgctgctgtgcgcgggcatcaccacctactcgccgctgcgccactggaacgccgggccgggcaagaaggtcggcgtggtcggcatcggcggcctgggccacatgggcatcaagctggcgcacgccatgggcgcgcacgtggtcgcgttcaccacctcggaatccaagcgcgacgccgccatggccctgggtgccgacgaggtggtggtctcgcgcaatcctggcgagatggccgcccacggccagagcttcgacttcatcctgaacacggtggccgcgccgcacgacctcaacgccttcatgacgctgctcaagcgcgacggcacgatgacgccggtcggcgccccggcgtcgccgcacccctcgccggaagtcttcaacttcatcctcaagcgccgcagcctggccggttcggcaatcggcggcatccccgagacgcaggagatgctggacttctgcgcggagcacaacatcgtcgcggacatcgagctgatccgcgcagaggaaatcaacgacgcctatgagcgcatgctcaagggcgacgtgaagtaccgcttcgtcatcgacaacgcctccttggcggcgtga

SEQ ID NO: 41302 - DNA, 1041 bp, Xylella fastidiosa
atgatcgattctaagcagaaaattgctgttcttggtgccggctcttggggaactgctcttgcagcattggttgcaaggcatgcctatccgaccatattgtggggccgtgatgtgggagtgatacagagcatcgatatccagcgccagaacttccgttatttacctagtattatgcttcctcagacgctgcgtgccactaccgatttggctgcagcggtctcaggtgccgactgggttttggtggcggttccctcttacgccttcactgaaactctacgtcgattggctccattgctgtcaaccggcgttggtgttgcttgggcaaccaaaggatttgaaccggggtctggtcgtttcctacacgaggtggctcgtgaaatcctggggggtgatgcgccattggcagtggtgacggggccttcttttgctaaagaagtaactctgggcctgcctacagcggtcaccgtacatggtgaatatgcgcgttttactcagatggtggccaatgcgatgcatggcccgatgttccgtgcctataccggcaacgacgtgattggtgctgagcttggtggggcaatgaaaaacgtactggcagtggctattggcgtggctgatggcatgcagttaggcatgaacgcgcgtgctggtttaattactcgtggactgaatgaaatgttacgtttgtctgcggttatcggtgctcgaccggaaacgctaatggggttggctggtctgggcgatctagtattgacttgtactggtgatttgtcgcgtaatcgtcgcctaggcttcgctctggggcgaggacagagtttgtcggatgcaatacgtgagattggtcaagttgttgagtctgtacagacttccgacgaggtaatgcgccaagctgaacagcatggtgtcgagttgccgatttccgaagctgtgcgtgctgttctacgtgaagagataactccatatgctgggatgaaagccttgcttgcacgagagcaaaagcctgaatatcttgatattctgtttaaggcaaactcttctttataa

SEQ ID NO: 41303 - DNA, 975 bp, Xylella fastidiosa
atgagcaagcggatctacgctagaatcgcaggcacaggcggttatttgccggaaaaagtgctaactaatgacgatctggcccatatcgtcgataccagcgatgaatggatccgcactcgcactggtatccgtgagcggcatattgctgccgaaggcgaaacgaccagcgatttggcttatgaggctgcgatatgtgcacttgaagctgctgaggtgcggtccgctgatttggatttgattgttgtcgggaccacaacgccggacttgatttttccgtctactgcttgcttgttacaggcacgtctgggagctgttggttgtggtgcgttcgacgtgaatgctgcatgttccggttttgtatatgcgttgagcgtggcagaaaaatttgtgtcttcgggttgctccaaaacagtgttagttgtgggggccgataccttgacccgaattatcgactggagtgaccgcacaacttgcgtactattcggggatggtgccggggcggtggtgctcaaggctgatgaagatacagggattctcagtacccatctgcatgctgatgggagcaaaaaagaattgttgtgggatcctgttggtgtgtcagttggttttggtgaaggcaaagattgcggtgcgttgttgatgaagggaaatgaggtgtttaaatatgccgttaaagcccttgatagagtggttgatgagacgttggaagcgaatcatctggataagcacgaactcgattggttaattcctcaccaagccaacttacgcattatcgaagccaccgcaaggcgtttagatatgtcgatggatcaggtggtggtcacggttgatcgtcacggcaacacttccacggcttcggtgccactcgcgcttgacgaggctatccgttctggtcgtgtgcagcgtggtcagttactgctcctggaagcattcggtggtggttttacttggggatcggcgttactgcgctattga

SEQ ID NO: 41304 - DNA, 999 bp, Xylella fastidiosa
atgaaaatcctcgttaccggagggagtgggttcctcggcgaagcactatgccgaggattacttaagcgtggctaccaagtacttagtttccaacgtagtcactaccaagcactgcaagcactaggcgttgtgcagatttgcggcgatctgagcgattttcacgcggtgcggcacgcggtgcgtggtgtggatgcggttttccataatgctgccaaggtaggtgcatggggttcctacactagttaccaccaaatcaatgtgatcggcacacaacacgttctggatgcctgtcgtgctgagaacattagcaagttggtgtacacctcaagcccgagtgtgattcatcgctccaactacccggttgagggtttagatgcagatcaagtgccatatagcaacgccgttaaagtgccatacgctgcgactaaagcaatggctgaacaggcggtgttagcagccaacagtgtcgacttaaccaccgtggcactacgcccacgcatgatatggggcccaggcgaccctcacttgatgccgcgcttagtggcgcgcgcccgcgctgggcgactgcgtctgatcgacgatggtcgtaacttggtagatagcacctacattgacaatgccgcacaagcacatttcgatgcgtttgagcatcttatgcctggagcagcctgtgctggcaaggcttatttcatctccaacggtgagccgttgcagatgcgcgaattgatcaacaagctactggccgctgccaacgcgccaccggtgactcaatccctgtcatttaagacgggttactgcattggtgcattttgcgagatgctatggtcgttactgcccctccttggagaaccactgctaacgcgctttctcgttgagcagatgtctactcctcattggtacagcatagaaccagcaaagcgtgacttcgggtacgtgccgcgcgtgtccattgaagagggcttggtacgtttgctgtccgaaacgcgcgttactggttga

SEQ ID NO: 41305 - DNA, 750 bp, Xylella fastidiosa
atgactcgtaaacttgtattgctacgccatggacagagtcaatggaactcaatgaaccgttttactggctgggtggatatagggctgaccgaacaaggtcatcaagaagccactatggctggtcatctgatgaaagaagaaggactagagtttgatgtcgctcatacttctttacttaagcgggcgatccatacattacaagacgcacttaaagcattggaccaggactggttaccaatttataaaagctggcgtctcaatgagcgtcactacggtgctctacaaggccttgataaaatagataccgcagctaaacatggtgaagagcaagtcaatatttggcgccgctcctatgacatccaaccgccgccgattgatctagatgacccaagccatccaatgcgagaccgccgttacgctgctctggaccgcaaagtattacctgtgacggaatcgctgaaaaacacactcgaacgagtattaccgtactggaatgatgccatcgcaccacaactaaatgacaacaagacggtacttattagcgcccacggcaactcattgcgtgcgttgtacaagtaccttaatcaagaaagtgatgagaaaatcctaaatgtcaatatccctactggcattccacttctatttgaactgagcgatacactacaagtagtgagttaccgttaccttggtgatccagatgcagcacaacgcgcttccgaaatggtagcaaaccaaggtaaggcgaagtaa

SEQ ID NO: 41306 - DNA, 1539 bp, Xylella fastidiosa
atggctgagatagtggactgttttgcagaccgccccatcatcgttggtagcgggcttgctggtctgatcgcagcactgaccatgtctcctgaaccctcagtgcttgtcacgcgcagcgccttgggcgcagaaacatcaagcgcatgggctcagggaggaatgtcggtcagccttagccccgatgacaatcccagcctgcatcttgccgacaccttggcggctggcgatggtctgtgtgatgcagtcgctgcagagagcatcatcttggaagcgcttgacgcttttcatgtcctacaacactttggcatccacttcgaccaagatagcaacggccatctggcgcttggactggaagcagcccattcccgtcgccgtatcgtgcatgttggtggcgatagatcgggtacagcgattgtacaagcattgactgcctgtgttctcaacgatccctcaatcacggtgcttgagggcctcgaagcacgacacattctgatggcggataacgtggtctgtggcttgctgcttgccaacccgacatccgagattgtgttgccctcctcaagaattcttctggcaacaggcggcattggtgggctttatgacgcgaccaccaacccggtgagcaactttggtcaaggcatcgcgatggctgcacgtgctggggccgtactggctgatatggaattcgtacagttccatccgacggccctccattgccacaaccgcccgctggcgctcgtcagtgaagctgtccgtggtgaaggtgcagtcctcattaacgaacgtggcgaacgctttatggcggatattcctggtgccgaacttgcagctcgtaacatcgttgcacaggcaatcagcgccgaaataacccgcggcggccaagtatttctcgatgctaggcaagcattgggagcacgcttcagcacccgctttccaaccatcaccgcactctgccacaaagtaggtattgaccctgtacacatgccgattccagtctgtcccgctgctcattaccacatgggtggtatcgcaatcgatcaccaaggccgcagcagcattcctggcttatgggttgcgggtgaagcagcgtctacaggcttacatggagcaaatcggcttgcgagcaattcactgcttgaagccgtcgtcatggggacacgtgcagcccgagatatcacattccacaacacacctcaccctctcggaacaatccctatcacccctaaaaagcctgataccacactgatccgaccgattgtctctcagtgccttggcgtacttcgccatgccgcagatatgcatcgtgctattgctgccctcttgccttttgtggaaggcgaagaagagtcttccgatcctgccatcgttgcgttgctgatcgccatctttgcatatcttcgcaccgaatcacgcggtgcccatgcacgcaccgatttccctctcaaacatgacacaacacagcggcgccacatgacacttgaggatgttcttgaaatcgcccactcctgtgttgcacaacgcaaagaaaagatctcctga

SEQ ID NO: 41307 - DNA, 795 bp, Xylella fastidiosa
atgaaaatgcgtattgcaagttggaacgttaattcactcaatgtgcgtttgtctcagttgcagcagtggttggtggaggctgcgcctgatgtgcttggccttcaggaaacgaagttggaggaccatcagtttccagaagcagcgttggcggcattgggctatgtcagtgtgtatgcggggcagaagacgtataacggtgtcgcacttctggcgcgcgtggcgttggaggatgtgcaagtcggtatcccggggttcgaggatgtgcagcgacgggtgatcgctgcaactgtggatgggatacgcgttgtcaatctatacgtggttaatggtcaagaggttgggacagagaagtacgcttacaaattaagctggttagatgcggtgtaccactggctggccgaggagctgcaacgctatccccgccttgtggtgctgggtgatttcaatattgctcctgatgcccgggacgtctacgatccgcaggtatggaatgaggatcatattctcacttcgaccacggaacgtgtggcactgggtaagctgttaggactggggttgcatgatggttttcgcttgcatcaccaggatacggggatattcagttggtgggattaccggcaagccagtttccggcgtaataggggcttacgtattgatctcacgcttgtctcggaggcgttgcgcgcgcaggtggtggcttctggaatcgactgcgtgcctagaggctgggaacgacccagtgatcatgctccagcgtggattgaattagctttggcggtgtcttcatcaccttag

SEQ ID NO: 41308 - DNA, 2001 bp, Xylella fastidiosa
atgaccaagcccacacgccgccagttggccaacgcaatccgtttccttgccgctgatgcagtacaggctgctcattctgggcacccgggcatgccgatgggcatggctgatatcgctgaagttctttggaacgatttcctacgccataaccctaacaacccgaactggtttaaccgcgaccgcttcgttctttccaacggtcacggctcgatgttgcaatatgcattgctgcatttaagtggctatgacctgccgttggatgaactcaagcgattccgtcagctgcatagcaaaacagctggtcatcctgagcgcagcgagaccccagggattgagacgaccacggggccacttggtcaggggtttgctaacgcagtgggttttgccttggccgagaaacttctagcgcaacgctacaaccgtccagaacatctgattgtcgatcaccgcacctgggtgttcatgggtgacggctgcctcatggaaggtatctcacatgaagcagccgcgctggcgggtacctggaacttaggcaaattgatttgtttctgggatgacaacaacatttctattgatggcaatactgcgggttggtttaccgaagacactccagcacgattcgaagcctatggttggcatgtaatccgcgatattgatggccatgatgcggaaaaaatcgcaaccgcaatccaagccgccgttgctcaagagaacaagccctcattgctatgctgccgtaccgtgatcggatttggctcacccaataaagcaggtaaagaatcctcgcatggtgccccattaggagcggaggaactggaggccacgcgtaagatgttggattggccatacggcccgttcgagattccgtccgagatttacgatggttggcgtgctaacggcacaggcatgctacgtcaagccgagtgggagcaggggttcgacaactatgcccgacagtatcctaaggaagcagctgaattaacccggcgctcccacgctgagttacctactgattttctcagccaattggatgcttacattgccaaagttcacgctgcggggccctccattgcttcccgtaaagcatcgcagatggcgattgaagcatttgcacctttccttcccgagttaattggcggctcggctgacttggcacattccaatctaacgttgtggaaagggagccaaacagttgttggcgatgcccccaacgccaactatgcctattacggcgtacgtgagtttgggatgagtgctatcgcaaatggacttgcattgcatggcggctttatccccttcgatgcgacatttctagtcttcagtgattacgcccgcaacgcagtgcgtatgagtgcattgatcccagcccatgtgattcacgtttacacacatgattcaattggacttggcgaagacggtccaacgcatcagcctgttgaacacttggccgcactgcgctacatccccaacaatgacgtgtggcgtccctgtgacgcagttgaatctgcagtggcatggaaggcggcgatcactcgcaagaacggcccgagctgtttggtgttcagccgccaaaacttgccgcaccaaccgcgccatgatgcacaacttgagcagattgcacgtggtggctatatcttggtcgacgcggcgagcagcatccccgacatcatcttgatcgcgaccggctcggaagtcagcctagcgatcgaagcgaaaaagacacttgatgcgatgcagctaaaaacacgcgtggtctcgatgccctcgaccaatgtgtttgaacgtcaggaccccacctaccgtgagtcggtcctcccatcgaaagtccacaagcgtgttgcaatagaagctggcgtcactggtttttggtggcaatacgtagggttacatggtgccgtgattggcctggatacctttggtgcatcagccccagcggatgtcttgtacaaacattttaatatcactgcagaacacgttgtcgaagtcgcaaaggcactttag

SEQ ID NO: 41309 - DNA, 1344 bp, Xylella fastidiosa
ttgctactctcttggctttcatctttgcctgagaggctcgaattgatgacttcgtctgctgctgcttctcattccggcctgccaatgcactggaagatgagcataggttttcttggtggtttgctaatcggcttggctgcgcactattgggttggtgctgatgtcgtttgggtgcaacatgccactcattatctcaccacgccgttttccaagttattcctcaatctgatcttcatgctgattgtgcccttgatgttctcggcactcgtggtcggtgtggccgaaatgggcgacatccgcgcactgggccgcatcggttggcgcaccctgggttataccgttgtgctgtcatccgtggctgtgttagtagggctggtgcttgtcaacgtactcaagccaggggtgggggtcgatccgcagttggcgcagcagctgcttagtgaaaatgcggagcgtagccgccagatcgtcgcttccacagatacccagatccacggcatggatatgctgttatcaatcgtaccgagcaacgtggtcgcagcggcttccagcaacgatgccattttatcgctgatgttcttcacgatcatgtttggcattggtatggttctggtgccgcaggagaaggtagagacactgaagcgtgctattgagggtgtatttgaagtttcgatggtcttgattggactggtgatccgtcttgcaccctatgcagtggcctgctttatgttcaacttgacgtcattattcggcctagagttgttgatacggttggcggcttatgtcggtgttgtggtcctggggttgtcgctgcatatgtttgttacctatggtttagcagtatggtgggcgggacgttcaccgctgcgttttttccgcgaaactcaagaggcaaccttgatggcgttctctacagcctctagcaatgccactttaccaaccgcgctgcgtgttgctgacgagatgaagctaccgaagcaaatttcgcgtttcgtactgaccattggtgcaactgccaatcaaaatggcacggcattgtttgaaggtttgaccgtcattttcctggcgcaatttttcggtgtggacctcagttttagtcagcaagcgatggtcatggcagtatgcatcctgggtggcatcggcaccgctggtgtaccgtccggctcgcttccagtggtggcactcatctgtgccatggtcgggattgatcctgtcggtattgggctgattttgggggtgaaccacttcctggacatgtgccgcactgcattaaatgtgactggcgatctagcattgactacattggtgtgcagaggcgagcctcagccaaaaggaagtgtttag

SEQ ID NO: 41310 - DNA, 651 bp, Xylella fastidiosa
atggtactgacaatcgaagccctcaagcatctatggcgccttgatgaatctcgggtgggacgtagtgaaccattgccattggataatcgccattacgtcaagggccatccactatgcgatgccttcacgggtttggcgcagattcaatttggattaggctgtttttggggtgctgagcgtctgttttggcaattgcctggagtattcagtacagcagcaggttacgccggcggcggggtgccatatccgacttatcgtgaagtctgttctggggagacgggtcatgcagaggttgtcttggtagtgtatgaccacactgttatttcatttgagcagttgttgcagacattttgggaatcccatgatcccacccaagggatgcgccagggcaatgatatcggtacccagtaccgttctgtgattcattgcactacatctaagcaatatgctgcagcatcaaccagccgagaggtttaccagcaacaactaaatactgctggttacactgcaattacgacagagatactccatccggcaccgcctttctactatgctgagaatgagcaccaacaatatcttgcaaaacatcctaacggctattgcggattgggaggtactggagtgacctgcccgattcgcttgcaggtttga

SEQ ID NO: 41311 - DNA, 2151 bp, Xylella fastidiosa
ttggctgctgccattagtttatctcttgctgggtgttcttccaaagaatcttccgcaattcctgagaaaactacaaccacacctcaagtgccagttactaccagcaatccactgttaacggccagttccttaccgttccaagcgccaccgttcgataaaatcaaggacagcgattatttgcccgcgttcgaggagggaatgaagcaacatctggctgaaatcaccaagattgctgagaaccccgatgcaccaaccttcgaaaacactatcgaaatgctggagcacagcggcacaaccttggatagggtctcacgagtctttttcggtctagtacatgctgacaccaatgatacgcgccaaaagattcaggaagaaattgcgcctaagctggctgcacaccaggatgagatttatttgaatcccaagctgttcactcggatcaagtcaatttacgatcagcgtgacacgcttagtttggacccattacagaaacgtttggtcgaacgtgattatgaagggttcgtacatgccggcgcacagttgcctgaagcagataaaacaactttacgtaaaatcaacgtagaagagagcacgctgtccacacagtttcacgctaagctggtcgccgccacagcggcaagtgccattgtggttgatgaaaaaaataaacttgatggactgagcgagggcgacattgctgcagcagcggaggctgccaaggcgcgtaagctcaatgacaagtacgtactcgcattacaaaatacgactcaacaacctatatcagcttcgctgaaggatcgtgagttgcgtgctcaggtgttacaagcgtcagaaactagggccgaaaaaggcgacgctaacgatactcgccaaatcgtgcagcgcctgactcagttacgtgcacaaaaagccaagttactcggtttctcgaactatgctgcttataacttggcagatcagatggcaaagacccctgaagcagcgctaaaactactcaacgataccgtgcctgcggctactgcgaaagcacgtaaagaggctgccgaaattcaaaagttgattgataagcaacgtgtcaatacgaaagcgaatcactttgagttagttgcctctgactgggacttctatgcggagcaggtgcgcaaagccaagtacaatttggatgaagagcaaatcaaaccatattttgagctcgacaacgtgctgcaaaacggtgtgttctacgccgccaatcagctatacgggatcacttttaaggagcgcaaagatataccaacttaccatccggacatgaaggtttacgaggtgtttgaccatgacgggagctcgttggcactgttctacactgattacttcaaacgtgacagtaaatccggtggtgcgtggatggatgtgttcgttgaacaaaatgcgatcaccgggaccaaacccgtggtctacaacgtctgcaactttactaagcctgcgcctggccagccggcactattgagcttcaaagacgtgaccaccctcttccacgagtttggccatgcgttacacgggatattttcgaaagtgaagtatccttcgttggcaggcacctcaacatcacgcgattttgttgaattcccgtcgcaattcaacgaacactgggcctctgatccaaaggtgttttcacattatgccaagcactaccaaaccggtgagtccatgccgcagagtttggtggacagtattcgcaaggcaaaaactttcaaccagggttacgtaactaccgagtacctttcagccgcacttctagacttggcttggcataccttaccagccgatgcgccactagaggatgtggagaaattcgaaaccgatgcactgaagaagtacaaggtcaatctgaaagaagtgccgccacgctatcgcactagctattttgaccatatttggagtggcggctattcggcaagctattacgcttacttctggtctgaagtgctgagtgatgacgcattcgagtggtttaagcagcacggtggcctagaccgtaagaatggcgatatattccgcgacaaaattctctcgcgtggcaacagcattgagttgggcgatttatatcggcaattccgtggccagaatccgagtgtgcaaccactgttagataaccgtgggttaaaataa

SEQ ID NO: 41312 - DNA, 1017 bp, Xylella fastidiosa
atgcttttcaataatgtctcgattgcgggactggctcacattgatgccccgtgtacactcacgtcgcaagaaattaacgcccgtttgcaaccgatgcttgagcggattggcattaaaagcgatgtcttcgccgatattgtcggtatcaatgcacgccggttgtggaataccaacgtacagacctccgatgtcgcaacgatggcagcgcgtaaagcattgcaggatgcaggggtggctgtggaccgtatcggcttggtggtcaacacgtcggtgagtcgcgattacctggaaccgtccactgcttcgattgtctccggcaaccttggtgttggcgagcaatgcattgccttcgatgtggccaatgcctgcctggccttcctaaacggcatggacattgcgggacaaatgctggagcgtggggacattgattatgccttggtggttaacgccgagactgctaaccgtgtttatgaaaaaacgcttgagcggatgagtgccccaggtgttaccgagcaggagttccgcgaggaaatggcggccttaaccctggggtgcggtgcggtggcgatggtactagcgcgtaccgctttggtgcctgatgcacctcaatacaaagggggagtgacccgctcggcgactgaatggaacaagctatgttgcgggaatctggatcgcatggttactgacactcgcttgatgctcattgaggggatcaaactggcaaagaaaacttttgttgtcgccaaacaagtgctgggttgggcggtggaagagttggatcagtttgttatccaccaggtcagccgcccacacactgaggcgtttatcaagtcattcggcattgatcctgccaaggtgatgaccattttccgtgagtacggcaacatcggccccgcttctgtgccgattgtgctgagtaagctcaaggaactgggccgtctcaaaaaaggtgaccgcattgccttgctgggtattggttctgggctgaattgttctatggcagaagtggtgtggtga

SEQ ID NO: 41313 - DNA, 621 bp, Xylella fastidiosa
ttgctcatcatggaccattccaaacaacaaaacgcatccatcacccaagcccaggcagaagaggccgtacgcacacttctacgttgggccggcgaagatcccactcgtgaaggcttgctcgacacaccacgccgtgtcgttgaagcatacggagattggttcagcggttaccgcgaagatcctcatgactacctgcaacgcactttcgaggaaatctctggctacgacgagctgatcgtactgcgcaacattacctatgaaagccactgcgaacatcatatggcacccatcatcggtaaagttcacattggctacttaccaaacggcaaagtcgtcggcatcagcaaattagcacgcgttgttgaatcctatgcacgccgcttccagatacaggaaaagatgactgcgcaaattgcagcatgtatccaagagacattgaccccacgtggcgtcggtgtcgtgatcgaaggtgcccacgcatgtatgactacccgaggtatacacaagcgtggtgtatcaatggtcacctcaaagatgctcggtaccttccgtgaagacgcacgcactcgcgccgagttcttacagttcatcgaagtaggtaccaacgtgatggacttatga

SEQ ID NO: 41314 - DNA, 1341 bp, Xylella fastidiosa
ttgaatcgaatcgtgaagaaacatacaggcattgcccctgccgaatatgggcgtcgtcgccgtcagttgatgaagatggttggtccccagggcatcgttgtgctgcctgctgcgcctgagcgggtacgtagccgtgatactcattatccgtaccgtcaggattcggatttttggtacctatgcggctttcccgagcccgatgcggtgttggtgctggtgccagggcgttgccatggtcaagtcctgctgttctgtcgcgaacgcgatcctgagcgcgaggcatgggatggtccacgtgccgggtacgatggcgcaatcgagcagtacggtatggacgatgcgtatccgattgatgatttggacgaaatcttacccggtctgctcgaaggtaggtcccaggtctattatcatttcggtcgtgatgttgaatttgatctaaggttgattggttgggtcaatcgtgtgcgtgatcaggtgcgctacgcggcggattctccacacgagtttatagatctggggcatctgctgcatgagcagcgtttgttcaaatcttatgatgaaattgtgttgcttcagtgtgcagctgatatcagtgtcgaagcgcatcttgccgcgttgcgctatgcgcatcctggcgtctctgaatatgtgttgcaggccgagcttgagcgtgtgttccgggctgctgacagttgcccggcgtatacaagtattgttgctgctggcgctaatgcttgcgtattgcattaccgtgccaatgcggaatgcagtcgtgacggggatttagtgttgattgatgccggcgcagagtaccgcggttatgctgctgacattacccgtacttttcctgtcaacggtcgtttcagtcctgcccagcgtgcgctatacgatctggtcggtgctgcttataatgttgcattagcgcaggcgcggccagggttgccatatgaggctggtcatttggctgcggtgcagacattgactgaggggctgctgcggcttggtctgttgcatggcacgttggaggataatttggctgatcagagttacaagcgcttttatcgtcacaagactgggcattggttgggtttggacgtgcatgatgttggtgactatcgcattgatggtgagtctcgattacttgagcctggcatggtatttacgattgagccagggttatacgttcttccggacgatacggctgtccacccgaagtggcgcggcatcggtatacgtaccgaggatgatgtattgattacggaagatggacattgtgtgctgacaggcgcgttaccgcgctcagctgatgaaatcgaggcggagatggctgcggtgcggtga

SEQ ID NO: 41315 - DNA, 2058 bp, Xylella fastidiosa
atgcgtttattcattgcagagaagccatctgttgccaaagcaatcgccggtgagctgggtgtgacagggaagggtgagggttacattgaatgtggtcacgatacgatcacttggtgtttcggacacatgctcgaacaagctgagccagatgcgtacatttctgaagacgttccactgaatccaaaaactggtaagaaaatctggcgcgtcgaagaactgcctatcatccctgaaacgtggatcatgcagccccgcgaagacgcgaaagcgcagcttgaggtcatcaagcggctgctgaaaaaggcaactgaaattgtcaatgctggtgacccagaccgtgaggggcagttactcgttgatgaagtgctggaatacttcgactgccacaagtcggtgcaacgcttctgggtatcggcacaagattccgtatcggtgcagcgtggccttgctgcgctcagaagtaacaccgcgtatcaaggctttgccaatgcagcacgggcacgtagtcgggccgactggctgattggtatcaatttcagcagggcttatacgctgcgcgcacagcgcggaggttcgcgtgcattgctgacgatagggcgtgtacagactccaacgctggcgctggtggtcatgcgtgatcgtgagattgaggcattcaaatcgattccttaccacacgatccgtgcagcatttaaacacgaggggggtgtattcgttgccgtttggcgggcgaaagaagatcaagttgggctagacccagaggggcgtttggtcgacacggtcatcgcgaacacgttggtcgaatccatcacaggtcatataggtaaggtcatcgagtacaagcaggagccaaagaagaaggcacagccgcgtgcttattcactttctgacatgactctcttggcgtctaacaaattcgggtatagcgcggcagatgtgcttgaggtgtgccaatcgctctatgagacacataagctcacgagctacccaagaaccgattgtgggtacctgccggaatcacaacatgccgatgccccacacgtgctcgaagccatcaagcacgtttatccagaggttgctgtgcttgttgatggagccaatcagaacattaagtccaagacttgggatgacagcaaaattaccgctcatcacggcattatcccgacgatgcacaagggcagtatggctaatctgtccgagaaagagcgcaacatctacgacttaattgtgcgtgtttatcttgcacagttctatttgcagcacgaataccttgccaccaccgttaccctcgaagttgctggtgagcgatttgatgtaggaggcaaggtcgtgacccgtaacggttggcgtgacgtgtacatcgaggccgaggaagaagccgagggtgagtctgagtctggaagcaacaaccaggcgttaccaaatatgcagaatggtgatgtggtgtcatgcgtgaaggcgacacgcattgatgctaagacaaaagccccaagccgtttcaccgagggaacgctgacacgtgctatggagaatatccacaaatatgttacggatgccgagcataagaaactgttgcgtgacggcgatggcataggcacttccgccacacgggcgtcgatcatttctgaattgaagcggcgccaatttctcgaagtgaaaggcaagcagatcgttagcacgaccttggggcgcagcatgattgatgcgcttccagaagtggtgaaaagcccagtgctcactgctctgtatgaacgcatgttgctgtccatcggagaaggtcgtttggaggtggacagtttcattacgaagcaagaggcatttattcgcgaacaaattgcgaaggctaatgatggcgcattgaagcttaatggtgcgaaggaatcaccgaaggtatcggagacccataagtgcatggtctgcggtaaagggcttgtccgtcgtatcggcaaaaagactggtaccaatttctggtcgtgcagtggctatcccacttgctcgcaaacgtatcccgacgccaagggaagacctaactacaccatccaacacaaggagacatga

SEQ ID NO: 41316 - DNA, 1938 bp, Xylella fastidiosa
atgatctctctacgtcatttcgcaatgcgccgcggtgggcggttgttgctgtccaatgttgatatcaccttgcatgcgggtgatcgtgttggcgtggttggtcgcaatggtgttggaaagtccagtctgtttgcagcgatccgtggcgaattggaagcggacaaaggcaatgttgagttacctggaaaattacgtattgccagtgttgcgcaggaaacaccctccttgtcggatctggccctggactttgtactcagtggtgatgatgtagtggccgaggtcctgcgtgtcgaggcagaggcgaatgcacgcgaagattgggaggcggtagccgctgcgcatcagcgcttagccgagatcggcggttacgacgccgaagcacgtgcaggcaaattgctgcatggcctgggtttcctcacacagacgcagcggcgtgccgtctcgaccttctctggtggctggcgcgtccgcttgaacctggcacgtgcactgatgatgcccagtgatctgttattactggacgaaccaaccaaccatctggatatggatgcggtgttctggttagaacaatggttgcagaagtaccctggtacgttgctgctgattagtcatgaccgtgagtttttggataacgttgccacgcatatcctgcatttgcatgatggcaacgccaaactatacgtgggcggctacaccgacttcgagcgtcaacgtgccgagcaactacgtcagcaacagattgcttttgagaaagagcaggccgagcgtgttcacttgcagagcttcattgatcgtttcaaggccaaagcatcaaaagccaagcaggcacaaagccggatcaaacgcttagaaaagttggctgggacggaggctgtccgtatggagcgtgaattccgtatcacgtttgcaccgccaaccaaactaccgcattccttgattacgctgcgccaggtgaattgcggttattcggtattgtccccgtctgcaccctcggatcctccacctgttgatactcatgcggcagcaccttcgcagcaggccgtgattcttcatcgtgttgattttggtcttgaggcgggagaccgtattgggttgcttggtcccaatggtgccggaaaatcaaccctggtcaaaacattggtgagtgacctggcccctttgacaggggagcgcatcgctcatccggatgtgcgtattggttatttcgcacagcacacggttgaatcactgcacgagggacaatcgccgattgatcatttccgtacccttgcgccgcaagcaccaatccaatccatacgcgactttttgggtaaatggaattttcctggagatcgtgcctttgaacctgtggatggtttttccggaggtgagcgtgcgcgcttggcattgtcgttgattgcttggcggcagccgaatgtcttgttacttgatgaacccaccaaccacctggatctagagatgcgcgaagccttggctgaggcgctgagtgattttgatggagcgattgtgatggtctcgcacgaccgtcacttgattggcttggtgtgcgacacgttttggcgtgttgctgatggtgtggtcgagccgtttgctggtgatcttgaccaatacgctgcttggctgcggacacgtcccgcggcacgtggtgtgcgtgccaagacagaggaggccaatcagccacaggctgcggtgactgccaaatcgcctgcttctcaactcccagtgaaaaagccggtcaaccaacaaaagctattggctgcggaaaagcatgtgagcgaattagagacgctcttagccgaattggatcgcaaacttgccgatccggccaattatgccaatggcgaagtgatgatgcgtcttggcgatgagcgcgagcaggctgccagacggttagctgaagcagaacaggcttggttgctgttgatggatgggggatga

SEQ ID NO: 41317 - DNA, 777 bp, Xylella fastidiosa
atgcgactgactccactccccgcattcgacaacaattacatctggacattgattgcccctgacggccgagcaatcatcgtcgatcccggacaagccttaccaatattagaagctcattccaaaggactcatccccactgcaatcctattgacacaccaccacgccgatcacatcggcggagtgccagaactgctagaacgctggccaacacttcccatctatgccccacacgacacacgcatcgcactgaattaccaccgcattggcgagggagattcattgaacatccttggtctgcgattccaagttatccacaccccaggccatactcacagccacttaaccttcataggtaacgatctactgttctgcggtgacacactattcagcctaggttgtgggcagatctttgaaggaacccccacacagatgctcgcatcattgcaacgattggctgcactgcccatacagacccgcgtatgctgcggtcacgaatacacattgtccaacgctgcattcgcactgcacgtcgaccccaccaacaccgccttacaaaaacgtcgacaacaagcaaacgccatgcgtctcgcaaacctccccacattgcctatttcactcgaaagcgaactaaacaccaacccattcctgcgtacggctgcacctaccatccatgcagcaacagctactcacctgcaacgaacaccaatagatgaagtagaagtattcgctacgctacgccactggaaaaacaacttccccataaaaaacatcccctga

SEQ ID NO: 41318 - DNA, 1365 bp, Xylella fastidiosa
ttgcatcaaacccttccaatgctgcgtctcaagaccgaacctgccgacttacagcactatggccgcgactggacccggcgcttcacaccggcacccttagcaatcgcacttcctgccactgtccaagaagtccaggccattgtgcgttgggccaatgatgcccacattgcgatcgtcccttccggcgggcgcaccggcctatccggcggtgccatggccaccaatggcgaactggtgctcagtctggagcggatgaacaaaatgctccggttcgaccccatggatcgcaccatgaccgtgcaagctggcatgccattagaggccgtccaagccgccgcccgccaacacggcctcctgtatcccgtcgactttgccgcccgaggctcatgctccattggcggcaccattgcgaccaatgcaggaggaatccgcgtggtccgttatggcaacacccgcgaatggatcgctggcctcaacgtagtgaccgggactggcgaactcctcacgttgaatcatgcactgatcaaaaactccagcggctatgacttccgacatctgatgattggttccgaaggcacattgggcattgtcgtcgaagccaccttgcgtctgaccgacccaccgccaccgaccaaagtcatgctgctggcattgcccacctttgacgtcttgatgcaagtatttgccgcctttcgcgcacaactacagattgaagccttcgaattttttacgcagcgcgcattgccccatgttctagcccacggtgcccaagcaccgtttgaacatccctatccgtactacgtcgtcaccgaattcccctgcgccgacgcaacccaagaaaccaccgcactcactgtctttgaaacctgcatggagcagggctgggtcttggatggtgtcatcagccagagcgacgcacaggcagcccaactatggcgcctgcgtgagagcatcaccgagagcattgccccatataccccgtataaaaacgatattgccgtacgcattgctgctatgcctgcgtttctagaacaagcacaaacattactgagccaagcctacccagaatttgaagtcctgtggttcggccatatcggtgacggcaacctacacattaacgtcctgaaaccgcacacagtgccccaggctgacttcatccacacctgcgaacacgtcaccgcactgcttgctgacctcctacaacgtttccgcggcagcatctccgcagaacatggcattggcctgataaaaaagccctaccttcacagcacccgcagccctgctgaaattgcattaatgcgtcaactaaaacgcgcattcgacccaaaatggatattgaacccagggaaagtatttgacccctaa

SEQ ID NO: 41319 - DNA, 1452 bp, Xylella fastidiosa
atgctcaaaaaacatttattcatcgtcaaaccgatcgagccgacaaatcacacagggacaggtaaaggggaaacgcaactcaaaagatcgctaacggcaggacagttagtgatgctcggcatcggggccgtgattggcgctggtattttcgtgctcagcggacacgctgccgccgagtatgccgggccagccgtggtgctgagctacattctggcgggaattgcctgtgctttggctgggttgtgttatgcggagttcgcggcaatgctgccggtctccggttccgcttactcttatgcctacgcgacgctgggggaattcacggcttggttcatcggctggaatctggtcctggaatatatgttctctgcctcgaccgtggcggtcggctggtccggttatctcaatagttttctgagcagtttcggttatgggctgccagcctcgctctccagtgcacctctggacgtagtcgatgggcggctgatttatagcggtggcctgatcaatctgccggcagtcgcgattgtggccgcgatcagtgggctgtgctacgtcgggatcactcaatcggccttcgtcaactccatcaccgtggcgatcaaagtcagcgtcatcgtgctgttcatcgctttcgccgcacgctatgtcaacccggacaactgggtcccctttgtccccgacaacgcagcaccaggcaagtacggcatggagggggtgatccgcggtgcagccgtggtgtttttctcctacatcggctttgatgcagtctccaccactgcgggagaagccaagaatccgcaacgtgacatgcccatcggcatcctcggctcgctcgccatctgtacggtgatctacattgccttctccggtgttctcaccggcctgatgcattactcgcagttggatacgcccaaacccgtggccaccgcgctggaaacctacccaacgctgtcatggctcaagcatgtcgtagaaatcggcgcgattgcagggctgagttcaacaatgctgatgatgctgatggcacaaccgcggattttctacgcgatgtcgcaggatggcctgctgcccaagttgctgtctaaagtgcatccaaaattccagactccccacgtaggtacgctcctcgtcggtgcctgtgcctgcactttagccggactgtttccaatcagtctgcttggcgatttggtctccatgggcacactgctagcgttcgcgacggtctgcattggcatcgtggtactacgccgtacccgcccggacctgcctcgccccttccgggtccccatgtactgggtgatcgcccctgcaggggcggcagcctgtctgtacctgttctggcagccgttcaccgagcactggccgctgatggtcggttggacggtactcggcttggtgatgtatggcttatacggctatcaccacagcaaattacggcgcggtggctaa

SEQ ID NO: 41320 - DNA, 1434 bp, Xylella fastidiosa
atgttcaaacaactctgggccaccaaactctctcaacccagccaggacagtgccgaaggactcagcctgcaacgcgtccttggagtgtgggggttaactgcactgggtatcggtgcagtgatcggcggcggcatcttcgtcattactgggcaagccgcggccaatcacgccggaccagccattatgctgtcgttcgcactcgcggcgatctgctgtacgttctgtgcgctggcgtatgccgaattcgcagcgatggtgccggtctctgggagcgcctacacctatacctatgccactttcggtgagctagcagcctggttcatcggttggatgctggtattggaatatggggtttctgccgcggcggtcgcggtgagctggagcggctatttcctcagcttattacagcatctgggcatcgatctgcccgccgcactagtgaatgcgccattggacggcacgctgcacgccactggggccattgccaatctgccagcagccaccatcgtgctgctgctgacctggttgtgctacttcggcatccgtaagtcctcgaagatcaatatcgcgatggttgcactcaaaagcgggctgatcttgctgattattggcgtcggctggaaatacgtgaaccctgattactggcaaccgttcatccctcccaatcaagggccgggcaaatacggatgggatggtgtgttacatggcgcgtcaatggtgtttttcgcctacatcggttttgaagcggtgtcggtggccgcgcaggaatcacaccgtccacagcgcgaccttcctatcagcatgatgagtgcgttagcgatctgcaccgtgctgtacatcatgatggccgccgtcatgactggattagtcccttacacgcaactgggcacagacgagccagtcgtcaccgcagtcgccgcacacccccaactgggctggctgcgcgtcgtggtcgaaatcggtgcattggtcggactgtcttcggtcgtgttggtgatgctcatcggacaaccgcgcatctttatgatcatggccggtgatggcctgctgccaccgatattcagcacaatccactccaagcaccgcactccgcacatcaacacggtgatcaccggactaggtattgcgttgctcgcagcggtgttcccactggatgtactcggcgaactcacctcaatggggacgctgattgcctttgccgccgtctgtgccggcgtgctgattctgcgctgtactcggccagatctgccacgcccattccgcatgccggcagcatggttgttttgctccgctggtgtactcagttgcattaccttattgtcagcaatgaccaggcacaattggatgctgatgagcgtgtggactgttcttggttttgcactgtacttcggttacggatatcgccacagcaaactgcatcgagaaagcacctga

SEQ ID NO: 41321 - DNA, 621 bp, Xylella fastidiosa
atgtgtaatgagcctgcgacgagcgatgttgcattgcctgatctggattgggccaagggtgacggcttgctgccggtgatcgtgcaggatgccgatacgctgcgcgtgctgatgcttggttatatgaacagccaggcattagaggtcacgcagcgcagccgcctggtgacgttttacagccgcagtaagcagcgtttatggaccaagggcgagcgttctgggcatgtgctgcatctggtggccattgatgccgattgcgatgccgatacgttattagtgcaggcccgaccccgtggacccacgtgtcatctgggcaggaccagttgttttcctgcagcgcctggacagtttcttggtgcgctggatgcgctggtggcggagcgtgaacgtgagcggccacaagacagttacaccaccgcattgtttgagcagggcgtccgccgcatcgcgcagaaggtcggtgaggaaggggtggagaccgcattggctggcgtggtccaggtcgatgatgcactccttgatgaatcagcagacctgctttaccacctgattgtgttgttgcgcgcccgtggtttatcgcttgccgatgccgttactgtattagaggcacggcatcgttaa

SEQ ID NO: 41322 - DNA, 774 bp, Xylella fastidiosa
atgttgagccgccgcctcattccatgcttggacgtgcgtgatggacgcgtggtgaaaggcgtgaagtttcgtgaccacgtggatatgggcgatatcgtcgaactggccttgcgttaccgtgatcatggcgctgatgagttggtgttttatgacatcggcgccagtccacgagggcgttctgtggattaccgttgggttgaacgcgtcgcgcgcctgatcgacattccattttgtgtggccggtggtatcggccaggttgagactgcccgtgctgtcttgcatgccggtgccgataagatttcgatcaactcaccggcactgcgccaacctgcgctgattagcgccttagccgaagcctttggggtgcaatgcgtcgtcgtcggcattgattcgatccgtgaggccgatggtcagtggcgcgtccgctgcaataccggggatccagataaaacccaagccttgccgctgcgcaccctggattggattgttgaggcgcagcgcctaggggcaggggagatcgtattaaattgcatggacagcgacggggtgcgctgtggttacgacattgcacagctgtctcaggcgcgggcactgtgtcaggtgcccttggtggcttctggcggcgccgggaacatgcagcattttgcggatgtatttcacaaggctgatgttgatggtgcattggcggccagcgtattccatagcggcgcgattttgattccgggtttaaaacagtttctgcgtgagcagcaaatcgaggtccgcgatgtgtaa

SEQ ID NO: 41323 - DNA, 1128 bp, Xylella fastidiosa
atgacccccatcgtgtttattgaccgtgacggcacgctcattgaagagccgcctgattttcagattgatgcctacgaaaaactgcgccttgtcaacggcgtgatcccggcattgctgaagctccgtgatgccggctatcactttgtgatcgtcaccaaccaagatggattgggcagccctgcgtatccccaagccagctttgatggccccaatgcgttgatgctgcagattttcagtagccaaggcatcgtcttccgcgatgtgctgatcgatcgtagctggccgaccgacaacgcgcccacccgtaaaccaggcatcggcttgatggtcgcctaccttcaagatcgcgacattgattgggcgcgctcggcaatggtgggcgaccgccccacagatctgcaatttgccgagaatctcaacattcgcggattccaattgcgtaccccgcaatttggtggtgattgggattgggacggcattgctcacaccttggccgatgcgccgcgccgcgccgtggtacagcgtcacaccaaggagacaaccatccgtgtcgagattgatttggatggcgcaccccaggcgcggatcaccaccggattaccgttttttgatcatatgctcgaacagatcgccaaacatgccggcatttccttacagatcagtgctgttggggatctgcatatcgacgaacatcacacgatagaagataccggcttggcgctaggtcaggcagtgcgccaagccttgggggacaaacgcggtattggccgctatggattcgatccgccccagctgccgtggcaggtgagcggcgcggcggcacacggtggctttaccctaccgatggatgagacccaagccagcgctgtgttggacttcagcggccgcccgtattgtgtctttgaaggaaccttcgtccgtgagcgcgtcggcgatatgcccaccgaactggtaccgcactttttccgctccctgtgcgatgcctccgggatgaacttgcacttgagcgtgcatggcgacaacgaccatcacaaagtagaagcgtgtttcaaggcgctggcgcgtgccttgcgtcaggcgttacaacgccacggccacgtgcttccttctaccaagggggcgttatga

SEQ ID NO: 41324 - DNA, 1098 bp, Xylella fastidiosa
atgaacacacagacccctacggtccttgacctggtacgtcaagaactacgcaactttgctggctactcctccgcgcgcagtgtcgctttgaccggtgacctctggctcaatgccaacgaatcggcctggcccaatcccgctgattcccacgccaccatgcgacgttatccagaaccgcaaccgcctaagttgcgccagatgctggcggcactctacggctgtgttcccgagcaactattgattggtcgtggcagtgatgaagggatcgacttactggtgcgcgccgtgtgcgaaccgggatgtgatcccgtcctggtcacccccccggtgttcggcatgtatgccgtttccgcacagttgcagaacgccccagtgatccaagtccctttggttgatgacgccgcgggcttccatgccgacgtgcctgcgatcatcactgccgcacagacctcccgcgccaaactcgtgttcttgtgctcaccctctaatccggtcggtgccgcgattccgctacagcagattgagaccatcttgcagacacttgccggcactgctctcgtcgtggtggatgaagcttacggcgaattctccgatgtcccttccgtggtgcccctgctggcccgctacccacatctggtcgtgctgcgtaccttgtccaaagcccatgccctggctgccgtgcgtatcggcagcgtgatcgccgatgcccatttagtcgcgatattacgtcgctgccaagcaccgtatcccttgcccaccccctgcgtgagcctggctgagcaggggctgtcagccgccgcgttgcaagtgaccgcacagcgtgtggccgagatccgtgctgagcgtgagcgcctgggtgccgccctggcctgtctgtctggcgtgcgccgcgtctatccctcccaagggaacttcctactggtgcgctttgatgatgccgaggccgcgcttcaggcgctgtacgccgctggcgtcgtcgtgcgcgaccagcgtgccgcaccgcagttgcatgatgccttgcggctgaccgtgggaacccccgaacaaaacacacgtctcctggccgtgttgcgtgacatccaggcggtgcccgcatga

SEQ ID NO: 41325 - DNA, 1296 bp, Xylella fastidiosa
atgaaaatcattgattggaaccaacttgataccgcggcccaggcccagacactgacccgtcccgcgcagaccatcgccacccaaacccgtgaggccgttgccgccttaattgaacaagtgcgtcgcggcggtgatactgccttgcgtgacatcaccgcccgccttgatggtgttgacctggccacgtttgaggttactgcggccgagctggccgctgcggccacggccgttgccccagaactacagcacgccatgcagacagccgcagcccggatcgaagctttccaccgtgccggaatgaccaacggctatcgtgtggaaacggcgcccggtgtggtgtgtgaacggcttgtacgtccgatcgcccgcgtgggcttgtacgtccccgccggcagcgcacccttattttcaaccgccttgatgctgggcgtccccgcacggctggcgggctgccgtgaagtcgtcttgtgtaccccaccctctaaagatggccgcgccaatccggcggtcctgctggccgcacgtctcaccggagtcacccgggtcttcacactgggcggcgcccaggccatcgcggcgatggcttacggcaccgcaagcgtgcccacctgtgacaaagtgtttggccctggaaatagctttgtcaccgaagccaaacaacagcttgcacaagccggcgtcgtcgcaatcgacatgccggcaggcccctcggaggtcctggtgatcgccgatgccgccgccaatcctgcgtttatcgctgctgatctcctctcccaagcagaacacggcccggattcccaagtcctcctgttgtctgacagtgatgcactgatgacagcggtacagactgcccttgccctccaattgcagcagctatcccgtgccgagatagcgcgtcaggccttagcgcagtcccggttgattaaagtggccaccctggagactgcctttgacatcagcaaccgctatgcgcccgaacatttgattttggcattgcgccaaccgcgtgcctggctgcaccgcgtcgcagccgccggttccgtcttccttggcgactacacccccgaagccctgggtgactattgcagcggtactaaccacgttttgcccaccggcggtgcagcccgcgcctatagcggcgtgagcgtctccagcttccaaaacatgatcagcgtccaagcggccagccgcagcggtattgctgaaattggcgactgtgcattgaccttggcgcgtgccgaaggattggatgcacacgccaatgctgtcgccttacggatgggaacagttccatga

SEQ ID NO: 41326 - DNA, 915 bp, Xylella fastidiosa
gtgagtgcgtccaccgcattaccggtacgcgaccgactgcgtattgcgattcaaaaaagcgggcgtttgacagaaccggcccgccgcctcctgacggcttgcggactgagctggcgtcagagccgcgacaaactgttttgctatggtgaatcgctgccggtggatctattgttggtgcgcgatgacgacattcccggcttgattgcccagggcgtgtgcgaccttggcatcgtgggtcgtaatgaactggatgaacaggcagcctcacggcgccgcaacggcctccccgttccctaccaaaccctacgtggactgcactttggccaatgccgactcatgcttgcggtgcctgaagaatgggagtggcaagatatatcgcaattgacaggcaagcgcatcgccaccagctaccccgcgatcttgaccgactggctacagacacatcacattgctgcacagatcgtcgaactctccggctcggtcgaaatcgccccacgcctgggtaccgctgacctcatctgtgatttagtgtcctccggcgccacattggccgctcaccaactcaaacccgtcatccaaatcatggagagccaagccgtgcttgccggcatgatccgccaacctgccgatgcccgtgccggactcttggccatgctgctgcggcgcatggatggcctgctcaccctgcgtgacagcaacttactgatgttccgtgccttccaagaacacctggacgccttgacccacttactgcccgatgccgaccccttggtacagctgcccgatgacggcagcggcaccctacgcgtgcagaccatgtgtcatggcaccatcacctggcagcgtttggaagaactggaacgtgctggtgctcagggcttgatggtattgaccgtagagcgatccctcgcatga

SEQ ID NO: 41327 - DNA, 2487 bp, Xylella fastidiosa
ttgtccaccgttgaaactcctgtttacgtcccgcctactgtcgttcacaaattcggggggacttcggttgccgatgcggattgctatcgccatgtggcgcgtctcctattagcacgtgaagagactgtgcaggtcaccatcgtttctgcgatgaaaggggtgacggatacgttgatcgcactggccgaacaggcagccaatcattctcccgactggcaggcgttgtggcagcaaacccgcacgcgtcattgcgacgccgctcaggccttgcttggagagcatgccggtacgctgcaaaactggttgaacacccgttttaatgaactgcatgaaatgctggttgccttgtccgtcatcaggatgctgccatctgaagtgctggaccgcttacaaggcttgggcgaggtgtactccgcacagttgcttgggcagtatttgcaagcccagggtgaggattgtgtcgttttggatgcccgccaagtgcttgtcgtgagtcctggtgagtttggtgccgaagtcgattgggcaacgagtgcacagcacttggcccattggcgtatgcagcatccacagcggcgtgtggtggtcaccggtttcgttgcctctgatcgtactggacgcgccatcaccctgggtcgcaacggcagtgattattccggtgccatcttcgcggcgttgtttgaggccgatgagcttcacatctggacggatgtggatggagtcatgtccgcagacccccgggtcgtcccggatgcggtgcaactggatgccttgagttacgacgaagcatgtgaattggcctatttcggcgccaaggtagtgcatccacaaaccatgtcgccggtgatgaaacgcggcgtgccgatcatcattcgaaacaccttccagcccggacatccggggactcggatcaccgctgatagcgtggtgagtgggtctgtcaaaggcctgaccctgagtccaggactggccgtgctgaacctggaaggcacgggtctgatcggtgtccctggtaccgctgaacgcgtgtttgccgccctgcgcaatgcgcgtttgtctgtcgtgatgatctcacagggatcttcggagcattccatttgctgcgtcgtgcaccaaaccgaggccgagcgtgcacgtgatgcgttgttgtatgccttcgcccatgaattggcgatagggcatgtccagcgcgtgcaactgaccaacaatatcagcgtattggcggcggttggcgacggcatggctggtcacctgggtgtagcggcgcgcttgtttgaatccttaaggcgcgcccatgtcaacatcctggccattgcccaggggtcttcagagcgcaatatttcggtggcaatcgacagtcagcaggcgacgaaggccctacgcgctgcacacgctgctttctggttatcaccccagacattttcgattggtgtgattggtccgggtcacgtgggtgaggccctattggaccagctatgtgctgcacagcagcaattactgtccaaggcaaatctggatctgcgtttgcgggcgatcgtttcacggcggcgtatgttattggatgagcgtggcctggggagtgactggcgccacgccttcgccgccgtaccagaggcggtcgatctggatgcctttaccgcacacttacaggccgcccatctgcctcatgcagtgatcattgactgtagcggcagtgctgaggtggctgatcgctatgccgactggctggcagccggtatccatgtcgtgaccccgaataaacaggctggctccggccccttgcatcgctaccacgcgattcgtgcagcagcagatgccagcggcgcacgctttcgctatgaagccacagtgggcgcaggcttgccggtgattacgacattgcgtgacttgatggataccggtgatagcgtcacctcgatcgaagggatcttttccggaaccctggcgtggctgttcaataaatatgatggtagcgtccccttctcccaattgatcacccaggcgcgagcgatgggatataccgagccggatccgcgcgatgacctgtctggggttgacgtggcgcgtaagctggtgattctggcgcgcgatgcggggcgtgatatcagcctagaggatgttgcggtagaaagcctggtgccggagacattgtgtcaactcagcgttgccgatttcatggcacgactcaatgaagttgatgccacctttgcagagcgtttggctgcggccaaacagcgcggttgcgtattgcgttacgtcgcacaactgtcccctggacacgtccctagtgtcagcttgattgaattgccttctgaccatgccttcgtcaatcttcgtttgaccgataacgtagtgcaatttacaacccgccgttattccgaaaaccccttggtcgtccaggggccgggcgccggtccagaggtcaccgcagccggtgtttttgcggatttgctgcgagttgcagcgggtgagggcgcacgcttgtga

SEQ ID NO: 41328 - DNA, 969 bp, Xylella fastidiosa
ttgaaccttaaagcgatcacccttatgcaatttgattcaaatggacgtttgcgtcacctgctcactttggaaggactgtcgcgtgacacactgctgcagttacttgactgcgctgcccagaactgtgcactcggggttgaccctatgggcaagcgcaacgtgttagctggtatggcggtatgcacactcttttttgaaccatccacgcgtacccgtcactcattccacctggccgcgcagcgtttgggagcggatgtattaaatttcgatgcttctatgtcgtccacgagcaagggtgagagtgcctgcgacacattgaagaatttggaggcaatgggggtgcgcggttttatagtgcgccatcctgaagagatcgtcatcgcacagttggctgcggtggttggtgagggtaccgtgctgatcaatgccggtgctggccgtagtacccatccgacgcaggcgctgctggatatgctgaccttatgtcaggctaagggcaacgatttttccaagctaaagctactctttgtcggtgacatcaaacattcacgcgttgcacgctccaacctgcatgcgttgcgcaccctgggtgcaggacagatccgggtgtgcggtccgactgcattattgccccatgacggactcctctctggttgtgttgtcagtcaagattttgatgccatgcttgaaggtgtggatgtactgatgatgctgcgtctacagcgtgagcgtatggaggaaggattggtgccctcgttggagcactaccatgccaactatggtttgaccgcagcgcgcctggcgcgtgcagctccggatgcggtggtattacatcctgggccaatcaaccgcggcgtggagattaccgatgaggtggccgatggcccgcagtcatggatcctgcgtcaagccagcaatggcgtgatggtccgtatggccgtgctggagacgttactgggttgcgcctga

SEQ ID NO: 41329 - DNA, 2346 bp, Xylella fastidiosa
ttgttatatatatattatttatttaaatcattatttttccatacactgttcgtattctctatttataaagattgtccttatatgcgtgcatcatctccagaaacgacttctgccgtgaagtgtcctttcaataagacagcggttgaagggactcacaataaagactggtggcccaatcagttacgtgtggatttgctgcatcagcattcgaataagtccaatccactgggtgaaacgttcgattacgccaaagagttccagaaactcgattacgctgcgttgaagcgggatttacatgcattgatgaccgattcgcaggattggtggcccgctgactttggtcattacggcggtttgtttatccgtatggcttggcatagtgccggcacctatcgtatcggtgatggtcgtggtggtgctggccgtggccagcagcgcttcgcgccgctcaatagctggccggataatgtcagcctggacaaggcacgtcgtctgctttggccgatcaagaaaaagtatggtcagcagatttcttgggccgatctgattgtgctttccggtaacgtcgcgttggaatcaatggggtttaaaacttttggtttcgctggtggtcgtgtggatacctgggaacctgatcaggatgtgtattggggccgggagacgacctggcttggtggggatgttcgttatggagctgtctcggaaggtgtacaccatccagatgaacacaggggagcaaaggagaaggctgccaagaatagcgactcgcgcgtgttggaaaatccgttggctgctgtgcagatgggattgatttatgtcaatcctgaaggtccggatggccgtccagatccgctcgcttctgctcgcgacattcgcgaaacgtttgctcgcatggcaatgaatgatgaggagactgtggcgttgatcgccggtggccacaccttcggaaaaacacacggcgcggctccagcagacaacgtcggtcctgagccggaagctggggagttggagcagcagggcttggggtggcacaaccgcttcggtagcggcaaggcgggggatacgattaccagcggtttggaggtgacatggactaagactccaacacaatggagcaacgatttttttgagcacttgtttggttacgaatgggagttgaccaaaagtcctgccggcgcctatcagtgggtggctaagaatgctgcagcgacgatcccgcatgcgcacgatccgtcgaagaaattactgccgatgatgctgacatcggatttagcgttgcgttttgatccgatctacgaaaagatttcgcggcatttccatgcgcatccggaccaattcgccgatgtgtttgctcgggcttggttcaagttgatgcaccgtgatatggggccgcgggtgcgttaccttggtccagaggttccggttgaagagttgatttggcaggacccagttcctaaggtcagccatgtgttagttgatgcgcaggatcttcttgcgttgaagcagaaaatttctgcttctgggttaggaatctcgcagctcgtttcgacggcttgggcatcggcctccacgttccgtggctcggataagcgcggcggcgcgaatggggggcgtctttgcttggctccgcaaagccagtgggaggtcaatcagccgcagcaactgagtgtggtgctggaaacattgcggcgtgtccagactgaattcaacgcgcaagcaggagacaaacgcatttctttggcagatttgattgtgttggctggcggtgtaggcgtggagcaggcggcgaagcgtgccggtatcgtggtggaggtcccttttgtgccgggacgtaccgacgctttgcaggagcaaactgatgtcagttcatttgctcctctggagccgtttgctgatgggttccgaaactatgtcaagggagatgaagttgtcccgtctgagcatcttttgattgatcgtgcccagttactgacattgactgcaccagagatgacggtattgatcggcggtttgcgggtcttgggtgccaacgttggcggtgtgaagcacggtgtgtttacagatcgtctggggacgttgagtaacgatttctttatcaatctactcgacatggggacggagtgggcccccgtttccaaagagcgtcatgtgttcgaaggacgtgatcgtcgcaccggtgtgctgaaatggacgggtacccgtgttgatctggtctttggctcgaatgcgctgttacgtgcgttagcagaattctatgccgcagtggatgctcaagagaagtttgtacgcgattttgtcgcagcttggagcaaagtcatgcatttggatcgctttgatttggtgtga

SEQ ID NO: 41330 - DNA, 882 bp, Xylella fastidiosa
atgcaattcaaggattattacgcgactttaggtgttgaaccgagtgcgggtgaggctgagatcaagaccgcttaccgtcggctagcgcgcaaatatcatcctgacgtcagtcaggagccgggggcggaggagagattcaaggccgtcaacgaggcttatgaggcattacgcgatccgaacaagcgtgcggcttatgaccagctccgtgcacaagggtatcggcctggagaggaattccatgctcctcctaattttggtggtgggcatggttttaactttgaagaggtgtttggcaatgcgtcgggggggcatttcagcgatttctttgagagcttatttgctggagcccgtgccggtggtcatcatgcaggtccagggggtggcgccaaatcgcaacacggtgatacgcgtgctaagttgacggtgccactggaagccatttacagggggggaagtgtgcgggtcacggtcaatgggcgtcagcttgatgtgcgtgtgcctaaaggtatccaacctggcaaggtgattcggctgaacgggcagggcagctacgctcgtcatctcttattagagatcgaatacgccccgcatccgcaatttgaagtcgatgggcacaatattctgcacactgtgcaggtgacaccatggcaggccgcattggggacttcgatcagcgtgccgactctcggcggatctgtggagctgaaggtgccaccggattccgatgcgggacgcaagttgcgtctgcgcggtcgtggtttgcctggtcctccgccaggagaccagatcgttgagttggaaatcactgctcctttagctacaaacgagacacagcgcaaggcatatcgggcgcttgccaaagcgtttggcgagaaggtttga

SEQ ID NO: 41331 - DNA, 2013 bp, Xylella fastidiosa
ttgcgcattaggtcagtcatcaatgtcatctttatgcttcaccggattgcttgctcgggtccattatggggaggacaatggtgcttccgttgtaatgccaagacgatgattgattccacttgttatccacgcttgtcgcgtatccaaatcccagaggatctccgcacttttcaggagtcggagttgcgtgcggttgccgatgagttgcggaattatctgatcgaatcagtaggcctcagtggcggtcactttgctgctgggttgggtgtggtcgaattgacgatcgctttgcattatttgtactgcactcctatcgatcatcttgtctgggacgtgggtcatcaaacgtatccgcataagatattgaccggtcgccgtgacaagattagtacggttaagcatcaaggtggtttggcaccgtttccgaagcgtgaggagagtatctatgacacgttcggtgtcggtcattcttctacttctatttcagctgcgcttgggatggcgattgtggcgcagcgtcatggggatgagcgtaaggtggtggccatcatcggcgatggtgcgatgacggcagggatggcttatgaggcgctgaatcatgctggcgggatgagtcctgcaccgaatcttcttgtgattcttaacgacaatcgtatgtcgatttccgaagcggtcggtgggcttaccaagatgcttggtcgtgcgactggcagcaaagcattgaatgcgatccgtgagggtggcaagagaatttttggggataagaaaaccaatgcaaccgcgcgttttttacgtcgctgggaggagcattggaaggggatgtttgtgccgtcgacgttgttcgaagagatggggttccattataccggcccgatcgatggccatgatttgccggcccttcttggtgcgttgaagacgttgcgtacgttgaagggtccacagttgttgcatgtgatcacaaccaaagggaaggggtatgagctggctgagggagaccagattggttaccacgccgtcgccccgtttgatccgcaaaagggtctgattaaggcgggagcaaagaagcaaacatatacggacgtgtttagtgagtggttgtgtgatatggcagcggtggaaccacgtttgctggctattacaccggcgatgcgtgagggatcggggttggtgcgttttagtcaggagtatccgcagcgctattttgatgtggccattgctgagcagcacgcgataacgttggcggctggtatggcgactcaaggtgctaagcctgtggtggcgatttactcgacctttttgcagcgtggttacgatcaattggttcacgatgttgcgttgcagaagttggatgtgctttttgcagtagatcgcggtggtgtggttggtccagatggtgcgacgcatgcgggtaatttggatctcagtttcctgcgttgcgtgccaaacatgatgttgatggctcctgccgatgaggcagagtgccggaagatgttgagtaccggtttccactattctgggccagtagcggtgcgttatccgcgtggtacgggtcctggggtggtgccgtccgctgagttggatgtgttgccggttggtgtggcgcagttacgtcattctggtacacggatcgctctacttggttttggggtgtgtgttgctcctgctgaacaggtggggcgtaggcttggtttgactgtggtcaatatgcgttttatcaaaccgttggatcgaacgttgctgttggagttggcgcgtactcacgaagggtttgtcacgattgaagataatgtggttgctggcggagctggctcaggggttgcggaattacttaacgctgaaggcatcgttttgccgattgtgcatcttggtcttccagatgcgttccagcaacacgcttcccgtgaggatttactggctgaggcgggtattgatgcggctggtgtgtatgctgcgctgttaagtcgttggcctgatttggcggtacagaaccatccgctgagtgcggtgagttga

SEQ ID NO: 41332 - DNA, 1944 bp, Xylella fastidiosa
atgtctgacctgtacaccattgatccgatgttggccaaagatgcgcacgtagaccgtgctcactacaaaacgctttaccacgaatccctcgaacaaccggaagcattctggagcaacatcgcacagcgcctggagtggttcaaaaccccaacaaaaatcaaagatgtcagctaccaactagaagacgttcacatccgctggttcgaagacggtgaactcaatgccagcgtcaactgcctagaccgccacctcaccttacgcggcgacaaaacagcactcctgtttgaacctgacgcccctgacgccccatcctcacgcatcacctaccgtgaactgtacgaacgtgtctgccaactcggtaacgcactgcgccacctcaacatcgaaaagggcgaccgcgtcaccatctatttaccaatgattccagatgcagtcgtcgccatcctcgcttgcgcacgcattggagcaatccactccgtcgtcttcggcggctttgcaccgaactccattgccgatcgaataaacgactgcggtagcaaactcatcatcaccgcagacgaaggcctgcgcggcggcagaaaaattccattgaaagccaatgttgatgccgcattaaagatccacggaacccaatccgtcgaaaccgtactcgtcgtgcgtcacaccggcggtacgatcaacatgcataccccgcgcgaccgctggttccatcacgtcgtcgacatccaagcgaccgaatgcgccccagaacgcatgaacgctgaagacccacttttcatcctctatacctccggctccacaggcaaacccaaaggagtgctgcacaccaccggcggctacctggtgtacaccagctacactcatgaaaccgtgtttgacctgcgcgaaaacgacatctactggtgcactgccgacatcggctggattactggtcacagctacatcgtttacggccccctggccaatggcgccaccgtgttgctgttcgaaggcgtcccccactacccaaccgtgtcgcgcttctgggaagtgatcgacaaacatcacgtcaccctgttctacaccgcgccgaccgcaatccgtgccttgatgcgcgaaggcgacacccctgtaaaaaaaacctcccgcaaaagcttgcggttgcttggcagcgtcggcgaacccatcaaccccgaagcctggcactggtactacaccatcgttggcaacggacgctgtcccattgtcgacacctggtggcaaaccgagacaggaggaatcctcatcaccccactgatcggtgcaaccgaccttaaaccaggctcagtcaccctccccttcttcggcatacgccccgccctagtcgataccaacggacaaatactggatggccccgcagcaggcaacctagtcctcctcgattcctggccgggtcaaatgcgtaccgtctacggtgaccaccaacgttttatagacacttactttcgcacctaccccaatacttacttcaccggcgacggctgccgccgcgatgccgacggctactactggatcactggacgtgtggatgacgtcatcaacatctccggccaccgcatcggcaccgccgaaatcgaaagcacactcgtcgctcaccccaaagtggctgaagccgcggtcgtcggcttccctcacccgatcaaaggccagggcatctacgcatacgtgacattaattaccggcgagacacccagcgaagcactgcaccaagaactgctcacctgggtacgtaaagaaatcggagcaatcgccacacccgatcacgtgcaatgggcacccaacctccccaaaacccgctccggaaagatcatgcgccgcatcctacgcaaaattgcagaaaacgcaccagaccaactcggtgacacctccacactggctgatccgtctatcgtcgacttattgctcaacgaacgactgacacactga

SEQ ID NO: 41333 - DNA, 1002 bp, Bacillus subtilis
atgaaattgttaaaacgagaaggcttgtcattaactgaggaaaaagcgctgtggatgtaccaaaagatgctggagatcaggggctttgaagacaaagtgcatgaactgttcgcccagggagtgcttcccggattcgttcatttatatgccggtgaggaagccgtggctgtaggggtgtgcgctcatttacatgatggcgacagcattacaagcacccacaggggacatggacattgtatcgccaaaggctgtgacctggacggcatgatggcggaaattttcgggaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggtaccttccacgaagggctgaatttagcggctgtatggaaccttcctgtcgtatttgttgctgaaaacaacggctatggcgaagctaccccatttgagtacgcatcagcctgtgattcaatcgccgatcgggcggctgcttataacatgccgggggttacagttgacggcaaagatattttagcagtttaccaggcagccgaggaagcgatagaaagagcaagaaacggcggcggcccgtctttgattgaatgtatgacctacagaaactacggccatttcgaaggagatgcccaaacctataaaacgaaggatgaaagagttgagcaccttgaagaaaaagatgccattcaaggttttaaaaactaccttttaaaagaaacagatgctaataagctgtcagacattgaacagcgtgtcagcgaatcgattgaaaaagccgtctcgttcagcgaagacagcccatatccaaaagattcggagctgctgacagatgtgtatgtgtcatatgaaaaaggaggaatgtaa

SEQ ID NO: 41334 - DNA, 1029 bp, Bacillus subtilis
atggcgagagtcataagcatgtcagacgcgatcaatgaagcaatgaagcttgcgatgagaaaagacgaaaatgtgcttttgatcggtgaggatgtcgccgggggagcggcggtcgatcatttgcaggatgatgaagcatggggcggtgtattaggggtcacaaagggactcgtacaggaattcgggcgtacaagagtgctggacactccgatttctgaggcaggctatatgggagcggctatggctgcggcatcaaccggtttgagaccgattgccgagctgatgtttaacgattttatcggcacgtgctttgatcaggtgatcaaccaaggggcgaaattccgttatatgttcggcggaaaagcgcaagtgccgattaccgtccgcaccacatacggagcagggttccgggccgctgcccagcattcacaatcgctgtatggccttttcacgagcatccctggactgaagacagttgttccatccaatccgtatgatgccaaaggtcttttgcttgcagcaatagaagataatgatccggtgtttttctttgaagacaaaacgtcctacaacatgaagggcgaggtgccggaagattattatacaattcccctcggaaaagcggatatcaaacgcgaaggcaatgatgttacgctctttgcagtcggcaagcaggtcaatactgcgcttgaagcggctgcacagctttcagagaggggcatcgaagccgaggtccttgatccccgcagtctgtctcctctggatgaggatgcgattttcacatcgttagaaaaaacaaaccggctgatcatcattgatgaagccaatccgcgatgcagcattgccacggatattgctgcgcttgtcgctgacaagggctttgatttgcttgatgcgccgattaaacggattacagcgccgcatacaccggttccgttttcaccagtgcttgaagatcaatatttgccgacaccagataaaattgtcagcgtcacgcttgaattgcttggcgagccggcattgaattaa

SEQ ID NO: 41335 - DNA, 1197 bp, Bacillus subtilis
atggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatcgaagcgcctgaaaaaggaacgctgatcgatatcaaagtgaaagagggagaagaggttccgcccggcacagctatctgctatatcggggacgccaatgagtcggtgcaggaagaggcgggggcgcctgttgctgaagacaatatgccgcaagccgtccagcccgtcaaacaagaaaacaaacccgcagcctccaaaaaagatcgaatgaaaatatctccagtcgccaggaaaatagcagaaaaagcaggattagacctaaaacaactgaaaggaactggaccaggcggacgaatcgtgaaggatgacgtaacaaaggctcttgctgaacagaaaaaagatcaagcaaagcctgtttcggagcagaaagcgcaggaaatcccggtgacaggcatgagaaaggtcatcgctgcccgaatgcaggaaagcctggcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcatcatcacacatccccatgtgcaccttggtatggctgtagccttggaaaatggcttagtggtgcctgtcatccgccatgctgaaaagctatcgctgattgaactggctcaatccatctcagaaaatgccaaaaaagcacgcgagggacgtgcgggaagcgaagaactgcaaggatctactttctccattacaaaccttggcgcgtttggagttgagcatttcacaccgatactaaatccgccggaaacaggcattctcggcatcggagcaagctatgacacaccggtgtatcaaggggaggagatcgtcagaagcacgatcctgccactcagcctgacatttgatcacagagcgtgtgacggcgcccctgccgctgcattcctgaaggcgatgaaaacatatttggaagaacccgcagcattaattttatag

SEQ ID NO: 41336 - DNA, 1377 bp, Bacillus subtilis
atgacattagccattatcggcggcggacctgcaggctatgcggctgcggtttccgcggcacagcagggcagaaacgtgctgctcattgacaaaggcaagcttggggggacctgcctgaatgaaggctgcatcccgacaaagtctttgttagaaagcgcaaacgttcttgataaaatcaagcatgccgacagctttggaatcgaacttccggcaggtgcgatatcagtcgattggagtaaaatgcaaagccgaaaacaacaggttgtcagtcagcttgtccaaggcgttcagtacctaatgaagaaaaatcaaatacaggttgtaaagggaacagcctcctttctttctgaaagaaagctcttgatcgaaggagaaaacggaaaagaaatcagagaggcggaccaagtattgattgcctccgggtcagagccaatcgagctgccttttgccccatttgacggcgaatggatcctcgacagcaaagacgcgctttctctttccgagattccgtcttcactagtcattgtcggcggcggtgtcatcgggtgtgagtatgcagggctgttcgccagattgggatcgcaggtgaccatcattgaaacagcggaccggctgatcccggctgaagatgaagatattgcccgtctctttcaggagaaacttgaggaagacggtgtcgaagtgcatacttcatccagattagggcgggtggatcaaacggccaaaacggcaatatggaaaagcggtcagcgagagtttaaaacgaaggccgattatgtgctggtggcgatcggcagaaaaccccgtcttgacggattgcagctggaacaggccggagttgatttttctccaaagggcattccggtgaatgggcacatgcagacgaacgtgcctcatatttacgcgtgcggagatgctatagggggcattcagctcgcgcatgccgctttccatgagggcatcatcgctgcttctcatgcttccggaagggatgtcaaaatcaatgagaaacatgtgccgcgctgcatctatacgtccccggaaatcgcgtgtatcggaatgacagaacgacaggcaagaagcatatacggggatgtgaagatcggcgaattttcattttccgcaaacggcaaggcgctcattaaacagcaagcggaaggaaaggtcaaaatcatggctgaaccggaattcggcgaaatcgtgggtgtctcgatgattggcccggatgtaaccgagctcatcggccaagcggcagcgatcatgaatggtgagatgacggcagatatggcggagcattttatcgccgcccatccgactttatcggaaacattgcatgaggcgctgttaagcacgatcggccttgcggtacatgcataa

SEQ ID NO: 41337 - DNA, 1350 bp, Bacillus subtilis
atgaagaaaaaatcattctcaatcgtaatagcgggcggagggagcactttcactccagggatcgtactcatgctcttggaccatttggaggagtttccgatcagaaagctgaagctgtatgataatgataaggagagacaggatcgaattgcaggcgcctgtgacgtttttatcagagaaaaagcgccggatattgaatttgcagcgacgactgacccggaagaagcttttacagatgtcgattttgttatggcgcacatcagagtagggaaatacgcgatgcgcgcgcttgatgagcaaattccgttaaagtacggagttgtcggccaggagacgtgcgggccgggcgggatcgcatacggtatgcgttcgatcggcggtgtgcttgaaatattagattacatggaaaaatactcgcctgatgcgtggatgctcaattattccaatccggcggcaattgtggctgaagctacgagacgccttagaccgaattctaaaattctcaatatctgtgatatgccggttgggatcgaagaccggatggcgcaaattcttggcttatcctcaagaaaagaaatgaaggtccgctattacggattgaatcatttcggctggtggacatcgattcaggatcaagagggcaacgatttaatgccgaagctgaaggaacatgtatcccaatacggttatattccgaaaacagaggctgaagctgtggaggcaagctggaatgacacgttcgccaaagcgcgtgacgtgcaggctgcagatcctgacacactgccgaatacgtatttgcaatattatttgttcccagatgatatggtgaaaaaatcaaatccgaatcatacgcgggcgaatgaagtcatggaagggcgcgaagcttttattttcagccaatgtgacatgatcacacgtgaacagtcctcggaaaacagcgaaattaaaatcgatgaccacgcatcgtatatcgttgatcttgcccgggcgattgcctacaacacaggtgaaagaatgctgttgattgttgaaaataacggtgcaattgcgaactttgacccgactgcgatggttgaggtgccatgcatcgtcggctcaaatggacctgaaccgattaccgttggcaccattccgcaattccagaaagggctcatggagcagcaggtatccgttgagaagctgactgttgaagcgtgggcagagaaatcgttccaaaagctgtggcaggcgctgatcctgtcaaaaacagtgccgaacgcgcgtgtggcaagactcattcttgaggatttagtggaggccaacaaagacttctggcctgagcttgatcaaagcccaacccgcatatcataa

SEQ ID NO: 41338 - DNA, 1815 bp, Bacillus subtilis
atgctaaaagacatccgcaagcctttccaatatcccaaactgccaattgacaaaaaagaaggcgcgaaaaagcgggcgaaagcaaaggatacaaagggcacactgagacgaatctggtcttacttggctgaaagaaaaggactgctcatacttgtcatgctaatggttgtcatcagcgccatattcggactccttggtccctttgtgatcggaaaggccatcgaccattttatcgtcgggaaaacggtcagcggcttgattcctgttttgcttcttctgctcgctatctatatcattcagtccctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacatcgaaaatgtcagttctaccttaaacacgtcagtcattcaaattttgtcaagtgtgatcacctttgtcgggacgattgcggtgatgctgtacatgagcccgctccttactttgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaattcctcgaaaaaaacgctgcactcaagacgtcgggcttttgggcgcagacgatttccgggtttattccgaaggtcatgaactctttgaataacttaagctttacaatgattgcggcaatcggcggtttgtttgcgctgaaaggctggatctcgatcggctccatcgttgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacactgaagcatttacagtttaccgtgcctgcggggcagtccatcgcgtttgtaggaccgacgggggcggggaagacaaccgtcactaaccttctcgcccgtttttacgagcctaacgatggaaaaattttaatcgatggtacagatattaaaacccttactagagcaagcctaagaaaaaacatggggtttgttcttcaggattctttcttatttcagggaacgatcagagaaaacattcgctacggcaggcttgatgcttctgatcaggaagtcgaagccgctgcaaaaacagcgaatgcccatagttttattgaaaggctgccaaaagggtatgacaccgtactgacgcaaaacggttcgggcatcagtcaagggcagaagcagttgatttctatagcgagggcggtgcttgccgatccggttcttctcattttggatgaagcgacaagcaacattgataccgttacagaagtcaacattcaagaagcgctcgcccgtttaatggaaggaagaacaagcgtcatcattgcccacaggctgaacaccattcaaagagcggaccagattgtggtgctaaaaaacggtgaaatgattgaaaaaggcagccatgacgagctgattcggcaaaaaggattttacagtgacttatatgaaagccaatttgagaaatag

SEQ ID NO: 41339 - DNA, 1449 bp, Bacillus subtilis
gtgagtacaaaaaagaaagaggctgtaataggaaaagaaagcttagctcataaagggcttttacgaacgattacattggtatctacattcggcggcctgttgttcggttatgatacgggtgtcattaatggggcacttccttttatggcaactgcaggtcagctgaatcttacacctgttacagaaggactggttgcgagttccctgcttctcggggcagccttcggggcgatgtttggaggacgtctgtccgatcggcacggccgccgaaaaacgatcctttatttagccttactcttcatcgcagccacacttggctgtaccttttcaccaaacgcgtccgtgatgattgcctttcgttttctgcttggactggcggttggctgcgcttctgtaacggttccaacctttttagcggaaatttcgccggcagaacgcaggggacgaatcgtgacacaaaatgaactgatgatcgtaattggccagcttctggcatacacctttaacgccattattggcagcacaatgggggagagcgcaaatgtatggcggtatatgctggtcatcgcgacacttccggctgttgtgttatggttcggaatgctcatcgtgcctgaaagcccgcgctggctggcagctaaaggcagaatgggtgacgccctgcgggtgcttcggcaaatccgtgaagacagtcaggcacagcaggaaataaaagaaatcaaacatgcgattgagggcacagcaaaaaaggccggctttcatgattttcaagagccgtggataaggcgcattctattcattgggattggaatcgccatcgtacagcaaattaccggtgtcaattcgattatgtactatgggacagaaattctgagagaagccggttttcaaacagaagctgcattaatcggcaatattgcaaacggtgttatttcagttattgcggtcatttttgggatatggcttctcggcaaagtccgtcgccggcccatgctgatcatcggacagattggcacgatgacagcccttctgctgatcgggattttatccattgtccttgaaggaacacccgccctgccgtatgttgtgctgagtttgaccattttgtttcttgcgtttcagcagactgccatttctacggtgacgtggctgatgctctcggaaatctttcctatgcatgtgcgggggcttggcatggggatcagcaccttctgcttgtggacagctaactttctcattggattcacctttcccattttgctcaatcatattgggatgtcggcgacattttttatctttgtcgctatgaatatcctagcgattctatttgtgaaaaaatatgtgcctgagacaaaagggcggtcacttgaacagcttgagcattcctttcgccagtatggccgccgcgctgatcaggaaatccaaaatcaaacaactcacttatcgtaa

SEQ ID NO: 41340 - DNA, 753 bp, Bacillus subtilis
atggaacaaaataaatgtgcactcgtaacaggaagcagccgcggtgtcggaaaagcggccgcgatcagacttgctgagaacggctataacatcgtcattaactatgcacgcagcaaaaaagcagcattagaaacagcggaagaaatcgaaaagcttggcgttaaagtgcttgtcgtaaaagcaaacgtaggacagcctgcaaaaatcaaagaaatgtttcagcaaattgatgaaacgttcggcagacttgatgtttttgtcaataatgccgcttcaggagtactaagacctgtcatggaattagaagaaacacactgggactggacgatgaacattaatgcgaaagcattgcttttctgcgctcaggaagctgccaagctaatggagaagaacggtggcgggcatattgtcagcattagttcattaggctctatccgctatcttgaaaactacaccacggtcggtgtatcaaaagcagcgttagaggctttaacccgttatcttgccgttgagctttcaccaaaacaaattatcgtcaatgctgtttcaggcggagcgatcgacacagatgcgctgaagcacttcccgaatagagaagatctgcttgaggatgcgcgccaaaatacgccggcgggacgcatggtcgaaattaaagacatggttgatactgtggagtttctagtgtcttccaaggctgacatgatccgcggacagacaattatcgttgacggcggacgctcactgctcgtttaa

SEQ ID NO: 41341 - DNA, 1770 bp, Bacillus subtilis
atgataaagagagagggggaatcaaccgtgggggttatgaaacgctacatgcaattcgtcaaaccttataagaagcaaattttcgttacagtgttaatcgggatcgtaaaattctccattccgcttgctctcccattgcttctgaagtacgtagttgacgacattattcaaggaggcggcacggccagtgacaaaaccacgtcattgttcacgattatggcgatcatgttcgccttatttttaattttgcgcccgcctgttgaatattaccggcaatattttgcccagtggactgccagcaaggtgctttatgatataagagctaagctgtttgaccatatacaaaaactgagccttcgtttttacgcgaatacaagaacaggggaagtcatttcccgagtgattaatgatgtagaacaaacaaaggatttcgtcatcacagggctgatgaatatatggctcgatatgctgacgattttgattgtaatctctatcatgctcacactggacgttaaattaacgctgatctctatcgttttattcccattatacggaatatcagtgaagtatttttacggccgtttacgaaagctgacaagggagcgctcacaggctcttgctcaagtgcaggggcatttgcatgaacgcattcaaggcatgcctgtcatcagaagctttgcgatagaagatcatgaacaggctcaatttaatgagaaaaacggtcatttcttagataaagccatccgccacacgaattggaacgcgaaaacctttgcggtcgttaataccattacagatttggcgccgctcatcgtcatagcgtgcgccgggtattttgtcattaatggaccgctgacagtcggaacaatggtcgcgtttgtcggatatattgacagaatgtacaaccctgttagaaggctgatcaattcctctacaactttgacacagtcaatcgcatcaatggacagggtgtttgaatttattgacgagccctatgaactcactgacaaaccaaatgcgataaaggccgatcagattcgcggaggagtggagtttcaaaacgtttcgtttcaatatgagaaggacaaagaaaatattcttcatgatgtatccttaaaagtaaatagaggagaaactgtagctctcgtcggcatgagcggaggaggaaaatcaacgctcgtcagcctgatcccaagattttatgatgtaacaagcggcagactgctgattgatgggacggatattcgcgattatgaagcaagaagccttcgcaaccaggttggtatggtgcttcaagatacctttttatttagtgaaacgattcgggaaaatatcgcgatcggcaagcctgatgccacacttgaagagataatcgaagccgccaaagctgcaaatgcccatgaatttatcatgagttttccagaaggatatgagacccgggtgggggaacgaggcgttaagctttcaggcggacaaaagcagcggatctcaattgcgcgggtattcctgaaaaatccgccgctcctcattttagatgaagctacatcagctctggatttggaaagtgagcattacattcaagaagcgatggacaaactggcgaaggatagaacaacttttgttgtcgcccaccgtttatcgacaatcacccatgcggataagattgttgtcatggaaaacgggacaatcattgaaatcggaacccatgatgaactcatggactatgagagccaatacaagcacttatttaccattcaaaatttgaactaa

SEQ ID NO: 41342 - DNA, 1179 bp, Bacillus subtilis
atggagaaagcaagcggcgcttatttttgggatgtggacggcaacaaatacatcgattatttagcggcgtacggtccgattattacaggacatgcccatccgcatattacagaagcgattaaaaaagcagcagagaacggtgtattgtatggaacaccaacgaaacacgaggttacatttgcaaaaatgctcaaagaagccattcccgctatggacaaagtaagattcgtcaattcgggtacagaagccgttatgacgaccatccgcgtggctcgcgcatatacaggccggacaaaaatcattaaatttgcgggctgctatcacgggcattcggaccttgtgcttgtcgccgcaggctccggcccgtctactctcggcacaccagactcagccggtgtaccgaaaagcattgcaaacgaagtgatcacagtaccatttaatgatatcgatagctataaagcagctcttgaaaaatggggcagtgaaatcgcggcggttctcgttgaaccgattgtcggcaacttcggtatcgtggagccgaaagagggcttcttagaacaagtaaatgaattaacacataatgcaggggctctcgttatttacgatgaagtcattacggctttccgctttatgtatggcggcgcgcaggatctcttacaggtgaaaccagatttaacagcactcgggaaaattatcggcggcggacttccgattggggcctatggcggcaaacaagaaatcatggagcaggtagctccgctagggcctgcttatcaggcaggaacaatggcagggaaccccgcttccatcctatcaggcatcgcttgtctggaagtgctcaaagaaaaaggcgtgtatgaaaagcttgatcaccttggcgctatgcttgaggaaggcattatgaagcacgcagaaacacacggcatcaccattacggtcaaccggttaaaaggtgcgctcacggtatacttctctgatgagaaagtggaaaattacgagcaggctgagcggagtgacggagaaacattctctacgtttttcaagctgatgctggaacgcggaattaatttagcaccttctaagtatgaagcttggtttattaccacagcacatacagagcaggatattaaagacacgcttacagcggtcgaggatgcatttaaacatctaaaaaactag

SEQ ID NO: 41343 - DNA, 1452 bp, Bacillus subtilis
atgagttcaaataaactgacaactagctggggcgctccggttggagataatcaaaactcaatgactgccggttctcgcggaccaactttaattcaagatgtacatttactcgaaaaattggcccatttcaaccgagaacgtgttcctgaacgtgttgttcacgccaaaggagcaggcgcacacggatattttgaagtgacaaacgacgtaacaaaatacacgaaagccgctttcctttctgaagtcggcaaacgcacaccgttgttcatccgtttctcaacagttgccggtgaacttggctctgctgacacagttcgcgacccgcgcggatttgctgttaaattttatactgaagaaggaaactacgacatcgtcggcaacaatacgcctgtattctttatccgcgatgcgattaagttccctgatttcatccatacacaaaaaagagatccaaaaacacacctgaaaaaccctacggctgtatgggatttctggtcactttcaccagagtcactgcaccaagtgacaatcctgatgtctgaccgcggaattcctgcgacacttcgccacatgcacggcttcggaagccatacattcaaatggacaaatgccgaaggcgaaggcgtatggattaaatatcactttaaaacagaacaaggcgtgaaaaaccttgatgtcaatacggcagcaaaaattgccggtgaaaaccctgattaccatacagaagaccttttcaacgcaatcgaaaacggtgattatcctgcatggaaactatatgtgcaaatcatgcctttagaagatgcaaatacgtaccgtttcgatccgtttgatgtcacaaaagtttggtctcaaaaagactacccgttaatcgaggtcggacgcatggttctagacagaaatccggaaaactactttgcagaggtagaacaagcgacattttcacctggaaccctcgtgcctggtattgatgtttcaccggataaaatgcttcaaggtcgactttttgcttatcatgatgcacaccgctaccgtgtcggtgcaaaccatcaagcgctgccaatcaaccgcgcacgcaacaaagtaaacaattatcagcgtgatgggcaaatgcgttttggtgataacggcggcggatctgtgtattacgagcctaacagcttcggcggtccaaaagagtcacctgaggataagcaagcagcatatccggtacaaggtatcgctgacagcgtaagctacgatcactacgatcactacactcaagccggcgatctgtatcgtttaatgagtgaagatgaacgtacccgccttgttgaaaatatcgttaatgccatgaagccggtagaaaaagaagaaatcaagctgcgccaaatcgagcacttctacaaagcggatcctgaatacggaaaacgcgtggcagaaggccttggattgccgattaaaaaagattcttaa

SEQ ID NO: 41344 - DNA, 825 bp, Bacillus subtilis
atgggggcctttttgttttttttgaaggcggggttggcaataaagagagggataaaattggctgtgaccatcagcatcaaagaaaaggcatttgttcaagaaggccgcaaaaacacggtcttagaaaacatagaattatcaatcgcaccaggcgaatttctaacgcttatcggaccgagcgggtgcggaaaaagcaccctgttaaagattattgcagggcttgattctgaatatgacgggagtgtggaaattaacggccgcagcgtaacagctccgggtattcagcaaggatttatttttcaggaacaccgcctctttccttggctgactgttgagcagaatattgcagccgacttgaatttgaaggacccaaaagtcaaacaaaaggtggatgaactgatcgagattgtcagattgaaaggatcggaaaaagcatatccgcgcgagctgtcaggcggcatgtcacaaagagtagccatcacccgggccctgctgcgggagcctgaggtgctgcttttagatgaaccgtttggtgcactcgacgcttttacaagaaaacacctgcaggacgtgctgctggatatatggaggaagaaaaaaacaacgatgattctcgtgactcatgatatagatgaatctgtttatttaggaaatgagcttgcgatccttaaggccaaaccggggaaaatccataagctgatgcccattcacctggcgtatccgcgaaaccggacgactccggatttccaagcgatcagacagagagtgctgtcggaattcgagaaaacagaagatttggagtacgcagaaggatcagggatatag

SEQ ID NO: 41345 - DNA, 663 bp, Bacillus subtilis
gtgattaaagcgttaatttttgattttgacgggcttattctagatacagaaacacacgaatatgaggttcttcaggaaatatttgaagagcacggctcagtgctgccgctatctgtctggggaaaggtcatcggaactgctgcgggtttccggccttttgaatatttagaagagcagatcgggaaaaagctgaaccatgaagagctcacacaattgagaagagagcggtttgccaaacgcatggaatcagaaaaagcgagacctggtgtcgaagcgtatttgaatgcggcaaaggatttaggcttaaaaataggccttgcctccagctctgattataaatgggtgtccggccatttgaagcaaatcggcctgtttgatgattttgaagttattcaaacggcggatgatgtggaagaggtgaagccgaatcctgaactctatttattggcggcaaagaacctgggggtatcgccagcggaatgtctcgcgtttgaggattctgtcaatggttcgattgctgcgaaacgtgcaggcatgaagtgtgtcattgtcccgaataaagtaacgggtaccttgatgtttgaagactatgatcacaggcttgaatcaatggcggagatggagctcgccctattgcttgatcatctgaactcacaaaactag

SEQ ID NO: 41346 - DNA, 1353 bp, Bacillus subtilis
atggagatgatggggatggaaaacattcagcaaaatcagggattaaagcaaaaagatgagcaatttgtgtggcatgccatgaagggagcgcatcaagcggacagcctgatagcccagaaggccgaaggggcctgggtaaccgacacagacggacgccgctatttggatgcgatgtccggtttgtggtgcgtcaacattggttacggcagaaaggagcttgcggaggctgcctatgagcaactaaaggagctgccttactacccgttaacgcaaagtcacgcacccgcaattcaactggcggaaaagctgaatgaatggcttggcggcgattatgttatttttttttccaacagcggatcggaagcaaacgaaactgcttttaaaattgcccgccagtaccatctgcaaaacggcgaccacagccgttataaattcatctcaagatatcgggcataccacggcaatacattgggagcgctctcagctaccggacaggcgcagcggaaatataaatacgagcctttgagccaagggttcctgcatgcagctccgccagatatataccggaatcctgatgatgcagacacgcttgaaagcgcaaatgaaatcgaccgcatcatgacatgggaattaagcgaaacgattgccggggtcattatggagcccatcattacaggcggaggcatcctaatgccgccggacggatatatgaagaaggtggaggacatttgccggcgccacggagcccttttgatttgcgatgaagtgatctgcgggtttggacggacaggtgagccgttcgggtttatgcactacggtgtgaagcctgatatcattacgatggcaaagggaatcacaagcgcgtatctgccattgtcagcgactgctgtgaaacgggacattttcgaagcgtatcagggggaagctccttatgaccgtttccgccacgtgaacacgttcggcggaagcccggctgcctgtgctttggcgttgaaaaacctgcaaattatggaggacgaacagctgattcagcgatcccgtgatcttggagcaaagcttttaggtgagcttcaagctctgagagaacacccggcagtcggggatgttagaggaaaagggctgctgatcggaatcgaactcgtcaaagacaaattgactaaagagccggctgatgccgccaaagtaaaccaagtggttgcggcgtgcaaagaaaaagggctgatcatcggcaaaaacggcgatacagtcgccggctacaacaatgtcatccacgttgcgccgccattttgcctgacagaagaggacctttcctttatcgtgaaaacggtgaaagaaagctttcaaacgatataa

SEQ ID NO: 41347 - DNA, 1491 bp, Bacillus subtilis
atggaaacgtacattttatccttagatcaggggacgacaagttcaagagcgattctgtttaataaagaaggcaaaattgtccactctgctcaaaaggaatttacacaatacttcccgcatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaaggatataatgataaattcagagaaaaaacagggcttttaatcgatccttacttctccggcacgaaggtgaagtggattttagacaatgtggaaggcgcaagagaaaaagcggaaaaaggcgagctgctgtttggaacgattgatacgtggctcatttggaaaatgtcaggcggaaaagcgcatgtgaccgattactccaatgcctcaagaacactgatgtttaatatttacgatttaaaatgggacgatcaactgctcgacattctaggcgtaccgaaatccatgctccctgaagtgaagccgtcctctcatgtgtatgcggagactgttgattatcacttcttcggaaaaaatatcccgattgctggagcggcaggcgaccagcagtccgcattgttcggccaggcatgctttgaagaaggcatggggaaaaacacttacggcacaggatgtttcatgctgatgaataccggggaaaaagcaattaagtccgaacatgggcttttgacaacaatcgcttggggcattgacggaaaagtgaactatgcgttagaagggagcatttttgtcgcaggctctgccatccagtggcttagagacggtttgagaatgttccaggattcatcgctaagcgaatcttatgcagaaaaagtggattcaactgacggcgtgtatgttgttccagcatttgtcggactgggaacgccttactgggacagcgatgtgcgcggttcggttttcggcctgacaagagggacaacaaaagagcactttatccgtgcgacactggagtcattggcttatcagaccaaagatgtgcttgacgcaatggaagcagattcaaacatttcattaaagacgctccgtgtagacggaggagctgtaaaaaacaatttcctaatgcagttccaaggagacctgttgaatgttcctgtggagcgcccggaaattaatgaaacgactgcacttggcgcggcttatttggcgggtatcgctgtgggattctggaaggaccgttctgaaatcgcgaaccagtggaatctggataaacggtttgagcctgaattggaagaagaaaaacgaaatgagctgtataaaggctggcaaaaagccgtgaaagcagctatggcttttaaataa

SEQ ID NO: 41348 - DNA, 1668 bp, Bacillus subtilis
atgatgaatcatcaattttcaagtcttgaaagagatcgcatgctgacagacatgacgaaaaaaacatatgacctatttattatcggaggaggaattacaggagccggaacagctcttgacgcggcatcaaggggaatgaaggtcgcactaagcgaaatgcaggactttgcggcgggaacatcaagccgatcaacgaagctggtacatggcggcttgcgctatttaaaacaatttgaagtgaaaatggtcgctgaggtaggaaaagagcgggcgattgtgtatgaaaacggcccgcatgtcactacaccggaatggatgctgcttccgtttcataaaggcggcacattcggttcatttacaacatctattgggttaagggtttatgacttccttgcaggtgtgaaaaagtcagaacgaagaagcatgctttcagcaaaagaaacgctgcaaaaagagcctttggtgaaaaaagacggcttaaaaggcggcgggtactatgtggaataccgcactgacgatgcgagactgaccatcgaagtcatgaaggaagcggttaaattcggggcagagcctgtgaattactccaaagtgaaggagcttctttacgaaaaaggcaaagccgtcggcgtattaattgaagatgtgctgacaaagaaagaatataaagtgtatgcgaaaaaaattgtcaatgctacaggcccttgggtcgatcagctcagagaaaaagaccattcgaaaaacggaaagcatttgcagcatacaaaaggcattcaccttgtatttgaccagtctgtctttccgctgaaacaggctgtatatttcgatacacctgatggccggatggtatttgcgattcctcgtgaaggcaaaacatacgtgggaacaacagacactgtttacaaagaggcgctggagcatccgcggatgacaacggaggatcgtgattatgtcatcaaatcaatcaattacatgttcccggaactgaatatcactgcgaatgacatcgaatccagctgggcggggctgcgtccgctgattcatgaagaaggcaaagatccttctgaaatttcacggaaagacgagatttggacatctgactcaggcctgatcaccattgccggcggaaaactgactggatacagaaaaatggcggacgacatcgttgatcttgtccgtgatcgcttaaaagaagagggcgaaaaggattttggaccatgtaaaacgaaaaacatgccaatctctggcgggcacgtcggcggttcgaaaaatcttatgtccttcgttaccgcgaaaacaaaagaaggaattgcagccggtttatcagaaaaagacgcaaaacagcttgcgatcagatacggctctaacgtagatcgcgtctttgaccgggtagaagcgctgaaagatgaggccgcgaaacgcaacattccggttcatattcttgctgaggcagaatacagtatagaagaagagatgactgcaacccctgctgacttctttgtccgcagaacgggacgtttattttttgatatcaattgggtaagaacatataaagatgccgttattgattttatgagcgagcgattccaatgggatgagcaggcgaaaaacaaacatacagaaaacctcaacaagcttttacacgatgcggtcgtaccgcttgagcaataa

SEQ ID NO: 41349 - DNA, 1698 bp, Bacillus subtilis
atgacttggagaaagagctatgaacgctggaaacagacagaacatttagatctggaattaaaagagcgccttattgaattagagggagatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgccataagtctccggagttcgcgatggaagcggcaaaaacacttgcgacacaaggcatccaaacatacgtgtttgatgagcttcgcccgacgccagagctgtcattcgctgttagacagctgaacgcttatggtggagttgtggtaacggcaagccataacccgcctgaatataacggctacaaagtatacggggatgatggcggccagctgcctccaaaggaagcggacatcgtcattgagcaggtaaacgcgattgaaaatgagctgacgatcacagttgtaagatatgataaagtttatacagaaaaactgacgtccatttctgtacatcctgaattatcggaagaagtagatgtaaaggttgttttcacaccgctgcatggaactgcaaataaaccggtcagacgcggtcttgaagcactcggctacaaaaatgtaacggttgtcaaagaacaggaactgccggattcaaacttctccactgttacatcgccgaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgttgctgcttcattacctgctttctgaaaagaaaaaacaaggcatcctgcctgataacggtgttgttctcaaaacgatcgtcacaagcgaaatcggccgtgctgtagcttcttcattcggccttgatacgattgatacgctgacaggctttaagtttatcggtgaaaagattaaggaatacgaagcatcaggccagtataccttccaattcggttatgaagagagctacggttatttaatcggggattttgcccgcgataaggacgccattcaggctgcgcttttggcagttgaagtttgcgcgttctataaaaaacagggaatgtcattgtatgaggcgctcatcaatctctttaacgaatatggtttttatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaagcaaagaagaagccatcgacttgccaaaatcaaatgtattgaaatacttcctggaagacgggtcttggttctgtctccgtccttctggaactgagccgaaggttaaattttatttcgccgtaaaagggtcatctttggaagacagtgaaaagcgacttgccgtcctttctgaagatgtaatgaagacggtggatgaaattgttgagtcaacagcaaaataa

SEQ ID NO: 41350 - DNA, 1101 bp, Bacillus subtilis
atggtacattacggattaaagggaattacatgtgtagaaacatccatcagccatattgatggtgaaaaagggcgtctgatttacagaggacatcatgcaaaagacatcgcactgaatcacagctttgaagaagcggcttatttgattttatttggaaaactgccttcaactgaagaattgcaggtatttaaagataagctggctgcggaacggaatcttccggaacatattgagcgcttgattcaatcactgccaaacaacatggacgatatgtcggtcgtgagaacggttgtttcagcattgggggaaaatacgtacacattccatccgaaaacagaggaagcaatccggctgattgcaatcacgccttctatcattgcatacagaaaaagatggacgcgcggtgaacaagcaattgcaccttcttcccagtacggacatgtcgaaaactactattatatgctcacaggtgaacagccttcagaggcaaaaaagaaagcgcttgaaacctatatgattctggccacggagcacggcatgaacgcatcgactttttcggcacgagtcacgttatctacagagagtgatttagtgtcagccgtcacggctgctctcggtacgatgaaaggtccgctgcacggaggtgctccttctgcggtgacaaaaatgcttgaagacattggagaaaaggaacatgctgaagcatatctgaaagaaaaactcgaaaaaggagagcgcttgatgggattcggccacagggtgtacaaaacaaaagacccgcgggcagaagctttgagacagaaagcagaagaggtggccggcaatgaccgtgatcttgatcttgcgctgcatgtagaagcagaagcgattcgtttgctagaaatctacaaaccgggacgaaagctgtacacaaatgttgaattttacgcagctgcagtgatgagggccatcgattttgacgatgaattgtttactccgaccttttcagcaagccgaatggtagggtggtgcgcccatgtactggaacaggcagaaaacaacatgattttccggccgtcagcgcaatataccggtgccattcccgaggaagttctttcataa

SEQ ID NO: 41351 - DNA, 870 bp, Bacillus subtilis
gtgaacccaatggacagacaaacagaaggacaagaaccgcagcatcaggacagacagccgggcattgagtcaaaaatgaatccgctgccgctgtcagaggacgaggattatcgaggaagcggaaaactgaaaggaaaagttgcgatcattactggaggcgacagcggaatagggagagcagcagctattgcctttgctaaagagggggctgatatctccattctatacttagacgagcattcggacgcagaggaaacacgcaaacggatcgaaaaggagaatgtccgctgcctgcttatcccgggagatgttggggacgagaaccattgtgaacaagctgtgcagcaaacagtggaccattttggtaaactcgatatcttagtgaacaacgccgctgaacagcatccccaggacagcattctcaatatttcaacagaacagctggaaaaaacctttcgcacaaatattttttccatgtttcatatgacgaagaaagctttgcctcacctgcaagaggggtgtgccattattaatacgacatcgattaccgcttatgaaggggatacggcgttaattgattattccagcacaaagggtgcgattgtttcctttacgcgttccatggcgaagtcgcttgcagataaaggcatcagagtgaatgcggtggcgcccggtccgatttggacaccgcttattccggcgacattccctgaggaaaaagtgaaacagcacggcttggataccccaatgggaagaccgggacagccggttgagcatgcaggcgcctatgttctgctggcgtctgacgaatcttcctatatgacagggcagaccattcatgtgaatggcggccgttttatttcaacgtaa

SEQ ID NO: 41352 - DNA, 1398 bp, Bacillus subtilis
atgaaagggagcgtttttaggaagaaaagcattcaggatttaatcgctgcgacgagcggggaaaagtctttaaaaagagaattaggggcatttgatttaacgttgcttggaatcggcgccattattggcacagggatttttgttctgacgggaacaggcgcagtcacggccggtcccgggctgacgatttcatttgttgtggcggcgttggcttgtttattcgccgccctgtcttacgcggaatttgcgtcaagtgtgcctgtttcaggttcggtgtatacattcacttatgcgacattgggagagcttatggcctttattatcgggtgggatttaattttagaatacatgctggcggtaagtgcagtgtcggtcggctggtctggttatttccaatcgtttttatcagggcttggcattcatcttccggttgctttaacagcggcaccgggcgcagtgaaaggcacctttaccctgtttaatcttcctgcattcgtcattgtaatggcgatcacatatttgctttatttaggcatcaaagaatcaaaaagagtcaacaatatcatggttatcttgaagatactggttgttctgctgtttatcgcggtggcagccgtttacgtgaagccgcacaactggcagccgtttatgccaatgggctttggcggcgtgttcagtgcagcggcgctcgtattctttgcttttatcggatttgacgctgtatcctctgctgcggaagaaacgaaaaatcccgcgaaggatctgcctaaaggcattattttctctttactggtctgcacgattttatatgtcaccgtatcagccatcatgactggggttatcccgtttgctcaatttgcgggtgtggatcatccggtttctcttgttcttcaaagcgcagggcaaaattgggtggcaggcatcattgatattggcgccgtgttgggaatgacaacagttatgctcgtgatgctttacgggcagacccgcgtcatgtttgccatgtcgcgtgacggacttgtgccgggttcactttctaaagtgcatccaaagcacaaaacaccttatgtagccacttggtttttcggaacgatgtcggcgcttctcggctcacttgttccgctggatgaacttgcaaagctggtgaacatcgggacgttgtcggcatttgtcctgatttctgtggcagttatcgttttgagaaagaaacagcctgatcttccgagagcttttaaatgcccgggagttcccgtgatcccaggcctggcgattctgttctgcctgttcttgattttaaatctgggatgggtgacgattgtccgcttcctagtgtggctgttaatcggcttggtaatctatttcctgtattcaagaaagcattcaaaattaaatcaataa

SEQ ID NO: 41353 - DNA, 996 bp, Bacillus subtilis
atggaatataccagtatagcagatacaggaatagaagcctccagaatcggcctcggcacatgggccattggcggaacgatgtggggaggcactgacgaaaaaacatcgattgaaacaatccgcgccgctcttgatcaggggattacactgattgacaccgcaccggcttacggcttcgggcagtccgaggaaattgtcggaaaggcaatcaaagagtacggcaaaagagaccaggtgattctcgcaacgaaaacggctctggactggaagaacaaccagctgttccgccatgcgaacagagcgagaattgtagaggaagttgagaattctttgaagcggcttcaaacagactatattgatctttatcaggtgcattggcccgatccgcttgtgccaattgaagaaacggctgaagtcatgaaggaattatatgatgcgggaaaaatccgggcgattggcgtcagcaatttttcaattgagcaaatggatacatttcgcgccgtcgcacctctccatacgattcagcctccatataatctgtttgaaagagagatggaagagagtgtccttccttatgcgaaagataacaagataacaacattattatacggcagtttatgcagagggctgttaacaggcaaaatgactgaagaatatacatttgagggcgatgatctgcgtaatcacgatccaaaattccagaagccccgctttaaagagtatctttctgctgtgaatcaattggataagctggcgaagacacgttatggaaaatcagtgattcacttggctgtcagatggatcttagatcagccgggagcggatatcgctctttggggagcaagaaagcctgggcagcttgaggccctatctgagattacaggctggacgctgaacagtgaagatcagaaagatatcaatactatattggaaaatacgatatcagaccctgtcggaccggagtttatggccccgccgaccagagaggaaatataa

SEQ ID NO: 41354 - DNA, 1758 bp, Bacillus subtilis
atgttttcagttttgaaaaagcttggctggttttttaaggcgtactggctgcgctatacgattgcgattgtccttttattagcagtcaatgtcattgaaatgtttccgcctaagctcttggggaacgccatagatgatatgaaagcaggggcatttactgcggaagggctgctgttttatatcggtatcttttttgtgctgacggcggccgtgtatatcatgtcttatttttggatgcatcagctgtttggcggagcgaatctgatggagaaaattcttcgtacgaagctgatggggcatttgctgactatgtcgccgccgttttatgaaaaaaaccgaacaggcgatttaatggcacgagggacaaatgatcttcaggccgtcagtttaaccacagggtttggcatcttgacgttagttgattctacgatgtttatgatgacgatctttttgacaatggggtttttgatcagctggaagctgacctttgccgccattatcccgcttccagtcatggcgattgcaatcagtctatatggaagtaaaattcatgagcggtttactgaggcccaaaacgcgttcggggcgctgaatgacagagtgctggaatctgtttcaggcgtgcgggtgattcgcgcgtatgttcaggaaacaaacgatgttcgccggtttaatgaaatgaccgctgatgtttatcagaaaaatatgaaagtggcttttattgattcactgtttgagccgacggtaaaactgcttgtcggcgcaagctatctgattgggctcggctacggagcgtttcttgtattccggaacgagctgacgcttggagagttagtgtcctttaacgtttatctcggcatgatgatttggccgatgtttgcaatcggtgaactcattaatgtgatgcagcgcggcaatgcgtcattagatcgggtaaatgaaactctttcttatgaaacggatgtgacagatccaaaacagcccgctgatcttaaagagcctggagatatcgttttcagtcatgtcagctttacatatccaagctcaacaagtgacaatcttcaggatatttcatttacggtgcgaaaagggcagactgtcgggattgcaggtaaaaccgggagcggaaaaacgacaattattaagcagcttttgcgccagtatcctccaggtgaagggagcattacattttcaggtgtaccgattcagcaaatccctcttgaccgtctccgcggatggatcggatatgtgcctcaggatcatttactgttttcacggactgtaaaagaaaatattttatacggaaaacaggatgcaactgataaagaggttcagcaagccattgccgaagcacattttgaaaaagatttgcacatgcttccgtccggtctggagacaatggtcggtgaaaaaggcgtggcactgtcaggcgggcagaaacaaagaatttcgatcgcgagagcactcatggcgaatccggaaatcttgattctggatgattcactttccgctgtagatgccaaaacagaggctgcaattatcaagaacatcagagaaaaccgcaaaggaaaaacgacatttattttgacacaccgattatccgcggtagagcacgctgacctgatccttgtgatggacggcggcgtcattgctgagagaggcacgcatcaagaactgctggccaataatgggtggtaccgggaacaatatgaaagacagcagctgttcactgcggaagaagggggagcaggggcatga

SEQ ID NO: 41355 - DNA, 2022 bp, Bacillus subtilis
atgaaaataggaaaaacgttatggagatacgcacttctttatcgaaaattgctgatcacagccgtccttttgctaactgttgccgtcggtgcagaactgactgggccctttattggcaaaaaaatgatagacgaccatatcctcggcattgagaaaacatggtatgaagctgcggaaaaagataaaaatgccgttcagtttcacggcgtctcatatgtcagagaggaccgattgcaggagcctgtttcaaaagcaaaagaagcgcatatttatcaagtgggaatggcgttctattttgttgatcaggctgtcagcttcgacgggaatagaacggtttctgacgggaagctgacgatcacaaacggagacaagagccgggcatatgctgccgaaaagctgactaagcaggaacttttccagttctatcagccggaaataaagggaatggtgttactgatctgcctgtatgggggcttgcttgtgttttcggtattctttcaatacggacagcattatctgctgcagatgagcgccaatcggattattcaaaagatgaggcaggacgtgttttcgcacatacagaaaatgccgattcgctattttgacaaccttccggccggaaaagtcgttgcgcggattaccaatgatacggaggctattagggatttatatgtcacagtgctttcaacatttgtgacaagcggaatctatatgttcgggatattcacggctttgtttctgcttgatgtgaagcttgcgtttgtatgtctggcaattgtgccgattatctggctgtggtcggtcatataccggagatatgcgtcatattacaaccaaaaaatccgctcgatcaacagtgacattaacgcaaaaatgaatgagtcaattcaaggcatgaccattattcaggctttccgccatcaaaaggaaacaatgagagaatttgaggaattaaatgaatcacatttttatttccaaaacaggatgctgaatttaaactccttaatgtcccataatctggtcaatgtcatccgcaatcttgcgttcgtctgtctgatctggcattttggcggtgcgagcctgaatgcggcggggattgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacggaagaagcgggtgaaccggcgaaggagcgcgcgctggggcgggttgaatttcgtgatgtgtcatttgcgtatcaagaaggtgaagaggtattaaagcatatttcctttactgcgcaaaaaggcgaaaccgtagcgctcgtcggccataccggatcaggaaaaagctcgattttgaatcttctgtttcgtttttatgatgcgcaaaaaggtgatgtcttaattgatggaaaaagcatttacaacatgtcaagacaggaactcagatcccatatgggtattgtgcttcaggacccgtacttattctcgggcacaatcggatctaacgtaagtctggatgacgaaagaatgactgaagaagaaataaaaaatgcactgcggcaagtcggtgctgagcctcttcttaagaagcttccgaagggcattaatgagcccgtgattgaaaaaggcagcacgctatcctctggagagcggcagttaatttctttcgctagagctttggcgtttgatcccgcgatcttgattttagatgaggcaacggcgcatattgatacagagacagaggccgtgatccagaaggcgcttgatgtcgtcaaacaaggacgcaccaccttcgtcatcgctcaccggctttcaacaatcagaaatgctgatcagattttggttcttgataaaggagaaattgttgagagagggaaccacgaggaactgatggcattagaaggccaatattatcaaatgtatgaactgcaaaagggacagaaacattccattgcataa

SEQ ID NO: 41356 - DNA, 897 bp, Bacillus subtilis
gtgcttacaattgatcacgtaacgaagacatttggagattataaagccgttgacggattggacttagatattccggaacagcaaatgttcggtctattaggcgcaaacggagcgggaaaaacaacaacgtttcgcatgatcctaggattattaagcattacggagggctcaatcagctggaagggccgtcctgtgaattatcatatcagcaacaaaatcggttatttgccggaagagcggggcctttatccgaaaatgaaggtaagggatcagctcgtctatcttgccagattaaaagggatggagaagcgagaggctgtaaaagagctcgggacatggcttgaacgcttcaatattacagattacgagaataagaaggtggaagagcttgcgaaggggaatcagcagaaaatccaattcatttcggcagttttgcataagccggagctcctgattcttgatgaaccattcagcggcttggaccctgtcaatgttgagctgctaaaagaggccgtgatctcgctgaaaaacagcggtgtttctattttattttcaagccatcggatggaacatgtggaggagctttgtgagaacctttgcatattgcagaaaggaaaaccggttgtacaaggcaagctgaaggagatcaagcgttctttcggtaaaaagaatgttaccattcactccgatgacgatctgcgctttttgcagtcccatgaaggcattcttcaatggaaggaaacggcagacggcgtcaagctgcagattgccaatgaagacatttctcaagagatttttgcgatgctccaaggaaaagggtttatcagaaagtttgagcttgaagagccgtcactgcatgatatttttatagaaaaggtgggggccgtctatgaataa

SEQ ID NO: 41357 - DNA, 1080 bp, Bacillus subtilis
atggaacgtacaacgaattttaacgcaggtcctgcagcgctgccactggaagttctgcaaaaagcacagaaagaatttattgattttaacgaatccggcatgtctgttatggagctttcccaccgcagcaaagagtatgaagcggtgcaccaaaaagcgaaaagcctcttaatcgaactgatgggcattccggaagattacgatatcttgtttcttcaaggcggggcaagccttcaattctcaatgcttccgatgaactttttaacacctgaaaaaaccgcacattttgtgatgaccggcgcttggtctgaaaaagcactggcagaaacgaaactgttcgggaacacgtctatcaccgctacaagtgaaacagacaattacagttatattccagaggttgaccttacggatgtaaaagacggcgcatatttacatatcacatccaacaatacaattttcggcactcagtggcaggagtttccgaattctccaattccgctcgtagccgacatgtccagcgatattttaagcagaaaaatcgatgtgtccaaatttgatgtgatctacggaggcgcccaaaagaacctcggcccttccggcgtgactgtagtcatcatgaaaaaaagctggctgcaaaatgaaaatgcgaacgtcccaaaaatcttgaaatattccacgcatgtcaaagcggattcactctacaacactccgccgacatttgcgatttatatgctgagcctcgttctggaatggctcaaggaaaacggcggtgtggaagctgttgaacagcgcaatgaacaaaaagcgcaggttctctacagctgtattgatgaaagcaacggcttctataaaggacatgccagaaaagacagccgctcacgcatgaatgtcacattcacgcttcgggatgacgaattaacgaaaacattcgttcagaaagcaaaagatgcgaagatgatcggccttggcggacaccgttcggtgggaggctgccgcgcttctatttataacgcggtctctctcgaagactgtgaaaaattagctgcgttcatgaagaaattccagcaggaaaatgagtaa

SEQ ID NO: 41358 - DNA, 1062 bp, Bacillus subtilis
atgagtaaacgagaaacgtttaacgagacgtttttaaaagctgcgcggggagaaaaagcggatcacacgcctgtgtggtatatgaggcaagcagggcgctcacagccggaataccgcaagctgaaggaaaagtacggattgtttgagatcacacatcagcccgaactttgtgcgtatgtcacaagactgccggttgagcaatacggagtcgatgctgcaatcctttataaagatatcatgacgccgctgccgtcaatcggtgtggatgttgaaatcaaaaacgggatcggtcctgtgattgatcagccaatccggtctctggcggacattgaaaaactcggccagattgatccggaacaggacgtgccgtacgtgcttgagacgattaaactgcttgtcaatgagcagctgaacgtcccgctcatcggtttctcaggtgcgccttttacgcttgcaagctatatgatcgaaggcggcccgtcgaaaaactacaataaaacaaaagccttcatgtacagcatgccagatgcatggaatctgctgatgtccaagcttgccgacatgatcatcgtgtacgtgaaagcgcagattgaggcaggcgcaaaagcgattcaaatctttgattcgtgggtcggcgcattgaatcaggcagattacagaacatacatcaaacccgtgatgaaccggatcttttcagagctcgcaaaggagaatgtgccgctgatcatgtttggcgttggcgcaagccatcttgcaggtgattggcatgaccttcctctcgatgttgtcgggcttgactggagactcggcattgatgaagccagatcaaaaggaattactaaaacagtgcagggcaacctggacccgtccattttgcttgcgccatgggaagtcattgagcagaaaacgaaggaaatacttgatcagggtatggagtcagacggcttcattttcaatcttggccatggggtatttcctgatgtcagtcccgaggttttgaaaaaactgacagcatttgtccatgaatattcacaaaacaaaaaaatgggtcaatattcctaa

SEQ ID NO: 41359 - DNA, 933 bp, Bacillus subtilis
gtgagtagaaagaaaatggggcttctcgtgatggcgtacggcacgccttataaggaagaagatattgaacgttattatacacatatcagaagaggcagaaagcctgaacctgaaatgcttcaagatttgaaagacagatacgaagcgattggcggcatttcaccgcttgcccaaatcacagaacagcaggcgcataatctggaacagcacttgaatgaaattcaggatgagattacgtttaaagcgtatatcggactgaagcatatcgagccgtttattgaagacgccgtagcagagatgcataaggatggcattacagaagcagtcagcatcgtgctggcgccgcatttctccacgttcagcgttcagtcctacaacaaacgcgccaaagaagaggctgaaaaactcggcggcttaacgattacgtcagttgaaagctggtacgatgaaccgaagttcgtgacatattgggttgaccgagtgaaggaaacatatgcgtcaatgcctgaggatgaaagagaaaacgcaatgctcatcgtatccgcacacagcctgccggaaaaaatcaaagaatttggagacccgtacccggaccagcttcatgaatcggcgaaattaattgctgaaggcgcaggcgtttccgaatatgctgtcggctggcaaagtgaagggaacacgcctgatccttggctcggacccgatgttcaggatttaacacgtgatttattcgaacaaaaaggctatcaagcatttgtatatgttcctgttgggtttgtcgcggatcacttagaagtgctttatgataatgattatgaatgcaaagtggttactgacgatatcggcgcaagctattaccggccggaaatgccaaatgccaagcctgaatttattgatgctttggcaacagtcgtattaaaaaaattaggacgttaa

SEQ ID NO: 41360 - DNA, 1413 bp, Bacillus subtilis
atgagtgacggcaaaaaacatgtagtcatcatcggcggcggcattaccggtttagccgccgccttctatatggaaaaagaaatcaaagaaaagaatctgccgcttgagctgacacttgttgaggcaagtccgagagtcggcgggaaaatccagactgtcaagaaagacggctatatcatcgaaagagggccagactcatttctggaacgaaagaaaagcgccccgcagcttgttaaagacttaggtcttgagcatttgcttgtcaacaatgcgaccgggcaatcctatgtgcttgtaaaccgcaccctgcatccaatgccgaagggcgctgtaatggggataccgacaaaaattgcgccgtttgtttctacgggtctgttttccttgtccgggaaggcgagagctgctatggatttcatcctgcctgcaagcaaaacaaaggatgatcagtcattgggagaattcttccgcagacgtgtcggagatgaagtggtcgagaacttaatcgagccgctactatcagggatctacgcaggcgacattgacaagctcagcctgatgtcgacatttccgcaattttatcagacggaacaaaagcatagaagcctgattctcggcatgaaaaaaacaaggcctcaaggctcaggccagcagctgacggcaaaaaaacaagggcagttccaaactctgtcaaccggtttgcagacccttgtagaagagatcgaaaagcagttaaagctgacgaaggtgtataaaggcacaaaagtgaccaaacttagccatagcggctcttgctattcgctcgaactggataacggcgtcacacttgatgctgattcagtaattgtgactgctccgcataaagcggctgcgggaatgctttctgagcttcctgccatttctcatttgaaaaatatgcactccacatccgtggcaaacgtcgctttaggtttccctgaaggctccgtccaaatggagcatgagggcacgggttttgtcatttcaagaaacagtgactttgcgatcacagcctgtacgtggacgaataaaaaatggccgcacgcagcgccggaaggcaaaacgctgcttcgggcatatgtcggaaaagccggagacgaatccattgtcgatctatcagataatgacattatcaacattgtgttagaagacttaaagaaagtcatgaacataaacggcgagccggaaatgacatgtgtaacccgatggcatgaaagcatgccgcagtaccatgtcggccataagcagcgtatcaaggagctgcgtgaagcacttgcatctgcgtatccgggtgtttatatgacaggcgcttctttcgaaggtgtcggcattcccgactgcattgatcaaggaaaagctgccgtgtctgacgcgcttacctatttattcagctaa

SEQ ID NO: 41361 - DNA, 978 bp, Bacillus subtilis
atgtcaaaagcaaaaattacagctatcggcacctatgcgccgagcagacgtttaaccaatgcagatttagaaaagatcgttgatacctctgatgaatggatcgttcagcgcacaggaatgagagaacgccggattgcggatgaacatcaatttacctctgatttatgcatagaagcggtgaagaatctcaagagccgttataaaggaacgcttgatgatgtcgatatgatcctcgttgccacaaccacatccgattacgcctttccgagtacggcatgccgcgtacaggaatatttcggctgggaaagcaccggcgcgctggatattaatgcgacatgcgccgggctgacatacggcctccatttggcaaatggattgatcacatctggccttcatcaaaaaattctcgtcatcgccggagagacgttatcaaaggtaaccgattataccgatcgaacgacatgcgtactgttcggcgatgccgcgggtgcgctgttagtagaacgagatgaagagacgccgggatttcttgcgtctgtacaaggaacaagcgggaacggcggcgatattttgtatcgtgccggactgcgaaatgaaataaacggtgtgcagcttgtcggttccggaaaaatggtgcaaaacggacgcgaggtatataaatgggccgcaagaaccgtccctggcgaatttgaacggcttttacataaagcaggactcagctccgatgatctcgattggtttgttcctcacagcgccaacttgcgcatgatcgagtcaatttgtgaaaaaacaccgttcccgattgaaaaaacgctcactagtgttgagcactacggaaacacgtcttcggtttcaattgttttggcgctcgatctcgcagtgaaagccgggaagctgaaaaaagatcaaatcgttttgcttttcgggtttggcggcggattaacctatacaggattgcttattaaatgggggatgtaa

SEQ ID NO: 41362 - DNA, 1290 bp, Bacillus subtilis
atgaaaagaattaagtttggattagccacacaaatattcgttggacttattctaggtgtcattgttggcgtcatttggtatggcaacccagcattgcctacttacctgcagccaatcggggatctctttttacgcttaatcaaaatgatagtgattcctattgttgtctccagcttaatcatcggtgtagccggtgcaggaaatggaaagcaagtcggtaaattaggcttcagaacgattctgtacttcgagatcatcacgacttttgccattattctcggactagcccttgcaaacatcttccatccgggtacaggagttaatatacacgaagctcaaaaatcggacatcagtcaatatgttgaaactgaaaaagaacaaagtaataaatcagtggcggaaacgttcctccatattgtgccgacaaacttcttccagtcattggtcgaaggggatcttctagccatcatctgctttacagtactatttgcattgggtatttccgcgatcggtgaaagaggcaagcctgtattagccttttttgaaggtgtatcccatgccatgttccacgttgtaaaccttgtgatgaaagtggcgccattcggcgttttcgctcttatcggagtgactgtgtctaaattcggactcggttctcttatctctctcggaaagctcgtcggattggtttatgtcgcgcttgctttcttcttaattgttattttcgggattgtcgcaaaaattgccggcatcagcatcttcaagttccttgcttacatgaaggacgaaatcttactggcgttcagtacgtccagctctgaaacggttcttccgcgtatcatggaaaaaatggagaaaatcggatgtccaaaaggcattgtttcatttgtcattccgatcggttacacgtttaacttagacggttccgttctctatcaatctattgccgcactctttttagcacaggtatatggcattgatttgacgatttggcaccaaattacgcttgtgctcgtcttaatggtgacatccaaagggatggctgccgtacctggtacttcttttgttgtcttgcttgcaacgcttggcaccatcggcgttccggctgaaggacttgcctttattgccggcgtagaccgcatcatggatatggcacgtacagttgtcaacctgactggtaacgcgcttgctgccgttgtgatgtctaaatgggaaggcatgtttaatcctgcgaaagcagaaactgttatgtcccaatcgaaaacagaacaaaacgcaaccatttctggttaa

SEQ ID NO: 41363 - DNA, 1542 bp, Bacillus subtilis
atgaatcttgtttcaaaattggaagaaacagcatctgagaagcccgacagcatcgcatgcaggtttaaagatcacatgatgacgtatcaagagctgaatgaatatattcagcgatttgcggacggccttcaggaagccggtatggagaaaggggaccatttagctttgctgcttggcaattcgcctgattttatcatcgcgttttttggcgctttaaaagctgggatcgtagttgttcccatcaatccgttgtacacgccgacagaaattggttatatgctgacaaatggcgatgtaaaggcaatcgtgggcgttagccagcttttgccgctttatgagagcatgcatgaatcgctgccaaaggttgagctcgtcattttatgccagacgggggaggccgagccggaagctgcggacccagaggtcaggatgaaaatgacaacgtttgcaaaaatattgcggccgacatctgccgctaaacaaaaccaagaacctgtacctgatgataccgcggttattttatatacgtcaggaacgactggaaaaccgaaaggcgcgatgctgacacatcagaatttgtacagcaatgccaacgatgtcgcaggctatttgggaatggatgagagggacaatgtggtctgcgctcttcccatgtgtcacgtgttttgtttaaccgtctgtatgaatgcaccgctgatgagcggcgcaactgtattgattgagcctcaattcagtccggcatctgtttttaagcttgttaagcagcagcaggcgaccatttttgccggtgtgcctacaatgtataactacttgtttcagcatgaaaacggaaagaaagatgatttttcttcgatccggctgtgcatttcgggaggcgcgtccatgccagtcgcgttgctgacggcgtttgaagaaaaattcggtgttaccattttggaaggctacgggctctcggaagcatcacccgtcacgtgctttaacccgtttgacaggggcagaaagccgggctccatcgggacaagtatcttacatgtcgaaaacaaggtcgtagatccgctcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccggaaaaaagacatgatcattgtaggaggatacaatgtgtatccgcgggaggtggaggaggtgctgtacagccatccggacgtcaaggaggcggttgtcatcggcgtgccggacccccaaagcggggaagcggtaaagggatatgtggtgccgaaacgctctggggtaacagaggaggacatcatgcagcactgcgaaaagcatctggcaaaatacaagcggcctgccgccattacgtttcttgacgatattccgaaaaatgcgacggggaaaatgctcagacgggcactgagagatattttgccccaataa

SEQ ID NO: 41364 - DNA, 582 bp, Bacillus subtilis
atgacagccgtttgtttagtaagacatggagaaaccgattggaacctgcagcaaaaatgccaaggcaaaaccgatatcccgctaaacgcaacaggtgaacgccaagcaagagaaaccggagaatatgtaaaggacttttcttgggatattattgtgacgagcccgctgaaaagagcgaaaagaaccgcggaaattattaatgaatatctgcatcttccgatagtcgagatggatgattttaaggaacgcgattacggcgacgcggagggcatgccgctggaggaacggacaaagcgctatccagataacatctatccgaatatggaaaccttagaagaactcactgacaggctgatgggcggtttggcaaaagtgaatcaggcgtatccaaacaagaaggtgctgatcgtggcgcacggtgcggcaattcacgccctgctgacagaaatatccggcggtgacccggagcttcaaagcacccgtctcgtcaacgcctgcctcagcaacattgaatttgcagaagaaaaatggcggataaaagactataatatcaacagccacttatccggctttatcaaataa

SEQ ID NO: 41365 - DNA, 1095 bp, Bacillus subtilis
atgaatgcggttattgttgatgcaaaacgaacgatctttggaaatcaaaacggactgctgaagcccttcctgccggaggatttggcggctcccatcatccgctgtctcagccgaaagctagaggatcaagttgacgaggtcattctcggaaacgctactggcagaggcggcaacctggccagactgtcagcccttcaagccggactgcctttatcggttcccggaatgacaattgacagacagtgcggctccggccttgaagctgtgcgctatgcctgcagccttattcaagcgggagccggcacgatgtatatcgcgggcggctcagaaagcagcagccaatcccctttttcagaacgggctcgcttttctccagatgcgatcggcgatccagacatgggcattgcggcagaatatacggctgcacgctattccatcagcagaagcatgcaggatgagtacgcgcttctcagccatcaacgcagcaggaacgcgcatgatgaaggattttaccgtgaagaagttgttgctctcggggaattggagacggacgaagcatttttgaaaacgcggccaatagaagcgattattccccgtgcaaagccggttttcgacaccagctccggaacagtcacagcagccaacagcagtggcatagcagacggagcagccgctcttttggtaatggaagaagaaaaagcagcagccctgggacttaagcctgtgcttcggtttatcggcagcgctgtcagcggcattcaccccaactttccgcccgcggcaccggttgtcgcgattcgtcagctcttacatacacacgatgtaacacctgatgatatcgatttatttgaaatcaatgaagcctttgccgtcaaaatttgtgtctgctcgcaagaactcggcattcccttttcaaaaatcaatgtgcgcggcggcgccttagctcttggccatccgtacggtgcatcaggtgcagctctggtaaccagattgttttatgaagcgaaaagacggccagactgtcaatatgctgttgcagccatcggaagcggcggcggaatcggactggctttattatttgaagttcttgcatag

SEQ ID NO: 41366 - DNA, 1440 bp, Bacillus subtilis
atgacaattactcatacctattcatctactgccgaaacatcgcccggccgtgtagcgatccagactgaatcggagcaaatcacgtaccatgattgggatcggcttgtctctcaaaccgcaaattggctgcggtcacagccgagcatgccgaatcgtgtggcgatcctgctcccaaatagtctcgcgtttttacagctgtttgccggagccgcagcggctggatgtacggccattcccatcgacacacgctggagcccggctgaatgtaaggagcggctgtccataagcaatgcggatcttgtggttactttagcctttttcaaaaacaaactgacagatagccagacacctgttgtattgctggataactgtatggcagatatttctgaggcagccgctgatcccttgcctaccattgatccggagcaccctttttatatgggatttacgtcgggctcgacaggaaaaccgaaggcctttacgcgatctcaccgctcatggatggagagctttacctgtacagaaacagatttttcgatttcatcagatgataaggttctgattcccggagcgttaatgtcctctcacttcctatatggggctgtcagcactttgtttctcggaggaaccgtttgtttgctgaaaaagttttctcctgccaaagcgaaggaatggctgtgccgtgaatccatcagtgttctctataccgtaccgacgatgacagacgccctcgcaaggattgagggttttcccgacagtcccgtcaaaatcatttcatccggcgcagactggccggcagaatccaagaagaagcttgccgctgcatggcctcatctcaagctgtacgatttttacggcacatcagagcttagttttgtgacgttttcttcaccggaagacagcaaacggaagccgcattcagcgggccgcccttttcataatgtccggatcgaaatccgcaacgctggaggagaacgctgccagccaggagaaatcggaaaaatatttgtcaaaagcccgatgaggttttccggctatgtgaacggcagcacaccagatgaatggatgacagtagatgatatgggctacgttgatgaagagggctttctatacatatcaggaagagaaaacgggatgatcgtgtacggaggattaaatattttcccagaagaaattgaacgtgtgcttctcgcctgcccagaggttgaaagcgcggctgtcgttggcattcccgacgagtattggggagaaatcgctgtagctgtcattcttggaaacgctaatgccagaacactgaaagcctggtgtaaacagaaattagcctcctataaaattccgaaaaaatgggtgtttgcagacagcttgccggaaacgagcagcggaaaaattgcccgttccagagtgaaaaaatggctggaagagagtgtacagtataaatga

SEQ ID NO: 41367 - DNA, 858 bp, Bacillus subtilis
ttggcgaatcaaaaaaagaaaacattaccgcctcagcaccagaaccagcagcctggttttgaatatctgatggacccgcgtccggtttttgataagccgaagaaagcgaaaaaattagagggcaaaaccgctattattactggaggagacagcgggattggacgcgctgtctcggtgttattcgcaaaagaaggggctaatgtggtcattgtgtatttgaatgaacatcaggacgccgaggaaacaaagcagtatgtagaaaaggaaggggtaaaatgcctgctgattgcaggagatgtcggggatgaagcgttttgcaatgatgtggtcgggcaggcaagccaagtgtttccatccattgatatattggttaacaatgcagctgagcagcatgtccagcccagcattgaaaaaatcaccagccaccagctgatcagaaccttccaaacaaacattttttccatgttttacttaacaaaggcagtgctgcctcatttaaaaaaagggagctctattattaataccgcttcaattaccgcctataaaggcaataaaacgctgatcgattattcagcgacaaaaggcgcgatcgttacgtttacaaggtccctttcccagtcgcttgttcagcagggcatacgggtcaatgcagtggcaccgggtcccatttggacaccgcttatcccggccagctttgccgcaaaagacgtggaagtgtttggttcagacgtgccgatggaacgcccggggcagccggtcgaagtggcgccaagctatctataccttgccagcgacgattccacatacgtcacagggcagacgattcacgtcaatggcggaacaattgtgaacggataa

SEQ ID NO: 41368 - DNA, 900 bp, Bacillus subtilis
atgtctgattcaaatcttacgaatcctataaaagcattttttcatgatgaatttcccgaacaatatcaagaaccgccaggcctgcaaaagaacatgaagcctgtccctgattgcggagaaaaaagctacaaaggatcaggtaaactaacgggtcgaaaagcgcttgtcacgggcggcgattccggtatcggccgcgctgccgcaattgcttacgccagagaaggtgccgatgtggctattaactacttgcccgaggaacagccagatgctgaagaggtaaaagagctgattgaagcagaaggccgaaaagcagtgctgatccccggagacttgagcgacgaatccttttgccaagatctagtcaaacagtcgcatcacgaactcggcggacttgatgtgctagcgctcgttgcaggcaaacagcaagcggtcgaaaacatcgaagatctgcctactgaacaaatctataaaacatttgaagtgaacgtcttttccctttactgggttgtaaaagcggcgcttccgtatttgccggagggagcttcaattatcacaactacctcagttgaaggctataatccaagcccgatgctgttagattacgcagcaacgaaaaacgccattatcggctttaccgtcggactgggaaaacagcttgcttccaaaggcatcagagtaaattcagttgcgcccggaccaatttggacaccgctgcaaatttccggcggacagccgacggaaaacatcccgaaattcggacaaggcacgccgccagctccattaaatcgcgctgggcagccagtggaattggccgatgtttatgtatttctagcttcagagaattcaagctatgtgacatctcaggtatatggcatcaccggaggaattccgacggcatag

SEQ ID NO: 41369 - DNA, 507 bp, Bacillus subtilis
atgaaaaaacggttttggtttcttgccggtgtagtgtccgttgttctcgccattcaggttaaaaatgctgtctttattgattacaaggtagaaggcgtcagtatgaacccgaccttccaggaaggaaacgaattgttggtcaataaattttcgcatcgatttaaaaccatccatcgttttgacatcgtcctttttaaaggccctgatcataaagtgctgattaaacgggtaatcggcttgcccggtgaaacgatcaaatataaagatgatcagctgtatgtgaacggaaagcaggttgctgagccatttttgaagcatttgaaatctgtttctgccggcagccatgtaacgggtgatttttctttgaaagatgtgacgggaacaagcaaggtgccgaaaggaaaatattttgtcgttggagataatcgcatatacagcttcgacagccggcattttggtccgataagagaaaaaaatattgtcggtgtgatttctgatgccgaataa

SEQ ID NO: 41370 - DNA, 3393 bp, Bacillus subtilis
atgaagccgatcgccttaagcattaaggggctccacagctttagagaggagcagacgatagattttgaaggcctttccggtgccggtgttttcggcattttcggcccgacaggaagcggtaaatcctctatactcgacgcaatgacgcttgctttatacggaaaggtggaacgggcggcgaataatacgcacggaatcttaaatcacgccgaagatacgctgtctgtgtcctttacctttgcgcttcagacgaatcaccaaatctcatacaaagtcgagcgtgtgtttaagagaacggatgaaatgaaggtaaaaacggcactttgccgcttcatcgaaatcaaggacgagcatacggtgctggctgataaagccagcgaagtgaataaaagagtggaggagctcttagggctgacgatcgacgattttacgagagcggtggtgctgccccaagggaaatttgctgaatttctgtctttaaaaggggcagagcgcaggcatatgcttcagcgtttatttaatttggagcaatatggagacaggcttgtgaaaaagctgagacggcaggcgcaggaagccaatgcgagaaaaaatgaaatgcttgctgaacagtccggtctcggtgaggcgagctcagaggcagtggagcaggctgaaaaggttctcgaacaagctgaagtccggctggaagcgatgaggaagaaccgtgatcaggcgaaggagcggtttacagagcatcaggagatatggaatgtccaaaaggaaaaatccacttatgaagaagaggaaaaacgtctcgcagaagaacagccgcatatagacagcatgcaaaaacgcctgctggaagcagaaacagcagcagcccttaagccctatgcggaccggtacgcagaagcgatccagcatgaggagcaagctgaaaaggaacaaacgctagcccaaaaggatttagcagaccggacagctttctttcagcaaaaacatgaagagtatgaagcgtggcgccagcataaaagcgagaaagagcctgagcttttagccaaacaggaacagctttcacgcttgcaggaaatcgaaatcaaactgagtgaggccaagcaagaggaagagcgcaaaaaggctgacctccggcagaaagaagaggctcttcaatctgtcatgaatgaattagagaccgtaacagaccgcctgacacgagggcaaaacagacagacagaattgaagcagcagctcaaatccctgcaggtgacatccgatgagcgaaaaagctgccagcaggccgcagagatggcattgcgcatcagacaaaccgaggaacaaatcaaaaaagagaaaaaacgaagtgaagaattgaacctcgtgctgcagaagatgaatgaagagaagaatacactcgttcaaaagacggaagcggaagaaaacaacatcattcaggcatatgaggcagttcaaactgtgtaccatttggtgtgcgaaacggaacgctcattaacacgtatgacggaagaggctagaaagagtcaacacacgcttcacttacagcgtgaaaaagcaagggtggcactgctgacaaaagagttagcccaaaagctgactgccggaaagccttgcccggtatgcggttcaaccgatcatgatccatctgcctcggtacatgaaacgtatgaagccgacagccatcttgaagaggacatcaaacggacagatgtgttattgacggaagctgcagctctcagccaggagattctttcagccaaaattatgcttgaagaacagtccgcgcgctttattgaacagtgtccgtttttgcagacaattcaagcacagaaccttgaagcggcagcttccttcgaacatcagccggtgtatgaagcatttgaaactgccaaatttgaatggaaacgaatcaagcaggacattctttctgttaagacacgaatggcacaaatgattggcgcctatcaggagtctttaaaaaaggccgagcagcttaatgaaaaaatcggttttgaaaaaagagaagccgaccgtattgaaagcatcatcagtgagcttcaatcctcaatggacagcagtctgaacatgtttaaagaagcatttcagaatcaatctgtggacgaagcagaaaaatggcagcaagccattgaagaaaaggaccgggctgcagaagaatgtgaaaaacgaattgagaagagtatcgcgtttcttgctgagcatgaagcacaaaaggaaaaactgcgggaatcgggacaccggcttgagcgggaaaagctggagcttcattatgcggctgaacgcatcaagagcgtgatagctgattatgagcacgaactcggagattatgcaaaaggagattcgattccaatccaactccgctctgtccagcaggatctaaagctgttaaaggaaaaagaacaatctttatatgaagaactgcaaagcgcccaaatgaagctcaaccaagcgaaaagccgcgcttctgcaagcgagctcactcttcaagaggcgaagggcagattggaaaaagcaaaagctgcttggcttgagcatacaaaaaacacctccattacccggactgaggaggttgaacaaagtctcatcccagctgatgaacttgaaaagatgaaaaccggcatagaccagtttatggataaactgaagcaaaatgctgcaaacttaaaacgagtagcagagatacttgccggcagagcattatcagagagcgaatggaacgaaaccgttgcagcattacaagaagctgaggacgcatttggcgctgctatagaggaaaaaggcgcggccgcaaaagcactggctgtcattcgcgaccatcataaacggtttaatgaaattgaagctgaactgaaaaaatggcagatgcatatcgacaggctggacaagctgcaagctgtgtttaaaggcaataccttcgtcgaatttttagctgaggagcagcttgaaagcgttgcgagggacgcctcagcaagactcagtatgctgacaagacagcgctatgccatcgaagtagattctgagggcggcttcgtgatgcgggatgacgcgaatggaggcgtacgacgcccggtttccagtttgtctggaggagagaccttcctcacctcgctttcacttgctcttgcgctgtctgcgcagattcagcttcggggggaatacccgctgcagttctttttcttagatgaaggcttcggcacactggatcaagatctgcttgatacggttgtaacggccttggaaaaacttcagtcagacaacctggctgtcggtgtcatcagccatgtgcaggaactgcgtgcacggcttccgaaaaagctgatcgtccatccggctgaaccgagcggccgcggtacgcgggtatcacttgagttgatgtaa

SEQ ID NO: 41371 - DNA, 600 bp, Bacillus subtilis
atgacacacaatccgaacatcatttggcatcccgctgccatctcaaagtctgacagacagtccttaaacggacacaaaagctgcgtcctttggtttacaggtttgtccggctccggaaaatcggtgctggccaatgctgtcgatgaaaagctttaccgcaagggcattcagagctacgtgcttgacggtgataatatccgccacggcttaaacaaagatcttggatttcagactggtgacaggattgaaaacatccgccggatcggagaagtggcgaagctgtttgtcgacagcgggcaaatgattttaacggcttttatttctccattcagagaggatcgggacatggttagagcgctctttcctaaaggtgagttcttcgaaatttatgtgaagtgcccgctgcatgtttgtgaacagcgcgatccaaaagggctttataaaaaagcgcgaaacggagagatcaaacatttcaccgggatcgattctccgtatgaagcgccgctttcacccgatttcatcattgagtctgaccagacctctatttccgatggagctgatctcatcattaacgcactgcaaaacagaggaattatataa

SEQ ID NO: 41372 - DNA, 978 bp, Bacillus subtilis
atgaggctggcaaacggcttgccgtggagcctgccgattacgctgcctgtcggagaaaaaacagcaagacagctgtctgccggagatcacgtcaagcttgtgaaagacggtgttacctacggcatgatcacagtcaccgatatataccagcctgataaaacacaagaagcactgtctgtttttaaaacaaacgatcctgcccacccaggcgtaaaaaaattgctggcgcgcccggattactatatcggagggcctatcacggtcagcagcctgcctgacaaatctttcgaacagttttatgcaacgcccgctgaaacaagagcggcctttcaaaaactcggctggaagacgattgtcggctttcaaaccaggaaccctgttcacagagcgcatgaatacattcaaaaaacagcgttagaaacggtcgacggtctgctgcttcacccacttgtcggagaaacaaagtcagacgatatccccagcgatatcagaatggagagctaccaggctttgcttaatcactattatccaaaggatcgtgtcatgttatcggttttccctgccgccatgcgttatgcaggtccgcgggaagcgattttccatgcgctcgtccgaaaaaattacggctgtacccattttattgtaggccgtgatcacgcgggtgtcggcagctactatggaacatacgacgcccaaaatatttttcaatcattcacagaggaagagctgggcatcaagccgctgttttttgagcacagcttttattgccgaaaatgcggaaacatgggcacctccaaaacatgtccgcacagcccgagagaccacatccacttatcaggcacaaaagtgagagagcttctccgccaaggcaaaaagccgcctaaagaattcagccggcctgaggtcgcagccgtgctgatcaagggacttcaccaacagcctgttgccatcaagcaaaacagcggggaattgcaatga

SEQ ID NO: 41373 - DNA, 591 bp, Bacillus subtilis
gtgtacgcctgcagctttggcgcagaaggaatggtgcttctcgacttaatatcaaaaatcaacaaaaacgcacacatcatctttttggataccgggcttcattttcaggaaacatatgagctgatcgagaccgtcaaagaacgatatccgggatttgcaatccagatgctcgaacccgagctgagcttaacagaacaggggacgaagtacggcggagagctgtggaagcataacccgaacctctgctgccaattgcggaaaatcgaaccgctcaaaaagcacctgtccggcatgacagcttggatttcaggactgcgccgggatcagtcaccaacgagaaagcatattcaatacgtaaacctggaccagaagtttgagctcatcaaaatttgcccgcttatccactggacatgggatgacgtttggacgtacatccgcctgcacaatttgccttataacaaactgcacgatcaacattatccgagcataggctgtgaaatgtgtacactgccttccccggacccgaacgatgagagggctggaagatgggccggacgggagaaaacagaatgcggcctgcatcaagaatag

SEQ ID NO: 41374 - DNA, 1041 bp, Bacillus subtilis
ttgaaaataggaattgtaggtgctacaggatatggaggcaccgaacttgtcaggattctttcgcatcatcctcatgcagaggaatgcatactttattcatccagcggagaagggaatgtctatagcgagggttatcctcatcttaccggcttagcggatcagcagctgaagccgattgatatgaatacgatcaaacacgaaatagatatcatgtttctcgctgcgccgcccggagtatcaagtgaattgactccaaagctggcagacgcgggaattacggttattgatctgtcaggtgatctgaggataaaagaaccggctgaatatgaaaaatggtataaacggacagcggcaccgaaggcggtgattcaagaggcggtatacggtctggcagaactgaatcaactgcaaattcaacaggcgaaactcattgccaatccaggctgttttccaacagctgttttgcttggcctcgcgccattggctcaaaagaaactgctcgatgaatctttcgttatcgttgacgcgaagaccggtgtttccggagcgggaagaaaagcatccatgggaactcatttttctgagctgaacgacaattttaaaatttataaagtcaatgaacatcagcacacgccggaaattgagcaggcgctgaatgaatggcagccaggtctcgggcccattacattttcggctcacttggttccgatgacaaggggcatcatggcgacgatgtataccagattaacctgtgacctaaccgcagatgacctgcatgatttatattcggaattttaccaagattcatattttgtgagagtgaggccaaaaggtcagtacccgcaaacgaaagaagtgtacggcagcaatttctgtgatatcgccgtgaccctcgatgagagaacgaacagagtcacgatcgtctcggtaatcgataatttaatgaagggtgccgccggtcaggcagtgcaaaactttaatttgatgaatggctggaatgaagaaactggactcaccatcatcacgccaatttatccatag

SEQ ID NO: 41375 - DNA, 1221 bp, Bacillus subtilis
atgattcagttaagtgaagatcaaattgtaaaagtaacaggtgatgtatcctcgccaaaagggtttcaggcaaagggtgtgcattgcggactgcgctactcgaaaaaagacctcggcgtcattatcagcgagacaccggccgtgagtgcagcagtttatacccaaagccactttcaggctgctccgatcaaagtgacacaagacagcttaaagcacggaccgacactgaaagccgtcatcgtcaacagcgccattgccaacgcctgcacgggagaacagggcttaaaggacgcatacacaatgcgggagagctttgcttcacagcttggcattgagccggagcttgtcgctgtttcatcaacgggtgtcatcggcgagcatttagacatggaaaaaatccacgcggggatcgaactgctgaaagaaacacctgcgggatcaggcgattttgaggaagcgattttaacaactgatacggtgatcaagcagacgtgctatgaactggcaatcggcggcaaaacagtcacgatcggcggagcgcgcaaaggctctgggatgatacacccgaacatggccacgatgctgggatttgtgacaactgacgcggcaatcgaagaaaaagcgctgcaaaaggcgcttcgggaaactactgacgtttcatttaaccaaatcacagttgacggagaaacatccacgaacgacatggtattagttatggcgaatgcgtgcgccgaaaacgagtgcctgacagaagaccatccagactggccggtctttaaaaaagcgctcttgctcacttgtgaggatctagctaaagagattgccagagacggagaaggcgcgacaaaactaattgaagcccaagtacagggagcgaaaaacaatcttgatgcaaacgtcattgccaaaaagattgtcggctcaaatcttgtaaaaacggcagtatacggaacagatgccaactgggggcggatcatcggagccatcggacactccgcagcacaggtgacggcagaagaagtagaggtttatcttggcggccaatgcctgtttaagaataacgaacctcagccattctctgaatctatcgccaaggaataccttgaaggagatgaaatcaccattgtcatcaagatggctgaaggggacggaaacgggagagcgtggggctgtgacctgacctatgactatatcaaaattaacgcgagctatcgcacgtaa

SEQ ID NO: 41376 - DNA, 777 bp, Bacillus subtilis
atgaagaaaacaatcgtttttaaatgcgggggaagcgtcatccgtgagctgtcggaggaattttatcaaaatctgaaagagctgagggcgtcaggctggaagctggcaatcgtacatggcgggggaccggaaatcacaaatatgctgaaacggttaaatatcaagacagagttttcgggcggacagaggaaaacaacgaagccggtgctggaagtggcggaaatggttttatccggttctgtcaataaatttttcgttgctgagcttgccaaacacggactgcgagccgcgggcatttctggtaaggatggcggtcttttggaggctgattatctagatccggaaacatacggagaagtgggagaaatcaaaaaagtcgatgcgtccatggtgaacgcgctgatggaaaatggcatcatccccgttattgcgccgctgtctatgacaagcgactgcaaaacgctgaatgtaaatgctgatctggctgcttcagcagtcgccggagcgcttgaagccgataagctgatgttcgtcacggatgtcgatggaatcatgaaggaaaagcagcgtctggacgtcctgacccctaaggagattcagatgctgatcaagcaggaagtgatcacaggagggatgatcccgaaggtcaattcagccttgtcagctttatcagatcaggtgtctgaagtcatgatcgtaaacggtaaaggatcattcttcgcagaacaaacctttcaagggacaaaaattgtcaaagcaaaggaggctgtttcatga

SEQ ID NO: 41377 - DNA, 1158 bp, Bacillus subtilis
atgagcagcttgtttcaaacctacggccgttgggatattgacatcaaaaaagcaaagggaacgtacgttgaggatcaaaacggcaaaacgtaccttgatttcattcaggggattgcggtatcaaatctaggacactgccatgaagcggtgacagaggcagtcaaaaaacagcttgacagcgtatggcacgtatccaacctgtttcaaaacagtctccaagagcaagcggcgcagaagctggcaggccatagtgcgggagatcttgtctttttctgcaacagcggcggccaggcgaatgaaggtgcgtataagcttgccagaaaagcaactggaaaaacaaaaatcatcacttttcttcagtcgttccatggccgcacgtatgcagggatggctgcgaccggacaggataaaatcaaaacaggcttcggcccgatgcttggaggctttcactacctgccatacaatgatccttctgcttttaaagctcttggggaggaaggcgatattgccgcggtgatgcttgaaacagtgcagggagaaggaggagtcaatccggcgagtgctgaatttttatcagccgtacagtcgttttgcaaggaaaagcaagcccttctcattattgatgaaatccagaccggcatcggacggacgggaaaaggcttcgcatatgagcacttcggactctcaccggatatcatcacagtcgccaaaggattgggaaacggctttccggtcggcgctgtcatcggaaagaaacagcttggagaagcgtttacccctggttctcacggaacgactttcggaggaaacatgctggcgatggctgctgtgaatgccacattgcaaattgtattccagcctgactttttgcaagaggctgctgacaaaggggcgtttttaaaagaacagcttgaggcagagctaaagagcccttttgttaaacaaatccgaggtaaaggattaatgcttggaattgagtgtgatggcccggttgctgacattattgctgaattgcagacattaggcttgcttgtattgccggccggccccgaacgtgattcggctgctgcgccgctcaccgtgactaaggatgaaatagcagaagccgtcagcaagctgaaacaggcaatcgctcatcattccgctgtaaaccagtga

SEQ ID NO: 41378 - DNA, 1062 bp, Bacillus subtilis
atggaaggttatttagtgttagaagatgggacatcgttcagcggcgagctggacggtcatgaaaactgcacgggagaagctgtttttttcacaggaatgacaggctaccaggaagtgctgacagatccatcatataagggacagattattgtatttacctacccgctgattggcaactacggcataaatgaaaaggattttgaaagcaagaaaccgcaagtaaaagccgcggttgtctatgaggcgtgtgatcacttttctcattatgaagcggtatacagcctcaaggagtatctacagaaatggaatattccgctgttaacccatgttgatacgagggctgtcgtgaagaaaatccgggcaaacgggacgatgggtgcgacagtcacagcctctaaagaaggagctgagattgcccttcaaccagagaatgtggcagagcaggcttccgcccaggaaatcagcacattcggcgacgggaataaacatatcgctctcattgattttggctataaaaagtcaatcgcatcatcacttgtcaaacgaggctgcaaggttaccgtggtgccataccagcaaatggaggccgtatacaacatcaaacccgatggaattgtgctatcgaacggacctggagatccgaaagccattcagccatatttaggaaagatcaaaagcatcatcagccgctttccgactctaggcatttgtctcggacatcagctgatcgcgctcgcgtttggagggaatacttttaagctgccattcgggcacaggggagctaatcatccggtcatcgaccgtaagacgaaacgggtctttatgacaagccaaaaccacagctatgtggttgatgaacagtcgattaatgaagaagagctcaccatcaggtttcatcatgtcaatgatacgtcagttgaagggcttgcccataaaaaactgcctgtcatgagtgttcaattccacccggaagcccatcccggagctgcggaaagcgaatggatttttgatgattatctaaagaatgtgataccagcaaggagagaaatcgcgcatgcctaa

SEQ ID NO: 41379 - DNA, 3084 bp, Bacillus subtilis
atgcctaaagacaccagtatttcaagcatattagtaattggctcaggcccgatcatcatcgggcaggcggcagaatttgattattcaggcactcaagggtgcatcgcgctgaaggaggagggctaccgggtaattctcgtcaacagcaatccggcgacaattatgactgatgaagccttcgctgatgaaatttattttgagcctctgacagcagaaagcctgacagccatcattaagaaagaacggcctgatgggcttcttgccaatttaggcggtcagaccgcgttgaatttagcggtggagcttgaagaaacgggtgttttaaaagagcacggcgtcaaactcctcggcacatccgttgaaacgatacaaaaaggagaggaccgggaaaaattccgttcgttaatgaatgaattaaaacagcctgtgccggagagtgaaattgttgataacgaggccgatgccctccattttgcggaatccatcggttttcctgttattatcagaccagcttacacattaggcggaaagggcggaggaatcgcccctgataaagaagcctttacagctatgattaagcaggcgctattagcaagcccgatcaatcaatgccttgtcgaaaaaagcattgccggctttaaagaaattgaatatgaagtcatgcgtgacagcaataacacatgcattaccgtctgcaatatggaaaatatcgatccggtcggcgtgcatacaggtgactctatcgttgtggcgccgtcacaaacattgacagacgaagactatcaaatgctgcggacagcaagtctgacgatcatctcagcacttgatgttgtaggcggctgcaacattcaattcgcgcttgatccattcagcaagcaatattacgtcattgaagtgaatccgcgtgtaagccggtcatcggctctcgcatctaaagcgaccggttatccgattgcgaagatggccgcgaaactggcagtcggatacactcttgacgagctgaaaaatccgctcacaggctcgacttacgcaagctttgaaccggcactggattatgtgatcgtcaaatttccgcgctggccgtttgataaattcaaaaacgcagaccgcaagcttggcacaaaaatgaaagccaccggtgaagtgatggcgattgaacggaatttagaagcggcgatacaaaaggcaggcgcatcgcttgaattaaaaaatatcgggacacaccttccagagctcagcgggttgtcaattgatacgctatgggatttggcaatcactccggatgaccgcagatttttcgttgtcatggagctgttgagccgcagcgtctcgattgatgacatccatgaaaaaacaaaaattgatccgtttttccttcatacctttgacaacatcatcaaattggaaaaccgcctgatggaagcagggagcgatctctcttttgaattattgaagaaagcaaaggaaaagggattctcagacgcaacgattgcctcgctgatcagcaaaacagaagaagaggtgcggcgccttcgcaaggagatgggcattacgccttcctttaaaatcgtagatacatgcgcggcagagtttgatgcgaaaacaaactatttttactccacatatttcggagagaccgatggagacatcagccgcaaagagaaaaaacgcgcgctcattatcggatcaggcccgattcggatcggccaaggcgttgaatttgattacagtgctgttcacggtgtgctgacactgcaagagcttgggttcgaaaccatcatgattaacaataacccggaaactgtcagcaccgattatgaaattgcggaccgcctgtattttgaaccgatgacaacggagcatattgtaaacgtgcgggagcaggaaaatattgattttgcaattgtgcaatttggcggtcaaactgcaatcaatgctgctgaagcgctcgaaaaagccggcattactcttcttggcacatcatttcaaacgctcgacgtgttagaggatcgggatcaattttatcagcttcttgacgagctgggattgaagcacgcaaaaggagaaattgcttatacaaaagaagaagccgcttcaaaagcgagtgagatcggctatccggtgttaatccgcccatcttacgttatcggcggaatgggcatgatcattgttgactcgcaagcccagctttctcagctgctgaatgatgaggacagcatgccatacccgattttaattgatcagtatgtgtctggaaaggaagtcgaaattgatttgatttccgacggcgaggaagtctttatcccgacatataccgagcatattgaacgggcaggtgtccattcaggggacagttttgccattcttcccggaccgtccatcacgagcgggctgcagcagggcatgaaagatgcggcacaaaaaattgcccgaaaactttcatttaaaggcatcatgaacattcaatttgtgatcgacaatggcaacatactcgttcttgaagtgaatccgagagcgagccgcacggttcctgtcgtcagcaaagtaatgggcgttccgcgcgccacacgtctgctggcgggagcgtccttaaaagatctaaatccggcagttcaaaatcatcatggagttgccgtgaagttccctgttttttcttctcatgcgatccaggatgtggatgtcaagcttggaccggaaatgaaatcaacgggagaaggcatgtgtgtcgcatatgattctaacagcgccttgaaaaaaatctatacaagagtctggagtcaaaaaggaagcatttatttgcaaaacgttccggaagatgtgaaggagttagcagaaaacgcaggttttacaatacatgaaggaacatttgcctcatggatggaacaggaaggaaactcgctccacattaatctgagcggttctgaagaagcacgcaaagaacgtttggaagccatgacgcacggcatccccgtctttacagaagaagaaactgtgcgggcgtttttacaaagcggttcaggccatccgcagcctgtatctctcaaagacctctataaaaaggaagtggcatcatgcacacagtga

SEQ ID NO: 41380 - DNA, 960 bp, Bacillus subtilis
atgcacacagtgacgcaaaccagtttatacggaaaagatttattaacgttaaaggaccttagtgaagaagatataaacgccttgctcgcagaagccggtgagctgaaacaaaacaaaattcagcctatattccatggcaaaaccttggcgatgatttttgaaaaatcatcaacgcggacccgtgtttcatttgaagcgggcatggcgcagctgggcgggagcgccctctttctaagccagaaagatctgcagctggggcgcggtgagactgtcgctgatacggcaaaagtgctgtcaggctatgtggatgccatcatgatccggacctttgaacatgaaaaggtggaggaacttgccaaagaagctgacattccggtgatcaatggacttaccgataaataccacccatgccaggcgctggcggatctcttgacgattaaggagataaaagggaagcttaaaggcgtaaaagtcgcgtacatcggtgacggaaataacgtggcgcactccttgatgatcggctgcgcgaaaatgggctgtgatatctcgatcgcttcaccaaagggatatgaagtgttagatgaagcagctgaagcggcaaagacatatgcacttcaatccggctcttctgtcacgctgacagatgatccgattgaagctgtaaaagacgcggacgtgatttattctgatgtgtttacaagcatggggcaggaagcggaagagcaagaacgtcttgctgtctttgcgccttatcaggtgaatgcggcgctggtcagccatgccaagcctgactatacatttttacattgtctccctgcgcatcgcgaggaagaagtgactgcggagattattgacgggccgaactctgcagtgttccagcaggcggaaaaccgtcttcatgtgcaaaaagcactgctgaaggccattttatataaaggggaatcatcaaaaaactgctga

SEQ ID NO: 41381 - DNA, 939 bp, Bacillus subtilis
atgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttggttgcaactgttacacctgatcagtcattccctacggtctcttgtatgattcaagaacaactcggcgcgaagaaagcgtgtgctatggatatcagcgcggcttgtgcgggcttcatgtacggggttgtaaccggtaaacaatttattgaatccggaacctacaagcatgttctagttgttggtgtagagaagctctcaagcattaccgactgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgccaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattggaagccggtaaaatcaaagacggcgatgtggtcgttatggtagggttcggcggaggactaacatggggcgccattgcaatccgctggggccgataa

SEQ ID NO: 41382 - DNA, 1242 bp, Bacillus subtilis
atgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagattttaatgttgaagattatatggataaaaaagaagccagaaaaatggaccgctttacacaatatgcggttgtggctgcgaaaatggcggttgaagatgcagatcttaacattaccgatgagatcgcgccgagagtcggtgtttgggtaggctccggtatcggaggacttgaaacactagagtctcaatttgaaatcttcttaacaaaaggcccaagacgggtaagcccgtttttcgtgccaatgatgattcctgacatggcgacaggccagatttctattgcattaggagcaaaaggggtgaactcttgtacggttacagcatgtgctacaggaacgaactccatcggtgacgcgtttaaggttattcagcgcggtgatgcagacgtgatggtcacaggcggaacagaagcgccgctgacaagaatgtcattcgccggctttagtgccaacaaagcgctgtctactaatccagatccgaaaacagcgagccgcccgtttgataaaaaccgtgatggctttgtcatgggggaaggtgcagggattatcgttcttgaagaacttgagcatgccctggcccgcggcgctaaaatttacggagaaattgtcggctacggctcaaccggagacgcttatcatatcacagcgccggcccaagacggtgaaggcggagcgagagcgatgcaagaagccattaaagatgcaggcattgcacctgaagaaattgattacatcaatgctcacgggacaagcacgtattacaacgacaaatacgaaacaatggcgattaagaccgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacacctgacgaagaatgtgatttggattatgtgcctgatgaagcccgcagacaggaacttaattatgttctcagcaactcattaggattcggcggacacaacgcaacattaatctttaaaaaatatcaatcataa

SEQ ID NO: 41383 - DNA, 810 bp, Bacillus subtilis
atgtctttattaaatataggaggctttatacatatgaatttttcacttgaaggccgtaacattgttgtgatgggggtagccaacaaacgcagcatcgcctggggcattgcgcgttctttacatgaagcgggtgcacgtttgattttcacatacgctggtgaacgcctggagaaatccgttcacgagcttgccggaacattagaccgcaacgattccatcatcctcccttgcgatgttacaaacgacgcagaaatcgaaacttgcttcgcaagcattaaggagcaggtcggtgtaatccacggtatcgcgcattgtatcgcgtttgccaacaaagaagagcttgtcggcgagtacttaaacacaaatcgtgacggcttccttttggctcataacatcagctcatattctctgactgctgttgtcaaagcggcacgtccgatgatgactgaaggcggaagcattgtcactttgacgtaccttggcggagagcttgtgatgccaaactacaacgtcatgggtgtagcaaaagcttctcttgatgcaagtgtgaaatatttagctgctgacttaggaaaagaaaatatccgcgtcaacagcatttctgccggcccgatcagaacattatctgctaaaggcatcagcgatttcaactctatcttaaaagacatcgaagagcgtgcaccgcttcgccgcacgacaacacctgaagaagtgggcgatacagctgcgttcttgttcagcgatatgtcccgcgggattacaggtgaaaatcttcacgttgattctggtttccatatcactgcccgctaa

SEQ ID NO: 41384 - DNA, 2280 bp, Bacillus subtilis
ttgaaatgcgcccgactgaatgatagaatcatacatttacatacatattcgagagaacattatcaattcctctttgaagagggaataaaaggacatttattttgttctcattgcggaaagcccgttttgttacggcttaacatcgccgatccgccagagtttatccatcgccagccaggcgattttccggcatgtgaggaggcgtgcgaaccgaagccctctaaagaggggaaaaaagaagatgatcaggaatctggtgtcattcgtttacccaagggaaaagcgatcgccgctgacccgtccccagctgttacagaatggcaccgtcctagaagcattaaaccaggaacaccatttgtgccaaaaacaatagaacccgatacgagcctttttccgtctgtcggtttaaacacggatcagctgaaagctgtcacggaaacagagggcccgctcctcgtgcttgcaggtgcggggagcggaaaaacacgggtactgacagcccgtgccgcccacatgatcgaacacttaggcataccgcctgaaaatatgctgcttgtcacctttacaacaaaagctgtcgctgaaatgaaagagcgtatggcgaaccagtacggattacagccggcaaaagtcagaagaattgtgacaggaacattccacagtctgttttataagatcttgtatcactctaattctgctaaatggaacggtgagcatctgctgaaaatggagtggcagcgggaacaatatatcaaaaaagcactctatgaagaaggcatcgatgagaaagaatccccagttgaccaagccctgcagcagatcggtttttggaaaaacacttatgtcccaaatgaacgcatccctctaaaagatgagtgggaaaaacaagtttatcgtttatatgaacattatgaacgccagaaaaaagaacacagccaatttgattttgatgacatggcttcagcctgctatgaattgtttatcgagcggcctgaccttctggaacaatatcaatctcggtttacgtatatcttaattgatgagtttcaggacattaatccggttcaatacaaaatcatgcaaatgctcgccagcccggagcaaaacctgtgctgtgtcggagacgatgaccagtccatctacgcgtttcgcggaagcaatccgtctttcattcttgattttcaaaaggattatccgggagcgaagacgatctatttaactgcgaactacaggtctacgcacccgatcgtctctagtgctgatatcgttgtgaaaaagaacaaaaacagatatgccaaaacgcttgaagcggcccgcgatgacattcaggtccctgtgctgttttatccttatgatgaagaggaagaagccacaatggtcgtttccgatatcaaagaaaaaattcaaaatggagccagtccagaagactttgcggttctttaccgcacaaacagcggaggccgtgctatatatgaaaggcttcatcaatcgtcaattccgtatacagctgaccgcggcgtccaatcgttttacagcagacggatcgtccgccagattctcgcctacttgtacgccagccaaaatgaggatgacaccgaggcgattaaacacttgcttcccgccttgtttttaaaacagtccgctttgaatacgctgaaggcgctctcgattacagaggactgtaccatgatcaaagcgctggccaaattgcctgatctgaagccattccagctggacaaaatcaagaaaatcgtaccgttttttgcaagcctccgcacaatgaaacccgtagaagccatcacctttgcagaaggaaaaatgggcttctccgagtatttaaaaaagcggggcaatgagggcaacaagctggaaaaaggctctgatgacctgcgcgacatcaaggttgtcgccaagaagttcaaaacgattcctgactttcttgcccacgtagaccatatgagggccgctgagaaaaacagaacggatgaacatggcgttcagctgatgaccattcaccggtcaaaaggccttgaattcaaaacagtctacgtgttaggcactgtagatggctcgattccgcacgatttctcattagaaacggcaagaaaaggagacgaggccgctcttgaggaggaaagacgccttttatatgtagccatgacccgggcgaaacagcatttatatttgtcttgccctgctaacaggcgcggcaaaacagccaaccgctcaagatttttgtatcccctgctacagaaagcaagacagcccttgcatcattaa

SEQ ID NO: 41385 - DNA, 1122 bp, Bacillus subtilis
atgtcacagcacgttgaaacgaaattagctcaaattgggaaccgtagcgatgaagtcacgggaacagtgagtgctcctatctatttatcaacagcataccgccacagagggatcggagaatctaccggatttgattatgtccgcacaaaaaatccgacacgccagcttgttgaggacgcgatcgctaacttagaaaacggcgcgagagggcttgcctttagttcgggaatggctgctatccaaacgattatggcgctgtttaaaagcggagatgaactgatcgtttcatcggacctatatggcggcacgtaccgtttatttgaaaatgaatggaaaaaatacggattgacttttcattatgatgatttcagcgatgaggactgtttacgctctaagattacgccgaatacaaaagcggtgtttgtggaaacgccgacaaaccccctcatgcaggaggcggacattgaacatattgcccggattacaaaggagcacggtcttctgctgatcgtagataatacattttatacaccggtcttgcagcggccgcttgagctgggagctgacattgtcattcacagcgcaaccaagtatttaggcgggcataacgatctgcttgctggacttgtcgtggtgaaggatgagcggctcggagaggaaatgtttcagcatcaaaatgcaatcggcgccgtcctgccgccatttgattcgtggcttctgatgagaggaatgaagacgctgagcctcagaatgcgccagcatcaggcaaacgcgcaggagcttgcggcgtttttagaagagcaggaagaaatttcggatgtgctgtatcccggaaaaggcggcatgctgtccttccgtctgcaaaaagaagaatgggtcaatccgtttttaaaagcactgaagaccatttgttttgcagaaagcctcggcggggtggaaagctttattacataccctgcgacccagacgcacatggatattcctgaagagatccgcatcgcaaacggggtgtgcaatcggttgctgcgcttttctgtcggtattgaacatgcggaagatttaaaagaggatctaaaacaggcattatgtcaggtcaaagagggagctgtttcatttgagtaa

SEQ ID NO: 41386 - DNA, 1173 bp, Bacillus subtilis
ttgagtaaacacaattggacgctggaaacccagctcgtgcacaatccatttaaaacagacggcggaaccggggcagtcagtgtaccgattcagcacgcctcgacttttcaccaatcttcatttgaagagttcggggcatatgattacagccgctctggcacgccgacaagaacagctctcgaagaaacaattgccgcactggaaggcggaacaagaggatttgctttcagttcaggcatggctgccatctcaacagcatttttactgctgtcacagggtgatcacgttcttgtgacagaagatgtatacggcggaaccttccgtatggtgacagaggtgctgacccggtttggcattgagcatacgtttgtcgacatgacggatcgtaatgaagtggcgcggagcatcaagccgaacacaaaggtcatttatatggagacgccatcaaatccgacacttgggattacggatattaaagcagttgttcagcttgcaaaagaaaacggctgcctgacctttctggacaatacattcatgacgccggcactgcagcgtccgcttgatctcggcgtggatattgtacttcacagcgcgacaaaattcttaagcggacacagcgatgtgctctcaggtttggctgctgtcaaagatgaagagcttgggaagcagctgtataagctacaaaacgcgttcggcgccgtccttggcgtgcaagattgctggcttgtcctgcgcggattaaaaacattgcaggtccgtttagagaaagcgagtcaaacagctcagcggcttgcggaatttttccagaagcacccggcggtcaagcgcgtgtattatccgggactggctgatcatcccggcgctgaaacccataaaagccagtcaacgggagcgggcgccgtgctatcttttgagcttgaaagcaaagaggccgttaagaagttagtcgagaatgtgtcactcccagtcttcgctgtcagccttggcgccgtggaatcgattttgtcctatccggcaacgatgtctcatgcggcaatgcctaaggaagagcgtgaaaaacgcggtatcactgatggcctgctccgtctgagtgtcggcgtcgaacatgcagacgatttagaacacgatttcgaacaagcgctgaaagaaattgctccagtttcggttcgttaa

SEQ ID NO: 41387 - DNA, 756 bp, Bacillus subtilis
atgagtcattctcaagaaaaaattgcactaattacaggagcaagcagtcaaggggatattggtacggctatttgtcgtaagttagcctcacagggtatacatatcttctttactcactggaattctgatacggcctggatagaagaatttcaacaagaaattttacgtatgggtgtccgctgtgaggcaatgaaaattgatttatcagatgcacatgctgcattcacaatacatgaaaaaatttcagataaattaggatatccttccatccttattaataatgcagctcattccgcaagtgataattatgtatcgttagatgctaaatcacttgatgagcattatgcggttaatatgagatcgaattttcttctttgtgttgaattcgcccgtcggtttaaaaaatctaatttaatatcaggaagaatcatcaatatgacatcagggcaggatttaggtcctttgcctggggagttagcgtatgcagcaactaaaggagctatttctgcatttactaggtcgttatcacaagaacttgcaccattgggcatcactgttaacgccgtaaacccaggtccaacagattctacatggatgacagatgaaataagaaattttctttcacctaaatttccaatggggcgtattggcacaccagatgatgcagcacgaatgattgcctttcttgcaagtgatgaggctgaatggataactggacaaattattcattcagaaggtggatttattcggggctaa

SEQ ID NO: 41388 - DNA, 2958 bp, Bacillus subtilis
atggctggcaagaaaacaatcacaataaacggcgttgaaatggaagcgtccgaggaacagacggtgctgcagcttttgaataacagctcgattgaagtgccgcaagtttgctatcatccaagcttagggccgattgagacatgtgatacgtgcatcgtcagcatcaatggtgagctgaagaggtcgtgctccgctgaattaaaggatggggatgtcattgatacgctctcacctgacgtgaaaaaagcgcaggtcatcgggatggacaagattttatataatcatgagctttattgtacagtttgcgattacaacaatgggggatgcgaaatacataatacggtgaaggaaatgaaaatcaatcaccaaagcattccgtttgatcacaagccataccataaggatgaatcccatccgttttatcggtatgatccagatcaatgtatattgtgcggacgctgtgttgaggcatgccaagacgttcaggtaactgaaacgctgaccattgactgggagcggaaacgcccgcgcgtcatttgggataacgacgtgccgatcaatgagtcgtcatgtgtgtcatgcggccattgttcaacggtctgtccgtgcaacgcgatgatggaaaaaggaatggaaggggaagccggatatttaacaggcatcaataacgaaacgctgcgaccgatgatcgagatcacgaaaggcgtagagacaggctacggctcgattctcgcgatttctgatatggaatcggccatgcgtgatgaacgaatcaaaaaaacgaaaaccgtctgcacgtattgcggcgtcggctgcagctttgatgtctggacaaagggcagagacattctgaaagtagagccgcaggaggaagcgcctgccaacggcatttctacttgtgtgaaaggcaagttcggctgggatttcgttaacagcgaagaacgcctgacaaagccgctgatccgtgaaggcgatcatttccgtgaagcagagtgggaggaggcgttattgctgatcgccagcaagttcactgaattaaaagaggcgtttggcccggattctctcgcttttattacatcttctaaatgtacaaatgaagaatcctatcttatgcaaaagctggccagaggggtcattggcacaaataatgtggacaactgctctcgctattgccaatctcctgcgactgccggcctgttccggacagtcggctatggcggtgattcaggatcaattacagatatcgcgcaagcggaccttgttttgattatcggttcgaacacgtctgagtcgcatccagtcttatccactcggattaaacgggctcataagctgagagggcagaaagtgatcgtcgcggatatcagaaagcacgaaatggcagagcgctcagatttatttgtccagccgcgtgccggatcggatatcgtctggctgaatgcgatcgccaaatatttaatagaaaacggcaaggccgatgaacgatttttgagagaaagagtgaacggacgggatgaatatgtaaaaagcctcgcgccgtacacacttgaatatgctgaggagaaaaccgggattgatcaagaaacccttatccaaatggcagagatgatcgggcaagctgacagtgtgtgcgcattgtgggcgatgggcgtgacacagcatattggaggaagcgacacgagcacggcgatctctaatctgctgcttgtgacaggaaactacggaaaaccgggagcaggttcttacccattgcgcggccataacaacgtgcagggagcaagtgactttgggagtatgcctgacagactaccgggctatgaaaaagtgacggacgaacaagtccgccaaaaatacgagcgtgtgtggggtgtgccgctgccgaaggagccgggtatgaccaaccacgaaatgattgaaaaaatccattccggacagttgaaagcgatgtatgtaaaaggtgaagaaatgggccttgtcgactccaatatcaatcatgtacacgctgcatatgaaaagcttgatttctttgtggtgcaggacattttcctttcacgtacagcggagtttgctgatgtggttcttcctgcgagcccgagccttgaaaaagaaggaacgtttacaaacacagaacgccggattcagcgtttgtatcaggtatttgaaccgctgggtgaatcaaagccggattggcagattattatggaggttgccaataagcttggcgccggctggctctatgagcatcctgcagacattatggaggaagcagccaagctgtcgccgatttatgccggtgtcacctatgaacgtcttgagggctataattccctgcaatggcctgtaaacgctgatggaaaggattcgcctttactctttacagagcgcttccctttcccagacggcaaggccattctctaccctgtccagtggacagagcctaaggaattcggtgaggaatatgatatccatgtcaacaatgggcggctcttggagcacttccacgaagggaacctgacttacaaatcaaaagggatttcggagaaaacaccggaagtgttcttagaaatttctcctgagcttgcggcagaacgagggattcaggacggaaccctcgtcagactcacatcgcctttcggaaatgtcaaagtgaagtgcctgattactgatcgagtcaaagggaaggaagtatatctgccaatgaacgattcaggggaagcggcgatcaacctgttaacaggcagccatgccgataaggataccgatacgcctgcttacaaagaaacatcggccaagatggaaattttgaagcacgacggaatcagcccgctgcctaagatcaaccaccgcaacggcaatccgcagccgcaaatcggtgtgcaggttcataagaaatgggcgcggaaggattatattttccctggtgacgctgtgaaaagggggatgggccataatggctaa

SEQ ID NO: 41389 - DNA, 753 bp, Bacillus subtilis
atggaagcaaacgatcaaacacaaaacataccagccatctccttcagatcagtcagaaaaagctataaacaagatggacaaacctatgatgtgctgcaggatgtcaccggagacattcaacagggtgcaatcgtagccgttttaggcccttccggctcaggcaaaagcaccctcctttctatgtgtaatttaatgagaacgcctgacagcggcgaagtcaacatatacggaaaggaagtcagagaatggaatgtcaatgagctgaggcgaacggcagccctcgcgtttcaatcggctcccgtgctcgacgggacagtgcgtgacaatttaagtcttgtacaaaggctgcatcaatcccagctgtactctcctgaaaagctggcttcgcttgcagggctgccgccagagttgttagacagaagcgccagagacttatcgggcgggcagcggcaaagactgtcactggccagaacgctctcaaatccttcctccattctattgttggacgaaatcacatcggccttggacccggtctctgctcttgagattgaagaactgatcaaacgtcagcatcaagagaaaaaatggacagtcatgtgggtcactcataatatggagcaggcaaaacgaatagccgataccatttggtttatggcagatggccggctgcttgaaatcgctgaaaccgacacatttttctccgctccgcagcatgaagcagcgaaagaatttttgaagggaggcactcggtaa

SEQ ID NO: 41390 - DNA, 1014 bp, Bacillus subtilis
ttgaaaacgataacaattgcagctgaagaagcaaaggaactcgtttggcaaaagctggacggtgccggtttgaatgaacgagatgctgaaaaagtggcagatgttctcgtgcacgctgatttgcgcaatgtacattcgcatggcgtgctgcacacagaacactatgtgaacaggcttttagcgggagggatcaatcctggggcacagcctgtttttaaagagacggggcctgtgaccggggtgcttgacggagacgatggtttcggtcatgtgaattgcgacatggcgatggaccatgcaattgacatggcgaagaaaaaaggagtcggcatggtcacggccgtaaacagcagccattgcggagcgctaagctattttgtgcaaaaagcggctgacgaaaagctgatcggaatggcaatgacgcatacagacagtatcgttgtcccatttggggggaggactcctattttagggacaaatccgattgcttacggagttccggctaagcataaaaaaccgtttatcctagatatggcgacatccaaagtggcttttgggaagattctgcaggcccgtgaagagggcaaagaaattcctgaaggatggggagtcgatgaaaacggagaagcagtaactgatcctgacaaggtcgtctcactttcaacattcgggggcccgaaaggctatggactatcgattgtagtggatgtgttttccggattgctggcgggcgcggcttttggccctcatattgccaaaatgtacaacggccttgatcaaaaaagaaagctggggcattacgtttgcgcgatcaatccatccttttttactgactgggatacgtttttagagcagatggatgccatgattgatgaactgcagcaatcaccgccggctgttggattcgaaagagtgtatgtgcccggcgagatcgagcagctgcatgaagaaagaaataagaaaaacggaatttctatcgcccggagcgtgtatgaattcttaaaaagcaggtga

SEQ ID NO: 41391 - DNA, 1020 bp, Bacillus subtilis
atgaaagcggttcaagtgcgaaaagcgtatgatctggtgacagcggaggtgaagaagccagttctttcaaaggatgatgaagtgctcgtgaaagtcaagcgagtcggcatttgcggttcagacatgcacatttatcatggaacgaatccgctcgctaccctcccgagagtcatcggacacgaggtaacgggacaagtggaggcagttggtgcgaatgtacagagcctaaaacccggtgatcatgtggtgattgagccgatttcttattgcggatcgtgctatgcctgccgcaaagggcggccgaatgtttgcgccaagctttctgtatttggcgtacatgaggacggaggcatgcgggaatatattgtgcttccggaaagacagcttcacgcggtctcaaaggacttgccttgggaggaagcagtcatggccgagccttatacgataggcgcccaggcagtgtggagaggccaggtggaaaaaggtgataccgtcctgatccagggagcggggcccatcgggatctgtgtgttaaaaatggcaaaactggcgggcgctgctgtcatgatgactgacttgaacaacgagcggctggcatttgcgaaagaaaacggcgccgatgctgttgtaaatgtccaagcagaacatgttgccgagcgggtccttgaatggactgggaatgaaggagcaaacgtggtcattgatgctgtttgcctgccggagacttttgcactttcaattgaggctgtgtcaccggcgggacatgtggttgtgcttggatttgatgaaagagcggctcagatttctcagctgccaattacaaaaaaagaagtcacgataaccggatcccgattgcagaccaatcagtttccaaaagtggtagagcttttgaatggaggccggttaatgcataacgggctggtgacccatacattttcagttgatgacgttcatcatgcatttcagtttattaaggagcatccagatcaggtgcggaaagccgtcatcacgtttgattaa

SEQ ID NO: 41392 - DNA, 837 bp, Bacillus subtilis
atgatcccgctgcatgagaacctggctggtaaaacggctgtcatcactggcggcagcggcgtgctttgctctgcgatggcccgggagctagcccgtcatggcatgaaggtggcgattttgaatcggacggctgaaaaaggccaagcggtcgtgaaggagataacggcggctggcggcacagcgtgcgctgttgctgcggatgtgctggacaggatgtcactggagcgggcaaaggaagacatccttggccaatttggcgctgttgatctgttaattaacggggctggcggcaatcatcctgacgcgataaccgatgtggagacatatgaagaagcgggagaaggccaatccttttttgatatggatgagaggggctttctaactgtattctccaccaacttcaccggtgcgtttctggcctcgcaagtgtttggtaaagaactgctgaaggcggattcacccgcgatcatcaacctttcttccatgagtgcttattcacctatgacgaaggttccggcatacagtgctgcgaaagcatccatcaataattttacgatgtggatggctgttcattttgccgaaaccgggctgcgggtcaatgcgattgccccaggcttctttctgacaaaacaaaatcatgatctgctgatcaaccaagacggaacgttcaccagccgatctcacaaaattattgcgggaacaccgatgaagcgcttcggaaaaccggaggatttgctcggtacgctcctttggctggcggatgaatcctattccggttttgtcactgggatcaccgttcctgtcgatggaggatttatggcttattcaggtgtgtaa

SEQ ID NO: 41393 - DNA, 819 bp, Bacillus subtilis
atggaacagattggattgattggatatggcagcatggcggatatgatcgctagacagctgttgaaacatgaacaaataaaagagaatgagctatttattgagacgagaacgaagggggagcggctgcgggcactcatgtcagattatccaaacgtatcggctgatccgttggagaattgggcaaatacgtgccaattgattttgatatgcgtcccgccactccatgtcatcgaaacaatgcgccgtctgtacccgtatgtgaacagaaatactcacatcgtatccatagctgccggtgtgccgctgcgtcttttggaggcagaaacagaagccggtatctcacgtgttattcctgccattacgtccgaagcagaagccggcatctcacttgtcgttcacagtgaagcactggctgcagagaaaaaagaacgtctgaatgaattgttatcggttttcagccgtgtacgggaaatcaaagaatcgaatttagatgtggccagcaatttaacgagctcggcaccgggattcatagctgcaatctttgaagaactggcactgtctgccgtcagaaacagcagcctgtccaaagaagaagcctttgattttctgattcattcgctatacggaactggcaagatgctgatcgaaaaaaatatgtctttcgaggagacgctggaacgtgttgcaaccaaaggcggaataacgggagagggagctgaggtgatacacgcctctgtgccggacgtttttgatgaggtatttgaaagaaccctgagaaaatatgaactgcttacagaacaggttggtaaacaaacatga

SEQ ID NO: 41394 - DNA, 1248 bp, Bacillus subtilis
atgagtgaagtttctgtaaaagcgaagctggcgaaagaagcagcagccgaaatgatcatgaaaacaacagccgagaaggatgaggcgctcagcctcattgcaaacggactccgcaaagaactggattttctcttggcggagaatgcaaaagacattgtgaacggaaaagagaatggtttaacaccggacatcattgaccgtctctcattggatgagaaacggatacgcgatatcgcggacgcggtggagctcttaatcgacttagcggacccaatcggcgactctcttgaaacgattgaaaaagaaaacggcctgtttattgaaaaaatccgtgtcccgctcggtgtcgtaggaatgatttatgaggcgaggccaaacgtcacagttgatgcggctaccctttgcctgaagacagggaacgcggttgtgctgcggggaagctcctcagccatccacagcaacaaagcgctcgtcagtgtcatttacagagcacttgagcaatcagcgcttccgattcacgctgtgcagctgattgaggatacgagcagagagacagcaaaagagctctttacgttaaatgatggcttagacgtattgattccgcgcggaggcaagaaactgattgatctcgttgtgagagaatcaacagttcctgtattagaaacgggagcaggaaactgccacatattcattgacgaaacagccaaaccgcaaatggcagaaaaggttgttgtaaatgccaaaacgcagcgcccttctgtatgcaacgcgattgaatcattgctgattcacaaggcttgggcaagacagcacggaaaagaattgctggaccagctggaaaacgcgggagttgaaattcgcggtgatgaattggtatgtgaacttcatccttcaagcaaacaagcatcaaaagaagattgggaaaccgaatttttagcgcctgtcctcagcgtaaagacggttgaaaacgtccaagaagctgtaaagcatatccaacaatacggcaccaatcattctgaagcgattttaactgaaaatgacaaaaatgcggtatattttcaaacggctgtcgatcgtgccgctgtctatcataacgcgtcaacccgctttaccgacggctttgaattcggctacggagccgaaatcggcatcagcacgcaaaagcttcatgcaagaggaccgatggggcttcctgcactgacttctacaaaatacatcattaaaggaactgggcaaatccgtgaatag

SEQ ID NO: 41395 - DNA, 2289 bp, Bacillus subtilis
atgacaaccatcaaaacatcgaatttaggatttccgagaatcgacctgaaccgggaatggaaaaaagcacttgaagcgtattggaaaggcagtactgataaagatacgtttttgaagcaaatcgacgaactatttttatccgcagtaaaaacacaaattgaccagcagattgatgttgtgcctgtttctgatttcacacagtatgaccatgtactcgacacagcagtcagcttcaactggatcccgaaacggttcagacatttgactgacgctaccgatacatacttcgctatcgcccgcggaatcaaagacgctgtatctagtgaaatgacaaaatggtttaatacaaattaccattacatcgttccggaatatgacgagagcattgagttccgtctgacaagaaacaaacaactcgaagattatcgccggatcaaacaggaatacggtgtggaaacaaagcctgtgattgtcggcccttatacgttcgttacgcttgctaaaggctatgaaccgtctgaagcaaaagcgatccaaaaacgccttgtgccattatatgtacagcttttgaaagagcttgaagaagaaggcgtaaaatgggttcaaatcgatgagccggcgctcgttaccgcctctagtgaagatgtacgcggcgcaaaagaattatttgaaagcattacaagtgagctttcatccttgaatgtgcttttgcagacgtattttgattctgttgatgcttatgaagagctgatctcttacccggttcagggaattggccttgatttcgttcacgacaaaggcagaaacctggaacagcttaaaacacatggcttcccgacagataaagtgctggcagccggcgttatcgacggacgcaacatttggaaagcggaccttgaagagagtctcgatgccgttcttgatgttctcagcattgcaaaagttgatgaactgtggattcagccttccagcagcctgctcgatgttccagtagcgaaacaccctgatgagcatttggaaaaagacctattgaacggattatcctacgcaaaagaaaagctggccgagctgacagctttgaaagaaggcttagtatcaggaaaagcggcgatcagcgaagagattcagcaggctaaggctgatatccaggcgcttaaacagtttgcaacaggcgccaattctgaacaaaagaaagagcttgagcaattaactgataaagacttcaagcgcccgattccgtttgaagaacgtttagccctacaaaatgaatctctcggccttccgcttttgccgacgacaacgatcggcagcttcccgcagtctgctgaagtgcggagggcacgccaaaaatggcggaaagctgagtggtccgatgaacagtatcaaaactttatcaatgcggaaacaaaaagatggattgatattcaggaagaattggagcttgatgtccttgttcacggcgaatttgaacggacagacatggtcgaatacttcggtgaaaagctggccggtttcgccttcactaaatatgcctgggttcaatcatacggctcacgctgtgtccgcccgccagtcatttacggagatgttgaatttattgaaccgatgacagtgaaagacacagtctacgcacagtcattgacttccaagcatgtgaaaggaatgctgacgggcccggttacaatcttaaactggtctttccctcgaaacgacatctcgaggaaagaaatcgccttccaaatcgggcttgcccttcgcaaagaagttaaagcgcttgaagacgcaggcattcaaatcattcaagtcgatgaaccagcgctgcgtgaaggccttccattgaaaacccgcgattgggatgagtatttgacttgggcggcagaagctttcagattaaccacttcttccgtgaaaaacgagacacaaattcatacacatatgtgctacagcaacttcgaagatatcgttgatacaatcaatgatcttgatgccgatgtgattacaatcgaacatagcagaagccacggaggatttttagattacttaaaaaaccacccgtatttgaaagggcttggccttggtgtatatgacattcacagccctcgtgtgccgtcaactgaagaaatgtacaatattatcgttgatgcgcttgccgtctgtccgactgaccgcttctgggtaaatccagactgcggattgaaaacaagacagcaggaagaaacggttgcagcattgaaaaatatggttgaagccgcaaaacaggcaagagcacagcagacacagctagtataa

SEQ ID NO: 41396 - DNA, 498 bp, Bacillus subtilis
atgaactactatacgacagccgaaacgccgctcggtgaacttatcattgccgaagaggaggaccggatcactcgtctatttctcagtcaggaagattgggtggattggaaagaaacggttcagaatactgagcataaggaaacacctaatcttgcagaagcgaaacaacagcttcaagaatatttcgcaggcgaaaggaagacattctccctgccgctcagccaaaagggcactccttttcagcaaaaagtgtggcaagcgctggagaggattccatatggcgaatcccgaagctatgcggatattgccgctgctgtcggcagtccgaaagcggtgcgcgctgtcgggcaggctaataaacgtaacgacctgccgatttttgtcccgtgccacagagtgatcggcaaaaacagtgcgttaacaggatacgccggaagcaaaacggagatcaaagcatttttgctaaacatcgagcgaatctcctataaagaaaaataa

SEQ ID NO: 41397 - DNA, 2100 bp, Bacillus subtilis
atgcgttgtcaacattgtcatcaaaacgaggcgacgattcgccttaacatgcaaataaattccgttcataaacagatggttctttgtgaaacttgctataacgaactgacccgtaaaccttcaatgagtatgggtcctcaatctttcggatttccgtttgaacaggcattccagccgaaagaacagagcgcagcaaaacaaagcgaaaaaaaagggttgcttgatgagctggctcaaaatattacaaacggtgcaaaagccggtctcattgatcccgtcatcggccgtgatgatgaagtggcgcgagtgatcgaaattctaaaccgccgaaacaaaaacaatccggttcttattggtgagccgggtgtagggaaaactgccatcgctgaagggctcgctttaaaaattgctgaaggtgatgttccaaacaaactaaaaaacaaagagctatacttgcttgatgttgcatctcttgttgcaaacacagggatcagaggccaatttgaggagagaatgaaacagctgatcactgagctgaaggaacgaaaaaatgtcattctgttcattgatgaaattcaccttctcgtcggcgcaggctctgcagaaggatcaatggacgccggcaacattctcaaaccggccctagccagaggcgaactgcaagtcattggcgcgacaacactgaaagaatatcgtcaaatcgaaaaagatgccgcgctggaaagacgttttcagcctgtcatggtgcaggagccttcaattgaacaggctatcctcattctgcaagggattaaagacaaatacgaggcgtaccatggcgtaacattcagtgatgaagcaatcaaagcatgtgtcactttatcatcccgctacattcaggacagacacctgccggataaagcaattgatttattagatgaagcaggttcaaaagccaacctgttaattgatgaactgaatgatgaggatgccgctgaacgcttaactgcaattgaagccgaaaaaacaaaagccctggaagaagaaaattacgaactggcggcaaaactccgtgatgaagaactcgcattggagaaaaaactgaacagctcctccgctcataccgctgtcactgtggaagctgagcacattcaggaaattgttgaacaaaaaacaggcatccctgtcggcaaactgcaggcagacgaacaaacgaaaatgaaagaactcgaagcaaaacttcatgaacgcgtgatcggacaagaagccgctgttcaaaaagtggcaaaagcggtaagacgaagccgcgccggattaaaatccaaaaacagaccagtcggctccttcctcttcgtcggtcctaccggcgtagggaaaacagagctttctaaaacactggcagatgaattattcggcacaaaagacgctattatccgactcgatatgagcgaatacatggagaaacacgccgtatctaaaattatcggttcaccgcctggatatgtcggccatgaggaagctggacaattaactgagaaggtgcgccgcaatccttacagcattgtgttgctggatgagattgaaaaagcacacccagacgttcagcatatgttcctgcaaattatggaagatggccgtctgacagacagccaaggcagaactgtaagcttcaaagacactgtgatcatcatgacaagtaatgcgggtgctggtgagaaacaaacgaaagtcggtttccaatcagatgacagtgtcatcgaagaacaaacattaattgattcactgagcatgttctttaaacctgagttcctcaaccgttttgacagcattattgagttccgctcattggaaaaagaacatcttgtcaaaatcgtcagccttcttcttggagaacttgaagaaacattggcggaacggggcattagcttgaatgtgacagatgaagcgaaagaaaaaatcgctgagctgggctaccacccttcattcggtgcacgtccgcttagaagaaccatccaagaatgggttgaggatgaaatgaccgatctgctgcttgataatggcgagatcacaagttttcacgtgattttagaagatgataaaatcaaagtgcgagcaaaataa

SEQ ID NO: 41398 - DNA, 747 bp, Bacillus subtilis
atgggtaaatttgaaggtaaaatagcgcttgtaacgggtggaacaagtgggattggtcttgctacagcacaaaaatttgtaaacgaaggtgcatatgtttatattacgggacgtagacaaaacgaacttgataaagctgttaaccaaattggcaagaacgtaaccggtgttcaaggtgatatttctaagcttgaagacttagacaaactatatgacattataaagcaggaaaaaggtaagttggacattctttttgctaatgcaggcatcggcaacttccttccattaggtgaaattactgaagagcaggttgatagaacgttcgacattaacgttaaaggaaccatctttactgttcaaaaagcgttatcactattcccggacaaagtaggttctattattgtaacgggctctactgctggatcaattggcaacccagcgtttagtgtatatggagcatctaaagcagcattaagagcactagttcgcaactggattcttgacctaaaaggtactgaaatccgtgtaaatgtggttagtccaggaggtattcttacacctgcctacgatgagctttttggtgatgcacttgaagaggtactggaaaatagcagaaatactgttccagctggaaaagttgggacacctgaagaagtagcaaacgctgtatctttccttgcttcagacgaaagcagttacttgacgggtgttgaattgttcgtagatggcgggctagcacaggtataa

SEQ ID NO: 41399 - DNA, 1914 bp, Bacillus subtilis
atgaatgaacaagttatcgttcaacgcgacccgcatgagccattgaaaacagacaagagggaaaaaaactgggcacagcacgcggagcttattgcagcacttgtatcaggcgctcttattttggcaggctggctcttatccggatatcaggtattatccataatacttttcttgctggcttttgtgatcggcggatttgctaaagcgaaggaaggaatcgaagaaacactcgaatccaaaacgctgaatgtagaacttttaatgattttcgctgccattggttccgccttgatcggatactgggcagagggtgctattttaatatttattttttccttaagcggagctttagaaacatacacgatgaataaaagcagcagagatttaacgtctttaatgcagcttgagcctgaagaagcgacattgatggtcaatggtgaaaccaaaagagttccggtttcagacttgcaggccggtgatatgattgtgatcaaacctggagaacgcgtagcggcagacggtatcattgaatcgggctcgacaagtcttgacgagtcggctttaacaggtgaatcaatgcctgtagaaaaaaacacaggcgacactgtattcacaggaacggtgaatcgcaatggctccttgacagtccgtgtcacgaaagcaaatgaagattcgttattcagaaaaattatcaaactggttgaatcagcgcaaaatagtgtttcacccgcgcaggctttcatcgaacgatttgaaaatgcttatgtgaaaggtgtgctaattgcggtggcgctccttttattcgtcccgcactttgcgctgggctggagctggagtgaaaccttctaccgcgcaatggtgtttatggttgtcgcgtcaccttgtgcgcttgtcgcctctattatgccggcggcgctgtccctgatttcaaatggcgcccgcaacggtatgcttgtgaaaggaagcgtctttcttgaacagctgggctcagtgcaaatgatcgcctttgataaaaccggaactgtaacaaaaggccagcctgccgtagagacgatcagaatagcagaaggattcagtgaagcggaagttcttgaggctgtctatgccatcgaaacgcaatcaagccatccgctcgcccaagccataacggcgtacgctgaaagccgcggcgtgaatcagtccggctacatatctatagaagaaacctcagggtttggcgttatggcagaagtgtcgggtgcgaaatggaaggtcggtaaagcaggttttatcggcgaggaaatggcagcacaatttatgaaacaaacagcatcagatgtcattcaaagcggtcatacaattgtatttgtgaaaaaggatgatcaaatagcaggctgtatcgcactgaaggaccaaatcaggcctgaagcaaaagaggtcatggaagaactgaaccgacttgggattaaaacggccatgctgacaggagatcacgaagacacggctcaagcgattgccaaggaagccggcatgacaactgtcgtggcagaatgcctgcctgaccaaaaagtgaatgaaatcaaacggttaaaagaagaattcggaacgattgcaatggtgggtgacggaatcaatgatgcgccggcactcaaagcagcggatgtcggcattgcgatgggcggcggaacagatgtagcacttgagaccgctgatatggtcctcatgaaaaacgatttgaaaaagctcgtaaacatgtgccgcttgtctcggaaaatgaacaggatcatcaaacaaaatatcgtgttttctctagctgtaatctgcctgctgatttgtgcaaactttttgcaggcgatggaattgccatttggcgtgattggtcatgagggcagcacgattttagtcatactaaacggtttaagactcctaaaataa

SEQ ID NO: 41400 - DNA, 1653 bp, Bacillus subtilis
atgcaagaattaaaagggattggtgcttcagccggcatcgcgattgcaaaagcgtaccggcttgaagagccagatttaacggttgaaaagaaaaacatctctgattctgaagcggaagtaagccgttttgatgaagcgattgcacgttcaaaagaagagctcgaaaaaatcaaagagcacgctttgaaagaactgggtcagcctgtgaaagaaaaaatcagcactgattcagtgaacgctgaattcgctttaaaagaaacgtcttctatgttcgttactatgtttgaatctatggacaacgaatatatgaaagagcgtgcggcagatatccgcgatgtaacaaaacgcgtaaccggccacctgcttggcgtcgaaattccaaacccaagcatgatctcagaagaggttattattgtagctgaagacttaacaccgtctgacacagctcaattaaaccgtgagttcgtaaaaggattcactactgatatcggcggacgcacatctcactctgccatcatggcacgttctcttgagattccagcagttgttggaacgaaagctgctacaggcacgatccaaaacggcgtgactgttatcgttgacggtatcaatggcgatgtcattattgacccatctgcggaaactgtaaaagagtatgaagaaaaacataatgcttatttggctcaaaaagctgagtgggcgaagcttgtcaatgaaccgactgtctcaaaagacggacatcatgtagagcttgcagcgaacatcggtactcctgatgatgtaaaaggtgttcttgaaaacggcggagaagcagttggcctttaccgtacagaattcctttacatgggaagagatcagctgcctacagaagatgagcagtttgatgcttacaaaacggttcttgagcgtatggaaggaaaatcagtcgtcgtgcggacacttgatatcggcggagacaaagagcttccttacctgcagcttcctaaagaaatgaacccgttcctgggatatagagcgattcgtctttgccttgaagagcaagaaatcttcagaacacagcttcgcgcgctgcttcgtgcaagtacatacggaaacttgaaaatcatgttccctatgattgcgacagttaacgaattcaaagaagcaaaagcgatccttcttgaagaaaaagaaaagctcgtaaaagcgggacaggctgtatctgacgatattgaagtcggaatgatggttgagattccgtcaactgcagtcatcgctgatcagtttgctaaagaggttgatttcttcagtatcggaacaaacgatttgattcaatacacaatggcagctgaccgtatgaatgaacgtgtatcttacctgtatcagccatacaacccggcaatccttcgcttaattacactggtaattgaagcagcacacaaagaaggaaaatgggttggcatgtgcggagaaatggcaggagacgagattgcgattccgatccttctcggcttaggcttagatgagttctcaatgagcgcaacgtctatccttccggcaagaacacaaatcagcaaattgtctaaacaagaagctgagtcattcaaagagaaaatcttatctatgagcacgacagaagaagttgtcgcgttcgtaaaagaaacattcaagtaa

SEQ ID NO: 41401 - DNA, 1179 bp, Bacillus subtilis
atggaacatttgctgaatccgaaagcaagagagatcgaaatttcaggaatacgcaaattctcgaatcttgtagcccaacacgaagacgtcatttcacttacaatcggccagcctgattttttcacaccgcatcatgtgaaagctgccgcaaaaaaagccattgatgaaaacgtgacgtcatatactccgaatgccggctacctggagctgagacaagctgtgcagctttatatgaagaaaaaagcggatttcaactatgatgctgaatctgaaattatcatcacaacaggcgcacaagccattgatgctgcattccggacgattttatctcccggtgatgaagtcattatgccagggcctatttatccgggctatgaacctattatcaatttgtgcggggccaagcctgtcattgttgatactacgtcacacggctttaagcttaccgcccggctgattgaagatgctctgacacccaacaccaagtgtgtcgtgcttccttatccgtcaaaccctaccggcgtgactttatctgaagaagaactgaaaagcatcgcagctctcttaaaaggcagaaatgtcttcgtattgtctgatgaaatatacagtgaattaacatatgacagaccgcattactccatcgcaacctatttgcgggatcaaacgattgtcattaacgggttgtcaaaatcacacagcatgaccggttggagaattggatttttatttgcaccgaaagacattgcaaagcacattttaaaggttcatcaatacaatgtgtcgtgcgcctcatccatttctcaaaaagccgcgcttgaagctgtcacaaacggctttgacgatgcattgattatgagagaacaatacaaaaaacgtctggactatgtttatgaccgtcttgtttccatgggacttgacgtagttaaaccgtccggtgcgttttatatcttcccttctattaaatcatttggaatgacttcatttgattttagtatggctcttttggaagacgctggcgtggcactcgtgccgggcagctcgttctcaacatatggtgaaggatatgtaaggctgtcttttgcatgctcaatggacacgctgagagaaggcctagaccgtttagaattatttgtattaaaaaaacgtgaagcaatgcagacgataaacaacggcgtttaa

SEQ ID NO: 41402 - DNA, 765 bp, Bacillus subtilis
atggaaaaaaaggcggtaattattaccggcgggtcaagcggcatgggaaaagcgatggcaaaaaaacaggctgaattagggtggcacgttatggtgacagggaggaaccatgaggcacttgaggaaacaaaaaaagaaattcagacctttgagggacaggtcgcttgttttcaaatggatgtccgttccgattccgccgcttcagacatgattaaagaagcggtaaaagcctttggccggcttgacgcgctgattaacaacgcggccggaaactttatttgtccggcagaaaagctgacgcccaatggatggaaagccgttattgagattgttttaaacggcacatttttttgcagccaagcagcggcaaggcattggattgaccagaagcagcagggtgtcattttaaatatggcagccacgtacgcttggggagcgggagcgggggtcgttcattccgctgcagccaaagcgggggtattgtcattgacaagaacgctggccgttgaatgggggagcaaatacggcattcgtacaaacgcgatagcccccggaccgattgaacgaacaggcggtgcggagaagctatttgaatcggaaaaagcgatggcccgcacgatgaacagtgtgccgctcggccgattgggcacaccggaggaaatcgccgctttggcagcgtttttgctttctgatgaagcatcctatataaacggggattgtatcacaatggacggggggcaatggctgaatccttatccgttttaa

SEQ ID NO: 41403 - DNA, 543 bp, Bacillus subtilis
atggcagaacgtatggtaggtaaacaagctcctcgttttgaaatggaagcagtccttgcaagcaaagaattcggcaaagtaagtcttgaggaaaacatgaaaaacgacaaatggacagtgctgttcttctatccaatggacttcacttttgtttgtccgacagaaattacagcaatgtctgaccgctatgacgagttcgaagatcttgatgcagaagtcatcggggtttcaactgataccatccatactcatttagcttggatcaatacagaccgcaaagaaaacggtcttggccagctgaaatacccgcttgctgctgatacaaaccatgaggtatcccgggaatatggcgttttaatcgaagaagaaggtgtggctttgcgcggattgtttattattaatcctgaaggggagcttcaatatcaaactgttttccataacaacattgggcgtgatgttgatgaaacgcttcgtgttctccaggcgctgcaaactggcggactctgtccggctaactggaaaccaggccaaaaaacactttaa

SEQ ID NO: 41404 - DNA, 966 bp, Bacillus subtilis
atgaaaagatcaggtccttttttccacgacgtgtctcaggagaacctttatttaaaatccgagctttcaaggtgccataagctgatttctgaacttgaagcaagctactttcatcagaaaaataacaaactgctcaaagaaaataccgatatgaaagaaaaactccagcagctgtctgccgaattaacacatatgtcaacaaaagaaaaacatgcctcccacaccagccaaaccctgcaccaaataagagctgaactgcttgataaaatcgttgttttgcaggagcttctatctgctgaaacctataaacgcagagccgaaatcgaagaaaaacataaacttcatattgcgaaagtcaaaatcgaagaagaaaataaaaatcttcataaacggatcagcgaacttcaagcctcaattgagcaggaacaaaatgcactgcttcaggcaaaacagcaagccgaattgataaaagccgaaaacgggcgtctaaaagagcaaatggtagaaaaagaatatcagctaaaacatattaaaatagaagttgatcatatgaaagatcgaatcatagaaacgaaagaaagactgctagacatagaaaaaacgaaagaaaaattatttcacgaaactattatatcgtataaacggcaacttgatgaaagcgatgcctggattgcttctcattttgccgatattgatggcggcacgaaacaaaaagaaaaaacggaagaagaagctccagcggcctacgcgcagccaaatcatgtagagactatccttgaagatgtcaccaaacagatacatgtgcttcaaaaacagcttgcccacgcccaatcatcagaccaggccaagagccatacaatcgaagagctgaaaaacagagccgctgaagaaaagccttatcaaaagtgggtgtataagcttaatcttgaaaaagaaaacaaaccttcacagaaaaaacctcaataa

SEQ ID NO: 41405 - DNA, 1758 bp, Bacillus subtilis
atggagacatttaaaagattaaaaatgtattattggccgtacagaaaagtgtttatgtggtcgcttctagccatgcttttgatgactgcaattactgtcgtttatccgattatcctgcaaattacgattgatgagatcgtactgggacggcagtatcagcttgcggcgtgggtcagcttaggatttattgcggtgatggttttgaaaggaatggctaccttttttcatcagtatttaggtgatatgttcgggatcaaatccgtttatcggctgagaaatggtctgtatgaaaaactgcagcggctttctttttcttactatgataacgcgaaaacaggagatttgatgtccaggctgactgctgatgttgaagggcttcgttttttcttatcatacggtctcgctgagctcattcgcttcggcctgctggtagccatcagcctgtcggttatgttttactattctgttcctctcacgcttgtgacaatagctgttctgccatttctcgcggttgcggtataccggtttgacaaaagagtccatcccgccttcagaggcatccgcaaatcgtttgcgaaactcaatacaaaagttcaggaaaatatcagcggcattaatacggttaaatctctttccagggaagattttcagatcagcactttcaataaagccaatgcagaatacagggcgcagtatttacaaacatcatccatttggtctgcgtatttccctttaatggagttcattggtaacacttgtattgtagctcttctctcatacggcggttacttggttatgcaaaatcagctcaatcccggcgagcttgttgctttcttcagccttgtcaattatatgatgtggcccattatgaacttaggttttgtcatcaatatgttctctcaagcaaaagcgtcaggggaacgcctgctcgacattctggaaaaagaagaagacattacagatcatcctcatgctttgcataaacaaaaattaaccggagatgtccatttcaaaaatgtttctcttgcatacggaaaagaacaaacaaacgcgctgtgcaatgtaagctttgaggcaaacagcgggaaggtaatcggactgttgggcccgacaggttcaggcaaaagctcagtgacacagcttctcaccagattttacagtcctgttggcggaatgattaccattgatcacaaacccatcacagattattcgttaaaaacccttcgctccaatatcggggtcgtacttcaagaatccttcctgttttcatctacgattagatcaaatatttcgtatgggcggccggatgcctcaatggaagacgtcatcgaagcggcaaaaagggcgcaggctcataactttattatggagcttcctgatgggtatgacaccatgctgggagagaggggaatggggctttccggcgggcagaaacagcgtattgccattgcgagagccatctgcttgaacccgagcattttaatattggatgatgccacaagcgcagtagatatgcaaacggagcacagcatacagcttgccttaaaagaagtcatgaaaaaccgcacaacctttatcgtcgctcaccgcatttcttcactgaaacacgctgatgaaattctcgtttttaataaaggacgcattcgtgaaaggggaacacatcatgagcttcttgaaaaaggcggctactataaaaagatttacgatttgcaataccgtgatgtcaaaatgattaatgagccgcatgaggtcggatag

SEQ ID NO: 41406 - DNA, 1116 bp, Bacillus subtilis
atggctgcaaaaacgaaaaaagctatcgttgacagtaagaagcaatttgatgccattaaaaagcagttcgaaacgttccaaattttaaatgaaaagggagaagtcgtgaatgaagcggcgatgcctgatttaactgatgatcaattaaaagagctaatgcgccgcatggtatttacgcgtgtgcttgaccaacgctctatctcattaaaccgtcaaggacgtctcggattttacgctcctactgcgggtcaagaagcttctcagattgcaacgcatttcgcgcttgaaaaagaagactttgttcttcctggataccgtgatgtgcctcagttaatttggcacggccttccattatatcaagcgtttcttttctctcgcggacatttcagaggaaaccaaatgcctgatgatgtgaatgccctttctccacaaatcattatcggtgctcaatacattcaaactgccggtgttgcgctaggtcttaaaaaacgcggtaagaaagctgtcgcaatcacttacactggtgacggcggagcttctcaaggggacttctacgaaggaattaactttgccggagcttataaagcacctgcaatcttcgtggtgcaaaacaaccgttacgcgatttcaactcctgttgaaaaacaatctgcagctgaaacaattgcacaaaaagctgtagctgccggtattgtcggcgtacaagtagacggaatggatccgcttgctgtatacgcagcaactgctgaagcacgcgagcgcgcaatcaacggcgaaggtccaacactaattgaaacacttacattccgttatggcccgcacacaatggctggtgacgatcctactaaatatcgtacaaaagaaatcgaaaatgagtgggaacaaaaagatccgcttgtacgtttccgtgcgttccttgaaaacaaaggcttatggtctgaagaagaagaagcaaaagtgattgaggatgcgaaagaagaaattaagcaagcgatcaaaaaagctgatgctgaaccgaagcaaaaagtaactgatttaatgaaaatcatgtacgaaaaaatgcctcacaaccttgaggagcaatttgaaatttatacacagaaggagtcgaagtaa

SEQ ID NO: 41407 - DNA, 978 bp, Bacillus subtilis
atggcgcaaatgacaatgattcaagcaatcacggatgcgttacgcacagaactgaaaaatgacgaaaatgtcttagttttcggagaagacgttggtgtaaacggcggcgtattccgtgcgacagaaggattgcaaaaagaattcggtgaagaccgtgtgtttgacacgccacttgctgaatctggtatcggcggtcttgcccttggtttaggcttaaacggcttccgtccggtaatggaaatccaattcttcggatttgtttatgaagtaatggattcagtttctggccaaatggctcgtatgcgctaccgttctggcggacgctggacttcacctgtaacaattcgttctccattcggcggcggtgttcatactcctgaacttcacgctgacagcttggaaggtcttgttgcacaacagcctggtatcaaagttgttattccatcaactccttacgatgccaaaggacttttaatttctgcgatcagagacaatgatcctgttgtcttcttagagcatatgaagctttaccgttctttccgtcaggaagttcctgaagaagaatacacaattgagcttggaaaagctgacgtgaaacgtgaaggtactgatctttcaatcatcacttacggcgcaatggttcatgaatcattaaaagctgctgatgagcttgaaaaagacggcatttctgctgaagttgtcgaccttcgtacagtaagcccacttgatatcgatacaattatcgcctctgtagaaaaaacaggacgcgcgattgtcgttcaagaggcacaaaaacaagccggtattgctgcaaacgtagtagcagaaattaatgaccgtgcgatcctgagcttggaagcacctgtacttcgcgttgcagcgccagatacagtatttcctttctctcaagcggagagcgtatggcttccaaaccataaagacgttcttgaaacagcaagaaaagtgcttgaattttaa

SEQ ID NO: 41408 - DNA, 1329 bp, Bacillus subtilis
gtggcatttgaatttaaacttccagatatcggggaaggtatccacgaaggcgaaatcgtaaaatggtttgtcaagcctaacgacgaggtagacgaagatgatgtactggctgaagtccaaaatgataaagcagtagtagaaattccttcacctgttaaaggaaaagtattagaattaaaagttgaagagggaacggttgcaactgttggacaaacgattattacgtttgatgcacctggttacgaagatcttcaatttaaaggcagcgacgagtctgacgatgcgaaaactgaagcacaagttcagtcaactgcagaagctggacaagacgttgcgaaagaagagcaagctcaagagcctgcaaaagctactggcgcaggacagcaggatcaagctgaagttgacccgaacaaacgcgtgatcgctatgccttccgtacgtaaatatgcacgtgaaaaaggtgtagacatccgtaaggttactggttcaggcaacaacggacgtgttgtaaaagaagatatcgacagctttgtaaacggaggagcgcaagaagctgcaccgcaagaaacagctgcaccacaagaaacagctgctaaaccggctgctgcaccagctccagagggcgaattcccagaaacacgcgaaaaaatgagcggtatccgtaaagcaattgcaaaagcgatggttaactctaaacacactgctcctcacgtaacgttaatggacgaagtggacgtaacaaaccttgttgcacatcgtaaacagttcaaacaggttgctgctgatcaaggaatcaagctgacttacttgccttacgttgtaaaagctcttacatctgcactgaaaaaattccctgttttaaacacgtcaattgacgataaaacagatgaagtcatccaaaaacattacttcaacatcggtatcgctgctgacactgaaaaaggcttgcttgtaccggttgtgaaaaatgcagatcgtaaatctgtctttgaaatttctgatgaaatcaatggccttgcaacaaaagctcgtgaaggcaagcttgctccagctgaaatgaaaggcgcatcttgcacaattacaaacatcggttctgccggcggacaatggttcactccggttatcaaccatccagaagttgcgattcttggtatcggacgcattgcagaaaaagcgattgttcgtgatggcgaaatcgtagcagctccagtcttagctctttctctcagcttcgaccaccgtatgatcgacggagcaactgcgcaaaatgcattaaatcacatcaagcgtttactgaacgatccacaattaattttaatggaggcgtaa

SEQ ID NO: 41409 - DNA, 1413 bp, Bacillus subtilis
atggtagtaggagatttccctattgaaacagatactcttgtaattggtgcgggacctggcggctatgtagctgccatccgcgctgcacagcttggacaaaaagtaacagtcgttgaaaaagcaactcttggaggcgtttgtctgaacgttggatgtatcccttcaaaagcgctgatcaatgcaggtcaccgttatgagaatgcaaaacattctgatgacatgggaatcactgctgagaatgtaacagttgatttcacaaaagttcaagaatggaaagcttctgttgtcaacaagcttactggcggtgtagcaggtcttcttaaaggcaacaaagtagatgttgtaaaaggtgaagcttactttgtagacagcaattcagttcgtgttatggatgagaactctgctcaaacatacacgtttaaaaacgcaatcattgctactggttctcgtcctatcgaattgccaaacttcaaatatagtgagcgtgtcctgaattcaactggcgctttggctcttaaagaaattcctaaaaagctcgttgttatcggcggcggatacatcggaactgaacttggaactgcgtatgctaacttcggtactgaacttgttattcttgaaggcggagatgaaattcttcctggcttcgaaaaacaaatgagttctctcgttacacgcagactgaagaaaaaaggcaacgttgaaatccatacaaacgcgatggctaaaggcgttgaagaaagaccagacggcgtaacagttactttcgaagtaaaaggcgaagaaaaaactgttgatgctgattacgtattgattacagtaggacgccgtccaaacactgatgagcttggtcttgagcaagtcggtatcgaaatgacggaccgcggtatcgtgaaaactgacaaacagtgccgcacaaacgtacctaacatttatgcaatcggtgatatcatcgaaggaccgccgcttgctcataaagcatcttacgaaggtaaaatcgctgcagaagctatcgctggagagcctgcagaaatcgattaccttggtattcctgcggttgttttctctgagcctgaacttgcatcagttggttacactgaagcacaggcgaaagaagaaggtcttgacattgttgctgctaaattcccatttgcagcaaacggccgcgcgctttctcttaacgaaacagacggcttcatgaagctgatcactcgtaaagaggacggtcttgtgatcggtgcgcaaatcgccggagcaagtgcttctgatatgatttctgaattaagcttagcgattgaaggcggcatgactgctgaagatatcgcaatgacaattcacgctcacccaacattgggcgaaatcacaatggaagctgctgaagtggcaatcggaagtccgattcacatcgtaaaataa

SEQ ID NO: 41410 - DNA, 1473 bp, Bacillus subtilis
ttgtcgcaacatgaaacacccttatacacaggactgaaaaagcatgcaagcagacagcctgttcaattccacattcccggccataaaaaaggggcaggaatggacccagaattcagacaatttatcggtgaaaacgcgttaagcatagatttgattaatattgaaccattagacgatctgcacgcgccaaaaggcattattaaacaagcacaagatctggctgctgaagcatttggagcggatcatacatttttttctgttcaaggaacaagcggcgccattatgacaatggtaatggctgtttgcggacctggtgataaaattattattccaagaaatgttcataaatcaattatgacagctattgtattttccggagcggttccaatttttattcatcctgaaattgacaatgaattgggcatctcccacggaattacacttgaatctgctaaacgggcgcttaccgagcatccggatgcaaaagggcttctcgtcatcaacccgacatatttcggtgttgcagccgacttaaaaagcatcgtagaactcgctcattcgtttgatgtgccagtgcttgtggatgaagcacacggcgttcacattcattttcacgacgaattgccgctatcggctatgcaggcaggagcggacatagcagcgacaagtgtacacaagctgggcggatcactgacacaaagctctattttaaacatgagagaaggccttgtatctaaagacagagtgcaatccatcctgagcatgctgacaactacgtcaacttcttacttgcttctcgcttctttggatgttgccagaaaacgccttgcaacagaaggccgccagcttgctgaggaaacactcaagcttgccaatcagacgagagatcgcctcaatcagattgaaggcatttattgtgtcggttctgagattcttgggtcgaaagcagcttacagctatgatccgacaaaattgattatctctgtgaaaagtcttggcctgacaggacatgacgtggaaaaatggcttcgtgaatcctttaatattgaggtggagctttctgatctgtacaatattttgtgtattttcactcctggtgacagccaaaatgatgcagaccggcttgtagaggctttaactgagatcgcacagcaaatgtcagaacaagatgtaacacatcagcaaactgaggttctgcttccagaaatacctttattggcaatgactccgcgtgatgctttctatgcaaatacggaagtcatcccattaaaagaagcatccggacggattattgctgaatttgtcatggtatatccgcctggtattccaatcttcatcccaggagaaattattacagaagaaaacatcagctacatttttaaaaaccttgacgcaggcctccctgttcaaggacctgaggactcgactttacatatgatccgggtcatcaaagaacaaaaagcaattcaataa

SEQ ID NO: 41411 - DNA, 1524 bp, Xylella fastidiosa
atgaccattcacaatttcgacctactggtggtcggtggcggtatcaacggcaccggcattgcccgtgatgccgccggacgtcacctctcagtgtgtctgtgcgaacaacacgacctggcctcccacacctccagcgccagcaccaaactgattcacggcgggctgcgctacttggaatattacgaatttgcgttagtcagcaaagcattggccgaacgcgaaatcttgctacgccaagcaccgcacatcgtcagaccactgcattttgtcctcccacaccaaccccatctgcgccccacctggatgatccgcgcgggcctgctgctgtacgaccaccttggctttagccgacgcaccctgcctcgctcacgtcgcttgaacttggccaaacatcccactgggcaaccactcaaacaggagctgcacaccggcttcatgtattgcgacgcccaggtccaagacgcacggctagtcgtgctgaatgcaatggatgcagcacaacgtggcgcacgtatcctcacccgcacccgctgcgtgagaacgcgccgtgacggcgcacattggctgactgaactcgaagacgctcaaggaagacacgaacaaattcgtacacgggccatcgtcaacgccaccggcccctgggccgtcacgtttctggatcacatcgctcaacagccacatcagcacacactgcgtctggtgaaaggcagccacattgtggtaccccgtctgtttgaacatgagcatgcctatatcttccaacaaccagacagacgcatcgtctttgccattccttacgaacaacatttcacactgattggcactaccgacgtcgactacgtagctgatcccgcgaatccacacattgacgctgccgaaaccatgtacctgtgcaatgcagtcaatgcctatttcagacaacaaatcacaccggaagacgtcctctggagctacagcggagtccgtcccctactgaacgatggacacaacaatgcatcgaaagtcactcgtgactaccaattagaaatacttggaaacagcgcaccattactcaacgtgtttggtggcaaactcaccacctatcgcaagctttccgaagaagcagtgaaccagctatgcgtagcattggaccatccctaccgtgcctggactgccaatgggccacccctgcctggcggcgaacaccacgacatcgcagcgctacaaaacacactgcgccaacaccgcccatggttacccactgccactgcgcaacgcctgatacacaactacggcacctgtgccgaaacactgctcggcagtgccaccaacctacacaccctgggaattcactttggcgccgacctgtatcaagccgaagtggactacctgcgcacccacgaatgggcatgcagtgccgaggatatcctctggcgccgcagcaaactcggcctgcatttagatgcgcatggcacacagcgcctggaagaccatctacgctcctgctcacgcatccccgatcacgcggacacaacaacacaatga

SEQ ID NO: 41412 - DNA, 1551 bp, Xylella fastidiosa
ttgcgctgcaccaagaccacgcaccctgtccgtatcgaaaacactgcactgatgaaaaaaaaatacatactggccattgaccaaggcaccaccagctcccgggccattctgtttgaccaaaaaggccacatcgccgggatggcacagcgggaattcacccagatatttccccaacctggctgggtcgaacacaacccgcgcgacatcatgaccagtgtgtacaccacgatcaccgaactgctcaacaacacccagattgacgtgcgcgccatcgccggaatcggtattaccaaccaacgcgaaacaaccgtcatctgggatcgtcagaccggccaaccgatctacaacgcaatcgtttggcaatcacgccaaaccaaggacatctgcgaccaactcacgaccgccggataccaagatctggttcacgccaaaaccggactcctgatcgacgcctatttttcaggcaccaaggtgaaatggattctagaccatgtcgaaaacgcacatacacaagcaacacgcggagaattggcattcggcaccatcgacacctggatcatctggaacctaaccggcggccaagtccatgtcaccgattacagcaacgcctcacgcaccctgctgtacgacatccacgccctgcgttgggatccagacctgctgacaatgctcgacataccagcggcgatcctgccggacgtccgttcatccagcgacatttacggcctcacccaaaccccgtatttccacggagaacagataccgattgccggaatcgccggtgatcagcaagccgcactcttcggccaagcctgtttcgaacctggcatggccaaaaacacctacggcaccggctgtttcatgctgatgcacaccggcaaaaaagccgtggaatccaaaaatggactactcactacgatcgcttggggcctgaatggagaaatcgagtacgcactagaaggctcgatcttcgtcgctggctctgtggtgcaatggctgcgcgatggattacgcatgttcggcaaagccagcgattcacaagcctacgccgaccgtgtcagcgacaacggcggcgtgtacgttgtaccggccttcgttggcctgggtgcgccctactggcgcagcgatgtccgtggcgcagtgttcggactgacacgcagcaccaccaaggaacacttcatccgtgccgcactagaatcaatggcctaccaaacccgcgacgtcctgagcgcaatgcaggcagatgcaggcatggaactcaaagagctacgcactgacggcgcggcaatcaccaatgacttcatggcccaattccagagcgatatcctcgccgtgccggtgctgcgctcggagatcgccgaaaccacagcactcggtgccgcctacctggctggacttgcaaccggattttggtccagccgcgaagagattacgcaacactgggccatcaatctctgcttcaagccgcagatggacaagcaacaacgcgagcacctatacgcaggctggaaacaggccgtcgcagccaccttaggcttccgtgtggcctga

SEQ ID NO: 41413 - DNA, 2277 bp, Xylella fastidiosa
atgacaatcgtgaccaacctgagcttcccgcgcatcggcgcacgacgcgaactcaagcgcgccctggaaagccactggcgtggcgagaccgatgccacacaactccaacacactgcacgcgaactgcgcgcacggcactggcaactacaacgtgatacgggcgtggacctgccacccagcaacgacttcagcctctatgaccacgtcctagataccgcattcctgttcgatgccattccacagcgctaccgcgccctggcagatgctgatcctctggccggttacttcgcgatggcgcgtggccgccaagctgacggcattgatctgcatgctctggagatgaccaaatggttcgataccaattaccactacctcgtcccagaattgcaccgtgaccaacacttcgcgctacgcggtaacaaacccatcgccgagtttgaagaagcactggcactaggcatcactacccgaccggtactcctcggaccagtcagctttctcctgctgtctaaaacagtggatggcagcaaccggctcgacctactggaacgtttactgccggtctacacccaattgctgcgccaattgcaggcaagcggtgccgaatgggtgcaaattgatgagccaacactcgtgctggacctggatgcacaaacacagcaagccttccgtaaagcctacgccgcactcaatcaaggaccacgcccaaaattgttgctgaccagctactttggtccgctcggcgacaacctcgaactggccttgcaactccctgccgatggcttacacatcgacttagtgcgtggcaccgaacaattggatgcggtcctcaacaccttgcccgcgggacgggtactctccgccgggctggtgaatggacgcaatatctggcgtaccgcactggacaacgcactgacactggcgcgctacgcgcaaggccgcattggcaaggatcacgtatggttggcgccgtcatgctcactcctgcacgtccctgtggacctggaacaagaaaaaaacctggacgccgatgtacgcaattggctcgcatttgccaagcaaaaacttagcgaactacgcgtactggctgacgcactggacaacaagccagaagcagaaacagcactgacccaaacacgccaagcattggaggcacggcgccaatcacccaaagtccaccgccccgaagtggcacagcgcctggccgcactcacaccggacaccacccagcgcaacacggcctacccgcaacgcagccaggcacaacaacaaacactcaacctacccgcttacccaaccaccaccattggctccttcccacagaccctggaagtccgtgaggcccgcgcgcagttcaaatccggtaagttgtccgaaagcgactatgagacgtttttgaaagcggaaaccgaacgttgcatacgtacccaggaagagatcgggttggacgtcttggtccatggcgaattcgagcgtaacgacatggtcgaatacttcggggagcaattggatggcttcatcttcaccaagctcggttgggtacagagttacggatcacgctgcgtcaaaccacccatcatttatggcgatgtagtgcgtccagcaccgatgaccgtcacctggtcggcttacgcacaatcactcaccgacaaaccaatgaaagggatgctcaccggtccggtgacaatgctgcaatggtcgtttgtacgcgatgatcaggaacgcgcgcagacatgccggcagatcgcactggcgcttcgcgacgaagtccaggatttagaaaaagccggaatcaaggtgattcaaatcgacgaaccagccatccgcgaagggctaccgctgcgccgtggtgaatgggcggactatctgaactgggctgtggagagcttccgcattgcctcttcaaacgtccgcgacactacacagattcatacccacatgtgctactcggaattcaacgacatcattgaagccgtggctgcattggatgcagacgtgatctcgattgaaacatcccgttcacgtatggaattactggatgccttcgtgaaattccgctatccaaacgccatcggcccaggggtgtacgatattcactccccgcgtgtcccacaggaagaggaaatggtgctgctattgaaaaaagcacgcgcagtacttcccccggaacaattgtgggtcaacccggattgcggcctgaagacgcgcggctggaaagaaacacgtgctgcattgcaaacaatggtgcatgccgcgcagcggctacgtgccgaataa

SEQ ID NO: 41414 - DNA, 1335 bp, Xylella fastidiosa
atgaatcattcccgctctcataccctctttgtccaggcgcaaacacgcatccctggtggcgttaactcgccagtccgtgcgttccgctcggttggcggggagccgttcttcgttgcacgtgccgatggcccgtatctgtttgacgtcgacggccaccgctacattgattatgtcggctcctgggggccgatgatcgtcggtcacaaccacccagcggtgcgtgaggcggtgcaagtggcgattagcaacggcctgtcctacggtgccccatgtgccgccgaggtgaccatggcagaaaccattgcgcggctcgtgccctcctgcgacatggtccgcatggtcaactctggcactgaggccacattgtcagcaatccgactggcacgcggcgccactggacgcaatcacatcgtgaaattcgaaggctgttaccacggccacggcgactcattcctagtcaaaggtggcagcggcatgctgacccttggcatgccaagttcaccaggggtgcctgccgagctgagcaaactaacaatcacgttgacttacaacgatttcgatgcggccacggcactgtttgaggagatgggacaccacatcgcggccgtcattgttgaacctgtcatcggcaacgccaactgcattccgccgcgaccaggctatctgcaacatttacgcaccctgtgcacccagtacgcagtgctgttgatctttgatgaagtcatgaccggctttcgcgtcgcacttggcggcgcgcaagcgctgtacggggtgacaccggacctgaccaccttcggtaagatcatcggtggcggcatgccggtcggtgcgtatggcggttgccgcgatctgatgcaacacattgccccagccggtccaatctatcaggcaggcaccctctcgggtaatccagtggcaatggcggctggtttggccatgctggaactaatacaggctccggatttctatacgcatctcagcaacgccgccgcagccctgtgtaccggtttgcaacaagcagccagccaggcaggcattgcaatgaccacacaacagattgggggtatgttcggactgttttttaccgatcaacaggtggaaacctatgcccaagcgaccgcctgcaatactgaccgcttcaaccgcttcttccacgcgatgctgcaacgcggcgtgttttttgccccatcagcgtatgaagcaggatttatctccagtgcgcattcaccagacatcatagaggccacgttggaagccgcgcgtgcagcgttccaaacaatcgccaacgaagcagcgatcctgagtgaatcagaagcaccgctgaaaatgccatga

SEQ ID NO: 41415 - DNA, 1005 bp, Xylella fastidiosa
atggcctatccacattaccgtccacggcgtatgcgccgtcatccctttattcgacgactgatacgcgaatacaccttgactgtggatgacctaatctggccggtcttcgtgcatggcctacccgggcggacacccatcgcatcaatgcctggtgtagagcggctctcactggatgcactgctccatgaggccgaacacgcattaactttaggtattccactcatcagcttattcccggtcattgatccggcattgaaaagccttgacgccgccgaagcatggaacccagatggcttagtacaacatgcagtacgtgcacttaaaacacgcttcccagagatcggcgtcatgacagatgtcgcactagatccatacaccacacacgggcaagacggaatcatcaactcacaaggctacgtactcaacgacatcaccgtagaagcactggtaaaacaatcactctcgcatgcacaagcaggtgccgacatcatctcaccctctgacatgatggatggtcgcatcggtgcgattcgcaaagccctagacactcatccaaacttcgtagataccagcatcatggcttattcggccaaatacgcatcggcattctacaacccgtttcgggatgcagtgggcagcacgaccaaccttggtaaagccgacaaaaaaacctatcagatggaccctgctaacagtgacgaagcactccgtgagattgccttggacatcgaagaaggtgcagatatggtgatcgtcaaacctggactgctttgcttggatgtagtatgccgggtaaaagagacattccggatgcccacttacgcctatcaagtcagcggcgagtacgccatgatcaaggctgctgtatccaacggctggttagaagaacgcagcagtgtgttggaaacgttaatagcattcaaacgtgccggtgcagatggcatattgacctacttcgcaccacaagtagcaagctggttgcgtgaaggtaaatcggaggattaa

SEQ ID NO: 41416 - DNA, 636 bp, Xylella fastidiosa
atgaaattgaccgtccccacttggttaacgctgctacggatcgtgatgatccctgtgctcattgtggtgttctatctaccttatcaatggagcaatattgtcgccacgggagtgtttgcgatcgctgcgattaccgactggcttgatggatggatcgcacgtcgttacgcgcaacattcgttattgggtgcgtttttagacccagttgcggacaaattgatggtggccatcgcattatttctcattgtgcaaggtcacccgacaccgtcgatggcattttgggcggcagtgatcgtcagtcgtgaaattgcagtgtcagcattgcgtgagtggatggccgaaattggtcatcgtgccaaggtgcgtgtagctgtccttggcaaagtgaagactacggctcaaatgattgcggtactgtgtctgctctattcggtgacacccgagaagaaggcgatccatcaaatatggtttggccacttgatcttccaagtcggttattggacattgttgatttccgcgttactgacactgtggtctggtttccagtatttgcatgctgcctggcctagtctacgtaccggaaaacctgtggtgattaaaacgcacatcagcaagaaccgaaaaattaatagttga

SEQ ID NO: 41417 - DNA, 1365 bp, Xylella fastidiosa
ttgtattgtcgtcgctctcatttgaagaaacctagtatgagtcatagaacgcatgactattggatcgcacaccagggcaccccactgcatggtgtcctgagtatccccggcgataaatcaatctcccatcgtgcagtcatgtttgctgcgcttgcggatggcacgtcacgtattgatggctttcttgaggcggaggatacgtgctctacagcagagatcttggcccgattgggtgtgcgtatcgaaactcccttatccacgcagcgcatcgtccatggtgttggtgtggatggacttcaggcatcgcatattcccctggattgtggcaatgcaggcactggcatgcgcctgctcgctggtttgctggtagcgcagccttttgacagcgtcttagtcggagatgcatcactgtccaagcgaccgatgcgacgtgtgacggatccgctgtcacagatgggcgcacgtatcgataccagtgacgatggcactccaccgctgcgtatttacggtggtcaattactccacggtatcgattttatctccccagtggccagtgctcagatcaagtcagcggtgttgctggctggattgtatgcacgtaacgaaacggtagtgcgtgaaccgcacccgacgcgtgattacaccgagcgtatgctcactgcgtttggtgtggacattgatgtttccacagggtgcgcgcgcttgcgtggtgggcaacggttatgtgctaccgatattacaatcccggctgatttttcctcagctgcgttttatctggttgcagccagcgtgattcctggctctgatatcaccctgcgtgctgttggactcaatccgcgtcgtattggtttgttaaccgtgttgcggctgatgggggcaaatattgttgaatccaatcgccatgaacagggtggtgagccggttgttgacctacgtgtgcgttatgcgccactccagggcacccgtgttcctgaagatttggtggcggatatgattgacgaattcccggccttgtttgtcgctgcagcggcagccgaaggtcaaacggtagtgagtggtgcggctgaactacgcgttaaagaatcggaccggttggctgcgatggtgacaggcttgcgcgtgcttggcgttcaggtggatgagaccgccgacggggcaacgattcatggagggcccatcggtcatggcaccatcaacagccatggcgatcaccgcatcgccatggcgttttcaattgcaggtcagctttctgtcagtacagtacgtattgaagatgtcgccaatgttgcgacttcttttccagactatgagacgttagcgcgcagcgctggtttcggtcttgaggtgtactgcgatccagcatga

SEQ ID NO: 41418 - DNA, 1089 bp, Xylella fastidiosa
atgacgatgcgtatttttaatttcagccctggtccagcgaccttacctgaacctgttttgcgccaagcgcaggatgaaatgcttgaatggaacgcagtaggggcttcggtgatggaaattagccaccggactgttgaatttatggagctcgctaaaggtattgagagcgacctgcgttgtttgcttggagtaccagatgactatgcagtattgttcttgtccggtggtgcgacaactcagcaagcgttgttaccgcttaattttgccgccccaggacagactgctgattatgtggtcaccgggcattggagtaagaccgcactgaagcaagccagcccctatgtgaatatcaacgtggtggccgatggggaacgtggtggttttcagcatattccaagccgtgctggctggcgtttgtctaaagatgcggcgtatgtgcacatgactgcgaacgagacgattcacggcgtcgagttccgccagacgccggacgttggcgatgtgcccttgtttgccgactttagctcttcgattgctgctgatctgatcgacgtatccaaatacgatttaatctatgctggtgcgcaaaagaaccttggtcctgtcggaatttgcgtggtgatcgtacgccgtactctgcttgaacgtaccggtcagccgcgtgctgatatttttacttacgcctcgcatgccgaacgtgattcgatgctcaataccccgccaaccttcaattggtacctgcttggtcttaccgtcaagtggatgcttgctgaggggggagtgcaggaattcgcgcgtcgtaatcaggccaaggcgcaattggtttatcagacgattgatcaatctggtggtttttatcgtaatggagttgctgcggcagtgcgttcgcgtatgaatattccgttctttttgccgaatgttgagcaagatgctcgtttcgccgccgaggctaaggccgctggtttattatccttgaaggggcataaagcgcttggcggcatccgtgcttccctctataacgccatgccactggctggtgtacaggcattagtggcatttatgcatgattttcaacagcgctatggttga

SEQ ID NO: 41419 - DNA, 747 bp, Xylella fastidiosa
atgattaccgctgaacatcttcataagtcctttaagacaaagaaggggctggttaatgcggtaaaggacctcagtttccacgctgctgatggtcgaatcacgggattactcggtcccaatggcgctggaaaaacgacgaccttgcgcatgctctatacgctattgatcccagatcagggctgcatcagcatcgacggtgtggacgcagtaagcgatccgatgacggttcgtcgtggacttggcgtattgccagatgcatgcggtatttataagcggttgaccgcgcgtgagaatatcgcctatttcggtgaactgcatggtttgtcccgcatagacatcgccgcgcgtctctccatactgtcgaaggcgctggatatggatgacattcttgaccgtcaggctgcgggtttcagccatggccagcgcactaagatcgcgattgcacgtgccttggtgcatgacccacgtaacatcatcttggatgagccgacgaatggtttagatgtgatgaccacacgtaagttgcgggattttctccgtcagctacgcgccgaaggccgctgtattattttctctagccatatcatgcaagaagtggcggcgttgtgtgatcacatcattgtgattgccaacggcacggtagtagtggccggtagtggcgatgagctacgcgcgcgcactggaaaggacaatctggaggatgctttcattgatgcagttggttcagatgaaggactgcatgcatga

SEQ ID NO: 41420 - DNA, 1917 bp, Xylella fastidiosa
atgggcaaaatcattggtatcgacctcggcaccacaaattcgtgcttagcgattattgaaggcggtaaagggcgtgtcatcgaaaactcggagggtgatcggaccactccttccattgttgcttacaccaaggatggtgaagtgcttgttggtgctgcagccaagcgccaagcggtcacaaatccgaaaaacaccttttatgcggttaagcgtttgattggacgtaagttcggtgatgcagaggtccaaaaggaccttgatttggtgccgtataagattactcagcatgacaatggggatgcctgggtggccactgctgatgctaagaagctggcgccgcaggaaatctctgccaaggtgctagagaaaatgaagaagaccgccgaggatttcctgggcgagaaagtcaccgaagcggtgattaccgtgccggcgtattttaatgacagtcagcgtcaggcgacgaaagatgctggtcggatcgctggcctggatgtcaaacgtattatcaacgagccgaccgctgcggcattggcttacggtttggacaagaagggcggagatcgcaagatcgctgtatatgatcttggcggcggtacctttgacgtctcgatcattgaaattgctgaagtggatggtgagaagcagttcgaggtattggcgaccaatggtgataccttcttgggaggtgaagatttcgacaagcgtgttatcgattatctggttgatgaattcaataaggatcaggggatcgatttgcgcaaggatccgctggcgttacaacgtttaaaggatgctgctgagcgcgctaaaatcgaattgtcttcctcccagcaaaccgaagttaacctgccatacattacggcggatgcatcgggtccgaagcacctgaatatcaaactgactcgtgccaagcttgaagccttggtagacgatttggtccgtaagtcaattgagccatgccgcattgcgttgaacgacgctggtttgcgtaccagtgatgttcaagaagtgattttggttggtggccagacccgtatgccgaaggtccagcaagcggttgccgacttctttggtaaagagccgcgtaaggacgttaatccggacgaagcggttgcattgggtgctgcgattcagggtggggtgctggctggtgacgtgaaggatgtgttactgctggatgtgaccccgttatcccttggtattgaaacgatgggtggggtgtttacaaagattatcgagaagaacacgaccattccgaccaaagcgtctcaggtgttttctactgccgaggatggtcagtccgcagtgactgtccatgtgttgcaaggtgaacgtgagcaggcgcgtttcaataaatcgcttgctaaattcgatttggcgggtatcgaacctgcgccgcgtggccagccgcagattgaggtgtcttttgatatcgatgccaacggtattttgcatgtctctgccaaggacaagaaaaccaataaggagcagaaggtcgaggttaaagctggttctggactttcggatagtgagattcaacagatggttgccgatgctgaggcacatcgtgaggaagacaaaaagttccaagagttggtgcaggcaaggaaccatgctgacggtttgatccattcaacccgttcggccattaaggagcatggtagtaaggttgggggtgaggtgattgggcgtgtcgaagcctcccttgcagagcttgaggctgccgtcaaaggtgatgataaaaaccagattgaggcgaaatctaaaactcttgaggaagttgcacagtcgttgcacatggcagcaacagcagagcagcaatcaggaagcacgggggctggtgcaggctcttcagccaaggttgacgatgtggttgatgctgaattcacagaagtcaagggcgacaaaaaataa

SEQ ID NO: 41421 - DNA, 558 bp, Xylella fastidiosa
ttgatgtctaacttcactatttctcagatacttgctcgggctgatttattggtagaccgtcccagtattgatgtggctattgcgcatatcgccgatgacatcgcccaggactatcagggcgatgtgccgttgtttgtcaccatcatgcatggtgggttgccatttgcgggtcaattggcattggagctgggccagcgtggtcaggacatagagttggattccttgcatgcgacgcgttaccgtggtgagcagactggcggtgcattggtgtggagccattatccggtcagtgctatgtctggtcgtcgtgtgattctggttgacgatattctcgacgagggtcataccttgtctgagatacgtcagtggtgcctaaagcagggggctaccgatgtgtcgctagtggtgctgatggtcaaatgtcatgatcgttgtatacccaatatgagggcagattattatggcgtggaggttccggatcgctatgtgtttggttttggaatggacatcgcggggcagctgcgcggcatcccggcaatttatgcgatgaggcaatag

SEQ ID NO: 41422 - DNA, 1050 bp, Xylella fastidiosa
atgtttatcaatgcttacggcgcacacgctggagataaacccttggagtccatgcagattgcccgccgtgttccgggtgcgcatgatgtgcaaattgacattcattactgtggcgtgtgccattctgatattcatcaagtccgctctgaatgggcgggcacgctttttccgtgtgtgccgggacatgaaattgtcggtcgggtctctgctatagggacgcatgtgaagggctttaagaccggagatcttgtcgctgttggttgcatggtcgatagctgtaaggattgccaggagtgcaatgcagggttggagaattactgtgatggcatgattggtacctacaacttcccgactcatgatgctccgggccacacattgggcggttactctcagaagatcgttgtggatgaacgttacgtgttgcgcatccgccaccctgaggcacagcttgccgcagttgcgccgttattgtgtgcagggattacgacgtactcaccactgcgccactggaatgccggtccgggtaagaaagtcggcattgtcggtattggtggcttgggtcatatggggattaagttggctcatgccatgggggcgcatgtcgttgcattcaccacgtccgaatctaagcgacaggatgccaaggcgctgggagcagatgaggtggtggtgtcacgtgatgaggaaagcatggctgcccatgtaaagagtttcgatttgattttgaatactgtggctgcctcgcattctcttgatccgttcctgactctgctaaagcgggatggcacattgaccttggttggtgcgcctgcgacgccgcatccttcaccgcaaatcttcaatctgatctttaagcgtcgctccattgctggatcgctgatcggtggtattgcagaaacacaggaaatgctggatttctgtgcggagaatggcattgttgcggacattgagttgatccgtgccgacggtatcaatgaggcctacgaacggatgatgaaaggtgatgtcaagtaccgttttgtgattgacaacgccactttggctgcttga

SEQ ID NO: 41423 - DNA, 1278 bp, Xylella fastidiosa
gtgatgtctaatagcccgcaaacgccgcttgccacgcgccagcgattgtccgaagttcgctatgagatccgaggggagttggcgcgccgtgcgcgtgagcttgaggcggagggacgcaagcttatcaagctcaacatcggtaatccaggtgcgttcggtttccgggcgccagagcatctgcaacgtgccatcgccgatgatatgggacgtaccgatccttatacgcatcagcagggtttgccaatcgcacgtgaggcgattgctgctgcttatgtacgacgtcactatccagatgctgatgcagatcgggtctttgtggggaatggggtttctgagttaattgatttgtcgttgcgggcgttgcttaatccaggcgatgaggtgttggttccttcaccggattatccgctgtggtcggcggcgacgattctcaacgatggtcggcccgtgtattaccgttgtgcgccggagaacggtttccagcccgatgcagtcgagatcgaaacgctggtgtcttcacggacacgtgcgattgtgttgattaatccgaataatcccagtggtgccaattattcgcaggagttattggagcggattgtggcaatcgcagtgaaacatcatctgctgttgttggttgatgagatttacgatcagattttgtatgacggtgcggtgtttgttccagtggctcctttggcggggacgcatccatgtatcactttcagtgggctgagtaaggtgcatcgtgcgtgcggttggcgtgtgggttgggcgttgctgtccgggagtagcattcaaattgataatctgcgcaatgcgatggatttgctgggtgcgttgcgtttgtgtgcgaatgtcccagggcaatatgcgattgatgcggcggtcaatgggccagatacgatcactccgttatgttcgcctggtggtcctttgtacgagacgcgccgtgcggtgattgaggcctgcgtggtgagtgagcatttgtcgttggtggtgcctgctggggcgttatacgcgttcccatcggtcgtgggaccggcggcgcggcactttgatgattatgcttttgcgctggagttgatgaatgacgagggggtgctggtggtgcctggatcaagttttaatgtgccatatcgggatcacttccgcgtgacgttgcttcctgatgctgcgttgatacgtgaagtgttttctcgtattgaccgggccttgtcgcgccgtgctgaggtggctgagaaggtggtgccgctcaagtcgcgtagcgccgccgcttga

SEQ ID NO: 41424 - DNA, 2163 bp, Xylella fastidiosa
atgacatacaaaagtccccttgtaacgcaacagaaccaaggcgcttccaatccacagcctgacagcgcactccacggcttagtgctccttgcccaattccatggcattgcggctgaccccatacagatagcgcatgacttcgggcgcagtggcgaactattcgatgaaacaaccttgctactggccgccaaaaaactcggactaaaagccaaagtcgtcacccaaccggtcacccgtatcgcaatggccgcattacctgcactcgcactgatccctggaggaacagcatttatcgtcgccaaagtgacaggcaaccagatactgatccacgacctggcagatcaacggccacgcacaatctcacacgatgaatttaccgcacgctacgccggtcgcttactccaagtcgcctcccgcgcatcggtcctaggaaatctggctaaattcgactttagctggttcatccccgcagtggtcaaatatcgcaaactgctggctgaagtctttgcagtgtccttatttatccagatattcgcactggtgacacccctgttctaccaagtcgtgatggacaaagtgctcgtacaccaagcactcagcacccttgaagtcattgtcgttggcctgatctccctggccttattcgaagtactgctcaccacactacgcacccatgtcttcgcacataccaccagcaaaattgatgttgaactcggcgcccgcttattccgccatctattagcactccccttagcgtattttgaatcgcgccgcgttggcgacaccatcgcccgcgtacgcgaactagaaaacatccgccacttcctcaccggccaagcactgacctccgtcttagacctcctattcaccgtcgtcttcttgtccgtcatgttttggtacagcagctggctcaccctgattgtggtgatctcattacccctgtacgcactgatctccgcattcatcaccccagtactccgcaaacgtctggatgaaaaatttgcacgcggcgcagacaaccaagcatttttagtagaaacagtcagcggcattggcaccgttaaagcaatggccgtagacccacgtgtcacccgcacctgggacaaccaactggcgggctacgttggcgccagctttagcgttaccaaaattgccaccctcggccaacagagcgttcaattagtacagaaactgaccaacgtcgccgtattattttggggcgccaaactggtgattgacggacaactgtccctcggacaactgattgccttcaacatgttgtccggccaagtcactgcccccatcatccggctcgcccagctatggcaggattttcaacaagtcggactttcggtcgaacgactgggcgaaatcctaaatacccgtaccgaactccccggcagccgcatgacattgccgcccatccaagggcgcatcaccttcgaacgcctcatcttccgctaccgtccagatacccccgacgtactcgccggaatcgacctagacatccaacctggcgaagtcatcggcatcgtaggacgctccggctctgggaaaagcaccctgacaaaactcgtacagcgcatgtacgtcccagagcgcggccgcgttttggtcgacagccacgacctctcattggccgatccagcctggctgcgtcgccaaattggcgtcgtactgcaagaaaatttcctgttcaaccgcagcgtccgtgaaaacatcgccatggccgacccgggaatcccattggaacgcgtcatccacgcagcaacattagccggtgcccatcccttcattgctgaactgccagaaggctatgacaccaagattggcgaacacggtacaggactctccggcggccaacgccaacgcatcgccattgcccgcgccctgattggcgacccacgcatccttattttcgatgaagccaccagcgcactcgactacgaatcagaacatgccgtcatgcaaaacatgcgagccatttgcaaaggccgcaccgttctcatcatcgcccaccgcctctccacagtccgcaatgccgatcgtatcgtcgtcattgataaaggaaaaatcgtagaaagcggctcccacgaaacactcctcaaccgcaacaacggtcattacgcccacctctaccgactccaacaagggaccacatga

SEQ ID NO: 41425 - DNA, 1458 bp, Xylella fastidiosa
atgctgcgcatcttggccgaagctttgacttacgacgatgtttcactcgtcccttcccattcgaccgtcctgcccaaggatgtcaacctcgaaacccggttgacacgcaatatcaggctcaaattgccggtcctttcagcggcgatggacaccgtcacagaagcccgtttggcgatcgttatggcgcagcttggcggcattggcatcatccataaaaaccttaccatcgaacagcaagtcgctgaggtcactaaagtcaagaaatacgaatctggcgtcattcgtgatccgattacagttgatccagagacatcaattcgcgatgtgttagcactgacccgtgccaagaacatttctggcgtgcctgtcgtcgataaaggtcaattaattggcctcgtgactcaccgcgatatgcgctttgaaagcgagcttgatgaccccgtgcgccatatcatgactaaaaaagaagccctggtgacagtcaaagaaggggccgactcccaagaggtactccaactgctgcataaacatcgcatcgaaaagatattggttgtgaacgatgcttttgaactgcgcggcctcatcaccgttaaagatattcaaaaaaaatccgactatcccaacgcagccaaagatgcggtgacccgcttgctggttggcgctgctgtgggtgtagggggagagactgaaaggcgcgttgagacattggccgctgctggagtggatgtgatcattgtcgatactgcgcatggttattctcagggtgtgcttgatcgtgtggcttggatcaagcgttacttcccgcaactacaagtgattggcggcaatattgttactggtgatgctgctttggcactgatggatgccggtgcagatgcagtgaaagtgggtgtcggtcccggctccatttgtacaacgcgaatggtggcaggtgttggcgtgccgcagatcaccgctgtgcagatggtctccgacgcgctgcaagatcgcatcccgctgattgctgacggcggtatccgctattccggtgatattggcaaggcattagctgcaggcgcatcaaccgtcatgatcggtggtttgtttgcagggactgaggaagccccgggtgatgttgagttgttccaggggcgcacttacaaaagctatcgcggcatgggttccttggcggcgatggaaaagggctccaaagaccgctatttccaggaagcgagcgacgttgataaactggtcccggaaggcattgaagggcgcgtcccttaccgtggttcagtcagtggcatcgtgcatcagctgatgggcggcttgcgtgccaccatggggtatgttggctgcgcaacaatcgaagagatgcgtaccaaaccccagtttgtcaaaatcactggggccggtcaggtcgagagtcacgttcatgacgtgcaaatcaccaaagagccgccgaattatcggatgcgctga

SEQ ID NO: 41426 - DNA, 888 bp, Xylella fastidiosa
gtgatcgtatctatgctggcagccaccgatttggctcgtatcctcgacgggcgtcgtattgctgatgacctgcttgatgctttgaaaacacgcgtggatgcacgtgtggcggcaggtaaactgcctccaacgttggccgtagtgcttgtcggttccgatccagcatcagtggtgtatgtccgcaacaagcggcgtgctgcagagaaggtggggattaaagcttatgacttcgatcttccagaagcgacgactgaggctgagttggccgcgttgattgaccggcttaatgccgatccaaagatccacggtatcctgatccaattaccattgccgggcattcctgatgcgcaccgattgattcagcgtgttgacccgcgcaaagatgtggatggtttccaccctcaaaatgttgggcacttagcattgcgtgagtttggtcttagaccatgcacgccacggggtattgtcaccttgctcggtcataccgaccgaccggtccgagggcgtaatgccaccattgttggagtgagcaaccatgttggccgaccgatgggactggagttgttgatggctggttgtactgtcaccagttgccataaattcaccccaccacagatgctggaagcagcagtgcgtcaagccgatattctgatcgttgcagtgggccgtccgggagtgattcctggagagtgggtgaagccaggtgcagtcgtgattgatgttggcattaatcgacttgatgatggtcggttggtgggtgatgttggttttgagagtgcagtcaagcgtgctagttggattaccccggtgcctggcggagtaggaccgatgaccgtagcgacgttgatgcaaaacaccctggaagccgccgaagcggcggattgttga

SEQ ID NO: 41427 - DNA, 891 bp, Xylella fastidiosa
atgattaagcgtattcgcaaggctgttttccctgtggccggtcttggtacacgttttttgccagcgaccaaaaccatccccaaggaaatgctgccaattatcgataaacccctcatccagtacgcggttgacgaagcgatccaggctggatgcgatacccttgtatttgtgaccaaccgttacaagcatgcggtggccgattacttcgacaaagcgtatgaattggagcagaagcttgagcgtgccggtaagtatgagcagctggaattagtgcgtcatgtgttgcctgatggagtgcgtacggttttcgtcactcaaacggaagcgctgggtctaggccatgcggtgttgtgcgccaagccggtggtgggtgatgaaccattcgcggtgttgctgccagacgatctcatgtggagtcgtaatggaggtgcactgaaacaaatggctgatgttgctgaagtctccggtagcagtgtcattgcagtagaggatgtccccgtcgataaaaccgttaactatggcatcgtcggaacggatgtgtttgacggatccaagggccgcattactcaaatcgtcgaaaagcctaagcccgacgatgcaccgagcaatcttgctgtggtggggcgctatgtcctgagtggcaagatattcgagatgcttgaaaacacctctatcggtactggcggcgagattcaattgaccgatgcgatcgccgaattactgaaatacgagagagtggatgcataccgcttccaaggtcgccgatttgattgcggtgcacacattggtctgattgaggccaccctgcatttggcgcttgaacacaggaaacatggccaggcggtgcgtgagatactgcgtgacacattgctcccggtcgacaagaactag

SEQ ID NO: 41428 - DNA, 1164 bp, Xylella fastidiosa
atgaatttccacgaataccaggcaaaacaactatttgccgaatacggcatccctgttccggccggacgcatcgcgtcttcagctgatgaagcggtcacagccgccaaatccttgggcaacggcccctggatggtaaaagctcagattcatgcgggcggtcgcggtaaggccggcggcgtgaaattctgcaaaacaaccgacgaagtgaaacaggccgcagcagcaatgctcggtaccaagatggctacttaccagtcggcaggtgtcgcactgccggtgaatctggtcctggtcaccgaagccggtgaaatcactaaagaactctatctgtcggtgttagtagatcgcggcacgcgttcaatcacctacatcgcctcatccgagggcggcgtggacattgagcacgttgcagctgaaacccctgaaaaaatccaaacgctcaacgtcgactttgtcgaaggcctacagccataccaaggacgcgatattggatttcacctcggcttggaagcgaaacaggttaatcagctgtccaaaatcatgattagcctctatcaattgttcaacgacaaagatttgtccttgatcgaattaaacccattagcaatcctgagcaatggggatttgtacgcactggatggaaaaattaattccgacgacaacgccacattccgccataaagaattggccgcaatgcgcgataaaactcaggaagacgaaaccgaggttctagcctcagagaacgatctgaactacgtcaccatggatggcaacatcggctgcatggtcaatggagccggacttgccatggccacgatggatgtgatcaaactcaatggcggcgaaccggcaaacttccttgatgtcggcggcggcgctaccaaagagcgcgtgacgaccgcattcaaactgatcctttcctcaaacaaggtcaaagccatctttgtcaatatcttcggtggcattgtccgctgcgacatgattgccgaaggcatcatcgctgcagtgaaggaagtgggtgtcaaagtgcctgttatcgtacgcttggaaggcaccaatgtagacgctggcaaacaactgctagccacatccggcctcgccatcatcccggctgacgacatcaacgacggcgccaaaaaagccgtggccgctgtcaccgtctga

SEQ ID NO: 41429 - DNA, 873 bp, Xylella fastidiosa
atgtctgtacttgttaataaaaatacgaaggtgatcgtacaaggcttcaccggtcaacaagggaccttccatgccactcaaatggtggaatacggcacccaagtcgtcggcggtgtcacccctggcaagggaggcaatactcatattgatctaccggtattcaatactgtgcgtgaagcagtccagaacacaggtgccgacgcctcagtgatctacgtaccaccaccgtttgcagcggatgcaatcttggaagcagctgcagcaggcatcaaagtcatcgtagcgattactgaaggtatcccagtactggatatgctacgcgttaaaaatgtacttaaagcatcacctgaaatcaccctgatcggaccaaactgcccaggcgtcattacaccaggggagtgcaagatcggcattatgcccggccatatccacaaaccaggtcatatcggtattgtgtcccgctccggtaccttgacttacgaagcagtgaaacaaaccactgacgtcggcctcggtcaatcaacctgcatcggtatcggtggggatccaatcaacgggctgaacttcgttgatgcgctaaaactattcaataacgacccgcagaccaaaggcatcatcatggtaggcgagatcggcggggatgctgaggaagccggcgctgaatatattaaacaccatgtgaaaaaaccggtggttggctttatcgctggtgcatccgcaccgaaaggcaagcgcatgggtcatgctggcgccatcgcctcaggaggctcaggaacagctgaaggcaagtttgctgcaatggaaaaagcaggcatcaagacagtacgttcaccgggggatttaggcgcagcgattgcttcgctcgtaaaatag

SEQ ID NO: 41430 - DNA, 3504 bp, Xylella fastidiosa
atgcgcctgtccacgatcaagctgtccggtttcaaatcgtttgttgatcctgccacgctccatctaccaaccaacatgacctgtatcgttggtcctaatggctgcggcaaatccaacattattgatgccgtgcgttgggtgatgggtgaaagctcagctagccggttacgaggcgattcgttgacggacgtgattttttccggatcttccgcccgtaaaccggtggcacaggccaccgttgagctgatctttgataacagcgaccacaccatcagtggagaattcgcggcattcaacgaaatttcggtcaaacgtaccgtgagccgtgacggctccagcgtctactccctgaacggcaccaagtgccgccgccgcgatattaccgacttgttcctaggcaccggcttggggccgcgcagctactcgatcatcgaacagggcatgatcagtcagattatcgaagcgcgccctgaagatttgcgtatctacctggaagaagccgccggcatctccaaatacaaagaacggcgtaaagagaccgagagccgcatccgtcatacccaagaaaatctggatcgcctgaacgatttgcgtgaagagattggtaaacagcttgaacacctcaagcgccaagcgcgccaagctgagcaatatcagacattgcaagaagaacgccgtgttaaagatgccgagtgcaaggccttgcaattccgtgaactggacatccgtctccaagcattgcgccaggcattacttcaagaggaaacccgcttacagcaattacttgccgagcagcgtgaagctgagatgcggatcgagacctcccgcgtgcggcgtgaagagtctgccgaagccttggcaaccgcacaggccgatgtctatcaagtaggtgccacactggcccgcatcgaacaacagatccaacatcaacgtgaaatgtcgcagcgtttgcacaaagcacgcgatgaagcacagaaccaactgattgatctgacccgtcacatgggggacgatgccgccacactggcggtgttacgtgaggcagtcgagaacaacgaaccccagttgcacgtgctgcgtgagcagaacgaatttaaacaagacgcactgcgcgacgccgaagcagcgttgacagactggcagcagcgttgggagagccacaaccgagagaccagcgaagcatcgcgtgctggtgaagttgaacgtacccgtgttgactacttggaccgtcaggccctggacgccgagcggcggcgtgacctattgcttgccgaacgtgccggacttgatctggacgcattggccgaagccttcgagcagatcgaagtgcaatacgaaacccagaaagcggcactggacggcctcaacgaccaacttgaacaacgtaaacagacattggcggacggacagcaccagcagcgtactgcgcagaccgaactggccgatgtccgtaaacatgcccagaccgctcgtggtcgtctatcttcactcgagaccctgcaacaggctgcccttggccaggaacagggcgccgccatgacctggttgcaggcccatggattgagttcggcggcccgtgtcggagaacgtattcgtgtcgaaagcggctgggaaaacgcccttgaaagcgcccttggtcacatgattgaaggcgtccttgttgacgacccgcggacgttggttgaagcattgagcggccttaacgaaggccacatcgcattggtggctgacacccagacacagatccaagtggcccccacatcgctggccgctaaagtccagggacctgttgcgatccgccgtttactgacccatctgcacggcgctgaagatttagtcgctgcccgcgccctgcaagcaacactgagcgagggcgactgggtgatgacccgcaacggtgaatgcctgggggaaggatggctacgcgtatcccgttccggagccgctgagcaaggcgcattactgcgtgaacgtgacattcaaaccctgcgcgcccagattgagaccctgcaagaacgcgaagctgaattggaacatcgcctgacgcacttccgcgaccacctattgatggccgaacagcaccgcgaagatgcacaacgccaactctacattgcacatcgtggcgtctccgaactggccggccagcgccaggcccaccacggcaaactagaggcctcccgtggccgtatccagcacattgaagccgagattgcccaattattagaaaccttggataccagccgtgaccaagcccgtactgcgcgcgccacactggatgacgcagtcacccgcatgggtgacctagagagccggcgtcaggcattgcacgctgagcggcaacaacttaacgtgacccgtgaccaagcgcgtgaagccgcacgcagcgtccgtgaagctatgcatgccttagcattgaccttggagtcacagcgtacccaaatggtgtccttgagtcagacactgcagcggatggacaaccagcgcggccagctcgacgcacgcttagaagaactgatgatccaactcggtgaaggtgactccccggtggagatcctggagcaacaacatcaggcggccctcagcgaacgagtccgtaccgaacacctcttgggccaagcacgtactcatcttgacggcattgatgccgaactgcgccaattcgaacacacccgtcagcagcgcgatgaacaggccctgtcccagcgcgagcgcatctctcaatgccgccttgaccaacaggccctcgccttgggcgctgaacagcggcaggcggcggtggagaaagtcggcttcgtcttacagcaccttgtggatgccctgcctgaagctgccaacccggctgactgggaggccgcgatagaacaactggatatacgcatccgtcgtctggaacctgtcaatctggcggccattcacgagtacaacgaagccgcacagcgtgtcgaatacctccaagcccaacatgaggacctgaccgttgccctacagacacttgaggaggccatctccaaaatcgaccgtgaaacccgaggccgctttaaagagaccttcgatcgcgtcaacgcggggttacagacactctacccccgtttatttggtggcggtcatgcctacctggagctgaccagtgaagatttactcgacaccggcatagcgatcatggcccgccccccaggcaagcgcgtctccagcatctccttactgtctggcggcgaaaaagccatgacagcagttgcacttgtgtttgccatcttccaactcaaccccgcacccttctgcctgctcgacgaagtggatgcccccctggacgaagccaatgtcgggcgcttggccagcatggtgaaagaaatgagcgagaaagtgcagttcctgtttgtcagccacaacaaatccaccatggaagccgctcagcaactgtccggtgtcaccatgcgtgaacccggagtgagccgcctagtcagcgtggatttggccgaagcggcccgtttggttgacgggagctga

SEQ ID NO: 41431 - DNA, 741 bp, Xylella fastidiosa
atggctcttatcaaatttgagaacgtctgcgtcgattttccaatctataacgcaagcagtagatcactaaaaaaacaactcatccaggccgtcaccggtggtcagttgcgcaaggaagaaagcggtcgtgttgtcgtcagtgtattaaaagggttgacattcacgttgcaagacggcgcgcgcgttggtctgctcggtcacaatggtgcaggaaagagcaccttgctgcgcctattgaatagcgtctatttcccttcctcaggccaagcactgatcgaaggaaccaccgggtcgttgatcgacatttcactaggaacggacccagaagccaccggacgcgaaaacatctatctacgtggcgcactgcttgggatgaccaagagcgaaataaaccgctcggtgaatgaaatcatcgaattctccgaactcggcaatttcatcgacatgccgttgcgcacgtattcgacaggcatgcatctacgcttagccttttcggtatccaccatcgtgtacccaaagatcctgttgatggacgaatggttatcggttggcgacgaaggcttcaagcaaaaagcggaaaaacgcctctcagaacttgtacaagcaaccaatattctcgttgtcgccagtcactccaaacaactgattctaaatacatgtaatcgcgtgatttggttggaacatggccagatacggatggatggcgacgcacaggaggtatgtactgcgtactttgggtga

SEQ ID NO: 41432 - DNA, 1080 bp, Xylella fastidiosa
ttgccgggcgctaatttgagcaatatgtattcccttttccgtcccctcctgttcacctgcgacacagagcgtgcccatgacatcagcctgtgtaccttggacatcgcctaccacagtggagcattacctctactgacacgccacccacgaccgttacccaccacagccttcggtctgaactttcccaaccctgttggcttagccgccggactggacaaaaacggaactcacattgacgctctattcgccttgggctttggctttatcgaaatcggcaccaccaccccacgtccacaaccggggaatcccaagcctcgccttttccgcctgacgcaacaacaagcagtgattaaccgcatggggtttaacaacctaggggtagatgcactggtacgtaacgttgcaggcgcgcggcaacgcaacggcccccttgggatcaacattggcaagaacaaagacacccctaatgaacaggccagtaacgactatcggtattgtctggaacgggtctatgcactggcggactatgtcactatcaatctctcctcaccaaataccgctggtctacgagcgctgcaagaggaacagacattgcgtcgcttgatcggagaattacgtgaagcacaagaaacgctggccgccaaacacggccggcacgtaccgatgctcatcaagatggcaccagatctcagtgacagcgacattgatgcagcagcacgtgtactcaacgagatgagcgtagacggagtgatcgccaccaataccaccgtgacgcgcccgctcctaagacaacatcggctggcaagcgaaacgggggggctgtccggtgccccactcctgggacagtccaccttggtgctacgtcggctacgtacccacttacctgaaactattgctcttatcggtgtaggcggcatctgttgcggtgccgatgcagttgccaaaatggctgccggtgccaacctggtacagtgctacaccggcttgatattcaaaggcccacagttggttggagaatgcgtggaagccattcgccgccgccgcgaagcctccagtagcgggagggcgagcactcaatga

SEQ ID NO: 41433 - DNA, 1695 bp, Xylella fastidiosa
atgcgccgccatcttgccttgttctccggatggctgattgcgttggcggtctcctcagcagcaacgctgaccctaccaagcgccttcaaacaaatgattgaccacggtttttccagcgaggggcaaatcaatcggacctttgctctactgttgttagtcgccgtgattctggcagtaggtacagcagcgcgcctgttctccgtctcgctactgggcgagaagatcatcaccgacctgcgtagccacttatacgcacacctcataggattagatgccagctttcacgatcgtaatcgcagcaacgagctggtgtcgcgtcttgccacagacagtgaactgctacgctcaatcattggatccacaatgtcagtagcgacgcgtagcaccgtgactgcaatcggcagtctcatcatgttattcatcaccagtccacgcctcgccagcctttccctggtggtcatcccactcgtgatacttcccattgtcttaggcgcacaacacctccagaaagccgcccgtaccagccaggatcgcattgccgacaccaatagcttcgctgctgaaacattacgtgctttacgtacagtgcaagcctatgcacgtgaacattacgaacgtacacgcttcgaccgcacactggaaacgagtttgcaggccgcgcgacaacgcattcacatccaaacatgggtcaccgctgcaagcatcgtgttgatattcagtgcaatcgtcggagtgttatgggcaggtgcacatgatgtcattgctggccgtatgagcgcgggcacactcggtgaatttgtcctatacgcactgatcggcggtggttccatcggcgcccttgccgaagtgtggaacgaactacaacgtgccgctggtggcatgggccggattttcgaattactcaaagagaaaaacacgctcaccgtaccagccacacctgccttgctaccccagccattgcggggagaaatccgctttgaacgtgtcggcttccactatccacaacgcccagaaacacctgcacttgatgacattgacctgcatatacgcccaggggaaaccatcgcttttgtcggcccatctggtgctggcaaaagcaccctgctatcactattactacgcttctatgatcccacccatggacgcatcctgattgatggtgtggacctacgccaaaccgatccgaaagtattacggacacacattgcactggtacaacaacaaccaacactgttcaccgcgagcgcaatggaaaatatacgctatggacgactggacgccaccactgccgaaatcgagatcgcctcacgctcttccgaagccgatggtttcatccgtgccctgccacagagctatgccaccgagctaggcgagcacggcatgtccctgtccggcggccaacagcaacgtatcgcaatcgctcgcgcactcctcaaagaagcgccgattctactcctggatgaagcgaccaacgcacttgatgcacaaaacgagcaggcagtacaacaggccctggaacgactgatgacagggcgcaccacattgatcattgcacaccgcttagtcaccatcctgaaggctgacaggatcgtggtgatggaccaaggccggatcgtcgcccaaggtacccacagcgaactcatcgccgctggaggcctatacgcaaagctcgcacgcctacaattcatcgaataa

SEQ ID NO: 41434 - DNA, 1008 bp, Xylella fastidiosa
atgacgcaaacaattacggtgatccgcggtgatggtatcggcccggaaatcatggatgccaccctgttggtattaaacacgttacaagcgaatctgaattacgaattcgcagatgcaggcttgaacgcacttgaaaagcacggagacttgctaccagaggccaccctgaattcaatcagcaagaacaaagttgcgctgaaaagcccgctcacgaccccggtaggtgaaggcttcagctcgatcaatgtcgccctgcgacgtaaattcgacttatatgccaacgttcggcctgcaaaatccttcccaaataccaagtcacgctttagcgataacgtagacctgatcaccgtacgggaaaataccgagggcgcctacctgagcgaaggtcaaaccatctctcctgacggagaagttgccacttccagcgcacgagtgacccgtaaagggtcggaacgcatcgtccgttacgcgttcgacttggcccgaacaacgggccgcaaaaaggtcaccgcagtacacaaagccaacatcattaaatcaacctctgggctgtttctgaaaaccgcccgagacgtcgcaagccagtacccagaaatcgatttccaagaaatgatcgtcgacaacgcttgcatgcaacttgtgatgcgcccagaacaattcgacatcattgtcaccaccaacttgttcggtgacatcctctcagatttgtgcgcaggcttggtcggcggtttaggcttggctccgggcgccaacattggtaatgaacaagccatcttcgaagccgtacatggctcggctccagacatcgctggacaaggtaaagccaatccatgcgcgctgctgctaggtgctgtacaaatgctggatcatatcggtcaaccacaaaacgccgaacgcctacgcaacgcaatcgtggccacactgaatgccaaagactcgctgactcccgacctggggggtaacggcaacaccatggaattcgccaaggcaattgccagcagactctaa

SEQ ID NO: 41435 - DNA, 522 bp, Xylella fastidiosa
atgatgtccccactgtgctatgacatctttgatagtccgattggaatactgacggttgtcgccgatacagatgcactatgtcgcgtgatgctcccaagcaacgatcacacaacacaagagcacaaatgctggcactatgctccgagtacaacgctattaaagcaagcacgcacccagttactcgactatttgcacgccgagctccacacattctcgctaccgttacgaccacagggcacaccattccaatgtgcggtatggcatgcactggcccacatctcattcggccagacttggagttatgcgcaattagctgctcacattgggcgaccaagtgcaagccgtgccgtaggggccgcaaacgctcgcaacccactgcccatcgtattaccttgccaccgtgtgattggcagcaatggcgcactcaccggcttcaacggcggactacatatcaaacgctccctgctgtacctggaaggtatcaaaccaactcatacgtgcaaggcaatcatgacatcttga

SEQ ID NO: 41436 - DNA, 4167 bp, Xylella fastidiosa
gtgaaagatcttatgacatcctattcgttcaccgaaaagaagcgtatccgcaaggatttcggcaagcatcgttcaatcctcaaggtgccgtttttgttagctatccaggtggactcttatcgtgcattccttcaaggagacgtggagtccagccaacgtaaagacattggtttacatgcggcactgaaatcagtatttcctattgtcagttacagcggtaatgctgctttggaatatgtcggttacaaacttggtgagccgatgttcgatgagcgtgaatgtcggcagcgtggtatgagttatggtgcgccgctgcgcgtgaccgttcgtttagtcatttatgatcgtgagtcatcgacaaaagcagttaagtacattaaggagcaggaagtatatcttggtgaaatccccttgatgactgaaaacggtaccttcattgtgaatggtaccgagcgagtcattgtttcgcagctgcatcgatccccaggtgtcttttttgaccacgaccgtggcaagacacacagttcgggtaaattgctttatagcgctcgtatcattccttgtcgaggttcatggttggacttcgaattcgacccaaaagatgcgctatttacccgtattgaccgtcgccgtaagttgccggtatctattttgttgcgtgcactcggttattctaacgaggaaatacttggcgaattttttgaaattaatacgtttcatattaatcctgataaaggggtgcagcttgagttggtgcccgagcggctacgtggtgagatattaagtttcaatctgactgacggtggcggcgtgattgttgaagccggtaagcgtatcactgcgcgtcatgtgaagcagttggaggcttcgggtatttctgcattagctgtgccggatgagtatctaattggccgtattttatcgcatgacgtgattgatgcgacgactggtgaattgttagccagtgccaacagtgaggtgaatgaggatcgcatagttgcttttcgcaaggctggtatcgactcggtcggaaccctttgggtgaacgatttggatcgtggtgcttatctatctaatactttgcgtattgatccgactagaactcagcttgaggcgcaggtcgagatatatcgcatgatgcgtccaggagagccgccaactaaggaggcagctcaaaacttatttcataatttattttttacttttgatcgttacgacttatcaatggttggtcgcatgaagtttaatcgtcgtgttggccgtaaagaagtcgctggcgagcctgttctttacgataaaaagtatttttcagatcgtaatgatgaagaatccaggcgcttagtttctaagctgggcgaaacttccgatatccttgatgtgattaaaggtttgtgtgagattcgtaatggtcgtggtgttgtggacgatattgatcatctgggtaaccgtcgggtgcgttctgtcggtgagatggcagaaaatgtcttccgtgttgggcttgtccgtgtcgaacgtgctgtcaaggaacgtttgtcaatggctgaatccgaggggcttacgcctcaagagttgatcaatgctaaaccggtcgctgccgcgattaaggaattcttcggttcctcccaattgtcccagttcatggatcagaataatcctttgtcggaagtgactcataagcgtcgtctttcggcattgggtccaggtggattaacgcgtgagcgagctggtttcgaagtgcgtgatgttcatttaagtcattatggctgcttatgtacgatcgaaacccctgaaggtcccaatattggcctaatcaattcactggccgtgtttgctcgtaccaaccaatatggcttccttgagacaccgtatcgcaaggttgtggaaggtcgcgttaccgatgaagttgagtacttgtcggcgattgaggaaaatcagtatgttattgcacaggcgaacacgctgactgatgataatgggcaattaaccgagtcatttgtgccatgtcgttttcagggggagtccctcttgaagcccccatcttatgttcattacatggatgtttcgccgatgcaaacagtatcagttgctgctgctttggtgccattcttggagcatgatgacgcgaatcgcgcattaatgggtgcgaacatgcagcgccaagctgtgcccaccttgcgtgctcagaaaccgttagttggtactggtattgagcgtacagtggcgcgtgactcgggtgtgaccgtgaatgcgcgccgtggaggtgtgattgatcaggtcgatgctggccgtatcgtggttaaagtcaacgaaagtgagattattggtgccactgatgctggtgttgatatatatggattgatcaaatatacacgctcaaatcagaatacatgtatcaatcagcgtccccttgtgaatgttggcgacatagttactagtggtgacgtactggccgatggcccatcgactgacattggcgaattggctcttgggcaaaacatgctgatcgcttttatgccttggaatggctacaacttcgaagattcaattttactttctgaacgcgttgttgaagaggatcgctacactacaatccacattgaggagctgacttgtattgcgcgcgataccaagttgggatcagaggaaatttcagctgacatccctaacgtctctgagcaggcattaaatcgtctagatgagtctggtgtggtgtacatcggtgctgaggtgcgcgctggcgatattttggttggtaaagtcacgccgaagggagaaagtcagttaactccagaagaaaagttgctgcgtgccatctttggtgaaaaagcttcggatgtgaaggatagttcgcttcgtgtacctccgggcatggatggtactgtaattgatgtccaggtgttcacccgtgatggtattgagaaggacaagcgtgcgcaccagattgaagagtatgaaatcaagcgtgtcaaaaaggattttgatgatcaatttcgtattctagaaggtgctatttatgctcgtttgcgttctcagattgtaggtaaggtggttaactccggtgttgatatcaaaaagggtgaggtcatcactggtgcttatcttgatggtttgaagaagagtgactggtttgcattgcgtatgaaggatgaggttgctgttgaggcaatcgatagggcgcagaaacagatacaagcgtatcagaaagagtttgatcagcgtttttctgacaagcgtagcaaaatcactcagggggacgacttggctccgggtgtattgaaaatggtcaaggtgtttttggctgtaaagcgttgtattcagcctggcgataagatggccggacgtcatggtaataaaggtgtggtttccaacgttgttcccgttgaagacatgccatttatggaggatgggacacctgtcgatatcgtgttaaatccgttgggcgttccctctcgtatgaatattggccaaatcttagaggtgcatttggggtgggcagctaagggtttggggcatcgaattcagcgtatgctggaggccaatgctgctattgcggacttaagaaaatttcttaatgaaatttataatcatgataaaagcgtggttggcgagcgtgtagatctgtctcagttcagtgatgacgaattgctgaatatggctaagaatctgactgatggtgtgccgatggcgagcccggttttcgatggtgcctctgaacaagagatcaagcgtatgctggatctcgcggaattgccgaccggcggtcagacccaactctacgatggccatactggggaacctttcgatcgtaagactacggtcggttacatgcactatttaaagttgaaccatttggttgatgacaagatgcacgctcgttcaactggcccttattcactggttacgcagcaaccattgggtggtaaggcccagtttggagggcagcgttttggcgaaatggaagtttgggccttggaagcttatggtgcagcttacacactgcaggaaatgttgactgtaaagtctgatgatgtgcaggggcgtaatcagatgtacaagaacattgttgatggcgatcatcagatggtggcaggtatgcctgaatcttttaatgttctcgtgaaagaaatccgctccttagcaattaatattgagttggaagataactaa

SEQ ID NO: 41437 - DNA, 939 bp, Xylella fastidiosa
atggtcttttcgggcaatgccaataaaccactgactcaaagtatttgtaaggagttaggggtgcgtatgggtaaatcgttagtgtcgcgtttttccgatggagaggagcaggtcgaaattgaggaaagtgtgcgtcgtcaggaagtatttgtggtgcagccgacctgtgcgccaagtgctgaaaatttgatggaactgttggttatcattgatgcgctcaagcgtgccagtgtttctagtgtcactgccgtgattccgtacttcggttattcgcgtcaggatcgccgcatgcgttctttgcgtgtaccgattaccgcaaaggttgcggcaaaaatgatcagtgcgattggtgctgatcgtgtgttgacgattgatttgcacgctgatcaaatccagggttttttcgatgtgccggtagacaacgtttatgcttcgcctctgttgctggctgatatttggcgtgcttatggtactgacaatctaattgtggtttccccggatgtggggggggtggtcagagcccgtgcgatggctaagcgtttaggcgataccgatctggcaatcattgataagcgccgtccgcgtgctaatgttgctacggtaatgaatattattggggaggttaacggtaagacctgtgtgttggtcgatgatttagtggatactgccggtactttgtgtgcggcggccgtagcacttaaacaaaatggtgctactaaggttgttgcttatatcacgcatccggtgctgtccggtcctgctgtggacaatattaataactctgagcttgacgagcttgtggtgaccgataccattccgttgtctgatgcagctcgggaatgccgaaaaattcgccagcttagtgtggctgaattgcttgctgagactattcggcgtattgcttttggtgaatcagtcagttcactgtatgtggattga

SEQ ID NO: 41438 - DNA, 897 bp, Xylella fastidiosa
atgggacgagttgatcccgtgagtgtcgtcgttgatgacggtgtgggctggtcggcgtggccagcacctgccaagttgaatttgtttttgcaaattaccgggcgacgtgttgatggttaccatgaattgcagactgtttttcgtctgcttgactggggcgatacgatccatctgcgggtgcgtgaagatggtcagattcatcgcattggtgagtcagtgactggggttgttgaggccgacgacttggtggtgcgtgcggcttatttgctaaaatatgcgactaatgtccatttaggggcagatatctttgttgaaaagcgaattccagtgggtggcggctttggcggtgggtcctctgatgcggcgactgtgcttcttgtgttgaatgcactgtggcacaccaggcttgacgttgcggttttggcggccttggggttacgtttgggagccgatgtacctgtatttgtacatgggtgtaatgcgtgggctgagggtgtcggtgagtgtttaacgccgatgattctgcctggagcagcctacttgctattggatccaggggtgtgtgtgccgacacgggagctgttccttgatccggatttgacgcgcgatgcgtcccccgcgacaataggcgacttcattgctggtactgcgtttggtaatgcattcgagccggttctgagacggcgcgagtctgccgttgcgggcgctcttgatgtgctttcagaggttggttttgcaagggtgactggctctggcagcggttgctttgtggaattcagtacgcgtgatgaggctgaatgtgctttggagcggctgccgtacgggttgtgtgcttgggttgctgatggcgcttcccgttctccgctgcttgatgtactgaaaacaatggaattttga

SEQ ID NO: 41439 - DNA, 1299 bp, Xylella fastidiosa
atgacgttgtgggtactcggactgaaccatcaaactgcgccaatggagctacgcgaacgggcctctttcgtcggtgatgcattgccacgcgcacttgattcactgcgcaacctccccaatgtgaacgaagccgcactgctatccacctgcaaccgtaccgagttatacgccgagaccacaaatgcgcaaatactgctgaactggctcgaacaacacagaccaggattacaaaaccacttatatcaatatcgcgacgcagcggcagtcaggcacctattcagagtcgccacaggcctagactcaatggtcctcggggaatcacaaatcctcggccaagtcaaggattcctggtccatggcacgcacccacggcacccttggcaacacacttgaccggctattccaacacggcttctccgtcgccaagcacgcacgcaccaatacacggattggcgccaaccccgtctcaatagcctcaaccgcagtgcgactagcacaagacgccttctccccgctgaacgaatcgaccgtcttgctcatcggcaccggcgagaccatccaactggcagccaaacacctgagcgaaggacgagtacaacgcctgttaattgccaaccgcacccacgccaaagcgcagatgctggccagccagcatggtggctacgcactccccctgaccgaactaaacctccaccttgccgaagccgacatcatcttctcggccactgccgcacctacccccatagtcacccaatccaacgtcgaaagcgcactacacatccgaaaacgaaaacccatgctgctatttgacctagcaataccacgcgatatcgagaccgaagtaggaacactcaccgacgcctacctatacaccattgacgacctggaacgcgccgtggaagaaaaccggcgcagccggcgcgaagcagccgaaaccgctgaggccatcattgaattacaagtgaaacgctacatggatacacttcaagcgcatgcacaccaagccccactacggcgcctacgcaccttcggcacaacgacccgagacgaactgctgacacgcgcacgacaacaactagcaaacggccgtcccgccgaagaagtcctggaacaacttgcccatggcctgaccaaccgcctgttacaccctccaactgccgcactgcgcgaagccgcactcgccaacaacaccgagctagtccgtgcagcagaacaactctttccagagaagcccggctaccaccaccccacccttcagacaacgattgtgaaaaccgatgaaaccgaccctgcgtcgtaa

SEQ ID NO: 41440 - DNA, 2043 bp, Xylella fastidiosa
gtgtcacaagcaaatggccttccatatactgatcggtacaatacgtatccggaaaacgtttcccttatgcacggcctcaattctcctcaacgtgctgcggtcttataccgtgaaggtcctctgctggtgcttgcgggtgctggcagcggcaagacgcatgtgattgtggagaagattgcgtacttgattacctcagattgttatcctgctaaacgtattgctgcgattacatttaccaacaagtccgcgaaggaaatgcgtgaacgtgtggcgaagcagatcaaaagtagtcgtgctgatggattgacgatctgcacctttcatgcattgggactgaagtttttgcagattgagcatgatgccgttggactgaagcctggcttctcggtgttcgatgcagatgatgctgatgcccagatcaatgacctgttgcatggagccaaacaggatgtgattgatgatacgaaaagacggatatcccgtgcgaagaatgctggtctgtcacctgaacaagcacttgctgctgcacgtaccacgcgtgagatggaggtggcgacgttatatgcacgctatcaagcacgcctgatagcgttcaacgccgttgattttgatgacctgattcgcctgccggtacagatccttgaaacgagtgatcaggttgcgatggcttggcgtgaacggattggttacttgttggtcgacgagtgtcaggataccaacgatgcgcaatatcgattactaaaggtgctggctagtccgcgtggcaacttcacgtgtgtaggagacgatgatcagagcatctatgcttggcgaggcgctaatgctgagaacttactgcaactggagagagattatccacagttgaaggtcatcaagttggagcagaactaccgttgtcccaaccgtgtgttgcgtgctgccaatgcgttgattgcacataacccacatgcgcatctgaagacgttgtggagtgaccagaaagacggtgagcgcatccgtatttgggagtgccgagacagtgaacatgaggccgaaaagatcgcaggggaaatctcttatttgggggatgccaagcaggtaccgtggagtgatttctgcatcttgttccgaggtaactttcaatcgcgtccgctggaaaaggcactgcaattattgcgtatcccttaccacttgacgggtggtaccgcgtttctggaacgtcaagaagtgaagaacctgttgtcttggctacgattgttggtcaacccggatgacgacgccgcatttctgcgtgcagtgcagtcacccaagcgtgaggttggttccacctcattggctaaattggctgaacttgcggcggcaaagcaaatgccgatgtcgcgtgcggctgagtcgctgggtgcgttgcaacaattaccggcgcgcgcagccaatggtctgaataaattcactgatatcttgcgtgagttgcgccagcaagtatcacgtgtgtcggcggctgagttagtgcggcgccttgctgaagtttctggtttacttaccgaattgcgtgagcagtccaatgatgaagcgagttaccaacggcgtaagcgcaatgtagaggaactggccgaatggtttgaaggcggccctttcggtgccagtgttggcgatcttgtttcgcagctagcattgctatcacgcaatgataaggacgatggcggtaaccaggtacgcatgatgacactgcacgcttccaaaggattggagtttcgttatgtgttcatcgctggttgcgaagatggcgtgctaccgcatgaagtcagcttggaagaaggcaatgtgcaagaggaacggcgcctattatatgttggtatcacccgagccaaagagcagttgtggatgagctatagcaaatgtgcgcgccgcttcggtgaacgtgtgcggtttaagcccagtcgctttttcgatgaactgccggctgaggaattacagcgcgatggtgctgatcccgtggttgatgccgaacgtaaacaggagcgtgctaaggctggtttggcagcaattcaggcgctattggactga

SEQ ID NO: 41441 - DNA, 771 bp, Xylella fastidiosa
ttgaatagcatgaacgagcaaggtgaggccattaataatagtgccgagtctcgaattcagttggaatcttcttggaaggcgcacgttggtaattggttattgcgtccggaaatgcgggatttgtctgccttcctgcgtgcgagaaaggttgctggtgtgagtgtctacccaccgggatctcagatatttgcggcgttcgaagcgaccccattccagcgggtcaaggctgtaatccttggtcaagatccttatcacggtcaaggccaagcgcatggtttgtgtttttcagtgcggccaggtatgccgttgccgccttctttgttgaatatttataaagagctcgaagaagatcttgggttgcttcgccctgatcatggctgtctgcttccttgggcaaagcgtggtgtattgctacttaatgcggtactgacggtggaggatggtcgtgcaggtgcgcatcagggtaagggctgggaaggttttaccgaccatgtcgttgataccttaaatcgcgagcgtgaaggacttgtattcatgctctggggtagctatgcccaagccaagggtaaggttattgatacgcgtcgccaccttgtactcaaggctgcgcacccttcacctttgtcagcgcatcgtggttttctgggttgccgtcatttttctctctgcaaccagtacttgagccaacatggcttggggatggtggattggagcttgccgccatgtattgcactggatggtgcaatcttaaatggtagaatagcggtgtag

SEQ ID NO: 41442 - DNA, 1635 bp, Xylella fastidiosa
atgatgagcgataaaccgttgacaaatttaaatttttcttcacttgatctgcatccagcgttgcttactgggctgacaagagcaggatttacactctgtactccgatccaggcgcttactcttccggttgcactggctggtcgtgatattgccggccaagcccaaacgggaaccgggaaaactttggcgtttttggtggtggtagttaaccgtttacttagccgtccggggctagttaatcgtaacccagaagatccgcgtgcgttgattttggcgccaacccgtgagcttgcgattcaaatctataacgatgcagtgaaatttggtggcaatcttgggttgcgttttgcgttgatttatgggggcgttgattacgataagcagcgcgaaatgttgcgcaaaggtgcggatgtggtcattgcgacgccggggcgcttgattgattaccttaagcagcacgaggtggtttcattgcgcgtttgtgagatttgtgttcttgatgaagcagatcggatgtttgacctggggtttatcaaggacattcgctttatattgcggcgcttgcccgagcgttgtagccgtcagactttgctgttctcagccactctcagtcaccgcgtgttggagttggcctatgagtatatgaatgagccagagaagctggtggcggagacggagactgtcactactacgcgggtccgtcaacgtatttatttccctgccgaggaggagaaaatcccattgctgttgggtttgctctcgcgtagcgaggggatgcgtactatggtatttgtcaatacaaaggtgtttgtcgaaggtgttgcgcgcgcactggatgaggctggttaccgggtcggtgtgctgtctggagatgtgccacaaaggaagcgagagactttgcttaatcgtttccagaaagggcaattggaaatactggttgccacagatgtggctgcacgtggattgcacattgatggcgttaattacgtatacaactacgacttaccgtttgatgcagaagattacgttcaccgtattggccgcactgcgcgtttgggagctgatggtgatgcgattagttttgcctgtgagcgttacgcgatgagtttgccggacattgaggcatatatcgagcagaagatcccggttgcagcagtgactgctgagttgctggctccattgtcgcgccctgaacgtgcatcgaatggtaacggtgatactgttggggatatttccccacattctcttgacgtgctggttgctcaggaatggcgtcggggtaagcccaggggtagccctggagagcgcgatggtcgcccccgtgtaggtaaagggccccggtcggatgggggaggtgggcgccgccgcactaaatttcgcttggagaccgagcgtgattctagtgtggatggggcagtcactcctgtatttggagtgtctacggggatagtatctgctccaggtaaagaggtggggcgaaacctcggtcgccgacgtcgtagtcgttcaatggattctggtgaaagtggccatgttgtcgccactaccgcccaagtggctgttaagtcaggtagtcaaccgtcgctcttaggtcgaatagggcaccgtatccgctcgctgttaaatatgttctaa

SEQ ID NO: 41443 - DNA, 1071 bp, Xylella fastidiosa
atgcctatttcctttctatgccctttatgcattccctcctgtttcctcatactgctcacagccttaacgacactgacaccagcatcaccaagccatgccacaaacatactgacgtacgctggtatcaaccttcctggcccggaattcagcccaagcaataaaccaggtgttctctataaggactatctttatccaagtgcatctgactacgcttacgtggtcaaaaagggcatgaacatcgtgcgcctccctgtcctttgggaacgcgttcagcccacactgaatgatgcactggacgccacgcaactcaaactgattattaaagccgtcgagcaagcgaaagcccagaaactaaacatcattctagatgtccataactactccgaatataacgatgagctgatcggcactgacaatgtccctatcagcgccttcgccgatctatggaaacgtctgtccctacagtttgccaacgacaaagcagtcatcttcggactgatgaacgagcctcatgaaatcacctcaaccacttgggctcaggctgctcaagcagccatcaacgcaatccgcagcactggcgcatgtaataaccttgtgttagtgccgggtaccgcttacagcggcgcacacagttggctgagcagctactacggcatccctaatggagaagcgctgctgaacatcaatgatcctgccaaacacatggcgttcgaagtacaccaatatctcaatgaaaatagcaccggcacgacgggcgaatgcatcagcaccaccatcggagccgagaagctagaagcattcaccaactggctgcgcacctaccacaaaaccggtttccttggcgagttcgctactggcaacaacgatacttgcaaccaagcattggaaggcatgctcagctatattgaggaaaacgcagacgtctggttgggactgacgtggtggggatctaacccctggtttggtcccgattatccatttaacctgcatccaaacagtgacggcagcgacaagccccagatgagcatcctggaatcacacgcacgtaagatcactaaaatccacaaataa

SEQ ID NO: 41444 - DNA, 918 bp, Xylella fastidiosa
gtgcaacatcgacggtggacaagggctaccgctaccatgattgcatccttctccagcattgctatgccacacgtctccctacttcccagcccatcaccgatcgcattcatcggcggcggcaatatggcacgcagcatgatcgcaggcatgattcgccaaggcgcccccagcacgtcaatatgcgtcatcgaaccaatcgccgcactgcgcgacgcacttatcgccgacttcaacatcaaggccgtcaccacagccacagaagcggccaccgacaccagcacctgggtgctggccgtgaaaccccaagtgatgcctgacgtgtgtgccaccctgccacttccagtgcaacccaacacaccactggttatctcaatcgctgcaggcatcaccacctgcaaactcaaacactggcttggcgacacctgtgcgattgtgcgcgccatgccgaataccccagccctgctaggtgccggcgtgaccggactattcgccacctcacacaccacggccacacaacgcaccctcgctgaagaactctttaacagcgtaggcaagaccctatggatcaccgaagaagcgttaatggacgccgtgactgccgtatcagggagcggtccagcctatgcgtttttgcttgccgaagcgatggaagcagcagccatcatgcaaggcctctccaccgcaaacgcacgcacactcgtccagcaaaccctattgggtgccgcacgcatgatgaccgagttaggggaaacacctgccgcactgcgccaccgcgtcacctcaccgcacgggaccaccgaagccgcaatcgcaacatttcaagaaaacgacttccaagcacttgtcgcaaaagcgatagatgccgccacacggcgcgcgcgcgcgctcggaaaggcaaacgataccgagcccacctga

SEQ ID NO: 41445 - DNA, 891 bp, Xylella fastidiosa
atgcaagatctgaaaaaaaaagtcattctggtgaccggtgcctccgacggcatcggcaagttcacagccgccacccttgccaagcaaggacataagctcatcattcacggtcggaatcgacagaagaccgaagcggccctcgcagagatcaagcggcaatctggtaaccccgatgtcgcaatgtttcttgcggacttcctgccgctcgccggcgtgaaggcgttcgctgacgccatcaaggaaaaatacgaccacattgatgtgctgatcaacaacgctggcgcgcagttcaccgaacaacgcgaggtcacgagcgaaggccatgaaaaaacaatggcgatcaacgtctttgccccaatgttactgacaaaattgctgatgcctctgctggtcaagagcgaatcggcccgcgtcgtcaccgtagcatcggatgcccatcgcatggcaggcaagcccgatctggacgacatcgaattgaaacagggctatcacatggccaaagcttacagcctatcgaaactatatgtgatctgggtgatgcaccatttcattggcgagacaaaaaaggctggcatccataacgtgacgttcaacctcgtgcatccggcgtcgacgcgaacaaacctgggcagagaagccgtgaaatcctggaaatggaaaatcatctttttcctgtggcagatcatgctggtgtcaatggacaaggcggccagcagcaccctgtatgccgcaaccgccccggaattagaaggcgtgtcaggcaggtattttgggccgaagggagaggagcagcccagcgccaaataccattcccctgagaatgaacagaaggtctgggactacgcgctgaacgccattcgaccctatctcccggcaggggcacagtcatga

SEQ ID NO: 41446 - DNA, 201 bp, SPHINGOMONAS
atgccaaagcgcaccgaccttaaaaccatcctgatcatcggcgctggcccgatcgtcatcggccaggcctgcgagttcgactactccggcgcgcaggcgtgcaaggcgctgcgcgacgagggttatcgcgtggtgctggtcaacagcaacccggccacgatcatgaccgacccgaacatggccgacaccgtgtacatcgac

SEQ ID NO: 41447 - DNA, 357 bp, SPHINGOMONAS
ccgcgcaaatgcgagcgctttctggccaacacccagctcaatcgcaaatcgcgggtgcgcgatctctccaagggcatgatcgtgcagctgcacctggccctggtgatggccatcgatgcgcgcatcctggtgctggacgagcccacgctgggcctggacatcctgtaccgcaagcagttctaccagcgcctgctggaagactacttcgacgagcagaagaccatcatcgtcaccacccaccaggtggaagagatcgagcacatcctcaccgatgtgatgttcatccgcgacggccgcatcgtgctcacggccgatatggaacacgtcgccgagcgctacaccgaagtactggtcaac

SEQ ID NO: 41448 - DNA, 513 bp, SPHINGOMONAS
ttgcagcaggaaggcatcgactgcaacctgacgctgatcttcaacggctcgcaggcgctggcctgtgccgaggccggtgtgttcctgatctcgccgtttgtcggccgcatcctggatttctttgtcgccaagggccagaccccggccagcatcgacgaagatccgggcgtggtgttcgtgcccggtgtctacgacgagttcaagcgccgcggctcctccactgtggtcatgggcgcctcgttccgctccactgcgcagatcgaggcgctggccggctgcgaccgcctgaccatctcgccggacctgctggagaagctcgacgccgaccacggcgacctgccgcgcaaactgtcgccattgaatgcggacaacgcggccatcacgccgatcaacagcgacagcttcgccaccgacttggccgctgacgatatggccaccgagaagctggccagcggcatcgacaccttcgccaaggacctggaggcgctgcgcaagaccatcgccgacaagctc

SEQ ID NO: 41449 - DNA, 616 bp, SPHINGOMONAS
caaaagggttacagggtgtttgggcacgttcacccgtacgagttcggtcaatttctggcggatcgaagagcttggaatcgcagctcacccgaatcttaatttgatcgaatacgatctgaccgatcttggctcgagcatccgtatgctagagagcaccggcgcgacagaggtctacaatctggcagctcagagttttgtcggtgtgtcttttgatcagccgaccacaacggcacaaatcactggtataggtccggtccacctgctgtaggcaattcgccaggtcaaccgagatatccgcttttaccaggcttcgacgtctgagatgttcggcaaggtgcagacggtccctcagatcgaaagcacgccgttctatccacgcagcccctacggggttgctaagctttacgcgcactggatgacggtgaactaccgtgagagttgcgacatcttcggatgcagcggaattctgttcaatcacgaaagtccattgcgtgggagtccattcgtgacgcgcaagatctccgactcggtggccaagatcaagctaggccagctggactgcatggaattgggcaacctggaccccaagcgtgactggggcgacgctcgcgaagag

SEQ ID NO: 41450 - DNA, 270 bp, SPHINGOMONAS
agccattatgtgcacaagcgggacgccccctcgggcaccgcgctgacgctgggtgaggctgccactggcttcggggcacagccgcggtttgccagcgtgcgtgccggtgacatcgtcggcgagcacagcgtgcagttcaccgggctgggtgaacgcgtcgagctgatccaccgcgccaccaaccgcgacatcttcgcgcgcggtgcgttgcatgcggccaagcgcctgctcggcaagccgccgggcagctaccgggtgcgcgatctggtg

SEQ ID NO: 41451 - DNA, 1215 bp, SPHINGOMONAS
atggcgaagatcaaggttgcaacgcccgtcgtggagatcgacggcgacgaaatgacgcggatcatctgggaatggatccgcgagcgcctgatccttccgtacctcgacatcgatctgaagtactacgatctctcggtgcagaagcgcgacgagaccaacgaccagatcaccatcgattcggccaatgcgatcaagcagtacggcgtcggcgtgaagtgcgcgacgatcaccccggacgagcagcgcgtcgaggaattcagcctcaagaagatgtggaagtcgcccaacggcacgatccgcaacatcctgggcggcgtgatcttccgcgagccgatcgtgatttcgaacgtgccgcgcctgatcccgggctggaccaagccgatcgtcgtcggccgtcacgctttcggcgaccagtacaaggcgaccgacttcaaggtgcccggcaagggcaagctgaccatgaagtgggaaggcgagaatggcgagacgatcgagcacgaggtgttcgatttcccgcaggccggcgtcgcgatgggcatgtacaatctcgacgaatcgatccgcgatttcgcgcgcgcctcgatgaactatgcgctcggccgcggctggccgctgtacctgtcgaccaagaacacgatcctcaaggcctatgacggccgcttcaaggacatcttcgccgaggtgttcgagaccgagttcaaggaccagttccagagcgccggcatcgtctacgagcatcgcctgatcgacgacatggtcgcatcggcgctcaagtggcacggcgagttcgtctgggcctgcaagaactatgacggcgacgtccagtcggaccaggtcgcgcagggcttcggctcgctgggcctgatgacctcggtgctgatgaccccggacggcaagacgatcgaggcggaagcggcgcacggcaccgtcacccgccactatcgccagcaccagcagggcaaggcgacctcgaccaacccgatcgcgtcgatcttcgcctggaccggcggcctcaagtatcgcggcaagttcgacggcacccccgaggtgacccgcttcgccgagacgctggagaaggtctgcatcgaaaccgtcgaaagcggcaagatgaccaaggacctcgcgctgctgatcggcccggaccaggcctggatgaccaccgagcagttcttcgaggcgatccgcgtcaaccttgagaccgcgatgggcagctgg

SEQ ID NO: 41452 - DNA, 888 bp, SPHINGOMONAS
gacctcaccttcgtcacgctcgacgagggaaccagcgtcgcgggggtgatgacgaccagcaaatgcccgtcacccgaggtggaatggtgccgcaaggcactgccgctcggcaaggcacgggcgctggtggtgaatgcaggcaactccaacgccttcaccggcaatcgcggccgcgccgccgtcgaggcgatcgccgcccgcaccgcgcagcatctcggctgcgatccctcggacgtgttcgtctcctcgaccggtgtgatcggcgtgccgctgccgatcgacaaggccgaggccgggctcgacgccgcctatgtcgccgagccgtgcagctgggagcaggccgccgcgacgatcatgaccacggacaccttcgccaagggcgcggtgaccaccgcggtagtcgacggccgcaccgtcacgctggccggcatcatcaagggatcgggcatgatcgccccggacatggcgacgatgctcggctatgtctttaccgatgccgcggtcgacccggtgttcctccagcgcgcgctgagcgaggccaacggcaccagcttctcgtgcatcacggtggacggcgacacctcgaccagcgacaccgtcctcgccttcgccaccggcaaggcgggcaatgcccccctcgccagcgacgaggatgacggcgccgacgccttccgcgccgcgctcgccgatctctgccgccagctcgcgctgctcgtcgtccgcgacggcgaaggcgcgcagaagctgatcgcaatcaccgtcgagggcgcggagagcgaccgcagcgcgcaccgcattgccatgtccatcgccaattcgccgctggtgaagaccgcgatcgcgggcgaggacgccaattggggtcgcgtcgtgatggccgtgggcaag

SEQ ID NO: 41453 - DNA, 1101 bp, SPHINGOMONAS
cgcggctggtgccccgatgcctggcggccgatggcggcgggggacggactgctggtgcgggtgaagccccggctggggcggctgacccgcgcggagctggccctgctcgcggacgcttccgcacgcttcggcaacgggctggtcgacctgaccaaccgcgccaaccttcagctgcgcggcgtgtcggacgcgggctggcccgcgctcctcgacctgctgaccgcgcacgcgctggtcgatcccgaccggacccgtgagcgccggcgcaccctgatcgtcgcgccggactgggaacagggcgacgacacgcatcggatcgccaccgatctgctggcgcgcatcgacgcgctgccggcgctgcccggcaagacgggcttcgtgatcgatgccggcccggcgccgctgctccgagacgcaccgggcgacttccgcatcgagcggggcgaagccggcggcctgatcctgcgtgccgaggggcggggcaccggcatgccgctcgcacctggcgacgaggccgcggcgctggcgcggctcgcccgctggttcgtcgatagcggcggggtggccgccggacggatggcccgccacacagcgccgctgcccgactgggccttgggcaccgagccgcccgccgcaccccgcaccgcgatcctgcccggcgcgcaccccatggggtcggccgtcggcgcgcccttcggccagatgacggcggacagcctcgccgtcctcgccgggcagcccatcgcggcggtgcgggtcacgccgtggcgggtactgctcgccgagggcccgctcgccgccgatccccgcttcctcgcggaccccgccgacccgctgctgcgcaccgatgcctgcgccggtgccccggcttgtccgcaggcgagcgtcgagacccgcagcctcgcccgcgcgctcgcgccgcaggtcgacggacgcctgcacgtctcgggctgcgccaaggggtgtgcccgcgccctgccagcggacgtgaccgtaaccgggcggaacggcctgctagacctcgccttggacgcgacagccggcgcgccacccgatcatgtcggcctcgaacccgccgcgctcctcgccctcctcggaaag

SEQ ID NO: 41454 - DNA, 1713 bp, SPHINGOMONAS
tatgtcgccttttacctgtggctgcgggcgcaggcgatcgacgccctggtgcaggtcggtgcccatggcacgctggaatggctgccgggcaaggcggtggcactttccgatgcctgctggcccgaggccctggccggcgacctgccgatcctctaccccttcatcgtcaacgatccgggcgaggccgcccaggccaaacgccgcacgggcgcggtgaccatcggccatcttccgcccccgctgaagactgccggaagcggggcggggctcggccggatcgaggcgctgctcgacgaattctccaatgcggtgggcctcgaccccgcccggcgcgaccggctgcaggtcgcgatccgcgaagaggcgcgcgcggtggggctggacgcggagctggggctcgacaccgccaccagtaccgccgaggcaatcacccggatcgatcgcttcgtctgcgacgtgaaggagggccagttcggcgacggcctccacgtcttcgggcggggccaatgcggcgcggcggagcgggacgggctgctggccgggctggccgggcggcgcgtcccggccgggccctcgggctcgcccttccgcggtcgccgcgacgtgctgccgacgggccgcaatctttacgccattgatccccgcgcggtgccttcgcgcgccgcccacgcccaggggatcgttctcgccgacgagctgatccgccggcatttgcaggaccatggcgactatcccaaggggctggtcgtcgacctgtggggttcggcgacgatgcgcaccgccggcgaggaattcgcaatggcgttgcatctgctcggcgcggcgcccgtgtgggacagcgcatcggagcgggtgaccggcgtggagatcctgccgctggcgatgctcgaccggcctcggatcgacgtgacactgcgcatctccggcctgttccgcgatgccttcccgacgctgccccagctgttcggccaggcggtgcgggcgctggcggcgcgcgacgagccggccgactggaacccgttcgccgggcaggtagcgggtgcgcgcgtctatggcccgcagccgggcgactatggcctcggcatgggcgccacggtggacacctatacggaggacgcccggcgtgctgcgggggaggcgtggctcgtcgcatccgatcatgcgttcgacctgcccgaggcgcaggccgatccggcgggcatccgcgcccgggtggcgagtgccgatacctttgtccatgtccaggacctggccgagaccgacctgctgctcgccgccgactatgccgcgcacgaggcgggcttcgcggcggcgaaggcgctcggcggcgggcgggcggcggcgctctatcatctcgatagccacgatccggcgcgtgccgtcgcgcggccgctgaccgaggaggtcgcgcgggtggtccgcgcccgtgcggcgcatccgggctggatctcgggcatgctgcgccacggctttcgcggggcggcggagatcgcggcgacgctcgaccatctcggcagcttcgcgcatctcgccggtgccgtcccgccccagctgttcgacctctatcacgacgcgacgctcggcgcgcccgaggtgcgcgcctttctcgcccgcgagaaccccgctgcgctcgccgcgatggaggcgcgcttcgccgccctccatgccgccggtctctggccgacccggcgcaactccatcctcgccagtctg

SEQ ID NO: 41455 - DNA, 1392 bp, SPHINGOMONAS
ttggctgaatcctacgacgtcctcgttctcggctcgggccccggcggctatgtcgcggcgatccgggcggcccagctgggcctgaagaccgccatcgtcgagcgcgagctgctcggcggcatctgcctcaactggggctgcatccccaccaaggcgctgctgcgctcggcggaaatcttccactatatgcagcacgccaaggactacggcctgatcgccaaccagatcagcgccgatctggacgcggtggtgaagcgctcgcgcggcgtcgccaagcagctcaatcagggcgtcacgcacctgatgaagaagaacaagatcgcggtgcacatgggcaccggcgtgctgaccgccaagggcaagctgaccgtcaccgccgcggacggcaagaagaccgagctggaagcgaagaacatcatcgtcgccaccggcgcccgcgcccgcgacctgcccttcgccaaggccgacggcaagcgcatctggacctatcgccacgcgatgacccccaccgagatgccgaccaagctgctggtcatcggctcgggcgcgatcggcgtggagttcgccagcttctacaacgacatgggcgccaaggtgacgatcgtcgaaatgctcgaccggatcgtgccggtggaagacaaggacgtctccgcccacctcgaaaaggcgttcaagaagcaggggatgaccatcctcacccagaccggcgtcgagaagctcgacgtgacggcgaccggcgtcaaggcgtcgatcaaggacaaggacggcaaggtcaccgtcgaggagttcagccacgtcatcgtcgcgatcggcatcgtcccgaacaccgagaatatcggcctcgagacgctgggcgtgaagaccgagcgcggccatatcgtcaccgacggcgcctgccgcaccaatgtcgagggcctgtgggcgatcggcgacgtgaccgcgccgccctggctcgcgcacaaggccagccatgagggtgtgatcgcggtggaagcgatcaacggcggccacccgcacgcgatggacccgcgcaacatcccgggctgcacctattgccacccgcagatcgccagcgtcggcctcaccgaagccaaggccaaggaagccggctacgaagtcaaggtcggcaacttcccgttcatcggcaacggcaaggcgatcgcgctcggcgagccggaaggctttgtgaagacggtgttcgatgccaagaccggcgagctgctcggcgcccacatgatcggcgcggaagtgaccgagatgatccagggctacacgatcggcaagaccggcgagctgaccgaggcggagctgatggaaacggtgttcccgcacccgacgatcagcgagacgatgcacgaggccgtgctcggcgcctatggcaaggccctgcac

SEQ ID NO: 41456 - DNA, 1584 bp, SPHINGOMONAS
aggatgtccatgcttcgaaagacactgctcgcgggagcggcgctgctgctcgcgcccctgccggccctcgcccaggacggatccaacagcatcatcgtgggcctcgccgcggccaagtccgggccgacgatcgaccgccacatcttcggccagttcgccgagcatctcggcagcggcatctatggcggcatctgggtgggcaaggagtcgccgatccccaacacccgcggcatccgcaaggacgtggtcgccgccctgcgcgcgatcaaggtgccggtggtgcgctggccgggcggctgcttcgccgacgaatatcactggcgcgacggcatcggcccgcaggaaaagcgccgcagcagcgtgaacaccaactggggcggcgcgggcgaacccaatagcttcggcaccgacgagttcatggactttgccgaccaggtgggggccgaggcctatatctcggtcaatgtcggctcgggcacgatccaggaggcggccgactggctcgcctatatgaccgccgatccctccagcaccgccggcaaggagcgcgccgccaacggccatgtcgcgccctacaaggtgaagtggctgggtctcggcaacgaaagctggggctgcggtggttcgatgcggccggaccattatgtcgacctgatgaagcgcttcgcccgcttcacccacaatctcgatcccaagcagggcgagaagggccccgagccgatgcagcgcatcgcggtcggccccaacgacggcgataccacctataccgaggcggtgatggcggcgtggaagggccatgactgggcgtggaacatcgagggcctgtcgatgcacgcctataccaccggcggctggccgccctccatgcccagcgtcggcttcgacgagaccggctatgccaggctggtcaaggcggcgctcgcgatggacgggatgatcgccaagcactcggcgatcatggacaagtacgatcccgagaagaaggtgccgctggtcatcgacgaatggggcgtgtggctggcgccgctgccgggatcgaacccgggcttcctcacccagcagaactcgctgcgcgacgcgatcatcgccgcgctgcacttcaacatcttcgcgcgccatgcggaccgggtgaagatgaccaacatcgcccagatgatcaacgtgctccaggcgatgatcctcaccgacaaggagaagatggtcctcaccccgacctaccatgtcttccgcatgtacgtgcccttccaggacgcgcaggcggtgccggtctcctttgacgcgggcacctacacccagggcgacgtgaccctgccgcgcgtcgacgcgatcgccgcgcggggcaaggacggcaaattgtggctggcggtgaccaacctcgatgcgggcaagccggcgcggttcgacgtgaagttggccgggctgacggcgaagaccgccaagggcgaagtgctgaccgccgcgaaggtcgatgcggtcaacagcttcgaagcaccgaacgcggtggtccccaagccgatcagcggcaaggtcgccaagggcgcggtgaccctggagctgacggccaaatcggtcccagtggtcgac

SEQ ID NO: 41457 - DNA, 1422 bp, SPHINGOMONAS
  unsure (1)..(1422): unsure at all n locations
gcgaccaagaccaccacgttcgaccgtttgaaccctgtaaccggcgccgtggcgtcgaccagcactgccgccacccccgccgatgcagcggccgcggtcgagcgcgccgacgccgccttcccggcatggtcggggctggggccgacggcccgccgcgccgcgctggtacgcgccgccgatgcgctcgaggcccgcgccgacgcctttgtcgaggcgatgatgggcgagatcggcgcgaccgagggctgggcccgcttcaacctgatgctcgccgccaacatggtgcgcgaggccgccgcgcttaccacccagatcggtggcgaggtgatcccttcggacaagcccggctgcatcgccatggcggtgcgcgaaccggtgggcgtgctgctcggcatcgcgccgtggaatgcgccgatcatcctgggcgtccgggccgtggcggtgccgctcgcctgcggcaatacggtggtgctcaaggccagcgagcaatgtccgcgcacccatagcctgatcgccgaagcgttggcacacgccggngctgcccgacggcgcggtctcgatcgtcaccaacgcgcaggaagacgccgcagaggtggtcggcgcgctgatcgaccatcccaagatccgccggatcaacttcaccggctccacccatgtcggcaagatcatcgcccagcgctcggccgagcatctgaagccggtgctgctcgagctgggcggcaaggcgccgctgatcgtgctcgacgatgccgatctccacgaggcggtaaaggcccagggccgttcggcgcgttcatgaaccagggccagatctgcatgtcgaccgagcggatcatcgtgctcgatgccgttgccgatgcctttgtcgagaagttcgccgccaaggtcgcgacgttggccgtcggcgatccgcgcgagggcaaggcgccactgggcgcggtggtcgaccgcaagaccgtgggccatgtccagtcgctcgtcgccgatgcggtggcggacggcgcggtgcaggtcgccggaggcccggcggacggcgtgctgatgccggcgcatgtcgtggatcgcgtgacccctgcgatgcggctgttccgcgaggagagcttcggacccgtggtcggcatcatccgcgccgccgacgaggagaccgcgatcgcgctggccaacgacagcgaatacggcctctcggcatcggtcttcacccgcgacaccgcgcgcggcctgcgggtcgcacggcggatccagtcgggcatctgccatatcaacggccccaccgtgcacgacgaggcgcagatgcccttcggcggcgtcaaggccagcggccatggccgcttcggcggcaaggccggcatcgatttcttcaccgagctgcgctggatcaccatcgagacccagcccggccattatccgatctaatcgaaacca

SEQ ID NO: 41458 - DNA, 726 bp, SPHINGOMONAS
atgtcgccgacgctcaaccgcgacatgatggaggtactccacgcgctcgaattccgcgacgatgtcggcgtgctggtgctcaccggcgaaggcgccgcctggaccgcgggcatggacctcaaggaatatttccgcgagaccgaagccggcggcctgggcgccacacgccaggcacagcgcgagagctatggctggtggcgtcgcctgcgctggtaccagaagccgaccatcgcgatggtcaatggctggtgcttcggcggcggctatggcccgctgttcgcctgcgacctcgcctttgcggcggaagaggcgcagttcggtctcagcgagatcaactggggcatcctgccgggcggcggcgcgaccaaggtcgccgtggagctcacctcgttccgcaacgccatgtaccatgcgatgatgggcgagaatatcgacggcaagaaggccgccgaatggggcctggtcaacgaggcccacccgctcgaccagctcaaggcgcgtgtcaccgaagtggcgaacgtgctgctgaagaagaacccggtggcgctcaaggcgaccaaggatgcggtccgtcgcgtctcgatcatgagctatgacgatgccgaggactatctggtccgcgcgcaggaggccgccaacagcttcgacaatgaagggcgcaaggaaggcatccgccagttcatcgacgagaagagctacaagcccggtctcggcgcgtacgacaag

SEQ ID NO: 41459 - DNA, 2142 bp, SPHINGOMONAS
gttcagtcgaagctcaacgccgtcgtcaacattatcggcgaggcgctgcacagcgaggtctgctcgatctatcttctccgcgaaggcgcgctggagctgttcgcgacgcgcgggctgaagcaggaggcggtgcacgtcaccaagctggggatgggcgagggcctcgtcggcaccatcgccgcccatgtcgagacgctcaacctcgacgaggcaaccagccaccccaatttcgtccataatccggaaaccggcgaggaccgcttccacagctttgccggcgtgccgatcatccggcgcgagcgggcggtgggcgtgctcgccgtgcagcatgtcgatccacggcgctatgccgatatcgagatcgaggcgctgcagaccgtggcgatggtgctttccgagctgatcgccaatgccgagctgatcgatgctgcgggcggtgcctccacccggctgcagccgaccgcctccggcacgatccgcggatttcggctggtcgagggcatggcgcgtggcgtggcggtgttccaccagccgcgcatcgtgatcgaacataccgtggcggacgataccgaggccgagcgccaccgcgtctatgccgcgttcgacaagatgcgcgagcagatcgagcgcatgaccagccaggccgaattcggcagcggcggcgagcatgaggagatcctcgccacctacaagatgttcgcctatgacgagggctggagccgccgcatcaacgaggcgatcgattccggccttaccgccgaggctgcgatcgagcgtgtgcagcagcgcacccgccagcgcatgcgggaaatcgacgatcccctgctgcgcgatcggatgcacgatctggaggacctctccaaccggctgctgcggatcgtctcgggccagctcggcaccgccgcgcaattggggttgcggcaggattcgatcctgatcgcgcgcaacctggggccggccgagctgctcgaatatgatcggcggcggttgaagggcgtggtgctcgaggaaggctcgctgaccgcgcacgtcaccatcgtcgcccgcgcgatgggcgtgccggtgctcggccgtgttcgcgagatccgccgcgaagtcgccgagggcgacctgctcctgctcgacgtgggcgaggaaagcgtattcgtgcgcccctcgctggcgatggaggaggcgttcgaggccaagctcgcgctcagccagaagcggcgggcggcctttgcccagctcaagaacgtcgcgccagtgaccagggatgggcaccgggtgacggtgatggtcaatgccgggctgcgcgacgacgtcgccgcgctcgacctgaccggcgccgacggcatcggcctgttccgcaccgaattccagttcctcgtctcggccaccctgccgcagcgcgaggcgcagcggcggctctaccgcgacgtgctggagacggcgggcgaccggccggtgatcttccgcaccgtcgacatcggcggcgacaaggcgctgccctatctgaaccatgacgaggacggcgaggaagagaacccggcgatgggctggcgggcgctgcgcctggcgctcgatcgcgatggcctgatgaaggcgcaggcgcgcgcgctgatcgaggcggcggcggggcggacgctcaacgtgatgttcccgatggtctcggagccctgggagttcgatcaggcgcgcgcgctgttcgaggcgcagcatgcctggcttgccgcgcgcggccgcaagatgccgaccgagatccgctacggcgcgatgctcgaggtgccggcgctggccgagatgctcgacatgctgctgcccaagctgcagttcctgtcgatcggcaccaacgacctcacccagtttctgttcgccgccgatcgcgcccatcccaagctggcgctgcgctatgactggctgagcccggcgatcctgcgcttcctcaagcgggtgagcgaccaggcgcgcgcggcgggggtgccggtggcggtgtgcggcgagatgggggggcgtccgctggaggcgctcgcgctgatcgggctgggtatcgatcgcctgtcgatcacgccggcggcggtgggaccgatcaaggcgatgctgcgctcgctggatcgcgacgcggtcatggcggcgatgacggccatgctcgcgcatccccag

SEQ ID NO: 41460 - DNA, 1281 bp, SPHINGOMONAS
atggcgcgtatcgtaatgaagttcggcggcacatcgatggccgggatcgagcgtatccgcagcgtcgccgcccgcgtcaaacgcgagtgggaggcgggcaaccaggtcgccgtggtcgtatcggcgatggccggcgagaccgaccggctggtcggcttctgccgcgaggcctcgtcgctctatgaccccaaggaatatgacgtcgtcgtctccgccggcgagcagatcaccagcgggctgctggcgatcgcgctgcaggcgatcggcgtgccggcgcgctcctggctcggctggcagctgccggtgcagacctcggacgccttcgccaaggcacggatcgaggacatcggcaccgacgcactgctcgccagcatgaatgcgggcgaagtcgcggtcgtccccggcttccagggcgtgcatgagggccggatcaccacgctcggccgcggcggctcggacacctcggcggtcgcggtcgctgcggcggtgaaggccgatcgctgcgacatctacaccgatgtcgacggggtctacaccaccgatccgcgcatcgtgccccgcgcgcgcaagctgaagcgcgtcacttacgaggaaatgctcgaactcgccagcgtcggcgccaaggtgctccagacccgttcggtcggcctggcgatgaaggaaggggttcgcgtgcaggtgctctcgtccttcacgggcgacgatgcgccgatggcagatacattgcccgggacgatgatcgtgggcgaagaggagattcaggacgtggaacgccagctcatcaccggcatcgcgcacgacaagaacgaggccaagatcaccctgaccgcggtgccggacaagcccggcgcggtggcatcgatcttcaccccgctcgccgatgccagcatcaacgtggacatgatcatccagaacatcgcgcaccagagcgccggcagcgccagcgcgaccgacgtgacgttcacggtgccggcggcggatctcgcccgctcgctggagatcctggcgcagcagaaggacgcgatcggcttcagcgacatcagccatgacacgcgcgtggccaaggtttcggtggtcggcgtcggcatgcgcagccatgccggtgtcgccgcgacgatgttccagacgctgggcgcgcgcggcatcaacatccaggcgatcaccacctccgagatcaaggtctcggtgctgatcgaggaagactataccgaactcgcggtgcgcgtgctgcacaccgcctatggcctcgacgcagacgaggtcgcagcctgagccgggact

SEQ ID NO: 41461 - DNA, 1143 bp, SPHINGOMONAS
ctcatgcccgtctacccgcggtgcggtgtgcggccggtgcgaggcgagggctgttacctgatcggcgaacgaggggaacgctatctcgatttcgccgccggtatcgccgtcaacgcgctgggccatggccacccgcatctggtgaaggcgatcgccgaccaggccgccacgctgatgcacgtctcgaacctctacggctcgccccaaggcgaggcgctggcgacacgtatcctgaagcacagcttcgccgacacgctgttcttcaccaattcgggcgtcgaggcgatcgagtgcgcgatcaaggtcgcgcggcgctatcactacgtcaacggcaacccgcagcggcacaagctgatcacgttcaagaacgcctttcacggccgttcgctgggcgcgatctcggcgaccgaccagggcaagatgcgcgacggcttcgagccgctgctgccgggcttcgactatgtgccgttcaacgatctggagggcgcgctcgccaagatcgatggcgagaccgccggcttcctggtcgagacgatccagggcgagggcgggatgaccgcgggcaagcccgagttcatccagggcctgcgcaaggcctgtgacgagcacggcctgctgctgatcctcgacgagatccagtgcggctatggccggaccggcaagatgtgggcctatgagcattacggcatcacgcccgacatcatgacctcggccaagggcatcggcggcggcttcccgctcggcgcctgcctcgccaccgaggaagcggccaagggcatggtcgccggcacccacggctccacctatggcggcaacccgctgggcatggccgccggcatggcggtgctcgacgtgatggaggagcccggcttcctcgagcatgtcacccgcatgggcgagcggctgcgccaggccttcgaacagatgatccccaaccatgaccacctgttcgaggagattcgcggcaaggggctgatgctcggcatcaagatgaaggacacggtggtgagccgcgacttcgtcgcccatctgcgcgatcatcacgggctgctgaccgtggcggcgggcgagaatgtgttccgcgtgctgccgccgctggtgatcgacgagagccacatcgccgaagcggtcgacaagctgagc

SEQ ID NO: 41462 - DNA, 786 bp, SPHINGOMONAS
ctcgccggccatgtgctggcgatgatcttcgagaagaacagcactcgcacccgcgtctcgttcgacatggcgatccgccaattgggcggcaccagcatcgtgatggatgcaggctcgatgcagctcggccgcggcgaaagcattgcggacaccgcccgcgtgctctccggctatgtcgacgcgatcatgatccgcaccgacgatcaccagaaggtgatcgacatggcgaaatacgccagcgtgccggtgatcaacggcctcaccgacgcctcgcacccctgccagatcatggccgacctgctgaccatcctcgaaagcggcaaggcgctgccgggcctcaaggtcgcgtggctgggcgacggcaacaatgtgctcgcctcgatcatggaagcggccggactgatgcagttcgacgtcgtcgccgcctgcccgcagggctatcagccgagcgatgccgatctcgcgaagggcaagggccgcgcccgcgtggtcggcaccgcgcgcgaggcggtggaaggcgccgacatcctggtcaccgacacctggatctcgatgggccaggcccatgccgagaccaagctcaaggcgatgatgcccttccaggtcacgcaagccctgatggcggcggccaagcccgacgcccgcttcctccactgcctgcccgcgcaccgcggcgaggaagtgaccgacgcggtgatcgacgggccccagtcgctgatctggcccgaggccgagaaccggctgcacgcgcagaagtccgtcctgcgctggtgtttcgggcagatc

SEQ ID NO: 41463 - DNA, 840 bp, SPHINGOMONAS
gtacccaaggtgacgctcaacaacggcgtcgagatgccgatcctcggcttcggcgtgttccaggtgccggacccggcggaatgcgagcgcagcgtgcgcgatgcgatcgatatcggctaccggctgctcgataccgcggcctcctatggcaatgaggaagcggtcggcgccgccatccgcacccacggcatcgatcgcgaggcgctgttcgtcaccaccaagctgtggattcaggacgccagctacgaaggcgccaaggcggcgttcgaacgctcgatcaacaagctcgggctcgactatctcgatctgtggctgatccaccagccctatggcgacgtctatggggcgtggcgcgcgatggaggaactgcacaaggccggccgcgttcgcgcgatcggtgtcagcaacttctatccggatcgcctggtcgacttcgtgctgcacaacgaggtcaagccggcggtcaaccagatcgagatccacccgttccaccagcaggcggacgcggcgaaggtcctcgctgactatggcgtgcaggccgaggcctggggcccgttcgcggagggcaagaacggcctgttcaccaacccggtcttgcagtcgattgccgacaggcacggcaggagcatcgcccaggtggtgctgcgctggctgaccgatcgcggcatcgtcgccatccccaagtcggtgcgcaaggagcggatggcggagaacgtcgcgatcttcgacttcgacctcgacgccgacgacctgaaggcgatcgaagggctcgaccaggcgcagagcagcttcttcgaccaccgcgacccggcgatggtgaaatggctcggcacccggaag

SEQ ID NO: 41464 - DNA, 774 bp, SPHINGOMONAS
ggcacgggtccgctggggctcgcgatcgcccgccgggtgggcgcgggcaagcatgtgctgctggccgatgtacatgaggaaaccgccaacacagcggcagaacgccttctggacgcgggtttcgacgccagtgctgccgtggtcgatatcgcctcgcgggcgtcgatcgaggcgctggtcgagcgagcgaccggactgggtgcggtcacgggcctgatccatgccgcgggcgtgtcgccgtcgatggcgagcgcggaggtcatcctcaaggtcgatctctacgggacggccgtgttgctggagacctttggcgacgtgatcgccccgggcggatcgggcgtggtgatcgcctcccagtccggccaccgcctgggcgcgctgaccgccgaggaagacgcggcactcgcgaccacgccgaccgaggagctgctcgcgctgccgttgctgcaggacgtcacggacacgctgcacgcctatcagctctcgaagcgcgccaatgtgctgcgggtgaagggcgaggcgccccgctggggcaagcgcggcgcgcgggtcaatgcgatcagcccgggtatcgtcatcaccccgctcgcccgccacgaactcaccggtccgcgtgcggactattacaatcgcatgatccagggctccccggtgggacgtgcgggtacgccggacgaagtgggcgccgtgggtgcgctgctgatggggccggacggcgcgtttatcaccggcagcgacttcctgatggatggcggcgtcaccgcgtcctggttc

SEQ ID NO: 41465 - DNA, 834 bp, SPHINGOMONAS
gtgatcgttgtaatcggcgccgggggcatcggccaggcgattgcccgccgccagggcttcggccggaaggtggtgctcgccgactggaacgcggaaacgctggccaaggcagccgacacgatgcgagatgccagctacgatgtggtgacgcagcaggtggacgtgacctcgcacgcttcggtgcaggcgctggccaaggccgctgccgcactcggcccggtgatgcaggtggtcaacaccgccggcctttccccgaacatggcgccggtggaaaagatcctcgaggtcgacctctatggctcggccgtcgtgttcgaggaattcggcgcggtgatcgcgccgggcggcgccggactgatcatctccagcatggccggccacatgatgcgccagctgccggaagaggacgagaagcagctcgcccacacccccgtcgaccagctgctctcgctgccgtgcctgcagtcggatcgcatccccaacacgctggtcgcctatatggtcgccaagcgcgccaatttcctgcgcgtccaggccgaggccattcgctggggggagcgcggcgcccgcgtcaacgcgatcagcccggacatcatcgtgacgccgctggccgcgcacgagctgaattccgagatcggcgacatctaccgcggcatggtcgaggcatcgccctccaagcggatggcaccgccggaggaaatcgcgatcgccgcgagcttcctgctcggcccggatgccggcttcatcaccggcagcgacctgctgatcgatggtggcgtgatcgccgcgatgcgcgccggcaagctgccgacgccggcctgatctcccccgggg

SEQ ID NO: 41466 - DNA, 1125 bp, SPHINGOMONAS
ccagagctgttcgacgcgctgctcgacacggtgcgccgcttcgtcgccgagcggctccgcccgctggaggctgcggtggaggcggcggatgcgatcccggagcatatcgtcgaggagatgaaggcgctgggcctgttcggcctctcgatcgacgaggaacatggcggcctgggcctcaccatgggcgaggaatgccgggtggcgatcgagctggggcgcaccacgcccgcctttcgctcggccttcggcaccaatgtgggcatcggcagccaggggctggtgatcgcgggcacgcccgagcagaaggcgcactggcttccgcgcatcgcccggggcgcgatcatcaccagcttcgcgctgacggaaccggacgtaggttcggattcgggcgcggtgcagacccgtgccgtgcgcgacggcgacgtctaccggctgagcggcaccaagcgctacatcaccaatgccgacaaggcgcagctcttcaccgtgatggcgcgcaccggcgcggaagcgggcgggcgcggcgtttccgcctttctggtgccgcgcgacctgcccggcgtctcgatcggcgagcccgagaagaagatggggcagaagggcgcccgcgtcgccgacgtgcggttcgatgacgtggccgtgccggtcgcaaaccgcctgggtgccgaaggcgacggcttccgcatcgcgatgcaggtgctcgatcgcggccggctgcacatcgcggcagtctgcgtgggcgtcgccgagcggctgatcgccgattgcgtcgcctatgccggcgagcgcaagcagttcggcaagccgatcgccgagcaccagctgatccaggcgatgctggcggattcgaagaccgaggcgctcgccgcccgcgcgctggtgctggagacggccaccgcgaaggatgccggggcgaacaccacgatggaggccgcggcggcgaagtatttcgccagcgagatggtaggccgcgtcgccgatcgcgcggtgcagatcttcggcggcgccggctacatcgccgattacgggatcgagcggctgtaccgcgacgtgcggctgttccggatctacgaaggcaccagccagatccagcagctgatcatcgcccgcgagacgctgaagcgc

SEQ ID NO: 41467 - DNA, 741 bp, SPHINGOMONAS
tttcgcctggatggccgcgtcgcgctggtcaccggaggctcgcgcggcatcgggcggatgatcgcggaaggcttcgtcgcttcgggcgcgaaggtctatgtatcgtcgcgcaaggccggggcctgcgaggagaccgccgccgcgctgggtccgactgccgtgccgctgccccatgacgtctccaccgtcgaaggctgccgggcgctcgctgccgatctggccgcgcgggaggcgcgcctcgacattctggtcaacaatgccggtgcggcctggggtgagccgttcgagagcttcccggaacagggctgggacaaggtcatggacctcaacgtcaagtcgcccttctttctcacccaggcgctgcacggcctgctcaaggccggcggcagcgccgagcgcccggccaaggtgatcaacatcacctcgatcgacggccagcggctgaacgcctgggaaacctatagctaccaggcctccaaggcggcactgatccacctcacccggcggatggcggcgcggctggtgcgcgaccagatccacgtcacctcgatcgcgccgggcgccttccccagcgacatgaacaaggccgcgcgtgaccatggcggcacggtggcgcaggcgatccccgctaggcggatcggcgtggccgaggacatggcgggcgcggcgatcttcctcgccgcccgtgccggggattatctggtgggcgaaaccgtgacggtcgacggcgggctggtcaac

SEQ ID NO: 41468 - DNA, 768 bp, SPHINGOMONAS
caggcgattttcattaccggcggcgcatccggtatcgggcgggcggtggcgcagctgttcgcggcgcggggctggcgggtcgggctggcggacgtcaacgcgacgggcctggaggaaacccgggcgctgctgcccgaaggatgcgcgacgacgcatctgctcgacgtgcgcgaccgcgatcagtgggtggcggcgctcgccgacttcgcgcaggccagcggcgggcggatggacgtgctgttcaacaacgcgggaatcggtaccagcggcccctttgccaccaccgatgcggccgagctggagcgctgcatcgcggtgaacttcaccggcgtggtgcacggcgcgcatgccgggttcgcgctgctcgccgcgacgccgggctcggcgatgctgatcaccagctcggcggcaggcatctacggcacggcgggtgcggcgatctattcggcgaccaagttcgcggtgcgcggactggccgaagcgctggacggcgaatggtcggcggccggcgtgaaggtgcgcacgctgatgcccgccttcatcgacacgccgctgctcgaccacccgaccggtggctccaaccagctgatccgcgagaatgtccggcgcgcggggctggagatctcgccggtaggcgatgtcgccgaggccgcctgggcggcggtgcacggcgaggtgctccacacccgtgtcggcaagaccgcgcgcaagctctggttcgccgcgcgctggatgccgggggcgctccgcaagcaggccaagcggagc

SEQ ID NO: 41469 - DNA, 723 bp, SPHINGOMONAS
atgacgagcatcggcatctacggcagcatggggcggatgggtcaggcgatcgccgcggctcttcccgaattcggcgcccgcctggcaggcggcacggacgtcggcgatgatcccgcagagctggcccgcaaggccgatgtcctcgtcgatttctcggccaccgccgcgctggaggcgaatctcgccgcagcccgcgccgcccgcaccccgatcgtgatcggcaccaccggcctcgccgaacgccaccaccgcatgatcgacgcggccgcgcaggaaatcgcggtgctgcagaccggcaacacctcgctcggcatcgggctgctcgcgcagctgatccatgaagccgcgtcgcggctgggtgccgactgggacatcgagatcgtcgagacccatcaccgcaacaaggccgatgcgccttcgggcaccgcgctgatgctgggtgccgccgctgccgaggcgatgggtaccaccctcgccgaggccggggtgagcgaccgcgccggccttaccggcccgcgcgccgccggcaccatcggcatggccagcctgcgcggcggatcggtgatcggcgaccatacggtggtcttcgccagcgacggcgagcgcatcgagctcacccaccgcgccgatgatcgcgccatcttcgccaagggcgcgatccgcgccgcgctctggctgcccggccgcgatgcaggccgctacacgatgcgcgaggtcctcggc

SEQ ID NO: 41470 - DNA, 1380 bp, SPHINGOMONAS
aaatgaaagcgggggagagaagacatggcgatcaagaccttggcaggcatgacggccctgctgctggcatcggcgagcgcgcaggccgccccgcgcgatccgctcgcccccaccggtcgctggtccgccaataccgacggccgggcgcccacgccgccgatgggctggaacagctggaacgccttcgcgaccgatgtcgacgaggagaaggtgctcgcctcggcgcaaaggatcgtcgacaccggcctcgccgccaagggctatcgctatgtcaatctcgacgagggctggtgggaccatcgccgcgccgacggacggatgctggtgcgcgcggacaagtttccttcagccgccacgcccgacggcgccacgtcgttcaggccgttcaccgatcggctgcatgcaatggggctgaaggccggcatctacaccgatctcggccgcaatacctgcgcacaagcctatggccccaacgagcccaacctgccgcgcggcagcgtgaccgagcgcgaggtggggctgtacggccatatcgaccaggacatcgcgctctatttcggcgcgtggggcttcgactatatcaagatcgatggctgcggcctgcgcgcctatggcgaagacagcccgctggtccgcgccggacgccaccgcgccttggcgccgctgctcgacctggagaacgtgaaccgctcgaacatcccggcagtgcgcggcatgttcgagcaggtaaaggcggcgctggttcgcgccgatccggacggcgactatctcctctcgctgtgcatctggggctcggccaatgtccgcgcctgggccaaggacgtgggcaatatctcgcgcaccagcgacgacatcacgccgcactggacgcgcctgctgaccaatttcgacaccgccgccaggcggccgctctacgcgcatcccggctcctggaacgatcccgacatgctgttcatcggcaagggcgagttcgatgccgagcatctgaccgaggcgcgctcccacttcgcgctctgggcgatggtctccgcaccgctgctgatcggtgcggacctgcgcacgacgccgcaatcgctgatggacattttcggcaatgccgcgctgatcgcgatcgaccaggatcccgccggcaaccaggccgtgctcgccttcgatacggacgacttccagattctggtaaagacgctggcggacggcgagaaggcggtggcgctgttcaaccgaaccgccgcgccgatcgaggcaaccctgaccgcccaacatctgaagctgcgcgccgacgcgccgatcgcgctcaccgacgtgtggaccggcgcccgttccagcctgcagggcgagcgcaagttcaagctcgccccgcatgagaccctggtattccgc

SEQ ID NO: 41471 - DNA, 1395 bp, SPHINGOMONAS
agtctgttccgtctcaaacccatccacgccgcggcggaccagccgcacgggcatcagctcgcccgcacgctcagctggtatcatctggtcgcgctgggcgtcggcgcgatcgtcgggacgggcatcctcaccctgatcggcgtcggcgcggatcgcgcggggccggcggtgatcctctccttcgtggtggcgggcgcgatctgcgcctgcgccgcgctcgcctatgccgagctggcgaccagcatccccgcctcgggcagcgcctatacctacagctatgtggcgctgggcgagatcgtcgcctgggtcgtcggctggagcctgctcgccgaatacacgctggtcgtcgccaccgtcgcggtcggctggtcgggctatgccacgcccttcctgctcgggctcggcgtgccccccgagctcacccatggcccgcagatggtcgccggccatgtcgcgcactggggcgtcaacgtgcccgcgctgttcgtggtctggctcgtcgccgggctgctgatcctcggcacccgcgagagcgccacgctcaacgccatcctcgtcgtcgtgaagctgatcgcgcttgcggtgttcgtcgcagtcgctttgccctatttcgacgccgccaatttcgatcccttcgcgccgttcggctatgccaagcatgccagcggcggggtggagcggggcatgatggccgccgccgcgatcatcttcttcgccttctacggcttcgacgcgatctccaccgccgccgaggaagccaagaaccccggccgcgacctcgcgatcggcatcgtcggatcgatggtcgcctgcgtcgccatctacatgatcgtagcgctcaccgccgtgggcgcgctccactatacccgcttcgccgacagccccgagccgctggcgctgatcctgcgcgagatcggccagcccggcgtcgccaagttcctcgcgctgagcgcgatcatcgcgctgcccacggtgatcctcggcttcctgttcgggcagagccgcatcttcttcgtgatggcgcgcgacgggctgctgcccaaatccctcgccaaggtctcgcggcgcggctcgccggtgcggatcacgctgttcacggcggcgatcgtcagcgtcttcgcggcgttcctgccgatcgacgagatcgccgccctcgccaatgccggcacgctcaccgccttcgccgcggtcggcctgtgcctgctggtgctgcgccgccgcgcgcctgagcttgcccgcccgttccgcacgcccgccgcctgggtcgtcggcctcggcgcgatcttcggctgcctctatctgttcctcagcctgccgaccaagacgcaactctggttcggcggctggaacctcttgggtctcgtcgtctatttcgcctatgcccgccgcaacgca

SEQ ID NO: 41472 - DNA, 2661 bp, SPHINGOMONAS
atcggcaacgatacgctcggcacgcgtgactcgctcaccgtctccggcaagacctacagcttctactcgctccccaaggcggcggcgaagctcggcgacatcagccgcctgcccttctcgatgaaggtgctgctggagaacatgctccgcttcgacgacggcgtgaccgtcacgcccgaggatgcccaggcgatcgtcgactggcagcagaaccccaaggcccccagccgagagatccagtatcgccccgcgcgcgtgctgatgcaggatttcaccggcgtgccctgcgtggtcgatctcgccgcgatgcgcgacgcgatcaccaagctcggcggcgatgcggccaagatcaacccgctggtgccggtgcacctggtgatcgaccactcggtgatggtcgacgagttcggcacgccccaggcgttcgacgacaacgtcaagctcgagtacgagcgcaatgccgagcgctatgagttcctgaagtggggctccaaggcgctcaacaatttctcggtggtcccgccgggcaccggcatctgccaccaggtgaacctggaatatatcgcccagtcgatctggtcgtcggtcgcgcctgacggcgagacgatcgcctatccggacacgctggtcggcaccgacagccacaccaccatggtcaacggcctgggcgtgctcggctggggcgtgggcggcatcgaggcggaagccgcgatgctcggccagccggtgtcgatgctgatcccggaagtcgtcggcttcaagctcaccggcaagctgcccgaaggcatcaccgcgaccgatctggtgctcaccgtcacccagatgctgcgcgccaagggcgtggtcggccgcttcgtcgagttctacggccccggcctgcattcgatgacgctcgccgatcgtgcgaccatcgccaacatggcgccggaatatggcgcgacctgcggcttcttcccgatcgacgacaagacgctcgattacatgcgcctcaccggccgcagcgacgagaatgtcgcgctggtcgaagcctatgccaaggcgcagggcatgtggcacgacgtcagcggccccgagccgatcttcaccgacacgctcgagctcgacatgtcgacggtccgtccgtcactcgccggcccgaagcgcccgcaggaccgcgtcagcctcgacagcgtcgacgacgtgttcaacggcgacctgaccaaggtgtacaagaaggcgcagcccgcgcgcgtgagcgtcgagggtcgcgaccatgacatcggcgacggcgacgtcgtgatcgccgcgatcaccagctgcaccaacacctcgaacccgtcggtgctgatcgccgccggcctcgtcgcccgcaaggcgcgcgcgctgggcctcacccgcaagccgtgggtgaagacctcgctggcccccggctcgcaggtggtcaccgattacctcaacaaggcaggcctcaccgaggatctcgacgcgatcggcttcaacctggtcggctatggctgcaccacctgcatcggcaattcgggtccgctcgccgagccgatcagccaggcgatcaacggcaacgacatcgtcgccgcctcggtgctgtcgggcaaccgcaacttcgagggccgcgtctcgccggacgtccgcgccaacttcctcgcctcgccgccgctcgtcgtcgcctatgcgctgaagggcacggtgaccgaggacatgtacgagacgccgatcggccagggcaccaacggcccggtcttcctcaaggacatctggccctcgaacgaggaaatccagggcctgatcagcgccaacatcgacgacgagatgttccgttcgcgctacggcaacgtctatctgggcgacagccactggcagggcatcagcgtcaccgtgtcggacacctatgcctggccgaccggctcgacctatatccacaacccgccctatttcgagggcatgtcgatgaccccggcgccggtgcaggacatcgtcgacgccaagccgctggcgatcctgggcgattcgatcaccaccgaccacatctcgcccgccggcagcatcaaggcggacagccccgcgggcgcgttcctccagtcgcaccaggtcgccaagaaggacttcaacagctacggcgcgcgccgcggcaacgatgaagtcatggtccgcggcaccttcgccaacatccgcatcaagaacgagatggtgccgggcatcgaaggcggcatgaccaaatatgccggcgaggtgatgccgatctacgacgccgcgatgcgccacaaggccgacggcaccgcgctcgtcatcgtcgcgggcaaggaatatggcaccggctcgtcgcgcgactgggcggcgaagggcaccaacctgctcggcgtccgcgcggtgatcaccgagagcttcgagcgcatccaccgctcgaacctggtcggcatgggcgtgctgccgctgcagttcgccgagggcgtgacccgcgagacgctgaagctggacggctcggaaaccttcaccatcaccggcgtcgcgggcctgcgcccgcgccaggacgtggaagtgaagctgacgcgcgccgatggctcgtcggaaaccttcctcacccgctgccggatcgataccgtcaacgagctggaatatttcctcaacggcggcatcctccactacgtgctgcgcaagctcgccgcc

SEQ ID NO: 41473 - DNA, 822 bp, SPHINGOMONAS
agttgctgtggagaccccatccccattgccgtttcccgccccgctgctagcgtcgcggccatgaccgaaggcatgacctatgggcgctatctcgccctcgaccagctgctcgccgcccagcatccgctgtcggaccggcatgacgagctgcttttcatcataatccaccagaccaaggagctgtggctcaagcagatcctcgccgagctgcacctcgccaaggggctggtgcgcgcgggcaagctgatcgaggcgtacaagggcctggcgcgggtgagccgcatccaggcggtgatgacgctgagctgggacgtgctcgcgacgatgacgcccagcgactatacccgcttccgctcggtgctcggcggcagctcgggcttccagtcggaccagttccgcgcggtcgagacgatgctgggcctgcgcggcggcggggcgccggggccgctgaccgacgcggccgccgcgctgccgagcctgtgggacgatgccaatgccgcgctcgccgccgccggcttcgtcttgcccgaggccgtgctgcagcgcgactggccgacgccctatcagccgaacgacgccgtgcgcgccgcctggggccaggtgtaccgcgataccaatcgctattgggacctgtaccagctggccgaaaagctggtcgacatcgacgacgcgatggcgacctggcggcacaagcatgtgctcaccgtcagccgggtgatcggcggcaagccggggaccgggggcacgccaggcgtgtcctatctcgaatcgacgctcgccaagcgcgccttccccgagctctggtcgctccggaccgatctg

SEQ ID NO: 41474 - DNA, 1508 bp, SPHINGOMONAS
gcatgacgaccggcccggcgccggtcagcgcccaggccgatacccccatccaggcggaggccggtgccgcgccggtgctgacccgcgacaatggcgcgccggtgggcgacaaccgcaattccaaggccgcgggcgatctcggcccggtgctgctcgaggattcgcatctgatcgagaagctggcccgcttcgatcgcgagcgcacgcccgagcgcgtcgtccatgcccgcggcaccggcgcgcacggcgtgttccgcgcgaccgccgacatttccgatctcaccaaggcgtcgctgttccagccgggcaaggaaacgccggtgttcgtgcgcttctccagcgtgatccacggcaaggacagccccgaatggctgcgcgacccgcgcggcttcgccaccaaattctacaccgatcagggcaactgggatctggtgggcaacaacctgccgatcttcttcatccgcgacgcgatgcagttccccgacatggtgcactcgctgaagcccgatcccgtcaccaaccggcaggatccgaaccgcttcttcgacttcttctcggcaacacccgaatcgacgaacatgctgacccagctctattcgaacctgggtaccccggcctcgtaccgcacgatggacggcaacggcgtccatgccttcaagctggtcaatgccaagggcgagacggtgttcgccaagttccgctggatcagccgccagggcgtccacaacctcaccgcggcccaggccggcgcgcaggcgttcgactatcacacccatgatctctacaccgagatcgccaagggcaattatccgagctgggacctgatggtgcaggtgatgcggcctgaggacttcgccaagctcgactacaacccgttcgacgacaccaaggaatggctgggcgtgccgttccgcaagatcggcgagatgacgctgaacaaggtgccggacaatttcttcgaatggaccgaacagtccgccttcgcgccgtcgaacatggtgccgggcatcgaggcctcccccgatcgcatgctgcagggccggctgttcagctatgccgatacccagcgctaccgcatcggcgccaacgcgctggcgctgccggtcaacaagccgcgcgtcacggtggtcaacaacagccaggacggccagctcaacgcctcgggccgggcctcgcgggtgaactatttccccgccgcgctggccccgaagaccaccccggccgaggcgggcgctgccccctatgcggtggatgcgacggtcgccgtcaagccgatcgccaagagcagcaacttcgcccaggcgggcgtcttctaccgcgcgctgccggcggcggagaaggcggatctgatcaagaacctgtcgggcgatctgggcaaggtcgtgtcgccgcgcacgcggacgatcatggtcagctacttctaccaggccgacaaggactatggcacccggctcgccaaggcggtgaacgtgccgctggccgaggtggagaaggcggtcgccgaatat

SEQ ID NO: 41475 - DNA, 915 bp, SPHINGOMONAS
atcgacccggaacgcgcccatcgcggcgcgattcgcacgctcggggcgtggggcgcgatccgcacgccgtttggcggcggtcctgaatcggcgacgccggtcacactggccgggcttaccttcccgaaccgggtcggtcttgcggcggggctcgacaaggacgccgaagcgattgcggggctattcggcctgggcttcggcgcggtcgaggtcggcacgcttacaccgcgcgcccagcccggcaatccccgcccccgcctgttccggttggtcgaggacgaggcggtgatcaatcgtatgggcttcaacaatggcggcatcgacgcggcactcgcgcgaatcgcccggctgtcgcccaggcagcgccccggcatgctcggaatcaatgtcggcgcgaacaaagattcgaccgaccgcgtcgccgactatgcgctgggagtcaccaaggccgcgccgctcgccgactatatcacgatcaacgtcagctcgcccaacacgccgggtctgcgcgacctgcaatcgcgaccggcgctcgacgaactgctcgcggcggcagatgcagctcgcggtaccacgccgctgttcctcaaggtcgcccccgatctcgaccggaccgggctggaaggcgcggttcgtgcggcgatcgaccatcatgtcgatgcgctgatcgtttccaacaccaccatctcgcgcccgccgctcgcgtcctcccagaggggcgaggccggcggtctctcgggcaagccgctcaaggcgctcgcccgcgccaagctgatcgaggcgcgggaactctcgggcgggcaattgccgctgatctcggccggcggcatcgacgggccggatgaggcgaagcgccgcatcgacgcaggggcggtgctggtgcagatctactcggcgctggtctatcgcggcccc

SEQ ID NO: 41476 - DNA, 873 bp, SPHINGOMONAS
cgcatcggcacccgcggctccccgctcgcccttacccaggcccatatggttcgcgatgcgctgaaggccgcacacgggatcgagggcgagatcgtggtcgtgcgcaccaccggcgacaaggtgcaggaccggccgctcgccgagattggcggcaaggcgctgtggaccaaggagctggatcgcgcactgctggaaggcgagatcgactgcgcggtgcattcgatgaaggatgtcgagacgctccgccccgaggccatcgccatcgccgcgatgctgccccgcgccgatgtgcgcgaccggctggtcggcgccgaatcgcttgccgcgctcaaaccaggcgcggtgatcggcaccgcctcgccccggcgggccgcgcaggtcaagcgccaccggccggacgtctcgaccgttctgttccggggcaatgtcgatacgcggcttgccaggctggcggcgggcgaggcggatgcgacgctgctcgcctcggccgggctggaacggctggggcggcacgatgtcggccatgtcctgccgaccaacgtcatgctgccggcgccggcgcagggcgcggtgggaatcgaggcgcgggccgccgatacgcgcacgctcgcgctgctcggggcgatcgatcatccgaagacccgcgcctgcgtgatggccgaacgtgccctgctggcggcgttgatggccgattgccactcgccggtcgcggcgctcgccacgctcgaaggtgcgatccttacgatcgaggcggaactcttttcggaggacggcagcgcccatgtgcacggcatgatcgaaggcgcgccggaggatccgatgctccccgcggcgcttgcccgcgacctgctcgatcgtgcgccggacgcggtg

SEQ ID NO: 41477 - DNA, 963 bp, SPHINGOMONAS
atcggggtgatcggcggcggcgcctggggaacagcgcttgcgcaggtggcggcacgcggcaccgagccggtgctgctctgggcgcgcgagccggaggtggtggcgagcgtcaatgccgaccacgagaaccgccagttcctcgccggcgtgccgctctcccccagtatccacgcgaccggcagcctcggcgacctcggcggctgcgacgcgctgctggtggtggcgccggcacaacatgtccgcgcggtgctggcggaaacggcggtggggaccacgccgctggtgctgtgcgccaagggcatcgaggcggggacgcggctgctggtcggcgaggtggcgcgcagcgtcgcccccagggcgccgatcgcggtgctgtccggccccaccttcgcgcatgaggtggcagcggggaagccgaccgcggtgacgctcgcctgcgaggatgccgcgctgcgcacccgactggtggagcggctcggcgccccagccttccgcccctatgcctcggccgatgtgatcggcgcggagataggcggggcggtgaagaacgtgctcgccatcgcctgcggggtggtggagggcgccggccttggcctcaacgcgcgcgcggcactgattgcgcgcggctttgcggaaatgacccgattcggtctggcgcgcggcgcccaggcggagacgctgaccgggctttcgggattgggcgacctcgtcctcacctgctcctccaccaattcacgcaatttctcgctgggcgtcgggctgggacaagggcgcagcgccgccgagctgctctcggaccgcaagaccgtggccgaaggcgccttcaccgcgccggtgctgcgggaagcggcagcggaggcaggtgtggaaatgccggttgcgctggcagtcaacgcgctgctcgaaggcgcaccggtggccgaggtgatcgacgcactgctgagccggccgctccgggcggaa

SEQ ID NO: 41478 - DNA, 1188 bp, SPHINGOMONAS
atgaacatccacgaatatcaggccaaggaactgctcgcgaagtttggcgtgcccgtgcccgccggctttgccgcgatgagcgtcgaagaggccgtcgaagcctcgaagaagctgcctgggccgctctatgtcgtgaaggcgcagatccatgccggcggccgcggcaagggcaagttcaaggaactgccggccgaagccaagggcggcgtccgcctcgccaagaccgaggacgaggtccgccacgccgcgaccgagatgctcggcaacacgctggtgacgatccagaccggcgccgccggcaagcaggtcaaccgcctgtatgtcaccgacggcgtcgacatcgccaaggaattctacctcgcgctgctggtcgatcgcgccaccggccgagtcgccttcgtcgtctcgaccgaaggcggcatggacatcgaaaccgtcgcgcacgacacgccggaaaagatccacaccttcgacgtcgatcccgcgaccggcttcatgccgcaccatggccgcgccgtcgccaatgcgctcggcctcgagggcgatctcgccaagcaggcgcagagcctggccggcaaggtgtatgacgccttcctcggcaccgacgcctcgcagatcgagatcaacccgctcgccgtcaccgacgacaacaagctgctggtgctcgacgccaaggtcggtttcgactcgaactcgctgttccgccacaaggacctgctcgagctgcgcgacgagaccgaagaggatccgatggagctcgaggcgtcgaagtatgacctcgcctatatcaagctcgacggcgacatcggctgcatggtcaacggcgccggcctggcgatggccacgatggacatcatcaagctgaacggcatgttcccggccaacttcctcgacgtcggcggcggcgcgaacaaggagaaggtcaccgcggcgttcaagatcatcctgagcgatcccgccgtgaagggcatcctggtcaacatcttcggcggcatcatgcgctgcgacatcatcgcggaaggcatcgttgcggctgccaaagaagtgaacctcgcggtgccgctggtcgtccgcctcgaaggcaccaacgtccagcagggcaaggacatcctggccaattccggcctgccgatcgtcgccgccaacgacctgggcgatgccgcccagaagatcgtggcggaggtgaag

SEQ ID NO: 41479 - DNA, 1158 bp, SPHINGOMONAS
tggcaggatccgttcgggctcgacggcgagctgaccgacgaggaacggatggtgcagggtgccgcacgcgactacgcacagggcgagctgctcccgcgcgtgacctccgcctatctggaggaacgcttcgaccgcgagatcatggccgagatgggcacgctgggcctgctcgggcccacgatccccgaaacctatggcggcgccgggctcggctatgtcgcctatggcctggtcgcgcgccaggtggagcgggtcgattcgggctatcgctcggcgatgagcgtgcagagctcgctcgtcatgcacccgatccacgcctatggtagcgaggagcaaaggcggaaatacctgcccaagctggcgagcggcgaatgggtcggctgcttcggcctgaccgagcccgatgccggctcggaccccgccggcatgcgcacccgcgccgagaagatcgacggcggctaccggatcaccggcgccaagatgtggatcaccaattcgccgatcgccgacgtgttcgtcgtctgggcgaagagcgacgcgcatgacggcgcgatccgcggcttcgtgctcgagcggggcatgaaggggcttaccagccccaagatcgagggcaagctgagcttgcgcgcctcggtgaccggcgagatcgtgatggacggggtggaagtgggcgaagacgcgctgctgcccaacgtgcaggggctgaagggcccgttcggctgcctcaaccgcgcgcgttacggcatcgcctggggcacgatgggcgcggccgaggcctgcttccacgccgcgcggcagtacacgctggaccgccaccagttcggccggccgctggcggcgacccaactggtgcagctcaagctcgccaatatgcagaccgagatcgcgctggggttgcaggcggcgctgcgctgcgggcggatgttcgacgcgggcacgctggcgcctgaggcgatcagcatcatcaagcgcaacaattgcggcaaggcgctggagatcgcccgggttgcgcgcgacatgcatggcggcaacggcatctcggccgacttccatgtgatccgccatgcgatcaacctcgagacggtgaacacgtacgagggcacgcacgacgtgcacgggctgatactcggccgggcgatcaccggcatcgcggcgttc

SEQ ID NO: 41480 - DNA, 1323 bp, SPHINGOMONAS
atgaccgtcgttacccgtttcgcccccagccccaccggcacgctgcatgtcggcaacctgcggaccgcgctgcataactggctgttcgcgcgccgccatggcgggaccttcctgctacggatcgacgataccgatcaggcgcgctccgaggaacgctttgtcgagtcgatccgtgcggatctcgcctggatgggcctgacgcccgatgccgaggagcgccagtcggcccgattcgagcgctacgaagcgcgattcgcccagctcgtcgccgatggccgggtctatcccgcctatgagaccgcgcaggaactggagctcaagcgcaaggtgctgctcggtcgcggcctgccgccggtctatgatcgcgccgcgctggcgctgaccgatgccgatcgcgccaagctggaggccgaaggcgtgcgcccgcactggcgcttccggctcgatcacgacgaggcgatcggctgggacgatctggtgcgcgggccccagcggttcgaggcgaagctgctcagcgatccggtggtgcgccgcgccgacggatcctggctctacctgctgccgagcgtgatcgacgacatcgatctgggcgtcacccatgtcgtacgcggcgaggaccatgtctcgaacaccgcgagccagatccagatgttcaccgcgctgggcggcgccaccccgagcttcgcgcacgaggcgctgctgaccggcaacgagggcaagctgtccaagcggctcggctcgctgggcatcgaccatttccgcgaggccggcatcgagccccaggcgctgatcgcgctgctcgcccggctcggcacgagcgacccggtcgaggccttcgccgatccggcgccgctgatcgcgagcttcgatttcggacgattcggccgcgcaccggcccggttcgacgaggccgaactcgcccagatcaacgcccgcatcgttcaccagctgccgcatgccgcggtcgccgatcggctgccggccggcatcgacgcggcgggatgggaggcgatccggccgaacctcaccaccgtcgccgaggcggcggactggtgggcggtggtcgaaggcccgatcgccgcgccgccggtggcggacgaggaccgcgcgttcctcgcccaggcgcgggcggtggccgcggggctcgactggtcggccgatccctggcgcgcgctcaccgatgcgctgaaggccgccaccggccgcaagggcaaggcgctgttcctgccgctccgccgcgcgctgacggcacgcgaccacggaccggacatggccgcgctgctccccctcatcggcaaggatcgtgcgctggaacggctggcc

SEQ ID NO: 41481 - DNA, 933 bp, SPHINGOMONAS
atgaaactcatggccggcaattcgaacctgccgctggcgagcgccatcgccgactatctggaaattccgctcacccaggcgaatgtccgccgcttcgccgacgaggagatcttcgtcgagatcctcgagaatgtccgcggcgaggatgtgttcgtgctccagtcgaccagctatccggcgaacgacaatctgatggagctgctgatcatgatcgacgcgctccgccgcgcgtcggccaagcggatcaccgcggtgctcccctatttcggctatgcccgccaggaccggaagcccggcccgcgcacgccgatctcggccaagctggtcgccaacctgatcactacggcgggcgccaaccgggtgctctcggtcgacctgcacgccgggcagatccagggctttttcgacattccgaccgacaatctgttcgcggcgccggtgatgtcggcggacatccagacgcgcttcatcgacaagcagtggatggtcgtctcgcccgacgtcggcggcgtggtgcgcgcgcgccagctcgccaagcggctggacaacgcccccctcgccatcgtcgacaagcgccgcgagcggccgggtgaatcggaagtgatgaacatcatcggcgaggtgaagggccgcttctgcatcctgatcgacgacatcgtcgattcggccggcacgctgtgcaacgccgccgcggcgctgaaggcggcgggggccgaggacgtcgtcgcctattgcacccacggcgtgctctcgggtgcggcgatggcgcgcgtcgccaagtccgaactgcgcgagctggtgatcaccgattcgatcggcaaccacgaggtggtcgcggccggcgagaaggtccgccacctgaccatcgcgccgctgatcgcccaggcgatccgccgcatcgccgacgaaagctcggtctccagcctgttcgac

SEQ ID NO: 41482 - DNA, 1479 bp, SPHINGOMONAS
atgggaatcgaaatcaagatgccggcactttctcccaccatggaggaaggcacgcttgccaagtggctcgtcaaggaaggcgacacggtgaaatccggcgacctgcttgccgagatcgaaaccgacaaggcgacgatggaattcgaagcggtcgacgaaggcgtgatcgggaagatcctggtcgccgaagggaccgataacgtaaaggtcggtaccgtgatcgcggtgatcgccggcgaaggcgaggacgtctcgtccgccaccgccgcccccgcgccgagcccgacccctgcacctgcgccggccccggctgccagcgcgcccacgccgactccgacccccgccccggcagcgcagcctgccgccgcgtcgggttcgcgcgtcaaggcgagcccgctcgcccgccgcatcgccgccgacaagggcgttgacctcgccggcgtgaccgggctcgggcccgaaacgggcccggccattcggtccaaaggggcccgaaccggtacgaaaaggggcgcccccaaaaggcccgggggggtaaccccggacttacacgggagccacagcccccccaaaggaccccagatcccgggaccacggcacccggacggggcccagaagacacgcaccacggaaacaccccggccctcgggcgagaccccttattacgggaggatgtgggccggatcccacggcgccgagccttggcccggaaagaaaccccaaaagggccggggttcctggggttttcaaaacggaaactcgggatttcccgggccacgagggaaaagaagaaaggcttctcggaaccatcccccaaagaccgatcgcggcggtcgccctcacccaagtgaaacaagaccggttccgcacatctacctcacggtcgacatccgcctcgacgcgctgctcaagctgcgcggtgagctcaacaaggcgctcgaagcccgcggcgtgaagctgtcggtcaatgatctgctgatcaaggcgctgggcgtggcacttgcccgcacgccgaagtgcaacgtcaccttcaccggcgacaagctgatcaagtacagtcgcgccgacgtgtcggtcgcggtgtcgacgccgaccggcctgatcaccccgatcgtcaaggacgcggcgaacaagagcgtctcggcgatcgcgaccgagatgaaggacctcgccgcccgcgcccgcgagggcaagctgcagccgcacgaatatcagggcggcaccgccagcctgtccaacatgggcatgtacggcatcaagcagttcgaggcggtgatcaatccgccgcagggcatgatcatggcgatcggcgcgggtgagaagcgcccgtacatcatcgacgacgcgctgggcgtggcgacggtgatgagcgccacgggcagcttcgaccaccgcgccatcgacggtgccgacggggccgagatgatgaagatcttcaaggaactcgtcgaagccccgatgggcatgatcgcctgatcg

SEQ ID NO: 41483 - DNA, 1641 bp, SPHINGOMONAS
gagccggacgaccccagcgaagaggcgcgccggatcacctatcttgagctctatgaagaggtctgccgcttcgccaatgtgctgaaggcggaaggcgtgcagaagggcgaccgcgtcaccgtctacatgccgatgattcccgaggcggcggtggcgctgcttgcctgcgcgcggatcggcgcgatccattcggtggtgttcggcgggttctcgcccgaggccctggccggccgcatcgtcgattgcgacagccgcatcgtcatcaccgccgacgagggccggcgcggcggcaagcgcgtgcccttgaaggccaatgtcgacgcagcccagaagcatgccccggtgctcgagaaggtcatcgtcgtgaaggcgacgggcggggacgtgcccatgcagcccggccgcgacctctggtatcacgaggccgccgccagggtttccgccgactgtccggccgagccgatggacgccgaggatccgctgttcatcctctacacctcgggatcgaccggcaagcccaagggcgtgctgcattcgagcggcggctatctgctctgggcggcgtacagccatgaggtggtgttcgattaccggccgggccaggtctattggtgcgcggccgatatcggctgggtcaccgggcacagctatatcgtctacggcccgctggcgaacggcggcaccacgctgatgttcgaaggcgtgccgacctggcccgatgccggccggatgtggcaggtggtcgaccggcaccaggtcgagatcctctacaccgcgccgaccgcgctgcgcgcgctgatgaaggagggcgatagctacgttacgtcgaccagccggaagtcgctcaagctgctcggctcggtgggcgagccgatcaacccggaggcgtggcgctggtatcacgacgtggtgggcgaggggcgctgcccgatcgtcgacacctggtggcagaccgagaccggcggccacatgatcaccccgctgccgggcgcgaccgcgctgaaacccggttcggcgtcgatgcccttcttcgggatcgagccgcagctggtcgacggcgatggcgcactgctggagggcgcgaccgagggcaatctcgtcatcgcgcggagctggccggggcagatgcgcaccgtctggggcgaccacgagcgcttcttccagacctatttcaccacctatcgcggcaagtatttcaccggcgacggctgccgccgcgattccgacggctattactggatcaccgggcgggtggacgacgtgatcaacgtctcgggccaccgcatgggcaccgccgaggtggagagcgcgctggtgctgcacgacaaggtggcggaagccgcggtcgtcggcatgccgcacgacatcaagggccagggcatctatgcctatgtgacgctcaacgcgggcgaggagtcgagcgagggcttgcgcaaggagttgcgcgactgggtgcgcaccgagatcggcccgatcgccacgccggacgcgattcagttcgcgcctggcctgcccaagacccgctcgggcaagatcatgcgccgcatcctgcgcaagatcgcggagggcgatgtcagcagcctgggcgacacctcgacgctggcggatccgtcggtcgtcgacgatctggtggcgaatcgg

SEQ ID NO: 41484 - DNA, 1929 bp, SPHINGOMONAS
ggcgtcgacatgaccgcgcagaagcccggcgtgaagcccggcgacgacttctggacctatgcgaatggcggctgggccgatcgtacccagatcgcggccgaccgcacctcggcgggcccgttcgttgacctcgcgctggcggcggaaaccaatgttcgcacactgctcgacgacatggccaagaaccccgccgcctatggcgcgagtggcaagcagatcggcgatttctacgccagctggatggacgaggcgggtatcgaggcgcgcggcacggcgccgctcaagccctatctcgcccgcatcgccggcgtgcaggacaagaccgcgctgcaggtgctgttcgccagcgtcggctatgcgacgccggtcgaggtggagatctcccccggctttgcggatccgacccgctacaccgccgcggtcggccagggcagcctcggcatgccgcgcgactatttcctgaacccgggcgagaagttcgagggcttccgcaaggcctatcgcgcctatgtgcagcagatccaggaactggcgggcatccccgatgcgtctgccaaggccgatgcgatcgtcgcgctcgaaatggcgatggccaaggtgcagtggtcgcccgagcagagccgcgacatcgccaagctcaacgatccgcagaccatcgccggcctgaaggccaaggcacccgagttcgactgggcgctgatgctgaagaccgcgggcgtcgacagctcgccgcagatcctgatggcgcagaacaccgcgctgatcgcgttggccaagatcttcgccgagacaccgctccagacctggaaggactatctcgcctatcgcttcgtcagcgatcacgcgacctatctgcccaaggcgttcgatcaggcccgcttcgacttctattcgaagacgctctccggcgtgccggcccagcgcgagcgctggaagcgcggcgtgcagatggtcaacggcgcgctcggcgaagcggtcggcaaggcctatgtcgccaaatattatccgcccgaggcggaaaagcagatggccgagctgatcgagaatctgcgcgactcctaccgcgagcggatcgaggcctcgacctggatggacgaggcgacccgcaaggccgcgctcgccaagctcgccgccttcgagccgcgcatcgggcatcccgacaagtatatcgattattcgtcgctcaccgtggatcgcggcgatatcctgggtaacgtgatgcgctcgggcgaattccagcaccagctgcagctggcgcgcttccccaagccggtcgaccgcacgctttgggcgatgacgccgcagacggtgaacgcctattacaacccgctgtcgaaccagatcaccttcccggccgcgatcctgcagccgcccttcttcgatcccaaggccgatccggcggtgaactatggcgcgatcggcgcggtgatcggccacgaaatgggccatggcttcgacgaccagggcagcatgttcggcccgaccggcaagctggagaactggtggacgcccaaggcaaaggccgattttggtgcgcgcacggcggcgctggccggccagtacgacacctatgagccgctgccgggcatgaagatcaacggcaagctcacgctcggcgagaatatcggcgatctgggcggggtcgaggcggcgtatggcgcctaccagaagtaccaggccaagcacggcaaggcgaagacggtcgacggcctgagcggcgaccagcgcttcttcctcggctggggccaggcctggcgggtgaagatgcgcgaggatgcgctgcgtcagcagctcgtcgtcgacccgcactcgcccgcgaccgcgcgcgtcaacggcgtcgtccgcaacgtcgatgcctggtacaaggcattcaacatccagccgggcgacaagctctatctgccgcccgagcagcgcgtccacatctgg

SEQ ID NO: 41485 - DNA, 561 bp, SPHINGOMONAS
gctagggcattggggatgctgacgttgccgaacatcctgaccctgtcgcgcatcttcaccgtgccgctgctggtggggttcctgtggtggccgcaatgggcgccgggatatgcgatcgccttcgcgctctacgtcctgatgggcattaccgattatttcgacggctatcttgcccgtgcgcagggaaccgtgtcgaagctgggcgtcttcctcgatcccatcgccgacaagatcatggtcgcggccgtcattctgatcctggcgggcaagggggtgatcgccgattggcacatcatcgccgcgctggtgatcctgctgcgcgagatcgcggtgtcgggcctgcgcgagttcctgggcgggatccaggtctcggtgccggtgtcgcgtctcgccaagtggaagaccacgctgcaactggtatcgctcggcgcgctgatcctgtccggcgcgctgccgcactgggactgggtgctactggtggggctggtgaccctgtggggcgcggcggtgctgaccgcgatcacgggctgggactatctgcgcgtcggcctgagccacatg

SEQ ID NO: 41486 - DNA, 2097 bp, SPHINGOMONAS
gcgaggattcccatgaccgatcagaacaaccgcaacgcccccgccggcggcgagacgcatcaggtgaccgatgccgaccatccggtgctcaccaccaaccacggcacgccgatcagcgacaaccagaatcagttgaaggcagggccgcgcggtccggtgctgattgaggacgaagtcttccgcgagaagatgaaccatttcgatcacgagcgcattcccgagcggatcgtccacgcccgcggctcggccgcgcacggctatttcgaggttaccgacagcctcgccgacgtcaccatcgcggatctgttccagaagaagggccagcgcaccgaggtgttcgtccgcttctcgaccgtcgcgggcggcgcgggctccgtcgacacgccgcgcgacgtgcgcggcttcgcggtgaagttctacacccgcgaaggcaattgggatctcgtcggcaacaacattcccgtcttcttcatccaggacgcgatcaagttccccgacctgatccacgccgccaagatggaggccgatcgcggctatccccaggcggcgaccgcgcacgacactttctgggacttcatcagcctgatgcccgaatcgacccatatgatcctgtgggcgatgtccgaccgcacgctgccgcgcagcttcgcgacgatggagggcttcggcgtccacaccttccggctgatcaacgccgaggggaagagcagcttcgtcaagttccactggaagcccaaggcgggcctcgcctcgacgatctgggacgagacggtcaagatcgccggggccgaccccgatttccagcgccgcgacctgttcgagcggatcgaccgcggcgattatccgacctgggaactcggcgtgcagctgttcgacgaggacttcgccaacgcgcagccctatgacgtgctcgatgcgaccaagctgatccccgaggaagtgctgccggtgcggatcgtcgggcggatggtgctcgatcgctatcccgacaatttcttcgccgaaaccgaacaggcggcgttcgtgcccgcccatgtcgtccccggcatcggtttcagcaacgatccgttgctccaggggcggctgttcagttataccgacacgcagctgtcgcggctgggatcggtcaatttccaccagctgccgatcaacgccgccaaggggcgtgccgaggcggcaggctgcccgttcctcaaccagcagcgcgacggccatatgcagatggcggtgcccaaggggcgcgccaattacgagcccaacagcctcgccaaggccggcgaggaaggcggcgcgcgcgaggatcccgagaagggctacaagacctatccagcggaggagcagggccagaaactccgtatccgcgcggagagcttcgccgaccattatagtcaggcgcggctgtttttccgctcgatggatccggccgagcaggcgcatatcgcctcggcgctggtgttcgagctctcgaaggtcagcctcgagcatattcgcgtggcggtgatggccaatctgcgcaacgtcgacgagacgctggcccagcgcgtcgccgatggcctggcaatggacctgcccgaagcggcccccaccgccgcgccggtgctcgacatggagccgtcgccggcgctgcggatcatccgtggtccgcgcgagctccgcacgctggagggcaagaccgtcggcatccttatcgccgatggcagcgatgcgggcgagctctcgacgctgaaggacgcggtcaaggccgccggcggccacgcgatgacgatcgcgccgaaagtgggcaaggtgccgctctcggacgggtcgacgatcgccgcggatgcccagctgttcggccagccctcggtcaccgtggatgcctgcgcggtgatcctgtcggaggaggctgcggccaagctcgtcaaggaaggcgctgccgtgcaatgggtgatggacgcgttcggccacctcaaggcaatcggggccaacgccgccgcccagccgctgctcgacaaggctggcgttgagccggacgagggcgtgaccgaccttcgcggcttcgtcgaggcggcgaagcagcgctactgggaccgcgagacgaaggtgcgtacactcgcc

SEQ ID NO: 41487 - DNA, 444 bp, SPHINGOMONAS
aagccgatcgtcctggtcggcctgatgggggccgggaaaaccacggtagggcgccgccttgcccagcgcctgcggcttcccttcgtagatgccgatgcggaaatcgaatcggcggcgggcatgtcggtctccgacatcttcgccaagttcggcgaaccgcatttccgcgacggcgaacggcgggtgatcgcccggctggtggacgggacccccaaggtgatcgccaccggcggcggcgcgttcatcaacgacgagacgcgggcgctgatcctcggccaggcgatctcgatctggctggatgcggagcccacggtgctggccgatcgcgtgcggcggcgggacacgcggccgctgctgcgcggcaaggatccgctggcgacgctcaccgaactggcgcgggtccgcaacccctattacgcgcttgcggaaatccgcgtgcccagc

SEQ ID NO: 41488 - DNA, 1062 bp, SPHINGOMONAS
atccccgtcgccctcggcgcacgcagttatgacgtgcgcatcgaacccggcttgctggccagcgcgggcgaggtgctcgcccccctgtcgcgcggtcggccgatgccgatcgtgaccgacaccaacctcgccgcacattgcgagacgctggtcgccagccttgccgccgccggggttgccgcaccggttctggtgctgcccgcgggcgaaagcaccaagagctgggcacagttggaggcgctgaccgactggctgctggcgcaaggcgtggtccgcagcgatcacgtgatcgcgctcggcggcggcgtaatcggcgatctggtcggcttcgcgaccagcatcctcaagcgcggctgcaacttcgtccagatcccgacgacgctgctggcgcaggtagacagctcggtgggcggcaagaccgcaatcaattcgcgcgcgggcaagaacctgatcggcgccttccaccagccgtcgctggtgctgatcgatccgcaggtgctggacacgctgccccagcgcgagctgcgcgcgggctatgccgaagtggcgaaatacggcctgatcgacgatgcggccttcttcgcctggtgcgaggaaaatgcggacgcgctgttcgcgggcgaccccgcggcgcgcgccacggcgatcggtcattcggtcgcggccaaggcgcgcatcgtcgccgccgacgaacgcgagaccaccggcacccgcgccctgctcaacctgggccacacgttcggccatgcgctggaggcggagacgggcttctcggacacgctgctccatggcgaggcggtcgctgcgggcatggcgctggccttcgccttctcggcacagcaggggctgtgcccggcggcggatgccgagcgggtggcggcgcatctccgcagcgtcgggctgccggacgggctggccgcagcgggcgtgaccgcggacggcaagacgctggtcggccatatgctgcacgacaagaagatggagggcagcaccctgcccttcctgctcgcgcgcgggatcggccagacctatctcgacaagacggtggacctggagacggtc

SEQ ID NO: 41489 - DNA, 1747 bp, SPHINGOMONAS
cccgaggcgaaggacgcgtggacctatgcgcggccggaggtcgcccgcgtcacccatgtcgcgctcgacctgcgcgcggacttcgcgagcaggacgctttccggcactgcgacgctggatgtcctcgccgcgccgggcgcgaaggaaatcgcgctcgatgaggacgggctggcaatcgcccgggtaaccgacgccgcgggcaagccgctgcccttcaccgtcggtgccgccaagcccgatctaggcgccccgctgaccatacagctgaacggcgcgcgcaagatcgtgatccattatgccaccgcaccggtggcctcggcgctgcaatggctcgcgcccgccctcaccgccggcaagaagaaaccctatctgttcagccagggccagccgatcaacaaccgcagctggatcccgacgcaggacagccccggcatccgccagacctggtcggccacgctcaccgtccccgccgatctggtcgcggtggcgagcggagatcggatcgacggcgccaggggcgtgccggcgggcaagggctggcacaagttccgcttccgcatggacaagccggtgccaccctatctgatcgccttcgcggtcggcgatctcgccttccagccggtcggcccgcgtgccggcgtctggaccgagccgagcatgctcgccgccgccgcgaaggaagtggccgatgtcgagaagatgatcgacgcggcgcaggcgctctatggtccctatcgctggggccgctacgacatgctcgtcctgccgccgagcttcccgtacggcggcatggagaaccccaccctcaccttcctgacgccaacgatcatcaccggcgacaagtcgaacgtcgacgtggtggcgcacgagctggcgcacagctggtcgggcaatctcgtcaccaacgcgacctggtcggacagctggctgaacgagggcttcacgacctatttcgagaaccgcatcatggaggcggtgtacggcaaggagcgcgccgcgaccgacgccgatctcgaatgggacggcctgcaaaaggacatcgccgatgccggcggcacggaggcgccgaccacgcggctgcatggcgaacccggcgcgaccttcggacagctggattacttcaagggctcgaccttcctgcgcacgatcgagcggacggtcggccgcgcgcgctgggacgtctatctgcgcggctatttcgaccgacacgccttccagccgcagaccacggcgggcttcctggcggacctgcgcgccaatctcgtgcagggcgacgccgggctggaggccaacctccagctagaccgttgggcctatgctgtggggctgccgaccaatgccgtgcacgtgcagtccgcgacgctgaaggcagtcgacgcgcaactggcggcggtgaacgccggcgggccggtctccgcggtgcagccgcagggctgggcgacccagcaatggctgcgctttcctcaatgggctggatcgccagcagacgcgggcgcggctcaaggaactggacgagtctcttgtgctctcggcctcgaacaacgcctatgttcgctcggcctggggcgagctggcgatcgccaaccgctatgatccggcggtgccgggcatcggcaagctggtcggcagcgtcggccgcgggctgctgatctatccgatctacaaggatctgatggcacagggcgattggggcaagccgatcgcgcgacgcttctacgaggcctcgaaggcggtctatcacccgacc

SEQ ID NO: 41490 - DNA, 1362 bp, SPHINGOMONAS
ttgagccgcctgatcgtcatttcgaaccgcgtaaccgcgcccaacggctccaactccggcgcgcaaggggggctggccgtcgcgctcgccgccgccttgcgcgaaaatggcggcatctggttcggctggtccggcgaacagaccgaccagttcaccggccagatcagcatgcagcgcagcgaaggggtgaccaccgcgacggtcgacctcgaagagcaggacatcgacgaatattataacggctatgccaaccgcacgctgtggccgctgttccactaccggatcgacctggcggaatatgagcggggtttcgccggcggctatcagcgcgtcaacgagcgcttcgccgacaccgtccgcccgctgatcgagcccgacgacgtggtatgggtgcaggactatcacatgttcccgctcggccaggaactgcgccggcggggctgcaagaaccggatcggcttcttcctccacatcccctggccgccgcgccggctgctctccagcctgcccaaggcgcacgaactgatcgagacgctgttcgcctatgacgtgatcggcttccacacccaggaatggatggagagcttcatcgacttcgcccgcgccgagatggaagcggtggtccagcccgacggcgtgctgcgcatcggcctgaaaagcgtgaagctggtcgcctgcccgatcggcatcgacgccaaggaattcgccgcgctggccgaaagcgagtccgcgcgcgagaccttcgagcagatgcgcaccagctcggtcggccgctccctgatcgtcggcgtcgaccggctcgattactccaaggggctggaggagcgcttcctcggctatgaacgcttcctcgccacctaccccgagcagcgcaaggaagtgtatctgctccagatcgccccgccctcgcgggcgacggtggagacctatcagcgcatccgcaacacgctggagggcctgtcgggcaagatcaacggcgcgcatgccgatctcgactgggtgccgctgcgctacgtcaaccagggctatccgcgcgacgtgctggcgggcgtgtaccgggcggccaggatcggcctcgtcaccccccttcgcgacgggatgaacctcgtggcgaaggaatatgtcgcggcgcaggatcccgaggatcccggcgtgctgatcctctccaagttcgccggcgcggcgatccagatggagcaggcgctgctggtcaatccctacagcgccgaggaagtctccgacgcgatctgccaggcgctcaacatgccgctcgaggagcggatcgagcgctggcaggcgctgaagcagggcgtcgacgaacaggacgtgatgtggtggctcaagaagttcaccgacgagctc

SEQ ID NO: 41491 - DNA, 633 bp, SPHINGOMONAS
ctcgataccgccagcctgttcctcgatttcgacgggacgctggtcgaactcgccgaccatcccgagggcgtggtggtcgatggcacgctggtcgacctgatccgcacgctggaggaaaagctcgacggccgcctcgcgctggtgagcggccgcccggccgaggatctggccgcgatgttcggcgaccgcgcgccctcggtcgtcggcagccacggcatggagttccgctggtccgacggccgccgcgaacgcgccgagcgccccgccgggctggtcgaggcgctggcggcgatgcgcgcctttgcggagggtcgccccggcgtggtgctggaggacaagccgctcggcgccgcggtgcattaccggctgaaccccgagcatgaggccgacgcgatcgcgctgggcgagcggctcgccgccgaacacggcctgtacctgcagcacggcaagatgatggtcgaggtgcgcagccccggcggcgacaagggcagcgcgatccgcacgctgatggccgatccgcgcttcgccgccggccgcgcggtgttcctcggcgacgacgtgaccgacgagcccggcttttccgccgtggcgctgctgggcggcgccggcgtgctggtcggcccgccccgcccc

SEQ ID NO: 41492 - DNA, 1092 bp, SPHINGOMONAS
atattgtggggtcgaggattcggtgccgaaggcgatgccgtcggcgaggtgtgcttccacaccgcgatgaccggctatcaggagatcatgaccgacccgagcttcgccggtcagatcatcaatttcaccttcccgcatatcggcaatgtcggcgccaaccccgacgacatcgaggccgacgatccccatgcgctgggcatgatcgtccgccaggacgtgaccgagccgtcgaacttccgcagcaccgagcatctcgatgcctggatggcgaagcacaagcggatcggcctgtcgggcatcgacacccgcgcgctcacccgccgcatccggctgggcggcgcgccgaacggcgtgatcgcgcactcgaagtccggcaatttcgacctcgacgcgctgctggagaaggcgcgcggctggccggggctggagggcatggacctcgcgatcaccgtgtcgtgcgagacgcatttcggctgggaaggcggcgtgtggaagctcggcgccggctatgacaccagccgcggcgagagcaagcgcccgcaggtcgtcgcgatcgactatggctcgaagcgcaacatcttccgcaatctggtgcaggccggcgcggacgtgaccgtgctgcccgccaccgcgaccttcgagcaggtgatggcgttcaatccggacggcttcttcctctcgaacggcccgggcgatccggcggcgaccggcgaatatgccgtgccggtgatccgccagctgctcgagaccggcaagccgctgttcggcatctgcctcggccaccagctgctcggcctcgcggtgggggcgcagaccaccaagatgttccagggccatcgcggcgccaaccatccggtcaagcggctggaagacggcgcggtggagatcaccagcatgaaccacggcttcgccgtcgagcgcgagagcctgccggccaatgcccgcgagacgcatgtgtcgctgttcgacggctccaatgccggcatcgaactcaccgaccgcccggcgttcagcgtgcaataccaccccgaagccagcccgggcccgcaggacagcctctatctgttcgagcggttcgtggggatgatggcg

SEQ ID NO: 41493 - DNA, 3316 bp, SPHINGOMONAS
atgcctaagcgcaccgacatctcctccatcctcgtcatcggcgcggggccgatcgttatcggtcaggcgtgcgagttcgattattcgggcacgcaggcgatcaaggccctgaaggaagagggctatcgcatcgtcctggtcaattcgaacccggcgacgatcatgaccgatcccgagctggccgacgcgacctatatcgagccgatcacgcccgcggtcgtcgccaagatcatcgagaaggagcggcccgacgccgtcctgccgacgatgggtggccagaccgcgctcaacaccgcgctcgcgctgttccgcgacggcacgctggagaagttcggcgtgacgatgatcggcgccgatgccgatgcgatcgacaaggccgaggaccggctgaagttcaaggacgcgatgaccaagatcgggctcgaaagcgcccgctcggcgatcgcgcataccgaggccgaggcgctgaccgcgctagactatgtcggcctgcccgcgatcatccgccccagcttcaccatgggcggctcgggcggcggcatcgcgtacaaccgcgaggaattcatcgcgatcgtgcgctcggggctcgacctgtcgccgaccaccgaggtgctgatcgaggaatcgctgctcggctggaaggaatatgagatggaggtcgtccgggatcggaacgacaatgccatcatcgtctgctcgatcgagaatatcgatccgatgggcacgcacaccggcgattcgatcaccgtcgcaccggcgctgacgctgaccgacaaggaataccagatcatgcgcagcgcatcgatcgcgtgtctccgggagatcggcgtcgagaccggcggttccaacgtgcagttcgcggtcaatccgaaggacggccgcctgatcgtgatcgaaatgaacccgcgcgtcagccgctcctcggcgctggcgtccaaggccaccggcttcccgatcgccaaggtcgcggccaagctcgcggttggctatacgctcgacgagatcgacaacgacatcaccggcgcgacccccgcgagcttcgagccgacgatcgactacgtcgtcaccaagatcccgcgcttcgccttcgagaagttcaagggcgccgaggcggtgctgggcacggcgatgaagtcggtcggcgaagtgatggcgatcggccgctcgatccacgaatcgatccagaaggcgctgcgcgggctggaaaccggcctcagcggcttcaacgatgtcgaccggctggtcggcgcgccgcgcgacgtgatcgaggcggcgctgaccgtgcgctcgcccgaccggctgctgatcgcggcgcaggcgatgcgcgaaggcttcagcgtcaaggaggtccagcgcttcaccagctacgacccctggttccttcagcggatcgccgagatcctcgacgccgagaaggatgtcgcgaccaacggcctgccgcaggacgcggtgggcatgcgccgcctcaaggcgatgggcttcagcgacaaaaggctggcctatctggcgctcaagtcggtcaatctccgcgcgggcagcgaggcgatggcgcgtagctcgggcctgatcggcgagatcgccaacgccatctcgggcggggtgaccgaggccgaggtgcgcaagctgcgccaccggctgggcgtgcgccccgtgttcaagcggatcgacacctgcgccgccgagttcgaggcgaagacgccgtacatgtactcgacctatgaggcgccgagcttcggcgaacccgagaacgaggccgagccgagcgaccgccgcaagatcgtgatcctgggcggcgggcgcgaaccggatcgggcagggcatcgagttcgactattgctgctgccacgcctgcttcgcgctggccgatgcgggctatgagacgatcatggtcaactgcaatcccgaaacggtgagcaccgactatgacacctcggaccggctctatttcgagccgctgaccgccgaggacgtgctcgagatcctcgaggtcgagaagtcgaagggcgagctggtcggcgtgatcgtccagttcggcggccagaccccgctcaacctcgccaaggcgctggaggatgcgggcatcccgatcctcggcaccagccccgatgcgatcgacctggccgaggaccgcgagcgcttcgccgatctggtcgccaagctgggcctcaagcagccgatgaacggcatcgcccgcagccgtgacgaggcggtgcgcgtggccgagcggatcggctatccggtgctgatgcggccgagctatgtgctcggcggccgggcgatggagatcgtcgacagcctccagcagctcgacgactatatccagaccgcggtgcaggtctcgggcgactcgccggtgctgatcgaccagtatctgcgcgacgcgatcgaggtggacgtggacgcgatcgccgacgggaccgacgtcgtcgtggcgggcgtgctccagcatatcgaggaagccggcgtccattcgggcgacagcgcctgctcgatcccgccctacagcctgcccgccgagatcatcgccgagatcgagcgccagaccgtggcgctggcgcgcgcgctcaaggtcaaggggctgatgaacatccagttcgcggtcaaggacggcgaggtctatctgatcgaggtcaacccgcgcgccagccgcacggtgccgttcgtcgccaaggcgatcggcgcgccgatcgccaagatcgccagccgggtgatggcgggcgagaagctggccaacctgccgaagatcgaccgcgacatcgactatatcgcggtgaaggaagcggtgttcccctgggcgcgcttccccggcgtcgatccggtgctgtcgcccgagatgaagtcgaccggcgaggtgatgggcatcgacaaggacttcgcgaccgccttcgccaagtcgcagctcggcgccggcacggtgctgccgcagggcggcacggtgttcgtcagcgtcaagcagggcgacaaggcggtggtgttgccgggggtgaagatcctcgccgatctcggcttcaagatcatcgcgaccagcggcacggcggagttcctcgccgccgaggggatcgcggtggagacggtgaacaaggtggcccagggccgcccgcacatcgtcgaccgcatccaggacggcgacgtcgcgctgatcttcaacaccaccgagggctggcagtcgctcaaggactcgatgagcatccgcgcctcggcgctggcgcagaaggtgccgtatttcaccacggcaccgggcagcgtcgcggcagcgcgggcgatcgcggcgatgcgtgcgcaggcgttcgaggtgcagccgatccaagcgtatttc

SEQ ID NO: 41494 - DNA, 1443 bp, SPHINGOMONAS
gaaatcccactcggcctcacgttcgacgacgtcctcctctatccgggcgaatccgaaatcgtgccgagcatggcggatacgcgcaccttcgtgacgaagaacctggcgctcaacatcccgatcctctcctcggcgatggataccgtcaccgaagccgacatggcgatcgtgatggcgcagctcggcggcatcggcgtgctccaccgcaacctggaagtggacgagcagtgcgaggcggtccgcgcggtcaagcggttcgagagcggcatggtcgtcaatccgatcaccatggcgcccagcggcaccctcgccgaggcgcaggcgctgatggcgaagcaccggatcagcgggatcccgatcgtcgaagccagcggcaagctggtcggtatcctgaccaatcgcgacgtccgcttcgccgagaaccccaaccagctcgtctccgagctgatgacccaccagaacctcgccacggtgaaggtcggcgtcgcgcaggaagaggcgcgtcgcctgctccatcagcgccggatcgagaagctgctggtggtcgacgacgcctatcgctgcgtcggcctgatcacggtgaaggatatcgagaaggccgtcacctatccgcacgccaccaaggatcccagcggccggctgtgcgtcgcggcggcgacgacggtgggcgacaagggctttgcccgcaccgaagcgctggtcgatgccgaggtcgacctgatcgtgatcgacaccgcgcacggccataacaaggacgtcagccgcgcggtcgagcgggtgaagaagctctccaaccgcgtgcaggtgatcgccggcaacattgccaccgccgaagcggcgcgcgcgctgatcgatgcaggcgcggatggcctcaaggtcggcatcgggccgggctcgatctgcaccacccgcgtcgtcgccggcgtcggcgtgccgcagctcaccgcggtgatggatgcggccgaggaagcggccaagtcgggcgtgcccgtgatcgccgatggcggcatccgcacctcgggcgacatcgccaaggcactggccgccggtgcgagcgcggcgatgatcggctcgctgctcgcgggcaccgaggaagcgccgggcgagaccttcctctaccagggccgtgcctacaagtcgtatcgcggcatgggctcggtgggcgcgatggccaagggctcggccgatcgctacttccagcaggatatcaaggatcagctgaagctggtgccggaaggcatcgaagggcaggtgccgtacaagggcccggcgcgcgacgtgatccaccagctggttggcggcgtgaaggcgtcgatgggttatgtcggcgcggcgacgctgccggaattccaggagaaggcgcgcttcgtgcgcatcaccaatgcgggtctcaaggaaagccacgtccatgacgtgacgatcacccgcgaggcgccgaactac

SEQ ID NO: 41495 - DNA, 2625 bp, SPHINGOMONAS
agcatgcagcgtcgaaccatattgaccggagccatgggcacaggtctggcggcggcgctgccaattgcggccggggcgaccagcccggtgatcccctcgccccgccagcgcctcgcactcgatacgggctggcgcttccatctgggtcacgcgtcggatctggccagggacttcaatttcggcctcaaccagcggacctatgccaaggccggcgccgataccgccgatgccgccatggccgaattcgacgacaagggctgggccccggtgcagttgccccacgactgggccgtcgacctgtcctacgccatcccgccggggatgaaggcggaagacaccaaggacgatgtcgcctcgcatggcttcaaggcgatcggccgcgactttcccgccaacagcgtcggctggtaccgccgccgcctgccgatcgaggccggcgatgccggcaagcgcatctggctggagttcgacggcgtgttccgcgacgcgatcgtgttcgtcaacggctatgtcgtcgcgcggaacgagagcggctatgtgcccttccaggccgacatcaccgatttcctgaacttcgacggcaagcccaaccagctggcggtgcgcgccgatgccagcttcggcgagggttggttctacgagggcgccggcatctaccggccggtgtggctggtcaaggccgcgcccgtacatgtgccgcaatggggaagcttcgtccgcagcacgatcacgccgcaaggcgcgcagatcaccgcctcgatcgaagtgcgcaacgccaccgagcttcctgccaaggccacgctgcgccagtatatcgtcgatgcggggggcacgatggtggccgccttgcccgacgcgaccctcacccccgcggccaacacgctcgtgacgcacgaggtgagcgtcaccctgcccaacccgcgcctgtggtccatcgagacgccggtgctctaccggctggtgagccggctcctcgtgaacgaagcgccgatcgatgtgtacgagaccagcttcggcatccgttcgatccgcttcgatgccgagcggggcttcttcctcaacgacaagccggtcaagctgctgggggtgtgcaaccatcaggaccatgccggcgtcggcaccgcgattccgcccgcgctcgatgcctggcggatcgcgcggaccaaggaaatgggcgccaatgcctggcgcagcgcgcacaacccgccctcggaatccttcctcgacgcgtgcgaccgcctcggcatgctggtgatcgacgaggcccggcgcaacagcaccgatccggaatcgacgagccagctcgagcgcatcctgcggcgcgaccgcaaccatccgagcatcatcctctggtcggtcggcaacgaggagccgcaggcgatgaacgcgcgcggcggccgggtgagccacaagatggtcgcccatatccgccgcctcgatccgacccgccccaccacccaggcgttcgaccgcgggcagtatgaggccgcggcgcgggaagtcgacgtgatcggcttcaactaccatacggacaagaccattccctttcacgcacgcttcccgaaccagccgatcatcggcacggagaccggcagcacggtttccactcgcggggagtatttcaacgacaggccgcgccagatcgtgcgcgcctatgacaccgaatatccggcctgggcctccaccgccgagcaatggtggaaggtcgccgatgcgcatccctatgtcgccggcggcttcatctggaccggcttcgactatcgcggcgagccgaccccgcacgcgctatggccggctgcctccagctatttcggggtgatggacctgtgcggtttccccaaggacaattactggtactatcgcgcctggtggcggcccgagccgctcgtccacctgctgccgcactggaactgggcgggccgcgaggggcaagacatcgaggtctgggcctatagcaatggcgaggcggtggagctgctgctcaacggtcgcagcctcggccgccgcccggtcgagcgtggcggtcatgtcgaatggcgcgtgccctatgcgcccggccggctggaggcgcgggcgatccgcggcggccgcgtcgtcgcgaccagcatgcgcgagaccagcggtcccgccgccgcgatccgcctgaccgccgatcgcaagcagatcgccgccgacggccgggatctcgccattctcgccgccgagatcgtcgacgcgaaggggcgccccgtccccaccgccaatacgccgctgcgcttcacgatcgacggaccggccgagctgatcggggtcggcaatggcgacccgaccagccacgaaagcgatcacgcccccgcccgccgcgcattcaacggcctcgcccaggccatcctgcggcatcacggggcggcagggatcgtccggttcaccgccgagggcgacggcgtgaagccggcaagcctcgccctgctggcgctctgaggcggcccctgctcgtcagcgccgcatcggcgccatccgccattcgtgaatggtcggcgagcggtctcgccaacaagtcaccttgtaatggcacagggcagggcaaccagcacgcggtcggggcgcccgcaacaaggagcctgttccgttgctggtccatcacct

SEQ ID NO: 41496 - DNA, 1254 bp, SPHINGOMONAS
atgaccgatttttcgatgatcgacggcgaactgcacgtcgaatcgctgcccctcgcgcgcatcgccgccgaggtgggtacgcccgtctatgtctattccaccgaacgcttccaggccaatgcccgcgcctttcgcgacgcgctgaagccgctggggcgcatccacctcgccttcgcgatcaaggccaatcccaacctcgcggtgctcaagctgctggcgaacgagggcttcggcgccgatgtcgtctcgggcggcgaaatggcgcgcgcgctggcggcgggcgtggcgcccaaggacatcgtcttctcgggcgtcggcaagacgcggcgcgagctggtcaaggggctggaggccgggatcggccagttcaacctcgagctggtcgaggagggcgaagtgctggcggcgctggcggccgagcgcggccttaccgcgcgcgcggcgctgcgggtgaacccggatgtcgatgccggcacgcacgagaagatctcgaccggcaaggcggagaacaagttcggcctgccgatcggcgaggcaccggcgatcttcgagcggctgggcaagctgcccggcctcgatctgcacggcatcgcggtgcatatcggcagccagctgctcggcttggcacccctggaatccgcattcgagcgcgtcggccggctgctcgccgaactgcgcgcgggcggccacaccatcacccatgtcgatctcggcggaggccttggcgtcgcctatcgcccgggtgaggtgccgccgacgccggaagcctatgcagagatggtcgcgcgggtgacgaaggactgggacgtcgagctgatgttcgaacccggccgcaccatcgcgggcagcgcgggcgtgctggtcaccgaagtgctgtgggtgaagccggggcagatccacccctgggtggtggtcgacgcggcgatgaacgacctcgcgcgggtggcgctgtacgacgcctatcatggcttcgcggcggtgaagcccaatggcgagcgcttcgtcgccaatgtcgcggggccggtgtgcgaaagcaccgacgtgttcgtgaaggcgcgcgagatcgatgcggtgaaggccggcgacctcgccgtgctggagacggcgggcgcgtacggcgcgaccatggccagcacctataacagccgcccgctggtacccgaggtgctggtctcgggcgatcgctatgccatcgtcgccggccgcatctccgccgaggagatcatggccgccgagcaggtgccggactggctc

SEQ ID NO: 41497 - DNA, 1416 bp, SPHINGOMONAS
aggagaagaccgatcaccgagcgcaaggacagctccaattccatgtggggagggcgcttcgccgaaggcccgtccgcggtgatgcgcgagataaacgcctccatccccttcgacaagcggatgtggcagcaggatctgcgcggctccaaggcgcacgtcgcgatgctgggccggcaggggatcgtgggcagcgaggacgcagcgacgattagcgccgggctcgaccaggtcgccgaggacttcgccgccaacggcgtgcccgaggatctggcgctcgaagacatccacatgctctccgaaagccggctggcggaaaagatcggccccgtcgcgggccgcctccacaccgcgcgctcgcgcaacgaccaggtcgcgaccgacttccgcctctgggtgcgcgatgcgatcgaccaggccgatgcggcgctgggtgcgctgcaggacgcgctgctggcgcgggccgagcagcatgccgacagcgtgatgccgggcttcacccatctccaggtcgcgcagccggtgacgctgggccaccatctgatggcctatttcgagatgttcgcgcgcgaccggtcgcggctgaaggatgcgcgggcgcggatgaacctgtgcccgctgggctcggcggcgctggccggcaccggcttcaacctcgatcgcgaggcgaccgccaaggcgctgggcttcgacgggccgacgcgcaactcgctcgattcggtctcggaccgcgacttcgcgctcgattatctgacggcggcggcgcagtgcagcctccacctcagccggctggccgaggaattcgtgatctgggcaagccagcccttcggcttcgtggcactttccgaccaatggtcgaccggcagttcgatcatgccgcagaagcgcaaccccgacgcggccgagttggtccgcgggcattcggggcggatcagcggcgcgcttttcagcctgatgatgacgatgaagggcctgccgctcgcctattcgaaggacatgcaggacgacaagccgccggtgttcgaggcgcatgacctgctcggcctcagcatcgcggcgatgaccggcatggtcgagagcgccaccttccggctggagcggatgcgggcggcggcggaggccggcttctccaccgcgaccgacctggccgactggctggtgcgcgagggcggcatcccgttccgcgaggcgcatcacatcaccggccgcgcggttgccaaggcggaagccgaggggatccgcctcgatcagctctcgattcaagcgctcaaggaaatcgatgcacggatcgacgaacgcgtgtacggcgttctcagtgtcgacgcatcggtcaacagtcgggtcagcttcggcggcacggcaccgtcgcgcgttcgtgcggcgatagcagcggcccgcaagggtcgcgaggaggaatca

SEQ ID NO: 41498 - DNA, 1431 bp, SPHINGOMONAS
gtgttccggcatctccaccagctgtccttgcgcttccacctcaaccgccgcaccggcgcggtgaccaaggtggtcgagcgcggcaccaagagcatcgacacgatgctctatttcctgctgttcaacatcgccccgaccatcctcgagctctgcatggtgctcggcatcttcggcacgcgcttcggctggtggctggtcgcgggcacgctggcgatggtggtgatctacatcgccttcacccgctgggtgaccgactggcgttccaagctgcgcgagcagatgaacgacctcgacaccggcgccgtggcccacgccgtcgattcgctgctcaacttcgaaacggtgaagtatttcaacgccgaagcccgtgagagtgcccgctacgacaaggcgatgacggcgtacatgaacgccgccgtgaccagcgagaattcgctcgcgtgggtcaatatcggccaggcggtgatcaccaacctgatgctcgccgccggcatggcgctggtggtgttcggctggtcgacgggccgcttcacgccaggtgacgtagtgctggtgtcgacgctgctcagccagctgttccgcccgctcgacatgctcggctgggtctatcgcacgatccgccagggcgtgatcgacatgggcgcgatgttcgacctgctcgataccggcgccgaggtgaaggacgccgcggacgcgcagccgctcgcggtgcagcaggggcatgtgcgcttcgagggcgtgcagttcggctatgatgccgatcgccagatcctcaagggcattgacctcgacattccggcgggcgccaccgtcgcggtggtcgggccgtcgggggcgggcaagtcgacgctcgcgcggctgatgtaccgcttctacgacgtcaccggcggccgcatcaccatcgacgggcaggacattcgagcggtcacccaaaccagcctgcgcgccgcgatcggcatcgtgccgcaggacacggtgctgttcaacgagacgatcggctacaacatcgcctatggccgcgaaggtgccacgcccgaggagatcgccgaggcggtgcgcggcgcctcgatcgcgaacttcatccaggcgctgccgcaagggctcgacacgcgggtgggcgagcgcggcctcaagctttcgggcggcgagaagcagcgcgtggcgatcgcccgcacgctggtgaaaaacccacccattctgattctcgatgaggcgaccagcgcgctcgacagccgcaccgaggcggacatccaggcgacgctcgagtcgatcgagcggggtcgcaccacgatcgtcatcgcccaccgcctgtcgacggtggtccatgccgaccgcatcatcgtgctggaagcaggccgtgtggtcgagcagggcacccatgccgagctgctgcgtgaaggcgggatctacgccgaaatgtgggcacgccag

SEQ ID NO: 41499 - DNA, 1071 bp, SPHINGOMONAS
cccaagccctgggtgatggccatcgccccctatgtcccgggccgcgccaccaccgattcgggcaagcccgccgccaagctctcgtcgaacgagaaccccttcggcacgccccaggccgcgcgcgacgcctatgccgccgccgcgaccgaactggagcgctatcccgacgccggcgccgtcgcgctgcgcgaggcgctgggcgcgcattacggggtggagcccgagcggatcgtctacggcaccggctcggacgaggtgctgcaccttgccgccggcgcgttcgccggggtgggcgacgagatcatctatgtccgctacggcttcgcggtgtacgacatcgccgcccggcgggtcggcgcgacgccggtggtggcgcccgatcgcgactatgcgaccgatgtcgacgcgatcctcgcctgcgtgaccgacaagaccagaatcgtcttcctcgccaacccgaacaatcccacgggcacgtacacggcgcgcgaggagatcgcccgcctgcacgcggcactgcccaaaagcgtgctgctggtgctcgaccaggcctataccgaatatctcgattccgaggatgatgacggcgggctggaactcgcccgcacccagcccaacgtgctggtgacgcgcaccttctccaagatcttcggcctcgcctcggagcgggtcggctggggctatgcgcaccccgacatcatcgcggcgatgcaccgcatccgcgcgccgttcgcgttcagcatcggcgccggccgcgccgcgatcgccgcactgggcgacaaggacttcgtcgcgcacagccgcgcgcacaatgcgcagtggcgccagtggttcgccgacgagatcgccagcatgggcaacaagggcgtccgcgcggtgccgtccaaggcgaacttccagctcgtcctgttcgagggcgaggtgaccggcgaacaggcctacaagcacctcatggaggacggctatatcgtccgctggctgccgggccagggcctgccccatggcttgcgcatcaccatcggcaccgaggaagagatcaagggcgtggcagcctcgctgcgccgcttgctc

SEQ ID NO: 41500 - DNA, 711 bp, SPHINGOMONAS
atggcacgtgtagcggtcgttaccggcggtacccgcggtattggcgaagcgatcagtctggcgctcaaggacgccgggatcaccgtcgccgccaattatgccggcaatgacgagaaggctgccgccttcaccgaacgcaccggcatcaaggcgtacaagtgggacgtgggcgatttcgatgcctgcgccgccggcgtgcagcaggtggaagccgagctcggcccggtcgacatcgtcgtcaacaatgccggcatcacccgtgacggcaccatcctgaaaatgacgcgcgacatgtgggaagacgtgatccgcatcaacctgggcggctgcttcaacatggcgcatgcggtgttcccgggcatgcgcacccgcaaatggggccgcatcgtcaacatcggctcgatcaacggccaggccggccagtacgggcaggtgaactatgccgccgccaagtccggcatccacggcttcaccaaggcgctggcgcaggaaggcgcgcgattcggcgtgaccgtcaatgcgatcgcgccgggctatatcgataccgacatggtcgccgcggtgccggcggacgtgctggagaagatcgtcgccaagatccccgtcggccggctgggccaggcgcacgagatcgcccgtgcggtggcgttcctctgcgcggaagagggcgggttcgtcaccggatcgacgctgtcgatcaacggcggccag

SEQ ID NO: 41501 - DNA, 990 bp, SPHINGOMONAS
cctgccgatcatccgaagatcccgcctgcccgcgtcggcgtgctgctggtcaacctcggcacccccgatgcgcccgagccgcaagcggtgaagcgctatctcggcgaattcctgtccgatcgccgcgtggtcgagatcccgccgctgctgtggcagccgatcctgcgcgggatcatcctgcgcacccggccgaagaaatcggcgcatgcctatgcccaggtgtggcgcgaggacggctcgccgcttgccgcgatcaccaaggcgcaggcacgcgggctggagggcgcgttcgggccgggcgtgaccgtccttcacgcgatgcgctacggcaagccctcggtcggcgatcagatcgcggtgctgaaggcgcaggggtgcgagcgtatcctggtggcgccgctctacccgcaatattgcgcggcgacgaccgccaccgccaacgatgttgccttcgccgcgctgatggcgatgcgctggcagccggcgctgcgcacgctgccgccttattacgatgaccccgcctatatcgccgcgctgaagaccagcgtcgaggaagggctggccgggctcgacttcacccccgatgcggtgatcgccagcttccacggcatgccgcagcggacgctggaacggggcgatccctatcactgccattgccgcaagaccgggcgcctgctgggcgaggcgctggggcgcgagctgatcgtcaccttccagtcgcgattcggccgcgccaagtggctggagccggcgaccgacacgacgctggaggcgctgcccgccaagggcatccgccgcatcgcgatcgtggcgcccggtttctcggcggattgcctcgaaacgctggaagaactggcgatccgcggccgcgaatccttcctggacgcgggcggcgagaatttcgcatatttgccttgtctcaatgatagcggcgcgggcatggagttgctccgacaacttatcgggcgcgaacttgccggctgggtgaac

SEQ ID NO: 41502 - DNA, 1272 bp, SPHINGOMONAS
cgcccgctgcaccccgaaacgcttgccctgcacgccggctggcgcgccgatccgagcaccggcgcggtggtgccgccgatctaccagacgacctcgtaccagttccgcgataccgatcatgccgccaacctgttcgcgctgcgcgagttgggcaacatctatacccgtctcggaaacccgacgacggatgtgctggagcagcgcatcgctgcgctcgaaggcggcgcggcggcgctggcggtggcctcgggccaggccgcgtctgcctatgcggtacagaacctcgcccgcgccggcgacaatatcgtcagcggcaccgacctctatggcggcacctggaacctgttcgccaacacgctgaaggacatgggcatcgaggtccgcttcgtcgatcccgccgatccggaggcgttcgtccgcgccagcgacgatcgcacccgtgcctggtatgtcgagacgctgcccaaccccaagctgatcgtcgcgccgatcggcgagatcgcagcactgggccgcccgctcggcattccgctgatcgtcgacaatactgccgcaccgctgatcgcccggccgttcgatcatggtgccgcgatcgtggtctattcgaccacgaaatatatcggcggtcacggcacctcgatcggcggcatgattgtcgatggcggcacgttcgactgggaagccttcccggatcgccagcctttgctcaacacgccggaccccagctatcacggcgcggtgtggagccaggcggccaagccgctggggccgatcgcctatatcctgcgcgcccgcaccgtgctgctgcgcgatctgggcgccgcgctctcgccgaccaacgccttccagatcctccaggggctggagaccctgccgctgcgcatgccgcgccactgcgagaacgccgccaaggtcgttgccttcctgcagtcgcgccccgaggtgacgcgggtgatccacccctcggtccagaccggcatccaggccgaacgcgccgcgcgggtgctgaccggcggccagggcgggctggtcggattcgagctggccggtggcagtggcgccggccgggcgttcatcaacgcactgcagctcttctaccatgtcgccaatatcggcgatgcgcgcagcctcgccatccatccagcgtcgactacccattcgcagctctccgccgaggagcaggccgttaccggtgtgtccgaaggctatgttcgcctctcgatcggcctcgagcatatcgacgacattatcgccgatctgggccaggcactg

SEQ ID NO: 41503 - DNA, 897 bp, SPHINGOMONAS
atgcgcccggacgacatggcccgcaccctgggtggcgggctgctgtccttccccgtgacccatttcgatgccgaaggagcctttctcgaaggtccgtatcgggcccattgcgcgtggatgctctcgcacgagctggccgggctgttcgctgccgggggtaccggcgagttcttctcgctcactcccgacgaggtcgtccgggtagtgggcgctgccgtggcggaggcgaacgggcggctgccggtgatctccggatgcggctatggcaccgcgatcgccgtcgagatcgcgcgcggcgcggaaaaggccggggcggacgggctgctgctgctgccgccctatctggtcggatcgtcgcaggcgggcctcgccgcgcatgtcgaggcggtgtgcagggcgaccgggctgggcgtgatcgtgtacaatcgcgacaacgccgtcctcgacgacgagacgctggcggggctgtgcgaacgcaaccccaatctggtcggcttcaaggacggggtaggcgacatcgaactgatgacccgcatctatgcgcggatgggcgaccggctgacctatatcggcgggctgcccaccgcggagaccttcgccactccgtatctgaccatgggtgtcaccacctattcctcggcgatcttcaactttctgccggaatgggcgctgcacttctaccgcgctgtccgcgccgatgaccggaccgagatcctcgcccagctccgcgcgttcgtgatgccctatatcgcgctgcgcaatcgcggccgcggctatgcggtgtcgatcgtaaaggcggggatgcgcgcggtcgggcgcgatgcggggccggtccgcacgccgctcaccgacctgaccgagggcgagcaggcggaactcgccgccctgatcgcccgc

SEQ ID NO: 41504 - DNA, 1194 bp, SPHINGOMONAS
cgcgtcgtcctcgcctattcgggcggcctggacacgagcgtgatcctgaaatggctgcagcagacctataactgcgaggtcgtcaccttcaccgccgatctcggccagggcgaggagctggaacccgcgcgcaagaaggccgagatggccggcgtgaagcccgagcacatcttcatcgaggacgtgcgcgaggaattcgtgaaggactatgtgttcccgatgatgcgcgccaacgcgctctacgagggtctgtacctgctcggcacctcgatcgcgcggccgctgatcgccaagcgccagatcgagatcgccaagctggtcggcgccgatgcggtgagccacggcgccaccggcaagggcaacgaccaggtccgcttcgagctcggctattacgcgctcaacccggacatcaaggtgatcgcgccgtggcgcgaatgggacctgaccagccgcaccaagctgatcgagttcgccgaatcgcaccagatcccggtgaccaaggacaagcgcggggaatcgcccttctcgaccgacgcgaaccttctccacacctcgtccgagggcaaggtgctcgaggatccgtgggaggaagtgcccgattacgtctattcgcgcacggtgaacccggaagacgcgcccgacatgcccgagacgatcacgatcgatttcgagcgcggcgacggcgtggcgctcaacggccaggcgatgtcgcccgccacgctgctgacggcgctcaacgagctcggccgcaagcacggcatcggccggctcgatctggtcgagaaccgcttcgtcggcatgaaatcgcgcggcatgtacgagacgccgggcggcaccatctatcacctcgcccatcgcggcatcgagcagatcacgctcgatcgcggcgccgcgcacctcaaggacgagctggccccgcgctatgccgagctgatctacaacggcttctggttctcgcccgagcgcgagatgctgcaggccgcggtcgattacagccaggagaaggtcaccggcaccgtgcggctgaagctgtacaagggcagcgtgatcgtcaccggccgcaagtcgccctattcgctctacagcgagaaggtggtgaccttcgaggacgaccagggcgcctacgaccagcgcgatgcggcaggcttcatcaagctcaacgcgctgcgcctgcgcctgctcggccgccgcgag

SEQ ID NO: 41505 - DNA, 1335 bp, SPHINGOMONAS
atggcgcgttttacctttcgtctgccggacatcggcgagggcattgccgaggccgagatcgtcgcctggcacgtgaagatcggcgaccgcgtggaggaagaccagcaggtcgccgacatgatgaccgacaaggccacggtggagatggagtcgcccgtctccggcgtggtggtcgaactcgccggcgaggtgggggaccaggtgccgatcggctcggcgctgatggtgatcgaagtcgagggtgaggctgcggccgaggcggagacgccggtcgaggagcaggtcgaggccgagaatcccggcgtggagcaatcgatcctccccggcacggggagggggaccgccggcgaagccggtggtggagggggagcgtcgctggacgactccgccgaagctgcgccagcatcccccgccgagccccccctccaccatcagcctgcggctgatggtccccctccccgttccggggaggatcctaagatcctcgcctcccccgcggtgcgcgcccgcgccgccgacctcggcatcgacctcgcgcaggtgaagcctgccgagggcgaccgcatccgccacgccgacctcgatgcgttcctccgctatggtagcgcgcagggctatcacgcgccccacgcttcccgcgcccgcgaggatcagccggtgaaggtgatcggcatgcgccgccgcatcgccgagaacatggccgcgtcgaagcgcgccatcccgcacttcacctatgtcgacgagatcgacgtcaccgccctcgaagcgatgcgcgccgacctcaacgacaatcgcggccagcgccccaagctgaccatgctgccgttcctcatcgtcgcgctgtgccgcaccctgcccgacttcccgatgctcaacgcccgctatgacgacgaggccggcgtggtcacccgccatggccgcgtccatctcggcatggcgacgcagaccgatgcggggctgatggtgccggtgatccgcgacgcgcaggatcgcaacgtctggcagctggcgagcgagatcacccgcctggcggacgccgcgcgcaccggcaaggcgaagtccgaggagctgagcggctccaccctcaccgtcacctcgcttgggccgctgggcggcatcgcgacgacgccggtgatcaaccggcccgaagtggcgatcatcggccccaacaagatcgtcgagcgccccgtgttccacggcgacgagatcgttcgcgccaagctgatgaacctgtcgatcagctgcgaccaccgcgtcgtcgacggctgggatgcggcgagcttcgtccaggcggtgaagaagctgctcgagacgccggtcctgctcttcgccgac

SEQ ID NO: 41506 - DNA, 1011 bp, SPHINGOMONAS
gccgccccccggatgaacatgatccaggcgatcaactccgccatggacgtgatgatggaacgcgacgaccaggtcgtcgtgatgggcgaggatgtcggctatttcggcggcgtgttccgcgcgaccgccgggctccaggccaaatacggcaagacccgcgcgttcgatacgccgatcaccgagatcggcatcatcggcgtggcgatcggcatgggcgcctatgggctgcgccccgtacccgagatccagttcgccgattatatctacccggcgctcgaccagctcgtgtccgaggccgcccggctgcgctatcgctcgaacggcgatttcaccgcgccgatcacggtgcgttcgccctatggcggcggcatcttcggtgggcagacgcacagccagtcgcctgagggcatcttcacccatgtctcgggcatcaagacggtgatcccgtcgaccccctatgacgccaagggcctgctgatcgccgcgatcgaggacaacgaccccgttctcttcctcgagcccaagcgcatctataacggtccgttcgacggccattatgatcgcccggccaagaactggaccgcgcatccggcgagcgaagttccgacaggctattaccgcgtcgaactcggcaaggccgccacggtccgcgagggcgaggcggtgaccatcctttgctacggcacgatggtgcatgtggttgcagccacgatcgaggagctgggcgtcgacgccgagatcatcgacctgcgcaccctcgtgccgctcgacatcgaggcgatcgaagcctcggtcaagaagaccggtcgctgcatgatcgtccatgaggcgacgcgcacctcgggcttcggtgcggaattgtccgcgctggtgcaggagcgctgcttctaccatctcgaagcgccgatcgcccgcgtcaccggcttcgacacgccctatccccacagcctcgaatgggcctatttcccaggtcccgtgcggatccgcgaggcgctcaacaaactcctcaag

SEQ ID NO: 41507 - DNA, 1242 bp, SPHINGOMONAS
tacggccatctgtacgtgcaggtgcttgtcgccatcatcgcaggcgtgctgatcggccattatgcgccggccaccggcgaagcgctcaaaccgctcggcgacggattcatcaagctggtgaagatgatcatcgccccggtgatcttcctcaccatcgtcaccggcatcgccggcatgcgcgatctgcgcgcggtcggccgggtagcggccaaggcgttcgcctatttcctgttcttctccacgctggcgctggtcgttggcctggtggtcggcaacatcatccagccgggtgccggactgaacatcgatcccgccacgctcaacgcgggcaaggtcgcggaatataccgccaaggcgcatgattcgacgatcaccggcttcctgctcggcatcatcccggacaccttcctctcggcgatcaccgagggcaacatcctgcagacgctgttcgtggcgatcctgttcggcatcggcctcgccttgctcggcgatcgcagcacccgcatcgtggcggcgctggaggatgtctcgctggcgatgttcaaggtcgtggcgatcctgatgaaggcggcgcccgtcggtgcattcggcgccatggccttcaccatcggcaagtacggcgtcggcacgctcgccaacctcgccatgctgctcggcaccttctacctcacctgcggcgctgttcgtggtgctggtgctcggcgcggtctcgggcgctgggccggattctcgatctgctgcctgatcgcctatctcaagaccgagctgctgctggtcctcggcacctcctcctccgagagcgccctgcccgccctgatcgacaagatggagcgtgcgggctgccccaagacgatcgtcggcctggtggtccccaccggctattcgttcaacctcgacggcaccaacatctacatgacgctggccgcgctgttcatcgcccaggcgacgggcgtgcacctgtcgctggagcagcaggtgctgctgctcggcgtggcgatgctgtcgtccaagggcgcggcgggcgttaccggcgcgggcttcatcaccctggccgcgacgctgtcgatcgtgcccagcgtgccggtggcgggcatggcgctgatcctcggcgtcgaccggttcatgtccgagtgccgcagcctcaccaacttcatcggcaacgcggtggcgacggtggtggtctcgcgctgggaggggcggctggaccatgccgcgctgcaggccgcgctgaagggtacgacg

SEQ ID NO: 41508 - DNA, 819 bp, SPHINGOMONAS
ggcggggaccagaccagcgtttactcagcaggagccgtcatgaccgacgtcgccatcgccgcccccgaccagtctgcccccgatcccatgccgctgcccgatcgcgggctcgcggtagtttcgatcgccaagtcgtacgacaagcgcaccgtgctgacggacgtgtcggtctcggtcgggcgcggcgaagtcgtcggccttctcgggccgaacggtgctggcaagacgacctgcttctattcggtgatgggtctggtgaagccggacagcggccgcatcatgctcgacggcgaggacattacccgcctgcccatgtaccgccgagcgatcctgggcctcggctatctgccgcaggaaacctcgatcttccgcggcctgagcgtcgagaagaacatctctgccgtgctcgagctggccgagccggaccgcgatgcgcgccaggcgcggctggacgagctgctcgacgagttcggcctcacccggctacgcacctcgcccgcaatggcactatccggcggcgaacggcgccgcgccgagatcgcccgcgctctggcggccaacccgacgatcatcctgctcgacgagccgttcgccggcatcgacccgatctcgatcgccgacattcgcgatctggtgaagcagctgaagcagcgcggcatcggcgtgctgattaccgaccataatgtccgcgagacgctggaaatcgtcgatcgcggatatatcatctatgacggccgcgtgctgttcgccggctcgcccgacgatctggtccgcgacgagaatgtccgccggctctatctcggcgaaagcttctcgctc

SEQ ID NO: 41509 - DNA, 627 bp, SPHINGOMONAS
atgcccgcaaccgcgaaaatctgtggcctgtccacgcccgagacgctcgacgccgccaccaccggcggcgccagccatatcggcttcgtcttcttcccgcccagcccgcgccacttgagcttcgagaaggcacaaggtctggccgcgcgcgtgccggggcatgtcctccgcgtcggcgtgttcgtcgatcccgacgatggcttcctcgatgccgccattgccgccgggcggctcgatgtgatccagctccacaaggtgaccccggagcgcgccgccgccgtgaaggcccgcaccggccgtgaaacctgggctgcgctggccgtgaagactcgcgccgatctcgttcccgccgccggctttcgcggcgcggtcgatcggctgctctacgatgccaaggcgccggagggggccaaggtgcccggcggcaccggactgcgcttcgattggaccctgctcgacggtttcgcccatcccctgccctgggtgctttccggcgggctggatgcggacaatgtaaacgaggcgatccgtgtcaccggtgcgggcctggtggatgtctcttcgggcatcgaggccgcgccgggcatcaaggatgtggacaagatcgccgcattccttaaagccgtg

SEQ ID NO: 41510 - DNA, 1947 bp, SPHINGOMONAS
caggacgcgccctatctccagggcctgaacgacccccagcgcgaggccgtgctcaccaccgaaggtccggtgctggtgctcgccggtgcgggtacgggcaagacggcggcgcttaccgcccgcctggcgcacctgctctggacgcggcgggcctatccgtccgagattctggcggtcaccttcaccaacaaggcggcgcgcgagatgaaggagcgggtcggccggctagtcggcgacgcggtggaggggatgccgtggctcggcaccttccatgcgatcggcgcgaagatgctccgccgccatgccgagctggtcgggttgcagagcaacttcaccattctcgataccgacgaccagctccgcctgctcaagcagctgatcctcgccaacgacctcgacgaaaagcgctggcccgcccgccagctcgcgggcctgatcgacgggtggaagaaccgcgggctgatcccggccgatctcgatgccggcgagtccgagagctacgccaatggccgcggccagtcgctttacgcccagtatcaggagcggctgcgcctgctgaacgcctgcgatttcggcgatcttctcctccatatgctcacgattcttaagaccaatcgtgaagttctggaactctaccaaaagcgcttccgctacatcatggtggacgagtatcaggacaccaacgccgttcagtatctctggctgcggctgcttgcgcaggagcggaagaacatctgctgcgtcggcgacgacgaccagtcgatctacagctggcgcggtgcgcaggtggaaaatatcctgaagttcgagaaggacttccccggcgccgttgtgatcaagttggaacagaattaccgctcgacgccgcacattctcggcgccgcctcgggcgtgatcgccaacaatggcggtcgcctgggcaaaacgctgtggaccgagatcgatgtcggcgagaaggtgaaggtgctcggcgtgtgggacgggccggaggaagcccggcgcgtcggcgaggagatcgaggggctgcagcgcggcggcctcagtctcgacgccaccgcgatcctggtccgcgcccagcaccagacccgcgagttcgaagatcggttcatcgcgatcggcctgccctatcgcatcatcggcggcttccgcttctatgagcggcaggaaatccgcgacgcgctcgcctatctgcgcgtggtcgcgcaaccggccgacgacctcgccttcgagcgcatcgtcaacgtgcccaagcgcggactgggcgacaaggcgctctccaaggtccaccagttcgctcgcgcgcaaggccttccgctcaccaccgccgccgcgcgtatcctcgataccgacgagttgaccccgcaggcgcggcgctcgctcggcaatctgatcggcgacatggcgcgctggcgcagcatgggcgacgatctccagcacccggacctcgcccgcatcatcctcgacgaaagcggttataccgcgatgtggcaggccgatcgcactgccgaggcggcaggccggctggagaatctcaacgaactcgtccgcgctatggaggagtatgagagcctctcggccttcctcgagcatgtcagcctggtgatggacaacgaagcctcggccgaggaacccaaggtcacgatcatgaccatccacgccgccaaggggctggagttcgatacggtgttcctcgccggctgggaggaaggcatcttcccgtcgcagcgagcgctcgacgagggcgggctggccagcctcgaggaggaacgccgcctcgcctatgtcgcgatcacgcgggctcggcggcgggcgatcatcctgcatgccgccaatcggcggatctacgggcaatggacgtcgagcctgccgagccgattcgtcggcgaactgcctgccgagcatgtcgaatcggaaagctcgatgaccggcggcgagagcctgtggcgg

SEQ ID NO: 41511 - DNA, 1038 bp, SPHINGOMONAS
atggggcagcaccccaaggtgatcgaggcgatggaagaggcgctgcacgatgtcggcgccggctcgggcggcacccgcaacatcggcggcaacacccattatcacatcgatctcgagcgcgagctggcggacctgcacggcaaggaaaacgcgctgctcttcacctcgggctatgtctcgaacgaggcgaccttgtcgacgctcgccaaggtgatgccgggctgcatcgtttattcggacgagctcaaccacgcctcgatgatcgcgggcatccgcaattcggggtgcgagaagcgggtctggcgccacaacgacgtcgcccatctcgaggaactgctcgccgccgacgatcccgcggtcccgaagctgatcgcgttcgaaagcgtctattcgatggacgcggacatcgcgccgatcgccgagatctgcgacctggccgacaagtacaacgcgctgacctatctcgacgaggtccatgccgtcggcatgtacggcccgcgcggcggcggcatctcggatcgcgagggcctggccgatcgcctgacgatcatcgagggcacgctgggcaaggcgttcggcgtgatgggcggctatatcgccgccgaccaggtgatcatcgacgtgatccgcagctatgcgccgggcttcatcttcaccacctcgctgtcgccggtgctggtcgccggcgcgctggcgagcgtgcggcacctgaagggctccagcgtggaacgcgaaggccagcaggccgccgctgcgacgctcaagcagctgatggccgaggcggggctgccggtgctggcgtcgaccacgcacatcgtgccgctgatggtcggcgacccggtgaaggccaagaagatcagcgacgtgctgctcgccgagtacggcgtgtacgtccagccgatcaactaccccaccgtcccgcgcggcaccgagcggctgcgcttcacccccggccccgcgcatgacgaagcgatgatgcgcgaactggtggacgcgctggtcgagatctggggccggctggagctgcggctggcggcg

SEQ ID NO: 41512 - DNA, 720 bp, SPHINGOMONAS
gtactcatcaccggcgccaccgccgggatcggcgaagcttcggtccgtgcctttgcggacgccggctggcatgtggtggcgaccggccgccgcgccgatcgcctggaaaagctggccggcgagcgcgtccacaccctcgccttcgacatccgcgacgacgccgcgcgcgatgcggcgctggacagcctgcccgcgcccttttccgagatcgacctgctgatcaacaatgccggcctcgcgctcggccttgagcccgcgcacaaggcgtcgctcgaaaactggcggacgatgatcgacaccaacgtcaccgcactggtttcgatcacccacaagctgctgccgggcctggtcgcgcgcaagggcgggatcatcaacctgtcgtcggtcgccgccacctatccctatccgggcggcaacgtctacggcgcgaccaaggcgttcgtccgccagttcacgctcaacttgcgcgccgacctgatcggcaccggcgtgcgcgtcacctcgatcgagccgggcatggtcgagaccgagttcaccctggtccgcaccggcagccaggaagcctcggacaaggtctatgcaggcgtcaacccgatgaccgccgaggatatcgccgagacgatgctgtgggtggcgacgctgccgccgcacttcgcggtcaacacgctggaactgatgccggtgaaccagggcaacggcccgttcgcggtgcatcgcgaa

SEQ ID NO: 41513 - DNA, 2574 bp, SPHINGOMONAS
atgaacctcgagaaattcaccgaccgcgccaagggcttcctgcaatcggcgcagaccgtggcgatccgcatgaaccatcagcggatcagcccggaacatcttctgaaggcgctgctcgaggacgagcagggcatggcgagcggcctgatccaggcggcgggcggcgacgccaagcgcgcgctgagcgagaccgacctcgcgctctcgaagatccccgccgtcagcggctcgggcgcgcagtcgacaccgggcctcgacaacgacctcgttcgcgtgctcgatcaggccgagacgatcgctcagaagtctggcgacagctatgtcaccgtcgagcggctgctcgtcgcgctggcgctcagcctcaacaccgccgccggcaaggcgctgcaggcggcgaacgccaagcccgaggcgctcaacaccgcgatcaacgccatgcgcggcggccgcaccgccgatacgtcttcggccgaggaccggtacgacgcgctcaagaagttcgcccgcgacctgaccgaggcggcgcgtgccggcaagctcgatcccgtgatcggccgcgacgaggaaatccgccgcacgatccagatcctcgcccgccgcaccaagaacaatccggtgctaatcggcgagcccggcgtcggcaagaccgcgatcgccgagggtctcgcgctgcgcatcgccaatggcgacgtgcccgatacgctgaaggaccgcacgctgatggcgctcgacatgggcagcctgatcgcgggtgcaaaatatcgcggcgaattcgaggagcggctcaagggcgtgctcgacgaggtgaagggcgccgagggccagatcgtgctgttcatcgacgagatgcacacgctgatcggcgccggcaaggccgagggcgcgatggacgccggcaatctgctcaagcccgcgcttgcccgtggcgagttgcactgcatcggtgcgaccacgctcgacgaatatcagaagcatgtcgagaaggaccccgcgctgcagcggcggttccagccggtgttcgtcggcgagccgacggtcgaggacacgatctcgatcctgcgcgggctcaaggagaagtatgagctgcaccacggcgtgcggatcaccgatgcggcgatcgtcgccgcggcgacgctctccaaccgctacatcgccgaccgcttcctgcccgacaaggcgatcgacctgatggacgaggccgccagccgcatccgcatggaagtggagagcaagcccgaggagatcgagacgctcgaccggcggatcatccagctcaagatcgagcgcgaggcgctgaagcgcgagaccgacgaagcctcgcgcgaccggctcgccacgctggaggaggatctcgcgaatctcgagcagcaatcggccgagctgaccacccgctggcaggcggagaaggacaagatcaacgccgaggcggtgctcaagggccagctcgaccaggcgcggctggaactggagcaggcgcagcgggccggcgacctcgcgcgggccggcgaactgtcctacggcgtgatcccgcagctcacccgccagctcgacgaggcgcagagcgccgccaagggcgcgatgctgcgcgaggaagtgaccggggacgacatcgccggggtggtcgcgcgctggaccggcatcccgatggagcggatgctggagggcgagcgcgagaagctgctccagatggaacagcagcttgggcgccgggtgatcggccaggccgatgcggtcaaggcggtctccaccgccgtgcgccgcagccgcgcggggctgcaggatccgaaccggccgctgggcagcttcctgtttctcgggccgacgggcgtcggcaagaccgagctgaccaaggcgctcgccgagtttctgttcgacgaccccaacgcgatggtgcgcatcgacatgagcgagttcatggagaagcacgcggtcgcgcggctgatcggcgccccgccgggctatgtcgggtatgaggagggcggcgtgctcaccgaagcggttcgccggcgcccctatcaggtcgtgctgttcgacgaagtggagaaggcgcacaacgatgtgttcaacatcctcctccaggtgctcgacgacggtcgcctgaccgacggccagggccgcacggtggatttcgcgaacacgatcgtgatcctcacctcgaacctcggcagccagtatctcaccaatctggccgacggtcatccggtggaggaggtcgagccgcaggtgatggacgtggtgcgggcgcatttccgccccgaattcctcaaccgcctggacgagatcatcctgttccaccggctgggcgcggaccatatggcgccgatcgtcgacattcaggtgggccgggtgggcaagctgctgaaggaccgcaaggtgacgatcgacctcaccccggcagcgcgcgaatggctgggccgggtgggctatgacccggtctacggcgcacggccgctcaagcgcgcggtgcagcgctatctgcaggatccgctggcggacctcatcctgcgcggcgccgtgaaggacgggtccaccgtccatgtcgatgaaggcgacggcgcgctggcgctgcgggtg

SEQ ID NO: 41514 - DNA, 726 bp, SPHINGOMONAS
cgctttaacgacaagaccgtgctggtaaccgctgccgcccatggcatcggccgcgccaccgcactccgcctgcgcaacgagggtgcccgcgtgttcgcgctggatcgcgatgctgccgcgctcgcgaccatggaaggcgtcgaggcggttccgctcgacctgctcgatccccacgcaatcgctgcgcttcccgagaagatcggcgcgatcgacgcgctcgcaaacatcgccggtttcgtggcggcgggttcgattctcgacggcagcgatgcggattggatgctgtccttcgacctcaacgtccatgcgatgcaccgcatgatccgcgccttcctgccgggcatgctggcgcgcggcggcggggcgatcgtcaacatgtcgtcgatcgcctccagcgtgaagggcatccccaatcgctatgcctatggcgcctccaaggccgcggtgattggcctgaccaaggcggtcgcggcagacttcgtcgcgcagggcatccgctgcaacgcggtgtgcccgggcaccgtcgacacgcccagcctgcgccagcgcgtgtccgatcaggccgatgcgtcgggcatcagcgtcgaggacgcgcacgccgccttcgtcgcccgccagcccatgggtcgcctcggccgcgaagaggaaatcgccgcgctcgtctgctatctcgccagcgacgaggctgccttcaccaccggcgcggtccatgtgatcgacggcggc

SEQ ID NO: 41515 - DNA, 1590 bp, SPHINGOMONAS
aagctgcccgacgccgcgacgccggtggcctatcgcctggacttcacgatcgtgccggagcaaccgcgcttcaacggccataccgagatcgacatcgacctgaaggcgcccgcgaccagcctgtggatgcacggccgcgacctgcacatcgccaaggcgaccgtccgcgccggcggcaagacgctccctgccaccttcacccagaagagcccgagcggcctcgcccagctcgatttcggcaaggcgctgcccgccggccgggtgacgctggtgttcgactatgacgcggcgttcggaaccggaacccagggcgtctaccgcgtcaatgtcgacaaggaatggtatagctggacccagttcgaatcgatcgaggcgcgcgccgctttcccctcgttcgacgagcccggctacaagaccccgttcaccgtctcgatcaccaccaagcccggcttcaccgcggtgagcaacgcacccgaggcgagcaagaccaaggccggcgacctgctccgccaccagttcgcaccgaccaagccgctgcccacctatctcgtcgcgctggtcaccggtcccttcgccaccgcctctgcgctgatcccccccacgccgcagcggagcacgccgatgccgctgggcgtcgtcggcaccaagcccaacgcccagcagctcgatttcgcgctgaaggaatcgggcaagatcgttgcgctgctcgagaattatttcggccagcccttccctttccccaagctcgaccagatcggctcgccgatcatgccgggtgcgatggagaatgccggtgccgacatctatggcgacggcatcctctttcttgacgaggaggcacccagcgagcgcaagcaggcgttcggtatggtcgtcgcgcacgaactcgcccaccagtggttcggcgatctcgtcaccccggcctggtgggacgatatctggctgaacgagagctttgcgaactggatgggataccggatcggcaacgagtggcgccccggcctcaacatcgagctgaacgcgatcgaggagggcttccaggcgatggacctcgacgcgctgtccgccggtcgcccgattcaccagccgatccccaacgacggcgatatcgacgccgccttcgaccagatcacctatggcaagggcggccaggtcgtcgcgatgattgccgcctatatgggcgacgtgccgttccgcgacggcgtgcggctgcacatgaagcgccacgcctatggcaatgcgagcaccgaccagttcttcgcctcgctggccgatgcggcgcatgaccagcgcgtgctcgcctcgctgaagagctttgtcgaccagcagggcgtgccggtggtgacgctgcaccgtgagggcacgaccctcaccgccacccagtcgcgctacgccttcttcggcgccaatctgccggccgagcagtggatcgtgccgctgtgcctgcgccagggcgaaaccaagagctgcaccctgctcgacaagcccagcatgacggtgtccgccaagggcagcggcgcgctggtgcccaatgccggtggctggggctattatcgcttcgagctggacccggcggaatgggacgcgctg

SEQ ID NO: 41516 - DNA, 720 bp, SPHINGOMONAS
cccgatggctaccatgagcttgagacgctgttcgcgttcgtcgagcatggcgatacggtgcgcgtggtgccggccgagaccgacagcttcacgctcgacgggccgttcgcgccggtgctcgcggcggagggcgacaatctcgtcacgcgcgcggccacccgctttcgcgaggcctttggcggcggcgcccacagcatcgcgctggagaagcgtctgccggtcgcctcgggcatcggcggcggttcggccgatgcggcggcgacgctgcgggcgctggccgcgctgcacggtatcgcgcccgaggatacccgcctgttcgcgatcgccgatgcgctgggttcggacgtgccggcctgcctgctcggccgcacggcgctgggcagggggcggggtgaacaactcgcacccgttgccgggctctcgggcatgccggtgctgctggtgaaccccggggtcgcggtgtcgaccgccgcggtgtttcgcggctgggacggtgtggaccggggtcctatcggtagcggcgatctgctcgacgtggcgcgcggcggacgcaacgacctcgagccgcccgctcgtgcgctggcaccggcgatcgacgcggtactggcggccctggccgtgcaggagggggtgctgctcgcccgcatgtctgggtcgggcgcgacctgcttcgcgctgttcgatacccagacggcgcgggactctaccacggcaactctt

SEQ ID NO: 41517 - DNA, 1518 bp, SPHINGOMONAS
ggtgccggtggggcgcgccctttccgcgatctggagccgctgatgcgccgcgcagtcgtgatcggcgccggtttcggcggtctcgctctcgccatccgcctgcagtccgcgggggtcgacaccaccgtgatcgaggcccgggacaagcccggcggccgcgcctattattgggagcgcgacggcttcaccttcgacggcggcccgacggtgatcaccgatccggacgcgctgaaggagctgtggcgcctctcgggccacgacatctcggaagatgtgacgctgaagccggtcacgcccttctaccgcctgtcctggcccgatggaacgaccttcgactacaccaacgacgacgccgttctggcaggcgagatcgccaagctcgatgccagcgacatcgccggctatcgccgcttcctcgactattcggcgagcgtctatgaggaaggctatgtgaagctgggcgccaaggcgtttctggacttcaagtcgatgctcaaggccgcccctgcgctgatgcagcaccaggcctggcgctcggtctattcgatcgtctcgggcttcgtgaagaacgagaagctgcgggaggcgctgtccttccacacgctgctcgtcggcggcaatccgatggcgaccagcagcatctacgcgctgatccacaagctggaacgcgacggcggcgtctggtgggccgaaggcggcaccaaccggctgatcgccggcatgatcacgcatttcgagcggctgggcggcaaggttcgcatcggtgatccggtcgacgagatcctgacgcttggcgatcgggtggtcggcgtgcgcaccaagagcggcgtcgaggtcgaggtggatgcggtggcgagcaacgccgacatcgtccacagctaccgcgacctgctgcgcaactcgcgcagcgcccggcgcacggcgaaccggctggtcaacaagcgcttctcgccctcgctgttcgtggtgcatttcgggctgcggggcaccttccccgacattccgcaccacatgatcctgttcggcccgcgctataaggggctgctggacgacatctacaccaacggcgtggtgagcgaggatttctcgctctatctccaccaccccagcgcgtccgacccgagcatggcgccggagggtcattcgacgttctacgtgctggcgccggtgccgcatctcggcaagttcccggcggactggagccaggtggggcccgtgctcgaatcgcgaatcctggcggaggtgcagcgccggctgatccccgacctggccgagcggatcgtcaccaagttccactatgcgcccaccgacttccgcgacgacctcgcggcgcaccacggctcgggcttcagcctcgagccgatcctgacccagagcgcctggttccgggtacacaaccgcgacgacgcgatctcgaacctgtatttcgtcggcgcgggcacgcatccgggcgcgggcatccccggcgtcgtcggcagcgccaaggcgaccgccgagctgatgctgggcgagttggcg

SEQ ID NO: 41518 - DNA, 669 bp, SPHINGOMONAS
agttggctggcgccgctcgaagaggaatttgcccagccctatatggcagcgctgcgcgactatctgcgcgccgagaaggcggcgggaaagcggatcttcccggccggcaaggactggttccgcgcgctcgacctgacgccgctggagcaggtgcgcgtggtgatcctggggcaagacccctatcatggcgaggggcaggcgcacggcctgtgcttctcggtgcagccgggcgttcgggtgcccccgagcctggtcaacatctacaaggagatggagaccgacctcggcatcccccgcgcgaagcacggctttctcgagcattgggctcgccagggcgtgctgctgctcaacgcggtgctgacggtggaaatgggccgcgccgccgcccatcagggccgcggctgggagcgatttacggacgcggtgatccggctggtcaacgcgaagcccgagccggtggtattcctgctctggggcagccacgcgcagaagaaggcggcgttcgtcgactcgatcgacaagggcgggcggcatctggtgctcaaggccccccacccctcgccgctctcggcacattccgggttcttcggcagccggcatttcagcaaggcgaacgcgtttctgcaaagtattgggcagaggccgatcgattgggcgctgccggcgctg

SEQ ID NO: 41519 - DNA, 2634 bp, SPHINGOMONAS
gatatccgctttctcgggcggctgctcggcgacgtcattcgcgcctatggcggcgaggaactgttcaagcggatcgaatatatccgcgcgacgtcggtcgaccggcatcgcggggttgcgggtgcgggcgcgatcgattccgggctggaccggctgagcctggacgagacgctggatttcgtccgcggcttcatgctcttttcgatgctcgccaaccttgccgaggatcggcagggcgtcgccaccgagaaggatgccgatgtcgctgccgcgctggagcggctcgccaaggccgggatcggccgcgagccggtgatggcgctgctcgaccatgcgctggtcagcccggtgctcaccgcccacccgaccgaggtgcggcgcaagtcgatgatcgaccacaagaaccgcatcgccgaactgatgcggctgcgcgatcacggcgtcaccgaaacggccgatggcgaccaggtggaggaagccatactccgccagatcgcgctgctctggcagacccgcatcctgcgccgcgagaagctgggcgtgccggacgaggtcgagacagcgctttcctatttccgcgacgtcttcctgccggtgctgccggcactctacgcccgctgggaccgcgcgctgggcgaccgcgcgccgagcttcctgcgtcccggcagctggatcggcggggaccgcgacgggaacccgttcgtcaccgccgaatcgatgcgcttcgccctcgcccgcgcggcggagacggtgctcgaccattatctcgaatcggtccacgcgctgggtgccgagctgtcgatctcgaccgagcatgtcaccgtgcccgaagccgtgctgcaactcgccgaggccagtggcgacaccggcaagagccgcagcgacgagccctatcgtcgtgcgctgaccggcatctatgcgcgcctctccgccacccatgaaaagctgatcggcaagcgccccggtcgtccctcgccgatcccggccgcaccctatggccatccgtcggagtttcgcgaggatctcgtcgccatcgcgcgcggcctggcgaatggcgggccgctcgctaccggcggcgcgctcgggcggctgatccgcgcggtggaaacgttcggcttccatctcgccacgctcgacatgcgtcagaacagcgcgatccatcaacgggtggtggcggagctgctcaaatcggccggcgtctgcgaagactatgccgcgctcgacgagcaggcacgcatcgacctgctccgccacgaactggccaatgcccggccgctgaccagcccctatgcggtctattccgaggaaaccgcctccgaactggcgatcgtgcgcgaggcggcggcggcgcatgcgcgctacgggcgggattgcatccgccactatatcgtctcgatggcgcagtcggtctccgacctgctcgaggtgcatgtcctgctcaaggaagccgggctctatgtgccgggcgaaaccccgcaggcgcacatcatggcgatcccgctgttcgaaacgatcgccgacctcgaggccgcgccgccgatcatggaggcctggctcggcctgcccgaagtcgccgcgatcgccgcggtgcgcgggcaccaggaagtgatgatcggctattccgattcgaacaaggacggcggctacctcacctccacctggcagctcagccgcggatcgaccgcgctcaagccggtgttcgagcaggcggggctggcgatgcagctgttccacggccgtggcggcgcggtggggcgcggcggcggctccagcttctcggcgatccttgcccagccgccgggcacggtgcagggccgcatccgcatcaccgaacagggcgaggtgatcgccgccaaatatggcagccccgaaagcgcgatgaccaatttggaggcgatggcctccgccacgctgctcgccagcctcgagcccgaacagctcgcgcccgccgatgccgagcgcttcgccgcggcgatggaccgcatctccgagaccgcgttccgcacctatcgcgggctggtctacgagacgccgggcttcaccaccttcttccgccagatgacgccgatcgccgagatcgccggcctcaagatcggctcgcgcccggccagccgcaagaagagcgacgcgatcgaggatctgcgcgcgatcccctgggtgttcagctgggcgcaggcccgcgtgatgctgccgggctggtacggcgtcggcgcggcactggaggcattcgaggacaaggggctgctccgcgagatggcgagcgcctggccgctgttccgcgcgacgctcgacaatatggagcaggtgctcgccaagtccgacatgggcatcgccagccattatgcggcgctggtcgaggacggtgagctgcgcgacggcatcttcgggcgcatccaggccggctggcagcagacgcatgacgcgctgctccaggtgacccgccagacgcggctgctggaaaagcacccgctgcttgacacctcgatccggctgcgcctgccctatatcgagccgctgaacctgctccagatcgagctgatgaagcggcaccgtgccggcgaggacgatccccggatcggcgagggaatcctgctgtcgatcaacgccatcgcgaccgcgctgcgcaacagcgga

SEQ ID NO: 41520 - DNA, 819 bp, SPHINGOMONAS
atgcgcatccaattcctcaagtgccacggctcgggcaacgacttcccgctgatcgacgctcgtgcgctgaccctgaccgagcccgaatgggccatcctcgcccgtctgctcgccgaccgcggcgggccggtgggcggtgacggcctgctcgcgctggtgccgggcgacgacgcccacgccttcggcatgcggatgtggaactcggacggatcggaggcggagacctgcctcaacggcctgcgctgcaccgcgcggctgggcttcgacgtgctggggctggacgcggcgcaggtgaagctgaagaccagctccgccagcgttgcccgcgaccccgaaatcgcccccggcgtcgtgacgatccgcaccctggtgggccccaattcgacccgcgccgccgatgtcgggctggtcggcgcgccggaagcggtgatcgacgcgcgcatcgagggcctgcccaacccgcgccgtttcaccgcggtggcgatgcccaacccccatctcgtcaccttcgtcgatgcggtcgacgaggacgagctggtcgcgctggggacctggtgcgagggccgcccggcgctgctgccggcgcgcggcaacgtatcgttcgtcgagcagcgcggcccccaaagcctgttcgtccgcaccttcgagcgcggcgtgggcctgaccgacagctgcggcagcgcgatggccggatcggtgctcagcgcggcgctgaccggccgcgtgccgttcggcaccccgatcgaggtgttcaaccgcggcggcatggtccgtggccaggccgaggcggaccggcgggtgatgctgagcgggaatgcg

SEQ ID NO: 41521 - DNA, 1338 bp, SPHINGOMONAS
gacgtcctgatcatcggttccggccccggcggctatgtcgcggcgatccgcgcggcgcagctgggtctcaaggccgtctgcgtcgaagcccgtgagacgctgggcggcacctgcctgaacgtcggctgcatcccctccaaggcgctgctgaacgcctccgagctgttctacgaagccgcctcgggcgcgctggccaagcacggcgtcaagctgggcaatgtcgagctcgacctgccggcaatgatggccgacaaggacaaggccgtgaagggcctgaccggcggcatcgagttcctgttcaagaagaacaaggtcgaatgggtgaagggcctcggcaccttcatcgacgcgcacaccgtgcaggtgggcgagcgcaccgtcaccgccaagaacatcgtgatcgccaccggctcgtcggtcaccccgctgccgggtgttgcgatcgaccagaaggtcgtcgtcgactccaccggcgcgatcgcgctggagaaggtgccggccaacatggtcgtgatcggcggcggcgtgatcgggctcgagctcggctcggtctggcagcgcctcggcgccaaggtgaccgtggtcgagtatctcgaccagctgctccccggcatggacggtgaagtccgcaaggaagccgccaagatcttcaagaagcagggcatggagatcaagctctccaccaaggtgaccggcgttgccgtcaatggcgacaaggcgaccgtcaccgtcgagcccgccgccggtggtgctgcggaaacgctggaagccgatgtcgtgctcgtcgcgatcggccgtcgtccgaacaccgacggcctcggcctcgacaagatcggcctcgccaccaaccagcgcggccagatcgagaccgatcacagcttccgcaccgccgtcgacggcgtgtgggcgatcggcgacgtgatcccgggcccgatgctcgcgcacaaggccgaggacgaaggcatcgcggtcgccgagaacatcgccggcctgaccggcattgtgaatcacgcggtgatcccgagcgtcgtctacacccatcccgaaatcgccggcgtcggcctcaccgaagagcaggcgcgcgaaaagggcgaggtgaaggtcggcaagttcccgatggcgggcaacagccgcgccaaggcgatcgacgacaccaccggctgggtgaaggtgatcgcccacgccaagaccagccgcgtgctcggcgcctggatcatcaccgcgccggccggcacgatgatcgcccaggtcgcgcaggcgatgcaattcggcgcgacgtccgaagacattgcctaaaaaagccatgcccaaccggcgcattccgaggcgatccaggaa

SEQ ID NO: 41522 - DNA, 1206 bp, SPHINGOMONAS
accgaagtcaaagtccctgtactgggcgaatcgatcaccgaagccactgtcggtgaatggctgaagaatccgggcgatcccgtccgcgtcgacgagccgatcgccagcctcgagaccgacaaggtctcggtcgaagtcccgtcgccggtcgccggcgtgatgggcgagcagatcgtcaaggtcggcgataccgtcgaagtgggtgcggtgatcgcgatcatcgcgggtgaaggtgccgcggccgctccggctgctgccgctccggctgcaacgcccgccccggcgccggccgctgccccggcgcccgccgccgatgcggctgcgctgtcgccgtcggtgcgccgtgcggtgctcgagacgggtgtcgatccctcgaccgtgcagggcaccggcaaggacggccgcctgaccaaggacgacgtgatcgccgccgccagcagcaagcctgctgcggctccggccccggctgccgctccggtgcctgccgctgccccggcttcgaccggcggtcgcaaggaagagcgcgtgcggatgacccgcctgcgccagaccgtcgccaagcgcctcaaggaagcgcagaacaccgccgccatgctcaccacgttcaacgacgtggacatgaccgcggtgatcgaggcgcgcgccaagtacaaggacctgttcgagaagaagcacggcgttcgcctgggcttcatgggcttcttcgtgaaggccgcgtgcatggcgctgaaggacatccccggcgtcaacggctcgatcgagggcgacgagatcgtctatcacgattattgcgacatctcggtcgcggtctcggccccgcagggcctggtcgtgccggtgatccgcgacgcgcaggacctgtcggtcgccggcatcgagaagacgatcggcgatttcggcaagcgcgccaaggacggctctctcaagatggacgagatgaagggcggtaccttcaccatctcgaacggcggcgtgttcggctcgctgatgtcgaccccgatcatcaacccgccgcagtcggccgtgctcggcctgcaccgcatcgaggagcgtcccgtggtgcgtaacggccaggtcgtcgtccgcccgatgatgtatctcgcgctcagctacgatcaccgtctgatcgacggccgcgaggcggtgaccttcctcgtcgcgatcaagaacgcgatcgaggatccgacccgcctgctgatcgacctc

SEQ ID NO: 41523 - DNA, 2849 bp, SPHINGOMONAS
ggcgtgagccccggcttactcgagaccctgtaccggcgctacaagagcgacccggcatccgtcgaaccgagctggcgtgcctggctcgagggtctcgaatccacggcctctggccccagctggcagcgtgccaactggccgctgaccgaaaccgacgcgctgacggccgggctcgaccccacccagatggagcccgcgcccaagcccgccaagggcggcgcgccggccaagccggccgcccccgccgcatcgacggcggacgtgaccaaggccgcggaagattcgatccgcgcgatgatgctgatccgcacctaccgggtgcgcggccatctcgccgccaatctcgatccgctgggcctcgcccgccagaacctgcccgccgatctgacgccggaatatcacggcttctcgggcgcagacctcgatcgcccgatctatctgggcggcgcgctcggcctgcagcacggcacggtgcgcgagatcgttgtgatcctccaggccaattactgcggcaatgtaggcctcgaatatatgcacatcgcggacgtggaggaacgccgcttctacaggaccggatggaaggcaaggacaaggcgatcaccttcacgccggacggcaagaaggcgatcctgtccaaggtcatcgaagccgagcagtgggaaaaattcctcggcaagaaatatgtcggcaccaagcggttcggcctcgacggcggcgaatcgatgatcccggctatggaagcgatcatcaagtacggcggccagcagggcgtccgcgagatcgtgtacggcatggcccatcgcggccgcctgaacatgctcgccaacgtcatggagaagccgttccgggtgatcttccacgagttcggcggcggttcggccaacccggacgacgtcgccggctcgggtgacgtgaagtatcacctcggcacctccaccgatcgccagttcgacggcatcagcgttcacatgtcgctggtcgccaacccgtcgcacctcgaggcggccgatccggtcgtgctcggcaaggcgcgcgcgctgcagaccatccgcggtgatctggaaaagcatgaccaggtcctgccggtgctgatccatggtgacgcggccttcgccggccagggcatcgtgtgggagacgctcggcttctccggcatccgcggctacaataccggcggctgcatccacttcgtcatcaacaaccaggtcggcttcacgacgagcccgcagttcgcgcgctcctcgccctatccgtcggacgtcgccaagggcgtccaggcgccgatcctgcacgtcaacggcgacgaccccgaagccgttaccttcgcctgcaaggtggcgatcgagttccgtcaggccttccaccgcgacatcgtgatcgacatgtggtgctatcgccgcttcggccacaatgaaggcgacgagcccgggttcacccagccgctaatgtaccagaagatccgccagcaccccggtgtgagcagcatctatggccagaagctgatcgccgagggcgtggtcgaccagggcttcatcgacgagaagaccacccagttcaacacgctgctcgaaggcgaattcgaggcgggcaagacctatctgccgaacaaggcggactggttcgccggccgctggtcgggcctgggcgcgccgtcggacggcgaaggctcgcggcgcaacgtcgagaccggcatcgaaaagaagctgttcgacagcatcggccgcacgctgaccacggttccgcaagatctcgagatccacaagaccctgggtcgtgtgctcgatgccaagcgcgagatgttcaagtcgggtgcgaacttcgactgggcgaccggcgaggcactggccttcggctcgctgctgtcggaaggctataccgtccgcctgtccggccaggattcgggtcgcggcaccttctcgcagcgccacgccgtctgggtcgaccagaagaccgaggcgaaatatgtgccgctgaccacggtgccgcatggccggttcgaggtgctggactcgccgctcagcgaatatggcgtgctcggcttcgagtatggctatgcgctggccgatccgaaggcgctggtgctgtgggaagcgcagttcggcgacttcgtgaacggcgcgcagatcatgatcgaccagttcatcgcgtcgggcgagtccaagtggctccgcgccaacggcctggtgatgctgctgccgcacggctatgaaggccagggccccgagcacagctcggcgcgtccggagcgcttcctccagctctgcgcgcaggacaacatgcaggtggtgaacatcaccacgccggccaactatttccacctgctgcgccggcagatgcaccgcaacttccgcaagccgctcattcagatgacgccgaagtcgctgctccgccacaagctggcggtctccagcgccgaggagttcctgggcgacagccacttcaagcggatcctgtcggacccgagcgctccggcggatgcgcaagtgaagcgcctcgtgctctgcaccggcaaggtcgcctacgacctgatcgaagcgcgcgacgcggcgggcgacaagaacaccgcgatcgtccggatcgagcagctctacccgttcccgggcgagccgctgaccgaacggctgaagcgcatgaccaacctcgaagaggtagtgtgggcgcaggaagagccgaagaacaacggctactggttctttgtcgagccgctgatcgagcagtgcctgatcgacgccggcatcaaggtacagcgtccgcgctatgccggtcgcgccgcggcggcctcgcccgccaccggcctgatgaagcgccacaccgcagagcagggcgcgctcgttgccgacgcgctcggc

SEQ ID NO: 41524 - DNA, 876 bp, SPHINGOMONAS
atgagcatcctcgtcgacaagaacaccaaggtcatcgtccaggggatgaccggtgctaccggcacgttccacaccgagcaggcgcttgcctatggcacgcagatggtcggcggcgtcacccccggcaagggcggtagcacgcatatcggcctgcccgttttcaacacggttgccgaagccaagtcgaagaccggcgccgacgccagcgtgatctacgtgccgccccccttcgcggccgattcgatcctcgaggcgatcgacgccgagatcccgctgatcgtcgcgatcaccgagggcattccggtgctggacatggtgaaggtgaagcgtgcgctttccggctccaagtcgcgcctgatcggcccgaactgcccgggcgtgctgacgccgggcgaatgcaagatcggcatcatgccgggctcgatcttctcgaagggctcggtgggcgtcgtgtcgcgctcgggcaccctcacctacgaggcggtgttccagaccaccaatgcgggcctgggccagaccacggccgtcggcatcggcggtgacccggtcaacggcaccaacttcatcgacgtgctcgagatgttcctcgcggacgaagccaccaagtcgatcatcatgatcggcgagatcggtggttcggccgaggaagaggccgcgcagttcctgatcgacgaggccaagcgtggccggaagaagccgatggccggcttcatcgcgggccggaccgcgcctccgggccggcgcatgggccatgccggcgcgatcgtctcgggcggccagggcggcgccgaagacaagatcgcggcgatggaagccgccggcatccgcgtttcccccagcccctcgctgctcggcgagacgctgatggaagtgctc

SEQ ID NO: 41525 - DNA, 960 bp, SPHINGOMONAS
atggctcgcaagaagatcgcgctgatcggctccggcatgatcggtggcaccctcgcgcacctcgctgcaatcaaggaactgggcgatatcgtcctgttcgacattgccgagggcacgccgcagggcaaggcgctcgacatcgcacagtccggaccggtcgaaggcttcgatgccaacctcaagggcgcgaacagctacgaggacattgcgggcgccgacgtctgcatcgtcaccgccggtatcccgcgcaagccgggcatgagccgcgacgatcttctcaagaccaacctgggcgtgatgaaggccgtgggcgagggcatcgccgcgcacgcgcccgacgcgttcgtgatctgcatcaccaacccgctcgacgcgatggtgtgggcgctgcgcgagttctcgggcctgccgcaccagaaggtcgtcggcatggccggcgtgctcgactcggcgcgcttccgccacttcctcgccgaggaattcaacgtctcggtcgaggacgtcaccgccttcgtgctgggcggacacggcgacaccatggtcccggtgatcgagtattcgaccgtcgccggcatcccggtgcccgacctgatcaagatgggctggtccacccaggagcgcatcgacgccatcgtcgcgcgcacccgctcgggcggcggcgagatcgtcgcgctgctcaagaccggctcggcctattatgcgccggccaccagcgcgatcgcgatggccgagagctatctgaaggacaagaagcgcctgcttccctgtgccgcgcacctcaccggccagtacggcgtcgacgatctgtacgtcggcgtgccgatcgtcatcggcaaggacggcgtcgagcgcatcgtcgagatcgagctgaacgccacggcgaagcagaatttcgacgtctcggtcgatgcggtcaaggaactggtcgcagcatgcaagtcgatcgacgcctcgctcgcc

SEQ ID NO: 41526 - DNA, 1563 bp, SPHINGOMONAS
ttcgaatatgacatgcagcagtcgccggtagccagcctgccgggatcgtggatcggccattcgcccgagatgcggctgtaccaggggctggtctggtaccagcgcgacttcaccgcggcggcacccaagcccggtaaccgcgtgttcctgcgcatcggcgcggccgaatatcgctcctatgtgtatctcaacggcaagccgctgggcgagcatcgcggcggctacacgccgttcgccttcgaggtcaccaagctgctgcgcccgggtcgcaaccaggtgacgatcggcgtcgattcggtgcgcaccgccaacgacgtgccgccaccggtgaccgattgggagacctatggcggcatcacccgcagcgtcacgcttgtcaccgtgcccgatacctatgtcgacgacgccttcgtccgcctgacgccggacggcacccgcatcgcggtatcggtgaagctcgaagggccggcggccgcgggaacggcggtcaggttccgcattccgggcctcggcgccgtgctcgacggcaagaccgatggcgagggcaaatgggacgcgacgctgccggtgccgcgtgcgctggtccgctggtcgccggagaacccgaagctctacgacatcgccatcgacgccggcgccgatcatttcgccgatcgcatgggcttccgcaccatcgcggtgaagggcgccgacatcctgctcaacggcaagccgatcttcctgcgcggcatctcgatgcacgaggaagaactgggcgccgatccggttcgcgcgatgacgccggcagccgcccgcgccctgctgggcgagatcaaatatggcctgcacggcaatttcgtgcggctggcgcactatccgcacagcgagtcgaccacccgcatggcggacgagatgggcctgctggtgtggagcgaggtgcccctctactggctggtcaactggaacaacccggacacgctggccgacgcccgtcgcatccaggccgagaacatccgccgcgaccgcaaccgtgcctcggtcgtgctgtggagcgtcgccaacgagacgccgaccaacgatgcgcgcaacgccttcctgcgcacgatgatcgccgatgtccgcgcgctcgactccagccgtctcgtcaccgccgcgctgctcagcggtcgcgagggcaagagcatcatgaagatcgacgatccgctggccaacgacctcgatgtcatggcgatcaacacctataatggttggtactccgacgacgcgctggaggatctggccagccaggaatggcgcggaccggcgaacaagccgctgatcttctccgaattcggcgccgacgcccgcgccggctatcacgacccggtggcgagcccgcacaagttcagcgaggagtatcaggccgactattaccgcgcgacactggcgatggccgccaaggtgccgttcctgcgcggcatgagcccctggatcctcaaggacttccgctcgccgcggcgccagcacccgatctatcagcagggctggaaccgcaagggcctgatctccgagacaggccagcacaagctggcgttcgatgtgctc

SEQ ID NO: 41527 - DNA, 711 bp, SPHINGOMONAS
gcaagccccgaggccacgcgggtcaagaagttcgagatctaccgctacgatccggattcgggcgagaaccctcgctacgacacgttcgaggtcgatctcgacgattgcggcccgatggttctcgacgcgctgatcaagatcaagggcgagcaggattcgtcgctgacgttccgccgctcatgccgcgagggcatctgcggttcctgctcgatgaacatcggcggcaagaacggactcgcctgcaccaccgcgatcgaggacatcaagggcgaggtgcagatcaccccgctgccgcatatggacgtgatcaaggacctggtccccgatttcacgcacttctatgcgcaatatgcctcgatcaagccgtggctgcagaccgtgaccaccacgccgtcgggcaaggagcggctccagagcccgcaggaccgcgagaagctggacggcctctacgagtgcatcctgtgcgcctgctgctcgacctcgtgcccgagctactggtggaacagcgacaagttcctcggtccggcgatcctgctccaggcctatcgctggctggccgactcgcgtgacgagatgaccggcgagcgtctcgatcagctcgaggatccgttccgcctgtatcgctgccacaccatcatgaactgcgcgaacgcctgcccgaagggcctgagccccgccaaggcgatcgccgaagtgaagaagctggccgcc

SEQ ID NO: 41528 - DNA, 1764 bp, SPHINGOMONAS
aatctggtggcgatgttcttcacgcgcgccgcggagaagggcgaggcgccgttcctttggcacaaggcgggcgggaaatggcacccgaccagctgggccgaagcggccgcccaggttgccagcctcgccaccgcgctcaaggcgctcgggctgaagcccggcgaccgggtcatgctggtcagcgagaatcgccccgaattctgcatcagcgacctcgccatcatggccgcgggctgcgttaccgtccccacctacaccaccaacaccgagcgcgatcaccagcacatcctagagaattcgggcgcctgcgcggtgatcgtgtcgaacaccaagctggccaagacgctgctgccggcgatgctgcgttcctcggccggccgcatcgtcatcggcatcgacgatgtccgcctcgcccagcacggcacgctggaggtccacgacttccgcgaactgatcgccgcccatcccaccgatgccgccagcgccgccgccgaggcgaccttccgccgcgaggaccttgcctgcatcatctacaccagcggcaccggcggatcgccccgcggggtgatgcagcatcacggcgccatcctgcacaattgccagggctgcgtgaccgtgatctcggaggatttcggctgggaggacgaggtattcctctccttcctccccctctcccacgcctatgaacataccggcgggcagttcttcccgatcgcgctgggcgggcagatctactattcggaaggcttggaaaagctcgcctcgaacatcgaagaggtgcgcccgaccatcatggtggtggtcccccgcctgttcgaggtgctgcgcacccgcatcaccaagcaggtggaaaagcagggcgccgtcgccagctacctgctcgaaaaggcggtggcgatcggcggccgcaaggcggcgggcaaatccggcctgcgcgacgcgccgatgaacctgctgctcggcgccacgctgcggccgaagctggccaagcgcttcggcgggcggatcaaggcgctggtctcgggcggcgcgccgctcaaccccgaggtcggcatcttcttcgaatcgctcggcctgaccttcctccagggctatggccagaccgaggcggcgccggtgatctcgtgcaaccggcctgccgccggcctgaagatggacacggtgggcccgccgctcgagggcgtggaagtgaagatcgccgaggatggcgagattctggtgcgcggcgagctggtgatgcacggctattggcgcaacgaagccgagaccgagcgggtgctgaagaacggctggctccacaccggcgacatcggggagatcgatgcgaaaggccgcatcaagatcaccgatcgcaagaaggacatcatcgtcaacgacaagggcgacaatgtctcgccccagaagatcgagggcatgctgacgctgcagcccgagatcctgcaggcgatgatttatggcgacaagcggccctacatgaccgcggtgatcgtgcccgatcccgaatgggtgcaggaattctgcgcgaagaccgcgacgccctgcaagttccgcaacctctcccgtgacgccgacttcaaggcgacgatcggcgcggcggtggagcgggtgaaccgcgatctctcggtgatcgagcgggtgcgcaagttcatcctcgccgacgaggcgttcaccatcgagaacgaacagctgacgccgagcatgaagatccgccggcacgtgctgaaggcggtctatgcggagcggctggacacgctgtactgaaaa

SEQ ID NO: 41529 - DNA, 543 bp, SPHINGOMONAS
ttgatggacctccaccagaacgaagacattcgcagtcgcattcgcacgatccccgactttccgaagccggggatcctttttcgcgacatcaccacgctgctgctcgatgccgaggggctgcggctcaccatcgaccggatggccgcgcaggtggaaggcccgatcgatctggtcgccggcgtcgaggcgcgcggcttcctgttcggcgcggcgctggcgatgcagctcggcaccggcgtgctgctgatccgcaaggacggcaagctgccgggtgcgacgatcgccgaggactacgccctcgaatatggcacggaccgcatcgccatccatgccgatgcgctggtgccgggcgcccgggtgctgctggtcgacgacctgatcgccactggcggtaccgcccgcgccgcggtccggctgctccgcaaggcaggggcggaggtggtgcaggcctccttcgtcgtcgatctgcccgatctgggcggggccgacgcgctgcgcggcgacgggctcaaggtctcggcgctggtcgccttcgaaggccac

SEQ ID NO: 41530 - DNA, 825 bp, SPHINGOMONAS
gaacaacagcagcgcgcgcgcacctggttcgaatccctgcgcgattcgatctgcgccgagttcgaggcgatcgagcgcgaggcggattccgacgctgcgttcacctacctcccctgggaccggaccgatacgagcggcgcgcctggcggcggcggcgtgcgcggggtgatgaagggtcgggtgttcgagaaggtgggcgtcaacgtctccaccgtcggcggcgccctcgagggggacttcgccaagaccatccacggcgcgggcgaggaccccagcttcttcgccaccggcatcagcctggtcgcgcacatggccaacccgcatgtgccggcggtgcacatgaacacgcgcttcctcacgacgaccaagcgctggttcggcggcggcgccgacctcaacccgccgctgccctacgaggaagacaccgccgatttccacgcccggctgcaggccgcgtgcgacgcgcacgacgcgggccattatccgcgcttcaagaaatgggcggacgactatttctacattccgcaccgccaggtgcatcgcggcgtcggcggcatcttctacgatcatctggaaggcgactgggaggcggatttcgccttcacccaggatgtcggccgcgcgtttctcgacgtgtaccccaggctggtccgccggcggatgcatcagcccttcgacgatgccgatcgccagcgccagctcgaatggcgcggccgctatgccgagttcaacctcatctacgatcgcggcaccctgttcggcctgaagaccggcggcaatgtcgatgcgatcctgatgagcctgccgcccatggccgcgtggagc

SEQ ID NO: 41531 - DNA, 2553 bp, SPHINGOMONAS
ccccaggccattcgccgcgaggactatcgtcaacccgactggctggtgccggacatcgcgctggacttcgatctcgatcccgccgccacccgcgtgcgggccgcgctccacgtcacccgcaacgggtcgcatgatcgcccgttggtgctgaacggcgacgggctcgaggccgtcgccgtgaaggtggacggcgtcgcctccaccgactggcgcatggacgggcaggatctggtgatcccgcttggcggcgacgcccacacgatcgagaccgaagtggtgatcgcgcccgagcgcaacacccagctgcagggtctctacgcctcgtccggcatgctctgcacccagtgcgaggccgagggcttccgccgcatcaccttcttccccgaccggccggacgtgctcagcaagtacaaggtgcggatggaaggcgacaaggcgcgcttccccgtgctgctgtccaacggcgatccgatcgcacatggggatgcggaaagcggccgccactgggccgaatggcacgaccccttccccaagccgagctacctcttcgcgctggtcgcaggcgatctcgtcgccaacaccggcagcttcaccaccatgtcgggccgcgaggtgcagctgggcatctatgtccgcgcgcccgacctgcccaagaccgaccacgccctccacgccctcaagctcagcatgaagtgggacgaggaggtctatggccgcgaatacgacctcgacgtgttcaacatcgtcgcggtggacgacttcaacttcggcgcgatggagaataaggggctgaacgtcttcaacagccgctacatcctcgccgaccccgacaccgccaccgactgggactatgacgcgatcgccgccgtggtcgcgcacgaatatttccacaactggtcgggcaaccgcgtcacctgccgcgactggttccagctgagcctgaaggaaggcttcaccgtcttccgcgaccagagcttctcggccgaccagggctcggccgcggtcaagcggatcgaggacgtgcgctcgcttcgcgccagccagttccccgaggatgccggcccgctcgcccacccggtgcgcccggacgaatatatcgagatctcgaacttctacacggcgaccatctacaacaagggcgccgagctgatccggatgatggcgaccatcctcggcccgcagaaattccgcgccgccaccgacctctatttcgatcgcttcgacggcacggcggcgacctgcgaggatttcgtggcgagcatggaggaggccggcggcgtcgatctcggccagttccgccgctggtacagccaggcgggcaccccgcgcgtctccgccaacctcgtccaggacggcgcgaccacccggctcgcgcttgcccagaccgtaccgccgacgccgggccagccggtcaaggagccgatggtcctgccgctcaagatccgcctgttcggcgagacgagcggcgcgccgctgatcgacgagcagctggtgctgttcgacaagcccgagcaggaactgcgcttcgagaacctgtccgaacgcgcggtgctctcgatcaaccgcggcttctccgccccggtgatcgtcgacgccaatcgcagcgcggcggacctcgctttcctatcggcgcatgacgacgatccgttcgcgcgctacgaggcgatgcagcagctgatgctcgacacgctggtcgcggcggtgaccaccggcaagggcgagcacgccgcactgatcgacgccgttcggggcacgctgaccgattcctcgctcgaccgcgcgttcatcgccgaagcggtgctgctgccgtcggacagcttcatcggcgaccagatggcgatcgtcgatccggaggcgatcttccacgcccgcgaggcgctgcgtgccgatctcggcaaggcgctcgaagccgaatggcgcgcggcctatgagggtgcccgcgccaaccgcttcgaatattcgccggccgccaagggcgcgcgccgcctgaagaacgtggcgctcggctatatcgcggcgagcggcgcgagcgacgcggcggaactcgccttcgcccagttcgacgcggccgacaacatgaccgatcgccagggcggcctcgccaccctggtcaacggcagttcggccctgcgcgaacaggcgctggaggcgttctaccagcgctatgccggcaacgcgctggtgctggacaagtggttccagacccaggcgctttcctcgcgcgacgatacgctggcggcggtcgagaagctggccaggcatcccgacttcacgctggccaatcccaaccgcgcacgggcgctggtcggcgcgttcagcatcaaccagcgggcgttccacgatccctcgggccgcggctatcgcttcgtggcggaccagctgatcgcgctcgacaagctcaacccgcagaccgcggccaagctggtgccgccgctcggccggtggaagcgcttcgatcccgcccgcgccgcgctgatgcggggcgagctggagcggatcgtcgccagccccggcctcagcaaggacatgttcgagcaggcgaccaagtcgctc

SEQ ID NO: 41532 - DNA, 363 bp, SPHINGOMONAS
cgttattttaccgaagaccatgagtggatcgaagtcgacggcgacgtcgcgacggtcggcatcaccgaatatgcccagagccagctcggcgacatcgtgttcgtcgaagtgcccgacgagggcaaggaactggccaagggcgacgatgccgccgttgtcgagagcgtgaaggcggcttcggacgtgtatgcgccggtgtcgggcaccgtcgtcgagggcaatgaagacctcaccgagaaccccgcgctggtgaacgaggatccggaaggcgaaggctggttcttcaagatgacgctgagcgacgagagcgagctggaaggcctgatgaacgaggccaagtaccaggcattcgtcgagaagcag

SEQ ID NO: 41533 - DNA, 1600 bp, SPHINGOMONAS
accgggggccggatcctcgtcgacaatctggtggcgcagggctgcgaccggatcttccatgtaccgggcgagagcttcctcgccgtgctcgacgcgctgcacgacgaacccagcatcgatctcgtcacctgccgccaggagggcggtgcggcgttcatggcctgtgccgacggcgcgatgaccgggcggccgggcgtgtgcttcgtgacgcgcgggccgggcgcgaccaacgccagcatcggcgtgcatgtcgcgatgcaggattcgcagccgatgctgctgttcatcggcgatgtcgaccgcggcatgcgcgaccgcgagggctttcaggaagtcgatctgccggcgatgttcgcgccgctcgccaaatgggcgacgcggatcgaggatgcgcggcgcatcccagaatatatcgcccgcgcctggaatgtcgccacctcaggccggccgggcccggtggtgatcgcgctgcccgaagacatgctgctggacgtggtggaggcggtggaccgccccgccattaccgagccgatccaggcggccgacgccttcgatctcgaccagctgtacgacctgctgcgcggtgccgaacggcccatcgcgatcgtgggcggcggcggctgggattcggatacggcggaggacttcgcccgcttcgccgaattgatcgagctgccggtcgcctgcgccttccggcgccaggacgcgatcgacaacgcctcaacggtctgggcgggcaatctcggctatggccccaatcccaagctggtccagcggatcaagacggcggacctgctgctggtagtcggcgcccggctcggcgaggcgacgaccgacggctacagcctgatcacgcccgagcatcccgggcagacgctggtgcatgtccacccggaccccggcgaattccaccgcgtgtaccgcgtcgacctgccgatctgcgcgcgggccgttcgagttcgccgtcgccgcagccgccacggtggaagcggcaggcctttcccgctttgacgccggtgccgcccatgccgaattgctggactggtcgaccccgaagccgcgcgagggcgtagccctcgatctcggcccctgcgtcgcggcgatgcgggaagcgctgccggcggacaccattatctgcaacggcgcgggcaatttctccggctggtggcaccgctactggcactatgccgtgcagccgagccagctcgcccccaccgccggcgcgatgggctatggcgtgccggcggcggtcgccgcggcactccgctttcccgaacgcaaggtggtggcggtcgccggcgacggcgacttcctgatgaacgggcaggagctcgccaccgccgtccagcacggtgcggacatgctggtgatcctggtcgacaacggcgcctatggcacgatccgcatgcaccaggagcgcgagttccccgagcggctttccggcacgacgctccgcaaccccgatttcgcggcgctggcccgtgcgttcggcggctgggcgaccacggtggagacgaccgaggcgtttgcccccgcgctcgcgctggccttggcacaaccgggcctcaagctcttgcattgcaagacggatatcgaagtg

SEQ ID NO: 41534 - DNA, 444 bp, SPHINGOMONAS
cctgcattggccgatacgatcttcgtcttgaatggtcccaacctcaacctgctggggctccgcgagccggaaatctatgggtcggacacgctggacgacattgccggcatgctggaagatcgcgcccgcgatctgggcctggaagtcgaggtgcgccagtcgaaccacgaggggcacctgatcgactggctgcacgaggcgcaggccgatggcgcgcgcgccgtgctcctcaatccgggtggctacacccacacttcggtggcgctccacgatgcgatcaagagcatctccacgccggtgatcgaggtacatctctcgaacccgcacgcccgcgaatccttccgccacaccagcttcgtaggccgggcggcgaagggtacagtggccgggttcgggtcgctttcctacattctcgcgcttgaagccgccgcgcgtctctgacag

SEQ ID NO: 41535 - DNA, 1326 bp, SPHINGOMONAS
atcaagaagctgctgatcgccaatcgcggcgagatcgcgctgcgcatccaccgcgcctgccacgaaatgggcatcaagacggtggcggtgcactccaccgccgatgccgatgcgatgcacgtgcgcctggcggacgaggcgatctgcatcggcccgccggccgcatcggaaagctatctcaacatcccgaacatcatctcggcggccgagatttcgggcgcggacgcgatccatccgggctatggcttcctgtcggagaacgcccagttcgccgagatcgtcgaggcgcacgggctgatcttcgtcgggcccaagcccgagcatatccgcacgatgggcgacaagatcgaggcgaagcgcaccgccggtgcgctcggcctgccgctggtgccgggctcggacggcccgatcagcgacctggaagaagccaaggcgatcgcggccaaggccggctatccggtgatcatcaaggccgcctcgggcggcggtggtcgcggtatgaaggtgtgcaccagcgaggaccagctcgagacgctgatgcagcaggcgggctcggaagcgaaggccgcgttcggcgacgccaccgtctatctcgaaaagtatctcggcaatccgcgccacatcgagttccaggtgttcggcgacggcaacggcaacgcgatccacctgggcgagcgcgactgctcgctccagcgccgccaccagaaggtgctcgaagaggcgctgtcgccggtgatcacgcccgaagagcgtgcgcgcatgggcgcgatcgtcgccaaggcgatgtccgacatgggctatcgcggcgccggcacgatcgagttcctgtgggaaaatggcgcgttctacttcatcgagatgaacacccgcctccaggtcgagcatccggtgaccgagatgatcaccggcatggacctggtccgcgagcagatccgcgtcgccgaagggcatggcctgtcggtgcgccaggaggatctggagttccgcggacacgcgatcgaatgccgcatcaacgccgaggatccgcggaccttcgcgccctcgccgggcacgatcacccacttccacgcgccgggcggcatgcacgtccgcgtcgatagcggcatctattcgggctaccggatcccgccctattacgactcgatgatcgccaagctgatcgtctatggccgcacccgcgagggctgcatcctgcggctgaagcgcgcgctcgaggagttcgtggtcgacggcatcaagacgacgatcccgctccaccaggcgctgctcgacgatcccgaattcctgaagggcgactatacgatcaagtggctcgaagagtggctc

SEQ ID NO: 41536 - DNA, 1693 bp, SPHINGOMONAS
  unsure (1)..(1693): unsure at all n locations
ctagggcgctttgccatgagcgagaccaaggcgggccatggcccttatacctatgcccaggcgggcgtttctattgcggcgggcaacgcgctggtgcgcgcgatcggcccgcttgcccgttccacccggcgcgcgggcgcggacgccgatctgggcggcttcggcggcatcttcgacctgaaggcggcgggcttcaccgatccgctgctggtcgccgcgaacgacggcgtcggcaccaagctgaagctggcgatcgagcacaaccatcatgacggcgtcggcatcgacctcgtcgcgatgtgcgccaacgatctgatcgtgcagggcgccgagccgctgtttttcctcgattattatgcgagcggcaagctcgacaacgcggtcgccgagcgggtgattgcgtccatcgccgagggctgccgccaggcgggctgcgcgctgatcggcggcgaaaccgccgagatgccgggcatgtatgccgacggcgattacgaccttgccggcttctgcgtcggcgcggtcgagcgcgaccggctgctcgacggcaagaagatcgcccccggcgacgtgctgctcggcctcgcctctacgggcgtgcactcgaacggcttctcgctggtgcggcgactcgcggcggacaagggctggaagctcgatcgtccggcactgttcgaccaggagcggctgctgatcgacacgctgatggcgccgacgcggatctatgtcgccagcctgctgcccgaactccgcaagggcacgatccacggcctcgcccacatcaccggcggcggcctgctggagaatgtacctcgcgtgctgccggaagggacccatgcccggatcgacgccgaggcctggccgttgccgcgattgatggcgttcctgcaggcgcaggggaatatcgagccggaggaaatggcgcgcaccttcaactgcggcatcggcatggtcgcggtcgtcgccgccgatcaggccgaggcggtgacggcagcgctgaccgcggcgggcgaaacggtgttcaccatcggcacgatcgaagcgggcgagcgcggttgtaccgtagtcggcggcgacgagacctggagcgcccgcgcgccgtggagcgccacccaccatgggtgagacgtctgccggcgtctccagccctcggaagaagatcggcatcctgatttctggtcgcggctccaacatggcctcgctggttgaagccgctgccgcgccggactgcccctatacggtggccctcgtcgccagcgacaagccggaagcgcccgggctagcctgggcagccgaacgcggcgtgccgaccttcgcgcagagccccaagggcatgccaaaggccgagtatgaggcgaagatcgacgcggcgctgcgcgatgccggcgtcgaggcgatcgcgcttgccgggtacatgcggctgctgtcggacgatttcgttgcgcgatggcgcgggcggatcgtgaacatccacccctcgctactccccaagtacaaggggctggatacgcacgcccgtgccatcgcggccggcgataccnaggccggcgcgtcggtccatatcgtcaccgaggagctggacggcggcgacgttctgggtcaggcgcgcgtgccgatcctgtcgggcgacacggctgacacgctagcagcccgcgtgctcgccgaggaacacgagctctacgccagaacgctgccc

SEQ ID NO: 41537 - DNA, 1497 bp, SPHINGOMONAS
acccgcgccgccttcggtgcctggttcgacacgccgggctcgaccgtgcagggctgggagacggacggcaaacgcgccaataccaaggtgatgaaccagattgcggcgatgggaatcgccgagcatgcggactggcacgtcgccgtccgcgacgtggagagtgcaatggcaagctggacccccgatagctggacgcaggcagaagcgcgccagatgccgcaatatccggacaagggggcgctcgacgccgccacccggcaactgagcagctatcccccgctggtctttgccggcgaggcgcgcgggctgacggccgagctggccaaggtgtcgcgcggcgaggccttcctgctgcagggcggcgactgcgccgaaagcttcgccgagttccacccgaacaacatccgcgacaccttccgcgtgatcctgcagatggcggtcgtcctcaccttcgcctccaagctgccgacggtgaagctcggccgcatggccggccagttcgccaagccgcgctcggccgataccgaggtgatcgacggcgtcgagctgcccagctaccgcggcgacaatgttaacgacatcgccttcacgcccgaagcgcggatccccgatccgcagcggatggtgcagggctacagccagtcggcagcgacgctcaatctgctgcgcgcctttgcaaatggcggctatgcgaacctgcaccaggtccacaaatggacgctcgacttcatgggcaagagcccttggtcggccaagttcgccgatgtcgcggaccggatcggcgaggcgctcgacttcatggaggcgtgcgggatcaaccccgataccgtgccgcagctgaagggcaccgatttctacaccagccacgaagcgctgctgctcccctatgagcaggcgctgacccggcaggacagcctgaccggcgactggtacgatacctcggcccacttcctgtggatcggcgaccgcacccgcttcgagggctcggcgcatgtcgagttcctccgcggcatcggcaacccgatcgggatgaagtgcgggccgagcctggagcccgatgcgctgctgcggctgctcgacacgctcaatcccggccgggtgccggggcggatgacgctgattacccgctacgggcatgacaagatcgaggcgggcctgcccaagctggtccgcgcggtgaagcgcgagggccatccggtggtgtggagctgcgatccgatgcacggcaacgtcgtcaaggcggcgaacggctacaagacgcggccgttcgaccggatcctcgccgaggtgcgcggcttcttcgccgtccaccgcgccgagggtaccttcgccggcggcatccatgccgaaatgaccgggcagaacgtgaccgagtgcaccggcggcgcgatcgcgatcaccgaacagggcctggccgatcgctaccacacgcattgcgatccgcgcctcaacgcgggtcagagcctggagctggcgttcctgctcgccgaaatgctc

SEQ ID NO: 41538 - DNA, 1032 bp, SPHINGOMONAS
cggcgattgatcgggcgcgaaggcgccgatttcgcctcgaacgactatctcggcctcgccgactcgccggcgttgcgcgaggccgtggcggcggcgctggcgcggggcgtgccgatcggatcgggtggatcgcggctgctgcgcggcaaccagaccgagcacgaggcgctggaggccgacgccgccgcgttcttcggacgcgagtcggcgctctatttctccagcggctatgcagccaatgccgcgctgctcggtaccctgccgcagcgcggcgacctggtgctgttcgacgaactcgtccacgccagcgcccatgaggggatgcggcttggtcgggcggaaacgcggcagacggcgcataacgatgtcgccgccttcgccgcagcgatcgcggactggcgccgcgcgggcgggtcggggcgcgtgtggattacggtggagagcctctacagcatggacggcgatctcgcgccgctggccgagctgtcggcgctggccggtgcggaggacgcgattctgatcgtcgacgaggcccatgcgaccggcgtctacggcccgcagggacaggggctcgcctatggcctgccgcgggacaatctcatcacgctgcacacctgcggcaaggcgctgggctgcgagggtgcgctggtcgccgggcccaaggtcgtccgcgacttcctcgtcaatcgcggccgggcgttcatcttctcgaccgcgccgtcgccgctgatggcggcagccgtgcgcgccgcgctgcggatcgtgggagaaggcgatgcattgcgtacggccctgttcgatcgcgttcgcgcggcacgcgcggcgctggggccgttcggcgttcttgatggccccagccaggtgctaccgctgatcctgggcgacgacgtccgcaccatgaccgtggccggcctgctgcaggaaagcggcttcgacgtgcgcggcatccggccgccgacggtccctgcgggcacctcgcgcctgcgcatctcgatcaccaacaatgtcacgctggccgatatcgccgctctg

SEQ ID NO: 41539 - DNA, 1206 bp, SPHINGOMONAS
gtctggcatcccttcacccagcacgggctgggcgagccgatcccgatggtcagccatgccaaggacgctgtgatccacaccgccgacggccgcagcttcatcgatgcgatttcctcctggtgggtgacgacgcacggccattgcaacccgcgcatcatggcggcgatcgctgcccaggcggccaagctcgaccagatcatcttcgcgggctggacccacgaaccggccgagacgcttgctgccggattgcgcaccatgctgcccgacgcgcttgaacatgtcttcttcagcgacagcggctccaccgcggtggaagtcgcgctgaagatggcgctcggctactggcacaatcgtggggaggaggatcgcaaccgcatcctcgtcctggagcacagctatcacggcgacacgatcggcggcatgtcggtcggcgcgcgcggggtgttcaaccggccctatcagccgctgctgttcgacgtcggcaccattccatatcccgcgaccggtgccgagcaggcgacgctggatgcgctggaagccgagtgccgcgccggtgccgcggccttcatcgtcgagccgttggtgctgggggcggggggcatgctcttctacacccccgcgctcctcgccgaaatggcggcaatctgcgcgcgctacgacgttcttttcatcgccgacgaggtcatgaccggctggggccgcaccggcacgctcactgcctgcgaacaggcgggcgtggtgccggatatcctgtgcctgtccaagggcattaccggcggcgcgatcccgctggcggtgacgttggcgactgcgccgatcttccaggcgcactggtccgaggaccgggcgcggatgttcttccactcgtccagctacaccgccaacccgatcgcctgtgccgcagcggtcgagaacctcgccatctggcgggaggagccggtgctggagcggatcgcgcaactcggcaactggcagcaggcggcgctggacgggctggcggatgtgccgggcctcgccaatttccgtcgcatgggcacgatcgccgcgctggagatcgagcaaccggagaatggctatctctccgcgatcgccccgcgcctgatggcgttcgcgcgcgagaacggcgtgctgctgcgtccgctcggcaacacggtgtacgtgatgccgccctacagcatcacgcgcgagcagctcgacaaggtgtgg

SEQ ID NO: 41540 - DNA, 1386 bp, SPHINGOMONAS
atgacgcaccgtttcgatccgacgtcgctgcgcgagtacgacatccgcgggatcgtggggaagacgctgggcccggacgacgcccgtgcgatcggccgcggcttcgcgacgctgctgcgccgcgccggcggccgccgggtggaggtgggccgcgatggccgcgtttcctcgccgatgctcgaggccgcgctgatcgagggcctgaccgcgtcgggctgcgacgtggtgcgcaccggcatgggccccacgccgatgctatattatgccgaggcaacgctggaggtggatggcggcatccagattaccggcagccataatcccggcaactacaatggcttcaagatggtgttccagcaccgctcgttcttcggccaggacatccagacgctgggcaagatggcggcggaaggcgactgggaagacggcgacggcaccgagaccgtgaccgatgccgacatcgaggacctctatgtcagccgtctgatcgcgggctatgccggcggcgcgtacaagatcggctgggacgcgggcaacggcgccgccggcccggtgatcgagaagctcgtcaagctgctgccgggtgagcaccatacgctgttcaccgatgtggacggtaatttccccaatcatcatcctgatcctaccgaggaaaagaacctcgccgatctgaagaagctcgtcgcggagaagaacctcgatttcggtctcgctttcgatggcgacggcgatcggctgggcgcgatcgacggccagggccgggtggtgtggggcgaccagctgctcgccatcctcgccgagccggtgctgcgcatcgatccgggtgcgacgatcatcgccgacgtcaaggccagccaggcgctctacgaccggatcgccgagctgggcggcaagccggtgatgtggaagaccggccacagcctgatcaagaccaagatgaaggaaaccggcgcgccgctcgcgggcgagatgagcggccacatcttcttcgcgcaggactattacggcttcgacgatgcccagtacgccgcgatccgcctgatccaggcggtgcacgtgatcggcaagtcgctcacccagctcaaggacgagatgccggcgatggtcaacacgccggagatgcgcttccaggtcgacgagagccgcaagttcccggtcgtcgaggaagtgctcgaccgtctcgaggcggacggcgcccaggtcgaccgcaccgacggcgcgcgggtcaacaccgacgacggctggtggctgctgcgtgcgtcgaacacccaggacgtgctcgtcgcgcgcgccgaggcgaaggaccacgcgggtctcgatcgcctgatggcgcagatcgacgaccagttggccaagagcggcatcgtccgcggcgagcaggcggcgcat

SEQ ID NO: 41541 - DNA, 969 bp, SPHINGOMONAS
atgaccgtacgttcggtgattctcggcacggggtccgccctgccggcgcagcgtgtttccaacgcggagctggcggagcgcgtcgataccagcgacgaatggatcgtcgagcggaccgggatccgcttccgccacatcgccgggccggaggaaaccacgggtacgcttgccgccggtgcggcgcgggcagccctcgagtccgccggtgtggaggctgcctcgatcgacctgatcgtgctcgccaccgcgacccccgaccagaccttcccggccactgcgacgcgggtgcagaacgcgctcggcatcctggattgcgtcgctttcgacgtggcggcggtgtgctcgggcttcctctatgcggtgcaggtcgccgattcgatgctgcgggccggcgtccatcgccgcgcgctggtgatcggcgccgagacgttcagccgcatcctcgactgggaagaccgcaccacctgcgtgctgttcggcgacggtgcgggtgcgatcgtgctggaggcgcaggataccgagggtgacgcgccgcagggcatccttgccaccaagcttcatgccgacggccgctacaacgacctgctctatgtcgatggcggaccctcgaccaccggcacggtcggcaagctgcggatgaagggccgcgaggtctttcgtcacgccgtgaccaacctggcctcggtgatgcaggaatcgctggccgcggccggtctcgagcccggcgacgtcgactgggtggtgccgcaccaggccaatgcccgcatcctcgatgcaacggcgcgcaagctcgatctcgcgccggaaaaggtgatcgtcaccgtcgatcgccatgccaacacgtccgccgcctcggtgccgctcgcccttgatgtcgcagtgcgggacggacgcatccagcgcggcgacctgctggtgctcgaggcgatgggcggcggcttcacctggggtgccgccgtcatacgcttc

SEQ ID NO: 41542 - DNA, 1182 bp, SPHINGOMONAS
gcgctccagcgcatccagccctccgccacgctcgccatgaccagccgcgtgttcgagctgaagcgtcagggtgtcgatgtgatcggcctgggcgccggcgagcccgatttcgacacgcccgacttcgtcaaggaagccgcgatcgaggcgatccgcagcggcaagaccaaatataccaatgtcgacggcacgcccgagctgaaggaagccgtgatccaaaagttcaagcgcgacaatggcttggactataccgcacagcaggtcacgatcaatgtcggcggcaagcacacgctgttcaatgcgatcgtcgccacggtggaagccggcgacgaggtcatcgttcccgcaccgtattgggtcagctatcctgacgtaattcagttcgcgggcggcacgcccgtgttcatcgccgccggcgccgagcagcagtacaagatcaccccggcccagctggaggcggcgatcacgtccaggaccaagtgggtaattctcaactcgccgtccaaccccaccggtgccgcctattcggccgccgagctcaaggcgctgggcgaggtgatcgagcgccacccgcatgtctgggtgttcgccgacgacatgtacgagcacatcctgtacgacggcttcgaattcgccacgatcgcgcaggtctgcccgtcgctctacgagcgcacgctcaccgtcaacggctgctccaaggcctatgcgatgaccggctggcggatcggcttcgccggcggcccggcaccgctgatcaaggcgatcgccaagctccagtcgcagtcgacctcgaacccctgctcgatcgcccaggcggcggccgtcgcggcgctgaccggcgaccagggcttcctcaaggaccgcgccgccgctttccagacgcgccgcgacctcgtcgtcggcatgctgaacgacatcgagggcatgacctgcccgacgccggaaggcgccttctacgtctatccggaattcagcgcgctgatcggcaagaccacccccaagggcaaggtgatcgcgaccgacgaggacatgatcggctatttcctcgacgacgcccgcgtcgcggcggtgcacggcgcagcgttcggcctgtcgccggcgatgcggatcagctatgcgacctccgaggcgctgctccgcgaagcctgcacccgcatccagacggcctgcgccgagctgcgc

SEQ ID NO: 41543 - DNA, 921 bp, SPHINGOMONAS
cgcgttttcatcgacggcgccgccggcaccaccggtctcgagatccgcgagcggctcgccggccgctccgagatcgatgtgatggtgctaggcgaccaggaccgcaaggatccgaagaagcgcgaggaagcgctcaacgcggccgatttcgtcatcctctgcctgcccgacgacgcggcccgcgaagcggtggcgatgatccgcaacgacacgactcgcgtgatcgacgcttccaccgcctatcgcactgcgcccgactggacctatggctttgccgagctggagcccggccaggccgcggcgatcgccgaggcggcgcgggtaagcaatcccggctgctaccccaccggcttcctcgctttggtccgcccgctgatccgcgccgggctgatcccgcacgatttcccgctcagcgtgaacgcggtgtcgggctattcgggcggcggccgctcgatgatcgaggagttcgagggcaagggcaccaaccccaccgacaccgccttccgcccctatggcctcgcgttggcgcacaagcatgtgcccgagatgcagaagcatgcgcggatcgtgaatccgccgatcttcatgccatcggtcgcgcgcacctatcgcggcatgatcgtggaagtgccgttgccgctctatgccttcacccgcaagccctcggtcgaatcgctcgagaacgtgcttcgcgacgcctatcgcgactcgccggtggtgcaggtgctgccggccgacgtgccgacggtcaccatcgaggaaaatgccggcaccgatcgcctgtcggtccgcgtgttcggcaatgacgagacccgccaggcgcggctgatcgccacgctcgacaatctcggcaagggcgccgccggcgccgcggtgcagaacctcaacatcatggccggcctggaccctgtcgcggggctg

SEQ ID NO: 41544 - DNA, 1572 bp, SPHINGOMONAS
atgctgggcggcatgcaggatttcgaacttcgggtatccactttgctcgatcatgcggcgcgggagcacggcccccgcgagatcgtgacgcgctgggcggacggcagcgagacgcggaccaactgggcaggtatcgcgcgcgacgcgcggcggatggcgcaggcgctggagcggcttggtatccgcaagggcgaccgggtcgcgacgctggcgatgaaccacagccgccacctcgtcgcctggtacggcgtgaccgggatgggcggcctgatccacacgatcaacccgcgcctgttcgacgaccagctggcgttcatcgccaaccacgccgaggatcgggtgctgctctatgacaggatgttcgcgcccgtgatcgagcggctcaagtcgcagtggacgacgatcgagcattatatctgcttcgacgatctcggccccgacgggttcgaggcgtggatcggttccgaggacggcgactatgcctgggtgaccggcgacgagcgcgagccgatgatgctgtgctacaccagcggcaccaccggcaatcccaagggcgtgatgtacacccatcgctcgacggtgatccatgcccttaccgagctgcagcccgccgtgttcgacctttcgacgcagtcggtcgcgatgccgatcgtgccgatgttccatgccgttggctggggcctgccctgggcggcaccggcggtaggggcgaagatggtcttctccgcgatcaacgacccgaaggtgctgtgcgagctgatgaaccgggagaaggtaacgcattcggcgggcgtgcccaccgtctggttcgcgatgttccagcacatcgacgcgaccggtgagcaccccaaacatctcaagatcgtcaccatcggcggatcggcggcgccgcgggcgatgatcgagcgattgatgaagatgggcatgcgggtcaaccacgcctgggggatgaccgaaaccagtccgatcggcacgatgggcgcgccgtcgcctgattttgacgacctcgatttcgatgcgcaggtggatcaggtggtgaaacaggggcgggtgccctacggcgtcgaacttcgcacggtcgatgatgcaggcaacgtgctgccccgcgacggcaagaccgccgggcgcctgcaggtgcgcggaccctgggtgatcgacacctattatcgcgagacgcgcccggcggtggatgccgacaactggttcgacaccggcgacgtcgccatgctccatcccgacggcgtgatgcagatcaccgatcgcgccaaggacgtgatcaagtcgggcggcgagtggattagctcggtggagctggaaaatgcagcggtgggctgcgcgggcgttgccgaggcagccgcgatcggcgtccaccacccgcgctgggaggagcgaccgatcctgctcgtcgtgcgcaagcccgacagcaccgtgagcgaggcggacatcctcgctcatctcggctgccatgtcgccaaatggtggctgccggacgagatccacttcgtcgacagcctgccgcatacggcgacgggcaagctgctgaagatggagatccgcaagcgctacaaggac

SEQ ID NO: 41545 - DNA, 1210 bp, SPHINGOMONAS
atggcaaatgtggcagtgatcggcgcccaatggggtgacgaaggcaagggcaagatcgtcgactggctcgccgagcgcgccgacgtggtggtccgcttccagggcgggcacaatgccggccacacgctggtgatcggcgaaaagatttacaagctctcgctgcttccctcgggcatcgtgcgcggcacgccgagcgtgatcggcaacggcgtggtgctcgatccctgggcgctcaaggccgaagtggagaagctgcgcgagcagggcgtcgaggtgacgccggacacgctgaagatcgccgatacctgcccgctgatcctgccgttccaccgcgatctcgatgcgctgcgcgaagatgccagcggcgccggcaagatcggcaccacccgtcgcggcatcggcccggcctatgaggacaaggtcggccgccgcgcgatccgggtgtgcgacctcgccaatctcgattcgatcgggccgcagctcgatcgcctcgccgcgcatcacgacgcgctgcgcgccggcttcggccagccgcctatcaatcgcgagggcctgctcgaagagctgcgcggcatcgccggcttcgtgctgcccttcgtccagccggtgtggaagatgctgaacgaggcacgctcgcgcggccgccgcatcctgttcgagggcgcgcagggcgtgctgctcgacatcgatcatggcacctatccgttcgtcacctcgtccaacaccgtctccggcacggccgccagcggcagcggcatggggccgggcgcggtgggcttcgtgctcggcatcgccaaggcctataccacccgcgtcggatcgggccccttcccgagcgagctggacaacgaaaccggggagcggctcggcacgcgcggccatgagttcggtaccgtcaccggccgcaagcgtcgctgcggctggctcgacgcggtgctgctgcgccagtcggtcgcggtctcgggcatcaccggcatcgcgctgaccaagctcgacgtgctcgacgggttcgaggagatccaagtctgcaccggctaccgtctgaacggcgaggtgctcgattattaccccgccagcgcgcccgaccaggcggcggtggagccgatctacgaaacgatggaaggctggtccgaatcgactgcgggcgcgcgcagctgggccgagctgccggcacaggcgatcaaatatatccgccgcgtcgaagagctga

SEQ ID NO: 41546 - DNA, 2538 bp, SPHINGOMONAS
cgcaccacctgcgcctattgcggcgtcggctgcggcatccgcgcgaccgttaccggcgagcgcgccgtccgcatcgagggcgatcccgaccatccggccaaccatgggcggctctgctccaagggcacgcatctcggcgagacgatcgggctggagggtcggctgctccatccgatgatcggcgatcgccgcgccagctgggacaaggcgctcgatctcgtcgcccggcgcttccgggaagcgatcgccgagcatggacccgacagcgtcgccttctacgtctcgggccagctgctgaccgaggattactacgtcgccaacaagctgatgaagggcttcatcggatcggcgaacatcgacaccaattcgcggctttgcatgtccagcgcggtggccgggcacatgcgcgcgttcggcgaggacgtggtgtcgggcagctatgccgatctcgacgcggccgatctgatcgtgctggtcggctcgaacaccgcctggtgccacccggtggtctaccagcgcatcatggccgcgcgcgccgagcgcggcacgaagctggtggtgatcgacccgcggcgcaccgaaacggccgaggaggcggacctgcatttggccgtccggcccggcagcgacgtggcgctgttcaacggcctgctcgcgcattgccgcgcggaagggctggccgatgccgccaatctcgacgtgccggcagggttctgggaggcactgggcgaggggcacgatctctggtccaccgcccagacctgcgacctcgtccccgccgatctccagcgcttctaccagctgttcgccgcgcacccgcgcaccgtcacactgttcagccagggcatcaaccagtcgatccgcggcaccgatcaggtcaacgcgatcctcaacctgcacctcgccaccgggcggatcggcacccccggcgcggcgcccttttcgatcacggggcagcccaatgccatgggtggtcgcgaggtgggcgggctcgcctccaccctcgcggcgcatcgcggcttcggcgcgcaggacattgccgatgtcggtcgcttctgggcagccgagcgcatggcgaccagaccgggcctcaaggcggtcgacctgttccgtgcggtcggcgaggggcggatcaaggcgctatggatcatggcgaccaatcccgccgtctcgatgcccgatgccggccgcgtccgcgaggcgttggccgcatgtcctttcgtcgtcgtctcggatgtgatcgcacagaccgataccagcgtgcatgcccatgtccgcctgccggccgccgcctggggcgagaaggacggcaccgtcaccaattccgaacgcacgatcagccgccagcgtgcctttctgccgctgcccggcgaggccaagccggactggtggatcgtcagccaggtggcgcgccggatggggttccgcaccgccttcccctttgatcgcccggccgaggtctggcgcgaacacgcgcggctgactgcctatcgcaatggcggcgcccgaatgctcgacctccaggcgaaggcggcgatcggcaatcaggcctatgacgagatggcgccgttctcctggcatccccagccctttgcggacggccgctacccgacccccagcggtcgcgcccggctggtcccggtggcgcagcgaccgctcgacgcgccgctgcgcgactggccgatgacgctcaacaccggccgctaccgcgaccagtggcatacaatgacccgtaccggcctgtcgcccaggctggcccgccaccgcgaggagccgctggtcgagatccacccggacgatgccgccgcgctggcgctggccgacggcgcgctggcgcgggtggcgacgccgcaagggaacagcctttttcgcgtcgcgcatcatgccgggcagcgccggggagaactgttcaccccgatccactggaccgatcgccagtcgcgcggcggccgcacgggactgctggcgcgcgatcttgccgatccgcattcgggccagcccggcttcaagctgtcgcctgcgcggatcaccccggtcgcggtcgattggcgcggctttctgatcgtgcggggtgagggggcggcgccagactgtttgtgggccacgcgggtgacggtgcccggcggcgtgctctacgaacttgccgggacgggcgatgctgcgccgctcgaccgtgccctgcccgcaggcgagcgtatcgaggcgatcgacccggcgcgcgggacccggcgcgtggcggtgctgcgtgacgggcggctcgcggcggtgctgttcgtcacccgcgccggcgcactgccgagccgcgactggctgatcggccagctcgaccagccccagggcccgcaagtgcttgccggccgcgcgccgggccgggcggcggatcgggggccggtggtctgcgcctgtttcgatgtcgggctgcacaccatcaccgcggccatccgcgatcagcgcctgctggacgtcgccgcgatcggcaccgcgctgggggcgggctccaactgcggatcgtgccggccggcgcttgcccgtattctc

SEQ ID NO: 41547 - DNA, 1446 bp, SPHINGOMONAS
cgtgtgatcgaccatgtgatcgcgggagcagccggcgccggagccacgcgccacgcggacgttttcgaccccaatagcggtgcggtgcaggcgcgggtgccgctcggcaccgccgccgatctcgaccgcgccgtcgccgccgcccaggccgcccagcccggctgggccgcgaccaacccgcagcgccgtgcccgcgtgatgttccgcttcaaggaactggtcgaggcgaacatggatgcgctggcccatatgctctcggccgagcacggcaaggtgatcgccgattccaagggcgacatccagcgcgggctcgaggtgatcgaattcgcctgcggcatcccccacgcgctcaagggcgagtatacgcaaggtgccggccccggcatcgacgtctattcgatgcgcatgccgctcggcatcggcgcgggcatcaccccgttcaacttccccgcgatgatcccgatgtggatgttcggcgtcgccatcgcctgcggcaacgccttcctcctcaagccctccgaacgcgatccgagcgtccccgtccgcctcgccgaactgatgctggaggccggcgctccgcagggcatcctgcaggtggtgcagggcgacaaggagatggtcgatgcgatcctcgatcacccggcgatcggcgcggtgagctttgtcggctcgtcggacatcgcgcactatgtctaccagcgcggcgtcgcggcggggaagcgcgttcaggcgatgggcggcgccaagaaccacggcatcgtcatgcccgatgccgatctcgaccaggtcgtggcggacctatccggcgcggcgttcggctcggcgggcgagcgctgcatggcgctccccgtggtggtgccggtgggtgacaagaccgccgatgcgctccgcgaaaagctgatcccggcgattcgttcgctgcgggtgggcatctccaccgatgccgaggcgcagtacggcccggtggtcaacgctgcgcacaaggcgcgcgtggagaactggatccagaccggcgtcgacgagggcgccgagctggtgatcgacggccgcggcttttcgctccagggccatgagcagggcttcttcatcggcccgtcgctgttcgaccgcgtgaccccgggcatgaagagctaccaggaagaaatcttcggcccggtcctccagatcgttcgcgcccccgatttcgagaccgcactgcggctgccgagcgagcaccagtacggcaacggcgtcgcgatcttcacccgcaacggccatgccgcgcgcgagttcgcggcgcgggtgaatgtcggcatggtaggcatcaacgtgccgatcccggtgccggtggcgtatcacagcttcggcggctggaagcgctcggcgttcggcgacgtcaaccagcacggcatggaaggcgtccgcttctggaccaaggtcaagacggtgacgcaacgctggccggat

SEQ ID NO: 41548 - DNA, 1140 bp, SPHINGOMONAS
ttcgacctcaccgacgaccagcgccagatccaggagttggcgcagaagttcaccgccgatgcgatcaccccgcacgcggctgaatgggatgagaagcacgtcttcccgcgcgacacgatcaaggccgccgccgagctgggcttcgcggcgatctatgtctcggaggaatcgggcggcatcggtctcggccggctcgagtccgcgctgatcttcgaggcgatggcctatggctgcccctccacctccgccttcatctcgatccacaacatggccgcctggatgatcgaccggttcggcgcgccggccgtgaaggacaagtatctccccagcctcgtcaccatggaccggctggccagctactgcctcaccgagcccggctcgggctcggacgcggcggcgctcaagacgcgcgcggtgcgcgacggcgaccattatgtcgtcacaggctccaagcagttcatctccgggggcggggagaacgacctctacctcaccatggtccgcaccggcgaggacggccccaagggcatttcctgcctcgccatcgagaaggacatgcctggcgtcagcttcggcgcccaggagcgcaagctgggctggcacagccaacccaccgcgcaggtgatcctcgacaatgtccgtgtgccggtggaaaatttggtcggcgccgagggcgaaggcttccgcatcgcgatgatgggattggacggcggccggctcaacatcggcgcctgctcgctgggcggcgcgcagcgctgcctcgacgaggcggtgcgctacacccaggagcgcaagcagttcggcaaggcgatcgccgactttcagaacacccagttcaccctcgccgacatggcgaccgagctggaggcggcacgcgcgctgctctacctcgccgccgccaaggtcaccgcgggcacccccgacaagacccgcttcgccgcgatggccaagcggctggccaccgacaccggatcgtcggtggtcgatcgcgcgctgcagctgcacggcggctatggctatctgatggactatccgatcgaacgcttctggcgcgacctgcgcgtccactcgatcctcgagggcaccaaccaggtgatgcggatgatcgtcggccgggagatggtgcgcgaatgagcgaca

SEQ ID NO: 41549 - DNA, 519 bp, SPHINGOMONAS
gaaacggcgacgctcgccggcggttgcttctggtgcacggaagcggtgttcaacgacgtgatcggcgttcagggcgtcgagagcggctatatcggcggcaccaaggacaaccccacctacaaggaagtctgcagcggcagcaccggccatgccgaggcgatccgggtgcgcttcgataccgatgtggtgagctatggcgagatcctcgacatcttcctcgccacccatgacccgacccagctcaaccgccagggcaacgacatcggcacccagtatcgctcggcgatcttcccgcattcggccgagcaggagcgcgaggcgctggacgcgatcgagcgcgcccgccccgattggccgcagccgatcgtcaccacgatcgagccgctgggccagtggtggccggccgaggactatcaccaggaatattggcagggcgaaggccagcggaacccctattgcctggcggtgatcccgcccaagctccgcaagctgcgcaagagcttcgccaacaaagcgaaa

SEQ ID NO: 41550 - DNA, 1185 bp, SPHINGOMONAS
ctcttcacgtccgagtccgtgtccgaaggccatccggacaaggtcgccgaccagatttccgactcgatcgtcgacctgttcctgtcgaaggatcccgaagcgcgcatcgcctgcgagacgctgaccaccacccagctcgtggtgcttgccggcgaaatccgctgcaagggcgtgtacgagaatggcgaatgggcacccggcgcgcaggaagagatcgagaagaccgtccgcgagacggtgaagcgcatcggctatgagcagtcgggcttccactggcagaccttccgcttcgagaacaacctgcacggccagtcggcgcacatcgcgcagggcgtggacgcgagcggcaacaaggacgaaggcgccggcgaccagggcatcatgttcggcttcgcctgcgacgagacccccgacctgatgccggcgacgctcgactacagccacaagatcctcgagcgcatggccgccgaccgccactcgggcgcggcaccgttcctcgagccggacgccaagagccaggtcaccctgcgcttcgacaacggcaagccggtcgccgccaccgcgatcgtggtctcgacccagcatgcgccgggctatgaccagggcgagaaggaagccgagctccacgcctatgtgaagaaggtgatcgccgagatcctcccggccgagctgctctcggacgcgaccgaatatcacatcaacccgaccggctcgttcgaaatcggcggcccggacggtgatgcgggcctgaccggccgcaagatcatcgtcgacacctatggcggcgccagcccgcatggcggcggcgcgttcagcggcaaggacccgaccaaggtcgaccgttcggcggcgtacatcacccgctatctcgccaagaacatcgtcgcggccggcctcgccaagcgctgcacgatccagctcgcctacgccatcggcgtgtcgaagccgctgtcgctctatgtcgacacccacggcaccggcaccgtcggcgacgacaagatcgagcaggcgatccagggcatcgagaagctgggcggcctcaccccgcgcggcatccgcacccatcttggcctcaacaagccgatctaccagccgaccgctgcgtacggccatttcggccgcaagcccgagggtgacttcttcccctgggagcgcaccgacctggtcgaggatctgaaggccgcg

SEQ ID NO: 41551 - DNA, 927 bp, SPHINGOMONAS
gcattcattttcccgggccagggcagtcaggccgtcggcatgggcaaggcgctggccgaggcgagccccgccgcgcgcgaggtgttccaggaagtcgacgaggcgctcgggcagcatctattcaagctgatgagcgaagggcccgatagcgacctgacgctcaccgccaatgcccagccggcgatcatggccaatgccatcgcggtgctgcgcgtgctggaaaaggaaggcggcatccgcctggccgacaaagccgatttcgtcgccggtcattcgctgggcgagtacaccgcgctctgtgccgcgggcgcgctggacctttcgaccacggcgaagctgttgcgcaagcgcggcgatgcgatgcagtcggcagtgccggtggccgagggcgcgatggccgcgctgctcggcgccgatctcgtcaaggcccaggcgatcgccgatgcggcggctgagggcgaggtatgcaccgtcgccaacgacaatgacccgcaccaggtggtgatctcgggcgcgcgcggcgcgatcgagcgcgcggtggcgatcgccaagggacatggcgccaagcgcgcgctgctgctgccggtctcggcgccgttccactgcccgctgatgcagccggcggcggacgcgatggagaaggcgctggccgaggtggcgatccaggcgccgctggtaccggtctatgccaatgtgacggcggcgccggtggcggatccggcgacgatccgcacgctgctggtggagcaggtgacgggcatggtgcgctggcgcgaatcggtggcggcgatgttcgatggcggcgtgcacgaattcgtggagctgggcggcaaggtgctcggcggcatggtcaagcggatcagcccggatgccaccgtgaccagcgtcgtgagcatggacgatatcgaggcgctggttaaggtgctt

SEQ ID NO: 41552 - DNA, 738 bp, SPHINGOMONAS
atgttcgatctcacaggcatgaccgcgctcgttaccggcgcttcgggcggcataggttcggcgatcgccaaggcgctggccgcgcagggcgcgaagctcgccgtatcgggctccaatgccgagaagctggaggcgttccgcgccggcctgggcggcgagcatgtcgcgctgacctgcaacctttccgatcgcgccgcggtcgacgcgctggtgccgcaggcggtggaagcgctgggcggcaggctcgacatcctcgtcaacaatgccggcgtcacccgcgacaacctggcgatgcggatgaaggacgaggagtgggagcaggtgatccaggtcaatctggaagccgcgttccgcctgatgcgcgccgccgccaagccgatgatgaaggcgcgcttcggccggatgatctcgatcacctcggtggtcggcgccaccggcaatccggggcaggccaactatgccgcgtccaaggccggcctggtcggcatgtccaaggcgctggggcaggagcttgccagccgcaacatcaccgtcaactgcgttgcgccgggcttcatccggtcggcgatgacggacgttctgccggatgcgcagaaagaggcgctgctcggccgtattcctgccggaaagctgggcgagggcgaggatatcggtgcggcggtcgtctatctcgccagcaaggaagcgtcttatgtgacgggtcagaccttgcatgtgaacggcgggatggcgatgctg

SEQ ID NO: 41553 - DNA, 213 bp, SPHINGOMONAS
gagatcaccacccgcgtgcaggcgctcgttgtcgaccatctgggcgtcgacgccaaggacgtggtgccgaccgcgagcttcaccgatgacctcggcgcggacagcctcgacatcgtcgagctggtgatggccttcgaggaagagttcggggtcgagatcccggacgacgccgcggagaagatcagcaccgtcggcgacgccgttgcctacatc

SEQ ID NO: 41554 - DNA, 1248 bp, SPHINGOMONAS
cgccgcgtagtcgtgaccggcctgggcctcgtcaccccgctgggggccgatgtcgaaaccgcctggaagaacatcctcgccagcaagtccggcgcgggcacgatcaccaagttcgatgcgacggatttccagagcaactatgcctgcgaagtgaagccggccgaccatgaatatggcttcgatgcgggcaagcgcgtcgatcacaagatccagcgccaggtcgatcccttcatcgtcttcggcatcgatgccgccggccaggcgatcgaggatgccggcctgaccgacatgcccgaagaaatgcgatttcgcgccggctgctcgatcgggtcgggcatcggcggtctgccgggcatcgagagcgaatcgctcgtgctccatgaaaagggcccgaagcgcgtttcgccgcacttcgtccatggccgcctgatcaacctcatttcgggccaggtctcgatcaagtacggcctgatgggcccgaaccatgcggtggtcaccgcctgctcgaccggcgcacactcgatcggcgacgccgcgcggatgatcgcgatggacgatgccgacatcatgctggccggcggcgcggaaagcaccgtctgcccgatcggtatcgccggcttcggccaggcgcgcgcgctttccaccggcttccgcgacgatcccaccaaggcgagccgcccctgggaccagggccgcgacggcttcgtgatgggcgagggtgcgggcgtggtcgtgctcgaggaatatgagcatgccaagcgccgcggcgccaagatctatgccgaagtggtgggctacggcctgtcgggcgacgcctatcacgtgaccgcgccgcatcccgaaggctcgggcgcgttccgctcgatgcagatggcggtgcgcaagtccggcctcgcgctcgaggacatcgattacatcaacgcgcacggcacctcgaccccgatgggtgacgagctggagctcggcgcggtgcgccgcctgttcggcgatgcgctcggcggtctgtcgatgagctcgaccaagtcggcgatcggccacctgctcggcggcgccggtgcggtggagagcattttctgcattctggcgctgcgcgaccagatcgtcccgccgacgctcaacctcgacaatccgagcgagaattgcgcgggcgtcgaccttgtgccgcacgtcgccaaggagcggaaggtgaaggccgtgctgaacaactcgttcggattcggcggcaccaatgccagcctggtgatgaag

SEQ ID NO: 41555 - DNA, 1455 bp, SPHINGOMONAS
atgcagcagcccgtcggcaaattgcttctgttcggtgccaccggcgatctcgcgcagcggatgctgctcccgtcgctctatgcgctgcatgcggacggcctgctcccccatggccttaccattaccggcaccgcccgctcggaccatgacgatgatggcttccgcgacttcgctgccaaggcgctcgaccagttcctgcccgccgaccgaaaagacgacagcgctgtccagggcttcctccagcgcctgcattaccagacgctcgatgcctcgcagatcgacggctatgccgcgctgaaggaaaagctgggcgacatctccggcggtctggccatcttcctgtcgaccgcgccctggctgttcgggccgaccatcaagggcctcgaatcggccgggctcaccggggagaatgtccgcatcagcctggagaagccgctcggccgcgacctcgcctccagccgcgagatcaacgacatcgtcgcggaagcctttcccgaggagcgcaccttccgcatcgaccattatctgggcaaggaaaccgtccagaacatcctggcgctgcgcttcggcaattcgctgttcgagccggtgtggaacgcccgcggcatcgacagcgtgcagatcaccgtctccgagacggtgggcctggaaggccgcgccggcttctatgacgacaccggcgcgctgcgcgacatggtgcagaaccacatgctccagctcgtcgcgctgatcgcgatggagcccccggcgcgcctcgacggtaccgcggtacgcgacgagaaggtcaaggtgctgcgctcgctgcgcaagatcccgatcgccgaggcgcccaacatgaccgtgatcggccaatatggcggcggcgcggtcaaaggcgagatcgttcgcgattatgccaccgatctcggcaaggattcgcgcaccgaaaccttcgtcgcgatcaaggcgcatgtcgacaactggcgctggcagggcgtgcccttctatctgcgcaccggcaagcgtctggccgagcgccgatccgaaatcgtcatccagttcaagccggtgccgcactcgatcttcgccgagcgcggcggcatgctccagcccaacgcgctggtcatccgcctccagccggaagaatatgtccagctgctggtgatggccaagcagcccgggctcgatcgcgagggctatcgcctgcgcgaggtgccgctcaatctcagcctcgacaccgaattcgccggcacccgccgccgcatcgcctatgagcgcctgctgctcgacctgatcgagggcgatcccacgctgttcgtccgccgcgacgaggtggaggcacagtgggaatggatcgacgcgatccgcgccggctgggacgccaacgatctcaagcccaagccctatgcctcgggcagctggggcccctcgctctcgatcgcgctcaccgagcgcgacggggtacactggcacgaa

SEQ ID NO: 41556 - DNA, 1485 bp, SPHINGOMONAS
aaggcgccgttcgccgcgcgctacgacaatttcatcggcggccgcttcgttgcccccaccgccgggcgctatttccagaacgtatcgccggttaccggacaggtggtgtgcgagatcgcccgctccgacgcggacgacatcgagcgcgcgctcgacgccgcccatgccgccgccgatgcctggggccgcacgccggtggccgaacgcgcgcggatcctcaatcggattgccgaccggatggaggcgaatctggagaagctcgccaccgccgagacctgggacaatggcaagccgatccgcgagaccatggccgccgacgtgccgctggcgatcgaccatttccgctatttcgcgggcgtggtgcgcggccaggaaggctcgatcggcgaaatcgaccacgacaccatcgcctatcatttccacgaaccgctgggcgtggtcggccagatcatcccgtggaacttcccgctgctgatggcggcctggaagctcgcgccagcgctggccgcgggcaattgcgtcgtcctcaagcccgccgagcagaccccggcctcgatcctggtctgggccgagctgatcggcgacctgctgccgcccggcgtgctcaacatcgtcaacggctatgggctggaggccggcaagccgctcgcctcgtcgcgccggatcgccaagatcgccttcaccggcgagaccagcaccggccggctgatcatgcaatatgccagcgagaacctgattcccgtcacgctggaactgggcggcaagtcgcccaacatcttcttcgaggacgtgacccgcgaggacgacgatttcttcgacaaggcggtcgagggcttcgtgatgttcgcgctcaaccagggcgaggtttgcacctgcccgagccgtgcgctggtccacgagaagatctatgaccgcttcatggagcgcgcgctgcagcgcgtgcaggcgatcgtccagggcagcccgctcgatcccgcgacgatgatcggcgcgcaggcctcgtccgagcagcagcagaagatcctgtcgtatatcgacatcggccggcaggaaggcgccgagctgctgatcggcggcggcgcggccgatctgggcggcgatctctcgggcggcttctacgtccagcccaccgtgttccgcggacacaacaagatgcggatcttccaggaggagatcttcgggccggtgctctcggtcaccaccttcaaggacgaggacgaggcgctgcatctcgccaacgacacgctctacggccttggcgccggcgtgtggagcagagacgccaacacctgctaccgcttcggccgcgcgatcaaggccgggcgggtgtggaccaactgctaccacgcctatccggcgcatgcggcgttcggcggctacaagcagtccggcatcgggcgcgagaaccacaagatgatgctcgaccactatcagcagaccaagaacatgctggtcagctacagcccgaagaagctgggcttcttc

SEQ ID NO: 41557 - DNA, 1107 bp, SPHINGOMONAS
aagcccgccaccaaaccggcgcgtccctatttttcctctggtccctgcgccaagcccccgggctggtcgcccgataagctcgcttgtcagtcgctcggccgctcgcaccgctcgaagctgggcaagacccgcctccaatactgcatcgacctgatgcgcgaactgctccgcctgccggacacccaccgtatcggcatcgtgccgggttcggataccggcgcgttcgaaatggcgatgtggacgatgctgggcgcccgccccgtcaccacgctcgcctgggaaagcttcggtgagggttgggtcaccgatgcggtcaagcagctcaagctcgatcccaccgtgctgcgcgccgactatggccagatccccgatctgaccgcggtcgactggtcgaacgacgtgctgttcacctggaacggcaccacctccggcgcgcgcgtgccgaacggcgactggatcgccgccgaccgcgagggcctgagcttcgccgacgcgacctcggcggtgttcgcctacgacctgccctgggacaagatcgacgtcgccaccttctcctggcagaaggtgctgggcggcgaaggcgcgcacggcgtgctgatcctcggcccccgcgcggtcgagcggctcgaaacctatacccccgcctggccgctgccgaaggtgttccgcctcgtttccaagggcaagctcgccgagggcgtgttcaagggcgagacgatcaacacgccgtcgatgctggcggtggaagacgcgatcttcgcgctcgaatggggcaagggcctgggcggcgccgaggggctgatcgcccgttcggacgccaatgccgccgcgctcgacaagatcgtcgccgaacgcgactggctcggccacctcgccgaggatccggcgatccgctcgcgcaccagcgtctgcctcaccgtcgagggtgccgatgccgacttcatcaagaagttcgccggcctgctcgaaaaggaaggcgcggcctatgacgtggccggctatcgcgatgcgccggcaggcctgcgcatctggtgcggcgcgaccgtcgacaccgccgatatcgaggcgctcggcccctggctcgactgggcctacgccaccgccaag

SEQ ID NO: 41558 - DNA, 1344 bp, SPHINGOMONAS
gcgcatcgcgaaaccgaggccgcgctggagcgggcgaaggacgccgccgaggccgccaacgctgccaagacgcgctatctggtcgcggtgagccatgagatccgctcgccgctcaacgctatctatggctatgcccagctgctcgagcgcggcgactccatcccgtcgaccgaggcgggcggtgtgattcggcgttcggccgagcatctcaccaatctggtcgaggggctgctcgatatttcgcgggtggaaagcggcgtgctgcaggtgcggcaggaactggtgcggctgccggcgctgctcgaccaggtggtggagatgttccgcgtgcaggcatcggccaaggggctgtcgctcgactatgtcgtcgaggggcggttgcccgcctatgtgcggaccgacgagaaacggctgcggcagatcctgatcaacctgctgtccaacgcgatcaaatataccgagcgcggcggcgccacgctcaccgtgcgctatcgcagccagagcgcggcgatcgaggtgcgcgacaccggccccggcatcccgcccgaggacctggagcggatcttcgaaccgttcgagcgcggccgcgaacccgatgcggtgatgcagccgggtatcgggctgggccttgccatcacccgcgtcctggcgcgcatcctgggcggcgaggtgacggtgacgagcgacgtggggaagggcagcagcttcctccttcggctcctgctgcccgagccgatcgaggcgccggccggcgccgctgcctatcgccgcgtcaccggctaccaggggccgcagaagacgatcctggtgatcgacgacagtccggcgcagaccacggtcgtcaaccatctgctgcgcccgctgggcttctccgtcttcgaggcgagcgggggcacggcaggccttgcgctcgccgagcattgcgcgcccgacctcgtcctgctcgacatccagatgccggggtgcagcggctgggacatcgccgagcagctgcgcgcgcgcttcggcgcggggctgcgcatcgtgatggtctcggccaatgcgcacgaattccacgccgggcgggacgggcaccgcgtgcacgatgccttcctcaccaagcccgtcgatctcgacgcactgctcgacatgatcgcgcggcaattgaggctcgactggatcgtcgaggacccagatgcggtgccgaccccgccggctccccccccggcactgcccgagacggcgggaccctatctcgatgcgctgcgccgctttatgaagctcgggcatgtccgcggaatcgaaacgacactcgtgactctggagagggacgttcccgaaagcgccgatctcgtcgcccggctg

SEQ ID NO: 41559 - DNA, 3582 bp, SPHINGOMONAS
gtcctgatcgccaatcgcggggcgatcgcctgccgaatcatccgcacgctcaagaagatgggcatccgctcggtcgcggtgttctccgatgccgacgaagcctcgcgccatgtcgcactcgcagacatcgcggtgcggatcggcccgggcccggcggcggaaagctatctcgacgtcgcccgcatcctcgcggcggccatggagacgggcgccgacgcgatccaccccggctatggcttcctctccgagaacgcgggctttgccgaggcctgcgaggccgccggcatcgcgttcatcggcccgagcgccgacagcatccgcgccttcggcctcaagcacagcgcccgcgcgctcgctgaggcgcagaacgtccccctcgcccccggcaccggcctgctcgacagcgtcgaagcagcgctcgaagcggccgaacgcatcggctatccggtgatgctcaaggcgaccgccggcggtggcgggatcggcatgcgggtatgcaccgacgcccaggcggtgcgcgacggctatgcggcggtggcgcggctcggcgcgggcaatttcggcgatgccgggctgttcctcgaacgcttcgtgccgcgcgcgcggcatgtcgaggtgcagatcttcggcgacggccagggccgcgtcgtcgcactcggcgagcgcgactgctcgctccagcgccgcaaccagaaggtcgtcgaagaagcccccgccccgcacctgcccgaacacatccgcgccgcgctgatcgaagcggcagtgcggctgggccgggcggccaactatcgctccgccggcacggtcgagttcctctacgatccggcgcgccaggactggttcttcctcgaggtgaatacgcgcctccaggtcgagcacggcgtcaccgaggaagtgaccggcgtcgatctggtcgaatggatggtgcgcggcgcgggcggcgactacagcttcctcgacactcccgtccccgcccccaaaggctggtcgatccaggcgcggctctatgccgaggatcccgcggtcgacttccgcccggcctcgggcacgctcaccgaggtcgccttcccggaaggcgtccgcgtcgaaagctgggtggaatcgggcagcgccgtctcctccttctacgacccgatgctcgccaagctgatcgtccacggcgaggaccgcgagtccgccgtcgcggcgatgcaggcggcgctcgaccgcacccgcttcgccgggatcgagaccaatgtccgctggctccgcgacgtggcccgcgccaccgatttcgtcaccggtgacgtctcgacgcgctcgctggagacggtggtccaccgcccgcagagcatcgtcgtccgttccgccggcaccgcgaccagcgtgcaggattatcccggccgcgtcggcctgtgggatatcggcgtgccgccctccggcccgatggacgcccgcgccttccgcctcggcaacatgctgctcggcaacgacagcgccgcgcccggactggaagtgaccgccaccggtccgacactccagttcaacaccgcgacgcgcatcgtcctcaccggcgccgatttcgccgccacgctcgacggcaaaccggtcccgcgcaacaagcccgtcgccatcgccgagggccagacgctggcactcggccgcgtcaccggcggcggcatgcgcggctatatcctgttcgccggcgggctcgacgtgccgagctatctcggcagcgccagcaccttcgatctcggcgagttcggcggtcatggcgggcgggtgctccgcgtcggcgacacgctgcacctcaccgatcatgcgccggcggtgatcccgggcccacgcgcgatcgaccaagcgcaactcggccccgactggacgatccgcgtcctctacggcccgcacggcgcccccgatttcttcgcgccggaggatgtcgacacgatcctctccgccgagtggaaggtccattacaacagcaaccggaccggcgtgcggttggtcggccccaagccgcactgggcacgcaaggatggcggcgaggcggggcttcacccctccaacatccacgataacccgtacgcgatcggcgcgctggactttaccggcgacatgccgatcatcctcggccccgacggcccctcgctcggcggcttcgtctgcccgttcgtggtgatcgcggcggacctgtggaaggtcggccagctcgcaccgggcgaccgcatccagttcgagcaggtcagcctcgacgaggccgatgccgccgcagcagtcgaagaggcctggatcgaaggccgcgccgccaccgcgaccagccccgccaagggcggcgggcgcgacgcgatcctggtcgatctgcccgccaagggtcgccgcccgcgcgtgctgttccgccgccagggcgaccgcaacctgctggtcgaatatggcccgatcacgctggacttggaactgcgcctgcgcgtccatgccgcgaccacggcgctcgcagccctcgcgctgccgggcattctcgatatcgtccccggcatccgctcgttccaggtgcatatcgacggcatccgcctcaaggaagcgggcctgatcgagcggctgacgcagatcgagaacgaactgggtgatctcgaggatttcgtcatcccttcgcgcatcgtccacctgccgctgagctggaacgaccccgcgatccacgagacgatccagcgctatatgcgcgtggtccgcgacgatgcgccctggtgcccggacaatatcgagttcatccgccgcgccaacgggctcgccagcgccgaggaggtccaccggatcatcttcgacgccagctacctcgtctacggcctgggcgacgtgtatctcggcgcaccggtcgccaccccgatcgatccgcgccaccggctcgtcaccaccaaatacaacccggcccgcacctggacgccgcccaacgtggtgggcatcggcggcgcgtatatgtgcatctatggcatggagggtccgggcggctaccagctgttcggccgcaccatccaggtgtggaacacctatcgccagaccggcgcctttgccgagggcaagccctggctgctccgcttcttcgaccagatccgcttcttccccgtaagccacgaagagctgaccgaatggcggcgcgacttcccgctggggcgccgcgaaatccgcatcgaggaaaccgagttccggctctccgagtatcgcgaatttctcgccgagaatgcccgctcgatcgccgcattcgaaaagcagcgcaacgccgccttcgccgccgagcgtgcggagtgggaacgaaagggcgagttcgatcgcgtcgccagcctcaccgaaaccgccgacgacagtgccgatgaagcagtgacggtgccggacggcgccgaactggtcgaggcgccgttcggcggcagcgtgtggaagctgctcaaggaggtcggcgaccccatcgacgcgggcgagacgatcgccgtgctcgaagccatgaagatggagtttccggtgaccagcccggcagcgggtacggtggccgcgctctatgtcgccgagcggcagacggtcaccccggggtcgccggtgctggcgctggtgcgggca

SEQ ID NO: 41560 - DNA, 1482 bp, SPHINGOMONAS
catcttatagacgcgctgccgctgcgtggcgcgccggacgccgttgctttggaagacaaggccggagcgctcacctatgccgcgctggaggcggcggtgggcggcatcgcgcatgcgctggccgcgcacgggctgccgccgggcgaacgcatggcgagctggctgcccaagacgcgcgccgcctgcctcctgccgctcgccgggccgcgcgccgggttggtgcatgtgccgatcaaccccgcgctcaagcgggcgcaggtggcgcatatcctggaggatagcggcgcacggctgctggtcacccagaaggcgcggttggcggcactcgcgccgggcgacgtccccgccgattgccgggtcgtcaccgaggaggaactggccggcaccgacgctgtgatgccgccggccggcggtgaccctgatgcgctggcggcgattctctacacctcgggctcgacggggcgtcccaagggggtgatgctcagccacgccaatctctggctcggggcgatcagcgtcgcacactatctgaagctcacgtccgcggaccgggtgctcggcgtgctgccgctgagcttcgactatgggcagaaccagctcttctcgacctgggcggccggtgcgcgcgtggtgccgctggactatctcaccgcgcgtgacgtggtgaaggccgtggagcgcttcgcgatcaccacgctggccggggtgccgccgctctgggtgcaactgctcgaggccgactggccgacggatatcgcagggaagctgcggcggctgaccaattccggcggcgcgctcacccggccgctggtgcgggacctgcgcacccgcttcccgggcgcggacctttatcccatgtatggcctgaccgaggcattccgctccacctatctcgatcccgcgctggtcgatacgcgccccgaatcgatcggcagcgccattcccttcgccgagatcctgatcgtcgatgccgagggcaggcgggccgtgcagggcgaactggtgcatgccgggccgctggtcgccaagggctattggcgcgatccggaacggaccgcgcgccgcttccggcctgcgccggtctttgccgagcatccgggcatggcggtctggtccggcgacaccgtggcggaggacgaagacgggctgctgcgcttcgtcggccgtgacgacgagatgatcaaatcctcgggcaaccggatcagcccgaccgagatcgaggaagcggtggtcgccggcggcgagacgagcgaggcggtggcattcggcgtccccgatcccaggctggggcaggcaatcctggtcgtcgcgcggggggacggcagccgggaggaggaattgcgcgcccggctgcggcgggaactgccgagcttccagcagcccgcacgctatgtctggcgcgaccgcctgccccgcaacgccaacggcaagctcgaccgatccgggctgaagacggagatcctatgaacgcgaaaccgatcg

SEQ ID NO: 41561 - DNA, 1263 bp, SPHINGOMONAS
atgaccaagctcagcggcggtgactcgaagagcacgctctattgctccttctgcggcaagagccagcacgaggtgcgcaagctcatcgccggcccgaccgtattcatctgcgatgagtgcgtcgagctgtgcaacgacatcatccgcgaggaaaccaagtcctcgctggtgtccaagaaggacggtggcgtcccttcgccgcaggaaatctgcgacgtgctcgacgattatgtcatcgggcagaagaaggcgaagcgcgtcctatcggtggcggtgcacaaccattacaagcggctcaaccatggtgccaagggtgccgatgtcgagctcgccaagtcgaacatcctgctcgtcggccctaccggctgcggcaagacgctgctggcgcagacgctggcgcgcatcctcgacgtgccgttcaccatggccgatgccaccacgctcaccgaagccggctatgtcggcgaggacgtggagaacatcatcctcaagctgcttcaggcctcggactacaatgtcgagcgggcgcagcgcggcatcgtctatatcgacgagatcgacaagatcagccgcaaggcggagaacccgtcgatcacccgcgacgtgtcgggtgaaggcgtgcagcaggcgctcctgaagctgatggaagggaccaccgcgtccgttccgccgcagggtggccgcaagcatccgcagcaggaattcctgcaggtggacacgaccaacatcctgttcatctgcggcggcgccttttcgggccttgagaagatcatcggcgaccgtctgcagggcaagtcgatcggcttcggcgcgcatgtcgccgcacccgacgagcgccgcaccggcgagctgctccgccagaccgagccggaagatctcctgaagttcggcctgatccccgaattcgtcggtcgtctgccggtgatcgcgacgctcgaagacctcgacgtcgaggcgctgatcaagattctgaccgagccgaagaacgccctggtcaagcagtatcagaagctgttcgacatggaggcggtcaagctcggcttcaccgacgacgcgctcaccgccgtctcgaagaaggcgatcgagcgcaagaccggtgcccgcggcctccgctcgatcctcgaaggcatcctgctcgatacgatgttcgacctgcccagcatggacggcgtcgacgaggtcgtggtcgacaaggacgtggtcgagggccgcaaggaaccggtgcgcatctacgcgaagaaggaaaagaccggcagcgccgcc

SEQ ID NO: 41562 - DNA, 2432 bp, SPHINGOMONAS
cagtcctatcccgtccttccgcttcgcgacatcgtcgtcttcccgcacatgatcgtgccgctgttcgtcggtcgcgataagtcggtcgcggcgctggaagcggcgatggctgccgacaaggagatcttcctcgtcgcgcagctcgatccggccgaggacgatcccggccgcgacgatctctatgataccggcgtttctgccgaagtgctgcagctcctcaagctgcccgacggcacggttcgcgtgctggtcgcgggcaaggagcgcggcagcctgacctcgatcgaggaaaccggcgcctatctcaccgcccatgtcgagccggtggaagaaggcgacgcgtcgcttgaagccgcacaggaaggtgtcgacgaggcggtttccaagctgacgcctgaaaatctcagccccgagctgaaggcgctgatgcgctcggtcgtcgaccagttcgagaattacgccaagctcaatcgcaagctgccggccgagaccgccgtgcagctgggcgagctggaggatccgtcgcgcctcgccgatgcggtcgccgccaacatctcggtcaaggtcgccgacaagcagtcgctgctggtcgaaaccgatccgcaaaagcggctcgagatggtgttcgccttcatggagggcgagttgggtgtgctgcaggtcgagaagaagatccgcagccgcgtcaagcgccagatggagaagacgcagcgcgaatattatctcaacgagcagctcaaggcgatccagcgcgagctgggcaatgagggcgaagagggcgagggcgacgaggtcgccgaacttacccagaagatcgccacgctcaagctttccaaggaagcgcgcgcgaaggcgcagggcgagctgaagaagctcaagacgatggcgccgatgtcggccgaggccaccgtcgtgcgcaactatctcgacgtgctgctgggcctgccctggggcaagaagtccaagctgaagaaggacatcgccgaggcgcagggtgtgctcgaccaggaccattacgccctggagaaggtgaaggaccggatcgtcgaatatctcgcggtccaggcgcgcaccaacaagctgaaggggccgatcctgtgcctcgtcggcccgccgggcgtgggcaagaccagcctgggcaagagcatcgccaaggcgaccggtcgcgagttcatccgacagtcgctgggcggcgtgcgtgacgaagccgagatccgcggccatcgccgcacctatatcggctcgctgccgggcaagatcgtgtcgaacctcaaaaaggccggcaccgcgaacccgctgttcctgctcgacgagatcgacaagctcggccaggacttccgcggcgatccggcctcggcgctgctcgaggtgctggatccggagcagaacagcaagttcaacgaccattatctggagatcgacatcgatctttcggacgtgatgttcgtgtgcaccgccaactcgctcaacctgccgcagccgctgctcgatcgcatggagatcatccggctggaagggtacacggaagacgagaaggtcgagatcgccgagcgccacctgatcgccaagcagattgacgcgcatggcctgaaggagggcgagttcacgcttaccaacgagggtctccgcgacctgatccgctactacacccgcgaggcgggcgtacgcacgctggagcgcgaggtcgcgaagctcgcccgcaagagcctgcgcaagatcctcgagggcaaggagacccaggtcaccatcaccccggagaatctcgcggactatgccggcgtgcggaagttccgcttcggcgtgggcgaggaggagcaccagatcggtgcggtcaccggcctcgcctggaccgaggtgggcggcgagctgctgaccatcgagagcgtgaccgtgcccggcaagggcgcgatcaagacgaccggcaagctcggcgacgtgatgaaggaatcggtggaagccgcgttcagcttcgttcgcgcgcgcagcccgagctacggcatcaagccgagcctgttcgcgcggaaggacatccacgtccacctgcccgaaggcgcggtgccgaaggatggtccgtcggcgggcatcggtctggttacctcgatcgtctcgacgctcaccggcgtggcggtccgcaaggacgtggcgatgaccggcgaagtgacgctgcgggggcgggtgctgccgatcggcggcctcaaggaaaagctcctcgcggcgctgcgcggcggtatcaagacggtgctgatcccggaggagaatgagaaagacctcgccgaaattcctgcgaacattcgcgaaggtctggagattgtcccggtttcgcacgtcgacgaggttttgcggcttgcattgaccgagccgcttaccgcaatcgactggtcggatgcggacgaactcgctacccagccgcccgccggcgtgccggcgatcgg

SEQ ID NO: 41563 - DNA, 1287 bp, SPHINGOMONAS
ctcggcggtgcggccctggcggctccggctgcggcacgggccggccccgggcagctggcccctaccccgccgatgggttggaacagctggaacagcttcgccaccacgatcaccgaggcacaggcactggagaccgccgccatccaggcgcgcgagctgctgccgttcggctacgacatctttaccatcgacatccaatggtacgagccggaagccaacagctacacctacaacgccaagccggtgccggcgatggacagccatggccggctgctgcccgcccccaaccggtttccgtcgtccacgaatggcaagggcttcgcacccatcgcggccaaggtccacgcactcggcatgaagttcggcgtccacctgatgcgcggcatcccccggctggcggtggaacgcaacctgccggtgctgggcgcgaacggcgtccgcgccgcggatatcgccgacaccacgagcatctgcccgtggaaccccgacatgtacggcgtcgacatgcgcaagccgggcgcacaggcctattatgacagcgtcttcgcactgctcgcctcctggggcgtcgacttcgtcaagatggacgacatgagccgcccctatgacgcgcatgcgccggaaatcgaggcggcggccaaggcgattcgcgcgaccgggcggccgatcctgctcagcctctcgcccggcgagacgccggtcccgcacgccgcccatgtcgcgcagcacgcccagatgtggcgcatctccgacgatttctgggacgactggaagatgctggaggcgcagttcacccggctggagaactggagcccccacgcccgccccggcgcctggcccgatgccgacatgctgccgctcggtcggctcgcgctcggccagcgcgacaccaagttcacgccggacgagcagcgcacgctgatgacgctctggggaatcgcccgctcgcccctgatcatgggcggtgacctgcgccacctagacgcccgcacccgcgcgctgctgaccaatcgcgaagtgctagcggtcaaccaggcgagcagcgggaaccggccctggttcgtcgccgacgatcgccgcgtgtggaccgcccgcgctgccacgggcggccactatgtcgcgctgttcaacaccggcgacaaggcgggtgaggccgcgttcgacctgcgcctgctcggcgcgacgggcaccgtgcgggtgcgcaacctgtcggagggcaaggtcgaggggacgagccccttgcggctcgcccgcacgctgccgccgcacggcgccggtctctacaag

SEQ ID NO: 41564 - DNA, 3051 bp, SPHINGOMONAS
gattgggaaaatccggcggtgttcgcacgcggcaagatgcccgccagcgccacccacttcccctatgagagccgcgccgccgccctggcgggcgatcccgcccggtcgagccgctatctgctgctcgacggccagtggcagttccacttctcgccctcgtcggacgcggtgccgcacgggttcgagaagccggactatgacgtcaccgcgtggaagcgcatcaaggtgcccgccgactggcaggccgagggcttcgaccaggcgcgctacaacaacatcacctatccctttccggcgaaccgcccgctgatcccccacgccaccaatccggtggggtcctatcgccgcgacgtgcagcttcccgcgacctggtccggacaggacgtgatcctccatatcggcgcggccggctccgcctatcgcgtctgggtgaacggcgtcgaggccggctactccgaggattccaagctgccgtcggagtttgatgtaaccaagctggtgcatgtaggccgcaataccgtggcgatccaggtacatcgctggtcggacggctcctatctggaggatcaggatttctggcgcgtctcgggcatcgaacgctcggtctatctggcggcggtgcccaaggcccgcgtggcggatctgtttgtccatgccgggctggacgccgcctacaaggacggcaaactctcgaccgagctgacgctcaccgatcgcaccgcgccgctcaccgcacggatgacgttactggatggtgacaagcccgtgctggtccgtgaggcggcgcttgccgccggcccggcgcagaagctgacgctcgccgctgacgtgggcggcgtgcgcccctggacggccgagacgcccaatctctacacgctgctcgtcgagctggtcgatgccgagggcaaggtggtgcaggccacgccgcagcgcatcggtttccgcacggtggagatcaggaacggcctggtcagcgtcaacggcaagccgatcacgatccgcggcgtcaaccgccacgagcatgatccggagacgttccacgtcgtcagccgcgcgtcgatggagcgcgacatccagctgatgaagcgggcgaacgtcaacgcgatccgcacctcgcactatccgaacgacccgtatctgtacgagctcgccgatcgctacggcctctacgtgatggacgaagcgaacatcgagagccacgcgtacatggactatgccaacaagcatggcgagcgtcgtgccgagctgcaggtcggcttcgatcctgcgtggaaggatgcgcatgtttcccgcgtcgtcaacatggtccagcgggacaagaatcacccctcggtgatcttctggtcgctgggcaacgaggcggggatcggcccgaacttcgaggcggcggccgcggcggccaaggcggtcgatccgggccggctggtctcctatctcggctggggcacctgggacgggatccaggatcatcggccgaactattatgccgacatctatgcgccgatgtacgatccggcggtgaagctggaggattacgccaccaactggaacttcaagcagccggtgatccagtgcgaatacgcccatatgatgggcaattcgggcggcaatctgaaggaatattgggacaccatctacgcccacccgaacaagctgcagggcggcttcgcctgggactgggtcgatcagtcgatgtaccggtacaccaaggacggcaaacgctattggggggacggcggcgagtacggcccgaacccgggtggtgacatcgagttcggggacggtctgctccagtcggatcgcacgccgaacccgcagctttacgagctgcgcaaggtctatgcgccgatccagttcgacggcttcgatgccgcggccggcacggtgacggtgcgcaaccgccacgacttccgcgacctgtccggcttcaccttcgagtgggaagtacaggaaaacggcgtcgcggtggcgaagggcgcgctggcgacgccggacgtggcggcgcacggggcgggcaccatcgcgttgccgctggcgggcctcgctcgcaagccgggcgccgagtatttcgtcacgatccgcgctcgggcaaaggccgatgccgtgccgctggtgccgggcgggacggtgatcggctgggagcagttcgcgctcgatccggcctatcgcacggccgaggtcgcggcgcccaagggcaaggtgacgacgcaggacgggcagggggcgatcacgctctcggccggcggcgccacgctggtggtgaaccgcgcgacgggcctcgtcgatcgctacgccgccaggggcaagacgctgctcagcggcggcgcaccgcatttctggcgcgcggtgacggacaacgacatcggcatcggcaccgacaagcagctcgccgcctggaaggggatgagccagacgcgcaccgtcgcctcggtgcaggtgcaggatctgggcgaggcaggcgccgaggtccgcgtcgcctatacgatgggcgcgggtgcggtgcgcttcaccagcgtctatcgcatggccggggacggctcggtcgcggtcgatggcaagttcgagccggtctccaagcagctgccgccgccgttccgcatcggcctcgccttcacgacgccgggcagcttcaagacggtcgaatggtatggccggggcccgcacgaaagctatgtcgaccgcaagacgtcggccccgatcgggctgtggcgcggcgcgatcgccgagcagaaccacgactatatccgcccgcaggaaaccggcaacaaggtcgatgtccgctggatggaactgatcgggggcggcgcgggcctgcgggtgcagggcgatgtgccgctgatgatgaccgcgctcgctttcccttatgccgatctcgaccggcatgtgcccggcacctggaagagcaccgatgtggtgcccaaggcgcagggcacgctgctggtcgacgccgcgcaatggggcgtcggcggcgacacccagtggagcgagttcggcaagccgctgctcaaatatcgcacccagctgatgcccatgtctcttcatttccgcctg

SEQ ID NO: 41565 - DNA, 1461 bp, SPHINGOMONAS
gtgacggtgcacggcgacaagccgggtgccaaatatgacaagcgcctgttcggccagttcgccgaacatctgggcaccggcatctatggcggcctttatgtcggcaccgacagcaagatccccaatgtgaagggctttcgccgcgacgtgatcgacgcgctcaaggcgatcaaggtgcccgtcatccgctggccgggcggctgcttcgccgatgagtatcactggcgggaaggcattggcccgaagtccaagcgcccggtgaaggtcaacaccaactggggtggggtgaccgaggacaatgccgtcggcaccaacgagttcatggacttcaccgaagtggtgggggccgagccctatgtctcgggcaatgtcggcaccgcgccgcccagcgagatggccgagtgggtcgagtacatgacctcgccgaccagctcgacaatcgccaaccagcgccgcgccaatggccgcgacaagccctggaagctgacgatgttcggcatcggcaacgagctgtggggctgcggcggcgacatgcacccggaatatgccgccgacgagacccgccgctacgccaccttcctcaaggtgcccgaaggccagaagctgatgaagatcgccagcggcgccaactcggccgactataactggaccgacgtgatgatgcgcaaggccggcgacaagatcgacggcatcggcgtgcattattacacggtgcccggaccgtggagcaagaagggggccgccaccggcttcgacgaggagagctgggcccgcacgctttccaagacgctcaagatggaagagctgctgaccgagcacggcaagatcatggacaagtatgatcccaagaagcgggtcgcgctgctcgtcgacgaatggggcacctggtacgatgtcgagccgggcaccaatccgggcttcctctaccagcagaacagcctgcgcgatgcgatggtcgcggcgctgaacttcaacatcttcgcggcgcatgcggaccgtgtgcgcggcgccaacatcgcgcagatggtcaatgtgctgcaggcgatgctgctgaccgacggcgccaagatggtgaagacgcccacctactgggtgttcgacctgtacaaggactatatggacggcacggtgctgccggtcgacgtgcagtcccgctggtacaacaaggatcagtggacgatgcgcgcggtcagcgccagcgccgtccgcggcaccgacggcgtcgtccatgtcggcctggtcaatgtcgatcccaaccagccggcgagcgtcagcgtcaagctggacggcgtggccggcacgcaggtggccggccgcatcctcaccggggcggcgatggacgcgcataacgacttcaaggcgcccgacgtcgtgaagccggcggcgttcaccggcgcgagcctgtcggccggcaccctgacggtgcaggtgcccgccaaggcgatcgtgatgctcgacatc

SEQ ID NO: 41566 - DNA, 2160 bp, SPHINGOMONAS
gccccagcgcaggcgcagaccgcgcagccgctgacactgcagcgcatcttcgcgagcccgtcgctggacggtcccgcaccccgcgcggtgcagctctcgccggacggcaagtatctgacgctgctgcggaaccgcgacgaggatcgcgagcgctacgatctctgggcgatggataccgccaacggccaatggcgcatgctggtcgattcgaagaagctgggttcgggcgccgaactctccgaagcggagaagatgcagcgcgagcgagcgcgcatcggcggtaccaagggcatcatcagctatgactgggcgccggacggccgctcgatcctggttccgctggacggcgagctgttccgcgcgcggctgacgggcgaaatcgacaagctgccggcggcggcgggacccaagctcaacgccgcgatcagcccggccggcaagttcgccagctatgtgcaggaccagaatcttgtcgtgatggacctggccagcggcaaggcgacgcgggtgacctcggatggtgcgggtacggtgcactggggcgaggcggaattcgtggcgcaggaggaaatggcccggagcgacggctattggtgggcgccgaacgacgcctatgtcgcggtcgagcggttcgacgaggcgccggtaggcatcgtcacccgcgccgcgatcggggccgagggcaccagcatcgtccagcagcgctatcccaaggcggggacgcccaatgccctggtcgagctctatgtgctcgaaccgaccgggcagaagcgggtcaaggtcgatctcgggccggaccgcgacatctacctggctcgcgtcgactggtcggcggacggcaagaccctgtatgtccagcggcagaaccgcgcgcagacccagctcgacctgctcgccgtcgatcccgcgaccggcaccgcgcgcgtgctgttcagcgagaaggcggcggccaagagctggatcaacctcagctacgggctgaagccgctcgacgacggcagcctgctctggtggtcggagcgggacgggcacggccatctctatcgctggcaggcgggcagcttcacccagctgaccaggggcgcctgggaagtcgcgcccgacggcatcagcgtcgaccagaaacgcggtcgcctctatttccagggcaacaaggacgacccgctcgagcggcacctctactggatcgattatcgcaagccgggcacgatcacccgcctcaccgagcggggatggtggaacacggccagcatggatgccagcggcacccgcgcgatcgtcagccgttcgaacgtcaaccagccccgccaggtctatctcgccgatgcggacggcaagcggatcgcctgggtacaggagaacgcggtcagcgatcccaagcacccgtacaatgcccatgtctcggcccatcgcgagcggaccttcggcacgatcaagggcccggacggcaccgaactgcactgggagatgatcacgcccaagctggagcccggcaagcgctaccccgtgttcttccagcattatggcggtccgcatgtgcagacggtcagccgcgcctggggtggcgcgctccagcaatatctggtgcagcacggctatatctggttccagatcgacaatcgcggttccgccaaccggggcgtcgcgttcgagagcgcgatctggcaggcgatgggcagcgtggaagtgcaggaccagctggccggcgccgcctatctcaagacgctgccgttcgtcgatccgaagcggatcgccatctatggctggtcctatggcggctacatgacgctcaagatgctggaggcggcgccgggtagcttcgccgccggcatctccggcgcgccggtgaccaagtgggaactttacgacacccattataccgaacgctacatgggcgatccgcgccaggtgccggaggcatacaaggcctcgagcacgctgggcgatgcgggcaggattgcggacccgctgctcatgatccacggcatgtccgacgacaatgtcgtgctcgacaacggcacggcgatgtatgccgcgctccagcagcagaaggtgccgttcgagatgatgctgtatccggggcagacgcaccgtgtcggcggccccggcatcagcgaacatctgtggggcacgatcctcaatttcctggatcgctcgctg

SEQ ID NO: 41567 - DNA, 1008 bp, SPHINGOMONAS
taccgtgtcgtcgtcgcaggcgccaccggcaatgtcggtcgcgaaatgctcaacatcctggccgagcgggaattcccgatcgacgatctcgccgtgctggcgtcgtcgcgctcgaccggcgacatggtggacttcggcgagacgggcaaacagtacaaggtccagaacatcgagcatttcgatcccaccggctgggacatggcgctgttcgccatcggatccgaaggcagcgcgatctacgcgcccaagttcgccgccgccggctgcacggtgatcgacaatgcctcgctctaccgcatggacccggacattccgctgatcgtgccggaagtgaacccggaggcgatcgacggctacaaggcgcgcaacatcatcgccaacccgaactgctcgaccgcgcagatggtggtggcgctcaagccgctgcacgatgccgccaagatcaagcgcgtggtggtcgcgacctaccagtcggtctccggcgcaggcaaggcgggcatggacgagctgttcaaccagagccgcgcgatcttcgtcggcgaccaggtcgagccgtccaagttcaccaagcagatcgcgttcaacgtgatcccgcacatcgacagcttcctcgacgacggctcgaccaaggaggagttcaagatggtcgccgaaaccaagaagatcctcgatcccaaggtgaaggtgaccgcgacctgcgtgcgcgtgccggtgttcgtcggccattcggaagcgatcaacatcgagttcgagaacgagatctcggccgaggaagcgcagaatatcctgcgcgaggcgccgggcatcatgctggtcgataagcgcgagaatggcggctacgtcaccccgatcgagtgcgtcggcgagtatgcgacctatgtcagccgcgtgcgcgaggattcgacggtggagaacggcctgtcgctgtggtgcgtctcggacaatctccgcaagggcgcggcgctcaacgcggtgcagatcgcggaactgctgggccgccgccacctg

SEQ ID NO: 41568 - DNA, 2640 bp, SPHINGOMONAS
gtgtaccgcttcggcggtggtgtttcggacggtggtgcgggggacaagtttctgctcggcggcaagggcgcgaaccttgccgagatggcctcgatcgggctgccggtgccgccgggcttcaccatctccacggcgatgtgcacgcgctattatgaggaaggcgagacctttcccgaaagcgtgaaggccgaagtcgcgaacggcatcgcccatatcgagggcatcacgggcaagaaattcggtgacgcggccgatccgctgctcgtctcggtccgctcgggcgcgcgggtgtcgatgcccggcatgatggacacggtgctcaacctcggcctcaacgaccggaccgtggaagggctggcggcgaccagcggcgacgatcgcttcgcctgggacagctatcgccgcttcatccagatgtatgccgatgtggtgctcggcctcgaccatggccggttcgaggaagcgctggagatcgccaaggaagatcgcggcttcacgctcgataccgagctgtcggccggcgatctccaggcgctggtcgccgagtacaaggcgatcgtcgaggagctgtggaacaagcctttcccgcaggacgtgcacgaccagctctggggcgcgatcggcgcggtgttcggatcgtggcagtcggagcgcgccaaggtctatcgccgcctgaacgacatcccggccgactggggcacggcggtgaacgtccaggcgatggtgttcggcaatatgggcgacacctcggcgacgggcgtggcgttcacccgcgatccttccaccggcgagcgggcttactacggcgagttcctgatcaacgcgcagggcgaggacgtcgtcgccggcatccgcacgccgcaatatctcaccaagcgcgcccgcgaggcggcaggcgccaagcccgcctcgatggaagaggcgatgcccgaggtctatggcgaactggcggcggtgttcgaccggctcgagacccattaccgcgacatgcaggacatcgagttcaccgtcgagcgcgccaaattgtggatgctccagacgcgcagcggcaagcgcaccgccaaggcggcgctcaagatcgcggtcgacatggccaatgaggggctggtcacgcgggaggaggcgatcctgcgcgtcgaccccgccgcgctcgaccagctgctccatccgacgctcgatcccaaggcgccgcgcgacgtgctgaccaagggcctgcccgccagcccaggcgcggcctcgggttacgcggtgttcgacagcgatacggcggagaagcgcgccaatgccggcgattcggtgatcctgatccgcgtcgagacgagcccggaggacatccacggcatgcacgcggcgcgcggcatcctcaccgcacgcggcggcatgaccagccatgcggcggtcgtggcgcgcggcatggggcggccttgcgtctcgggcgcgggcagcctctcgatcaacgcgcgcgacaaggtgatgcgtgtcggcacccgtgaggtccgcgagggcgacatggtgacgatcgacggcgccaccggcgaagtgatggccggccaggtgccgaccgtgcagcccgagctgtcgggcgatttcggcacgctgatgacctgggccgacgaagtccgccgcctgaaggtgcgcgccaatgccgagacgccgctcgactgccgcactgcgcgcgagttcggcgccgagggcgtcggcctgtgccgtaccgagcacatgttcttcgaacagagccgcatcaccgcggtgcgccagatgatcctcgccgaggacgagaccggccgccgcgctgcgctggagaagctgctgcccgaacagcgcagcgacttcctggagatcttcgaggtgatggccggcctgccggtgacgatccggctgctcgatccgccgctccacgaattcctgccgcacgaggaggccgagttcgccgaggtcgcgaccgcggcgggggtggacgtcgacacgctcaagcgccgcgcgggcgaactgcacgagttcaacccgatgctcggccatcgcggctgccgcctgggcgtgacctatcccgaaatctacgagatgcaggcgcgcgcgatcttcgaggcggcgatcgcggtggcggagaagtccggcgcggcgccggtgcccgaagtgatgatcccgctggtcggcacccgccgcgagctggagctgatgaaggcggtggtcgacaaggcggcgcaggcggtgttcgccgagaagggccgcacgatcgactatctggtcggcacgatgatcgagctgccccgcgccgcgctgatggcgggcgagatcgccgaggtcggcgccttcttctcgttcggcaccaacgatctcacccagaccacgctgggcgtgagccgcgacgatgcctcgcgcttcctgaccacctatgtcgagaagggcatctacgccaaggatccgttcgtcagcctggacgtggagggcgtcggccagctgatcgcgctcgccgccgagcgcggccgcgcgacccggcccgacatcaagctcggcatctgcggcgagcatggcggcgatccggcctcgatcgcgttctgcgagcagacggggctcgattatgtctcggcttcgccctatcgcgtgccgatcgcgcggctcgcggcagcgcaggcggccata

SEQ ID NO: 41569 - DNA, 789 bp, SPHINGOMONAS
atcctgttccagaccgggcgcggcgacgtgttcgaaaagtatctggagagcttcgcccactggcatgcccggggctggacggtctccgccttcgactggcgggggcagggcggctcgggtcggctgacgccgcgcggcgattgcggccatatcggcgacttcgcggcctatatcggcgacctgcgggcgttcgtggacgcgtggaaggcggagacgcccggtccgcacgtggtgatggggcattcgatgggcggccatctggtgctgcgcgggctggtcgatcgcgcgatcgcccccgatgcggccgtgctgatcgcgccgatgctgggcgtgcgcagtgcgctcgggcggatggcgccgacgatggcgcggctgctcgcgggcctcggcgacaagcgccgcccggcctggaaggggaacgaaaagccctacaccaccgagacgcgcgccaacctgctcacccatgatcccgatcgctatgccgacgagctgtggtggcaggcgcaggaccccgcgctgctgaccggcgccccctcctggcaatggctggtcgaggcgttccgttcgatggcggagctggaggccgggccgatcgaggcggtgcggacgccgttgctgctcctcgtcgccgatgcggacgggctggtcgacccgcgtgccgcgctccgcatcgccccgcgtctgcccgatgccgagctgctgcgcttcggccccgaaagcgcgcatgaaatcctccgcgaggccgatccggtgcgcagccgcgcgctgggcgcgatcgacggctttctc

SEQ ID NO: 41570 - DNA, 2271 bp, SPHINGOMONAS
cgcaccctgtacgagaagatctgggccgaccatgtcgtcgagcgccgggacgatggcacctgcctgatctatatcgatcggcacctcgtccacgaagtcaccagcccgcaggcctttgccggccttcgcgcggcggatcgcaaggtgcgtcgtcccgatcttaccctcgcggtgcccgatcacaacctgccgaccaccccgcgcgtcgatgccgccggcaacgcgttaccgatcgcggactctgccagcgccggccagctctccgcgttgcgcggcaatgtcgccgagttcggcgtgccctatatcgatgcgctcgatgcgcggcaggggatcgtccatgtcgtcgggcccgaacagggcttcaccctgcccggcaccacgctggtgtgcggcgacagccacacctcggcgcacggcgcgctcggcgcgctggcattcggcatcggcaccagcgaggtggagcatgtgctcgccacgcagacgctgctgctcaagcaatcgaagacgatggaagtccgcgtcgacggcacgctcggccacggggtcagcgccaaggacgtggtgctggcgatcatcggcaagatcggcgcggccggcggcaccggctatgtcatcgaattcaccggcgaggtgatccgcaacctctcgatcgaggggcggctgacgatctccaacatgtcgatcgagggcggcgcgcgttcgggcctgatcgcgccggacgaaaagaccttcgcctatctcaagggccgcccgctcgctcccaccggcgaggcatgggaccgcgccgtcgcctattggaagacgctgccgaccgataggcacgcggtgtacgacaaggtggtgacgctggacgcggccgacatcgcgccctcgctcacctggggcaccagccccgaggacgtggtgccgatcaccggcgtcgtccccgatccgcagagcttcgacgatccctcgaagcgcgccgccgcgcagcgctcgctcgactatatgggcctcacccccggcaccgcgatgcaggacattccggtggagcacatcttcataggatcgtgcaccaacagccggatcgaggacctgcgcgccgccgccgcggtggtgcagggccgcaaggtggccgaccgcatcccccaggcgctgatcgtgccgggctcgggactggtcaagcgccaggccgaggaagaggggctcgaccgcattttcctggaagcgggcttccagtggcgcgagccgggctgctcgatgtgcctggcgatgaacccggacaaggttcccgccggagaacgttgtgcttccacttcgaatcgcaactttgaagggcgccagggcgccgggatcgcgcacccacctcgtcagcccggcgatggcggcggctgcggcggtgaccgggcacctgacggacgttcgcgcgttgatggcggaccaggcgtaatagtgaaggggagagacgccgtgaaaaaggcgctcgtcgcattgattgccggaacgatcctgagcggtgtcgccgcggcctatgcgggtgcctatccgcggccggagacgccgatcaagaccatcccggcgctcgagcggaccgtcgtcgcaccgcgctgacgcgggcggccgattgccggaaattggggatggccgccggccattcgttaggaaagctgtgtccatgtatctgaacaccgtgtcggcggagcgccgctgatggagccgatccagcaggtttcgggccgcgcctatccctggggcgccaagaacatcgatacggatatcatcatccccgcgcactggctgaagaccacgacgcgcgaggggctgggcaagggcgcgttcgagagcgtgcgcgcggagccggggaacctgttcgacgatccccgctatgcaggcgcgccgatcctggtggcgggcgagaatttcggctgcggctccagccgcgagcatgccgcctgggcgctggcggacatgggcatccaggcggtgatcgcgccgagcttctcggacatcttctcgggcaacgccttcaagaacggcatcgtcaccgtggtgctgccgcaggaggcgatcgaccggctggtgcaggtggcgacggccaacgaaatcaccgtcgacctggagacgatgaccgtcaccaccgacttccaggatcgcttcgccttcgaactcgacccgttccgccgcgactgcctgatgcaggggctggacgagatcggcatgacgctggcacaagataccgcgatttcgaaattcgaatccgcggttgcgcatgaacgcccgtggatcgctgta

SEQ ID NO: 41571 - DNA, 1374 bp, SPHINGOMONAS
atggcgatcgaactcaagatgccggcgctctcgccgaccatggaagagggcacgctcgccaagtggctcgtcaaggaaggcgacgtcgtgaagtccggcgacatcctcgccgagatcgagaccgacaaggcgacgatggaattcgaagccgtcgacgaaggcacgatcgcccagatcctggtcgccgaaggcacggacaacgtgaaggtcggcaccgtgatcgcgatgatcgcgggcgagggcgaggacgcctcgacggcggccgccgcaccggcccccgccagcgagccggccccggcccccaccgaaaaggcaccggaaaccggcaccgctcagctgaccgccgcagtcgagaagacgcggcccgccgatcccgccgtgcccgccggcaccgagatggtgaagaccaccgtccgcgaagcgctgcgcgacgcgatggccgaggaaatgcgcgccgatccgcgcatcttcgtgatgggcgaggaagttgccgagtatcagggcgcctacaaggtgacccagggcctgctcgacgaattcggccccaagcgcgtcatcgacacgccgatcaccgaatatggctttgccggcgtcggcaccggtgctgcgatgggcggcctgaagccgatcatcgagttcatgacgttcaacttcgccatgcaggcgatcgaccacatcatcaactcggcggccaagaccaactacatgtccggcggccagatgcgctgcccgatcgtgttccgcggtcccaacggcgcggccagccgcgtcggcgcgcagcacagccagaactacggcccgtggtacgccagcgttcccggcctgatcgtgatcgcgccctatgacgcggccgatgccaagggcctgatgaaggcggcgatccgttcggaagacccggtcgtattcctcgagaacgagctgatgtacggtcgcagcttcgacgtgccgaagctcgacgactatgtcctgccgatcggcaaggcccgcatcatgcgcgagggcaaggacgtgacgctggtcagctactcgatcggcgtgggcgtctcgctcgaagcggcagagaagctggcggccgagggcatcgatgccgaggtgatcgacctgcgcacgctgcgtccgctcgacaagcagaccgtgctggagagcctgaagaagaccaaccgcatcgtggtggtcgaggaaggctggccggtctgctcgatcgcgtcggaggtcgccgcgttcgtgatggaagagggcttcgacgacctcgacgcgccggtgctgcgcgtcaccaacgaggacgtgccgctgccctacgccgcgaacctggaaaagctcgccctggtgaacgccgacaaggtggtcgccgtggtgaagaaggtcacctatcgc

SEQ ID NO: 41572 - DNA, 1026 bp, SPHINGOMONAS
aaagcaccgaccccacccgcaatcccgaatcgcgagcgcccggccgaaccggaacggttcaaggcttcgaaggagcagctgctcgaattctatcgccagatgctgctgatccgccgcttcgaagagaaggcgggccagctctacggcctcggcttcatcggcggcttctgccacctctacatcggccaggaagccgttgcggtgggcctgcagtcggcgctggacggcgagaaggactcggtgatcaccggctatcgcgaccatggccacatgctcgcctacggcatcgaccccaaggtgatcatggccgagctgaccggccgcggcgcgggtatctcgcgcggcaagggcggctcgatgcacatgttctcgaccgagaagaagttctacggcggccacggcatcgtcggcgcgcaggtctcgctcggcacgggcctcgccttcgcgcacaagtataacgaggatggcggcgtcgccatggcctatttcggcgacggcgccgcgaaccagggccaggtgtacgaatcgttcaacatggccgagctgtggaagctcccgatcatctatgtgatcgagaacaaccagtatgccatgggtaccagcgtcaaccgctcctcggccgaagaccagctgtacaagcgcggcgagagcttccgcatcccgggcatccaggtggacggcatggacgtgctcgcctgccgcggtgcggcggaagaggcgctcgcctgggtgcgcgccggcaagggcccggtcatcctcgagatgaagacctatcgctatcgcggccactcgatgtccgatccggccaagtatcgcagccgcgaggaagtccagtcggttcgcgacaagtcggacccgatcgaggcggtgaagcgcgagctcgagacgatgggcgtcaccgaagagcagctgaagccgctcgaggccgagatccgcaagatcgtgaacgaatcggcggacttcgccgaacagacgccggagcccgatccggccgaactctataccgacgtactggtggagacctac

SEQ ID NO: 41573 - DNA, 1278 bp, SPHINGOMONAS
gtgaccgcaatcatcgacgtccacgcccgccagattctcgacagccgtggcaatcccacggtggaagtggatgtcctgctggacgatggcagcttcggccgcgccgccgtgccctcgggcgcctccaccggcgcccatgaggccgtcgaaaagcgcgacggcgacaagtcccgctggctcggcaagggcgtcgagggcgccgtcgatgcggtgaacggtgagattgccgaggccgtcgtcggcctcgacgccgaagaccaggccgatctcgaccgcaccatgatcgagctcgacggcaccgccaacaagggccgcctgggcgccaacgccatcctcggcgtcagcctcgccgccgccaaggctgcggccgatgcccgcggcctgccgctctatcgctatgtcggcggcgtcaacgcccatgtcctgccggtgccgatgatgaacatcatcaacggcggcgagcatgccgacaacccgatcgacttccaggaattcatgatcgtgccggtcggggccgagaacatcgtcgaggcggtgcgctgcggttcggaaatcttccacacgctgaagaagaagctgcacgaaaagggcttggcgaccggcgtgggcgacgagggcggcttcgccccgaacatcgcctcgaccaccgaagcgctcgacttcatcatggcgagcatcgaggctgcgggctacaagccgggcgacgacgtgatgctcgcgctcgactgcgccgccaccgaatatttcaaggacggcgcctacgagatggtgggcgagggcaagacgctctcctcgatccagaatgccgagttcctggccaagctcgccgccgactatccgatcttctcgatcgaggacggcatggccgaggacgatttcgaaggctggaaggcgctgaccgacctgatcggcggcaaggtgcagctggtcggcgacgatctgttcgtgaccaacccggagcgcctcgccatgggcatcgagaagggcctggccaactcgctgctcgtcaaggtcaaccagatcggcacgctgaccgagacgctggaggccgtcagcctcgcccagcgttcgtcctacaccgcggtcatgtcgcaccgttcgggcgagaccgaggacgcgacgatcgccgacctcgcggtcgccaccaactgcggccagatcaagaccggcagcctcgcgcgctcggaccggctcgccaagtacaaccagctgatccgtatcgaggaagagctgggcgacgcggcggtctatgccggccgttcggtgctgcgccgcgcc

SEQ ID NO: 41574 - DNA, 1596 bp, SPHINGOMONAS
cgtcaatcgcgccatggtcttggcgaacaggggatcgtcacctcggcgaccctgcactggaacctgattaccgcaccgctggtggagcacgcgatccgtcgcggagagggcagcctggccgccgaaggtcccctggtcgttgctaccggcaagcataccggccgttcggccaaggacaagttcatcatccgcgatgccgagaccgagaccagcgtctggtggggcaagaccaaccaggcgatgacgccggcgcatttcgccgcgctcaaggccgatttccttgccgagttggccacgcgcgacgagctgttcgtggccgacctctatggcggttcgcaggccgagcaccgcgtgcaggtgcgtgtgatcaacgaactcgcctggcacaatctgttcatccgcacgctgctggttcggcctgcagcggacgcgttggcggatttcgtgcccgactacaccatcatcgacctgccgagcttccgcgccgatcctgcgcgccacggcacgcgcggtgagacggtgatcgcggtcaatttcagcgaaaagctgatcctgatcggcggcaccgcctatgccggcgagatgaagaagagcgtgttcggcctgctcaactatctgctgcccgaacagggcatcatgccgatgcactgctcggccaatatcggccccaagggcgataccgcgatcttcttcggcctgtccggcaccggcaagacgacgctctcggccgatgcgtcccgcacgctgatcggcgacgacgagcatggctggtcggacaccgcggtcttcaacttcgaaggcggctgctatgccaagatgatccgcctttcggccgaggccgagccggaaatcttcgccaccaccaagcgcttcggcacggtgctggaaaatgtggtgatggatccggcaacccggacgctggacctcgacgatgcgagcctcgccgagaacagccgcggctcctatccgatcgatttcatccccaacgcctcggcggacaatctcgggccggtgccgaagaacatgatcttcctcaccgccgatgcctatggcgtgctcccgccgatcgcgcggctgacccccgaacaggcgatgtaccatttcctctcgggctataccgcgcgggtggcgggaaccgagatcggcgtgaccgagcccgaggcgaccttctccacctgcttcggcgcgccgttcatgccgcggcatccgtcggtctatggcaacctgctcaagaagcggatcgcggaagggaatgtcgcctgctggctggtcaacaccggctggaccggcggcaaatacggcatcggccaccgcatgccgatcaaggcgacccgcgcgctgctcaatgccgcgctcgacggcagtctgaaccaggccgagttccgccgcgatcccaccttcggcttcgaagtgccggtcgcggtgccgggcgtcgattcggccatcctcgacccgcgcgagacgtggccggacaaggccgactatgacgcgactgccgagaagctcgtcgaccagttcgtcgagaatttcacgcagttcgaggatcatgtggaggccggcgtccgcgctgcggctcccagggcgcgggcgctcgcc

SEQ ID NO: 41575 - DNA, 1170 bp, SPHINGOMONAS
atgaccgacgtcgtgatcaccgccgccaagcgtaccccggtgggcagcttcctcggcgccttcgccgccacccccgcgcacgagctgggccgcgtcgcgatcgaggcagccctcgccgaagccggcgtgaagggcgaggaagtctccgaagtcattctcgggcaggtgctcaccgccgcgcaggggcagaacccggcccgccaggcgtcgatgaacgccggcgtgccgaaggaagtgccggcatggagcgtgcagcaggtctgcggttcgggcctgcgcgcggtggcgctcggcttccagtcgatccgcaacggcgacgcgacgatcatcgtcgccggtggccaggaatcgatgtcgatgagcccgcacgcccagtcgctgcgccccggcaccaagatgggcgacctgagcctggtcgatacgatgatcaaggacggcctgaccgacgtgttcaacggctatcacatgggcatcaccgcggagaacctggccgagcagtatcaggtgacccgcgccgagcaggacagcttcgccgtccgctcgcagaacctcgccgagaaggcgcgggcagacggtcgcttcaaggacgagatcgcacccgtgacgatcaagacccgcaagggcgagacgattgtcgcggacgacgaatatatccgcgcgggtgcgaccgtcgacggcgtgtccggcctgaagccggccttcaagaaggacggcaccgtcaccgccgccaacgcctcgggcctcaatgacggcgccgcggcgctcgtcctgatgagccgcgaggaagccgagaagcgcggcgcgccgatcctcgccacgatcaagagctgggcgagcaccggcgtcgatccgtcgatcatgggcatcggcccggtgaccgccagccgcaaggcgctggaaaaggccggctggtcggtcgccgacctcgacctgatcgaggcgaacgaggcgttcgcggcgcaggcgctgtcggtcggcaaggaactcggctgggacgcggacaaagtgaacgtgaacggcggcgcgatcgccatcggccacccgatcggcgcctcgggcgcgcgcatcctgacgacgctcgtccatgagatgaacaagcgcgacgccaagaagggtctcgccacgctctgcatcggcggcggcatgggcatcgcgctctgcatcgagcgc

SEQ ID NO: 41576 - DNA, 2345 bp, SPHINGOMONAS
ccgccgcgagcagcgccggggaaacgcgccccccgaccagcaccgcgttgacatagtcgagcccgcgccgcgccgcgccgtcgaatgccgccggcgcgacataggtggagaccacgcggatccggccgctctcctgcgagaacaggccgaagctggtgccggaggtcaccacctgggtgaagctgccggagatgccgccggtcgcggtgatcaggtcgagcaccgtgcccggcgtgacgttgccggtctgcacgatctgcaatgtcgccccgctggcgatcgagacctgcccgttcaccgccagccggtccgacgcggtcggcgtcagctcgaacagcgcggtcgacgtgcccgcgagcgcgacattgccgttcaccgtcatcgtgcccggcgatgcgccggggctgagcgtgccggcgaccgcgacattgccgttgaccgtgcccgccgaaccgaaggtcgcgcccgccgccaccgtgatggtcggcgcggtgatcgtcgagccggcgagaccgacgaagcgcccgccggccagctgcacgtcggcaaaggttgcggtccccgccagcgtcgcgaagccgccgttcatccgcagggtttccatgttgaccacatcgccgagcgcgatccccgcgccggtcgcggtgccggcaatctcgagccgatcggtgcccgctccgccatcgatgcgcggattggtcgcgccgtcgcgcagcaccacgcggtcatcccccgcgccgagcgacagggcacccatggccccggcattgtcgaccagatcggtcccggcatcgagcagggtcgcgccggtgatcgtgccggtgttggtgagcgtgaatgcgtccttccccgatgcgacgatcgccgcggcaccggggccggtcgcggtgatgcggccggcattggtgatggtcagcgtcgtgtcggtggcgagcagggcgacggcgttggtaccggtcgcggagatcgtgccgccggcctggttggtcagcgtaccgctggtcgcgccgcgcgggctcgcgatccgcacgccgcgcgccgccacctccggtgcggtcgcgctgccgctcgcggcgatgctgccgctgttctgcagcgcataggtgatcggccggtcgcccgctgtcaggcgcaggtccacgcccacggcccgcagcccatcggcaacgatcgtgccgctgttggccagcgataccgtgccgaccgtcgccgtccccgcgccgatgtccgccgtcaacgcgcgcgcggtgccggtgcccgccgtcgcccgcagcgtgccgctgttggtgatcgtcgctgcgcccgccgcgtcgagagcggtgaacgaggccgtcgcgtagagcccgccctcgatcgtgccgctgttcgctgccgtcagcatgtcataggcgccgagcaccgccatgccgctattcgcctcccccgcggcgatgcggccggtgttggtgaaggacaagggcgcgtagttgtagacgctcaccgccgggccggtcagccctgcgccgccgatcgtgccgttgttcgtcatcgcggccgtcatgccgtagaccgatccgccgatcgtgcccgcattggtgaaaccggcgagcggaacggcatcgccctcggcgaacagggtgctccggatcagcgacaccgatcccgcgatcgtcgcccggctgatcaccgcgccgtcgcccatcacccgcagatcggcatagcggctgtcgagcccggtcagggttaccgtggtggtgctgccgatcgccgcgacggccgctgcggtgaacccgctggtcggggcggcgccgatcgcgaccgaaccgctggtggtgagggcgcggccgaaggtgccgtcactgacggtgatgcgcccgctcacccccgtgctatcccccgcctgcagcaacgtcccgccgctgccgagcgcgaggttgccggcaagcgtgccgccattggcgaaatagatgccgttatatccgagcgacacatcgccctggatcacgcccgcattgttgatgcggccgccatcgagccgaatggcgccctggccgaaccggccgccgctggacgtgatcgtgccggtattgacgacgactccgccatagaagctcgtgatggcggggccgctggtctggatggtgccgttgttgacgacccggaaggcgttgacgatcccgttggattcgcgcgtgccggtctggatgatcgtcccgttgttggtgacggtgccgaccccggaggtaccgtagctgccgtcgagttcgatgcggccgttgttgatcagcgcgtcgccgccgaccaccgcggcgttgtagctgtcgcccccgttggtggcggtgtagagcgcgcggatcgtgccctga

SEQ ID NO: 41577 - DNA, 3256 bp, SPHINGOMONAS
ccgtgagggggcttcatgaagggttacgtacggtcggacacgcacgtctcgctgcttgcgaaggcggggcgcctggggggtgtggttctcgcagcggccctgggaaccgcgctgttcgcgcctggggcggcgcaggcgcagagcctgggttgccaatcggtcaacgatggatcgatcaacttcaccgccaggtttgtcgccggggatccgcgccagtcggaaacgacctcgcgaaccgcgactagtaccgcggcgctttccgtgatcgctgcggcagctggctacagcgataacatttccaccaacatggtccccggcatcaaccccttcacgcccggcgacaggctcgacttcacggccgtggtcagccagtatagcggcagcgccggcatgcgcatccgcttccgggtgaacaacagctatgtcggcctccccgcgggggcgcgggtcacgccggacccgaccggcaccggcacctttaccggctattacaatgtgccgagcggcctgcagggcgtcggcatgacggtcgatcatctcggctcgacctcgaacagcctgaccgacgtcaccgtcacctgtacgccctacatcgattcgaacctttcgctcggcgtcacgatgacgcactcgggcacgccgcagcagggcgggacggtcgactataccatcacgcccagcgccagcggtgcgaacaccggcaccaacgtcacgctcaccttcagcctgccatcgggcctcagctacaattccggctcgggctcgggctggagctgcacgtccacccgctgcctgtacaccaacacgatcgccaacggcgccagcggtaatccgctcaccctgcggctcaacatcgcgagcaacgccgcgacgagcctgacgcccagcgtcacgctgtcgggcggcaatgccggaagttccgcatccgcaagcgatccgacctccatcgcggtggtgcagatacccgcctcggtggcgatcgcgaccggtgccaaccagacggcctcgacgaacacggtgttcgccaccccgctgagcgtcacggtgcgcgacggctcgaacgcggtgataccgaacacctcgggtcaccttcaccgcaccggcatccggcgccagcggcaccttctcgaacggcagcaacagcatcaccgtcacgaccgacggttcagggatcgcaaacgccggcagcttcaccgccaacggcagcggcggtgcatattcggtgaacgccacggcgggatccgtattcgccaccttcagcctgaccaacaatctcgtcacggtgcccagcgtcaccggtctctcgccgaccacgggtccgaccggcggcgggacgacggtggtgatcaccggcacggggcttgccggcgcgaccggcgtcagcttcggcggcacggccgcggccggcttcaccgtggacagcgcgacccagatcaccgcgacgtctccggcggcgagcgcgggcacggtgaacgtgaccgtcacgacccccagcggcaccagttccacgggcgcgtcgaaccagttcacctatgcggtgcccccgacgacaccgacgctgacctcgacgcctgcgacgctcaccaacagcacgagcgcgaccttccagttcagcctggcgagcggcacgggcgaatgctcgatcgacggcggagccttcaccagctgcaccagccccagaacctatacgggactgtccgacggcagccacagcttccaggtccgtgccaccagcggcggtggtacgagcgcagccgccagctacagctggacggtggacacgaccgcgccgagcgcgccgatcgttacgactccggccaatgcttcggagcgcgtcgtcaccaaccgtgcgaccagcggaaccagcgaagccaatgcgacgatcacggtctatctggacggcagcgccgatggcacgaccaccgcggatggcagcggcaactggacctacacgctgaccgcgctcagcgcggctgcccataccatcaaggcgcgcgcgacggacgcggccggcaacacctccgtcgattcgagcacccggtcgttcaccgcctacagcgaacttgcggtcacgcaggtgtccacctcgatcaccgccacgatgaacaccaccagcttcagcgcgacccgcccggtcaccgcatccggcggcaaggccccgctcgcctatgcgatcagtggcggcacgttgccgacgggggtgacgttcgacacgtccaatggcgggttgaacggcacgccgaccagcgtcctcgccgcgacggacttcacgatcacggtgaccgattcgatcgggcaggccagcagcaagatcgtgcgtctggccgtcaattccgaccgcggccagatcgtcgccttcacctccaccgcaccgggatcggcgcgggtgggcggcacgacctatacggtgacggcgggatccagctcgggcctcacggttgcgttgaccatcgactcggccagcagcggcgtgtgttcgatctcgggcagcacggtcagcttccttggcgtcggcacctgcacgatcaacgccaatcaggcgggcaacggcagctatgatccggcgccgcaggtgcaacagagcttcgccgtggcgcaaggcacgcagtcgatcagcttcacctcgacggcgccgagcgccgcggtggcgggcggcgcgagctacaccccggccgcgaccgcgacctcgggcctggccgtagccttcaccatcgacccgtcgagcagcgcggtgtgcgccatctcgggcggggcggtgagcttcaccggcgtgggcagctgccgggtcaacgccaaccaggccggcaataccgactataccgccgcggcccaggtgcagcagagctttgcggtgggcatcggcacccagacgatcggcttcacctcgacggcgccgagcgcggcggcggtgggcggcgcgacctacacgccggccgcaaccgccacctcgggcctcgcggtcgccttcacggtcgacaccagcagcggcagcgtctgcacgatctcgggcggagcggtgagcttcaccggcgtcggcacctgcacgatcaacgccaaccaggccggcaataccgactataccgccgcgccccaggtccagcagagcttcgccgtcgggcgcggcagccagaccatcatcttctccgcgctgccggacgtggcgatcaccgcatcgccggtgacgctcaatgcgacggcggggtccgggctgccggtcagcttcaccagcagcacgggcacgatctgcaccgtctcc

SEQ ID NO: 41578 - DNA, 1494 bp, SPHINGOMONAS
cgggtgggtcgcctgtcgttgccctaccgggcgtcgctggcactcatgctggtgggcaacctgctggctgcaagcgccgggctcgcgcttccccatttgctgggagaagccgtcgatcagctctccagaccgggccagggcccagcctcgctggtccggcttgcgatgctgcttgccgcggcagtggcggcccgcggcctgttccagatgctggccagcttctctggcgagcgggtagggcagctggtcgcgcgggacctgcggctcgcctatttcgatgcgctgcagaggctcggccacgggttccacgacgcgatcgatcctggtgatctgatcacgcgcggcatgctcgatatcgaaggggtacgcggcttcatcgaaatgggggtgcagcggttgctgcagatcaccttgctcaccaccgcgggcgcggtggtgctcgtcgctgccgatccggtgatggcggtggcgacgcttgcctgcgtgccgctgatcgcctggcgggccggacgcatgggattgcagctgcgaatcgcatggacgcggctgcagcgcgaaatggcggtgctaacccgcgtgatggaggaaaatctgcacgggtcgcgcgtcgtccgcgccttttcggcgaccgcgcatgaactgtcgcggttcgatgcggcgtccgggcgcgcgctcgcgctgtccgatgatcgcatccgcgtccgtgcccgtgcgatggcgtcgatcaacgccagcttctacgccgcgatgctcgcggtgctgggcgtcggcgcttggcgaatcgaagcgggcatgctgacgctgggcgaactgacgttgtgcctcgccttcatgaccgtgctgcagctgccggtgcggcagatgagcatggtgatgaactcggccgcacgcgccgtctcgtccgggcagcgggtgttcgatatcctggatcgctcgcctgtcgtcgacgacacagaggcaacgcagcaattgccggcgcaggactgggcactggtcttcgaccgcgtccggtttcgccatgccgcggacgggccctgggtgctggacgacatttccttcacgctgtcgccgggccgcaccttggggatcgtcggcgcatccgggtcgggcaagagcacgatcgcggcgctcgccgcccggctctacgatcccgatgcggggcgggtgacgctcggggggatcgatctccgcgacgccagcctctcggcagtgcgcgggacggtgcatgtcgtgcagcaggatctgttcctgttcgacgacgccgcgcgccggaacatcgattatgcgcgcccagatatcggccaggcggcggtacgcgatgctgcagcagtggcgcagctggacgaccatgtcgccaggctgcccgaggggtacgacactcgggtcggcgaacgcggttcggcgctctccggcgggcagcgtcagcgcatgacgatcgcgcgcggcctgatcgccgatccacggatcctgatccttgacgatgcggcctcggca

SEQ ID NO: 41579 - DNA, 1125 bp, SPHINGOMONAS
atcgcgaccgcggttgcgctcgcccgctggctgcgccaggacagcatcgcacgcgaccgcgagcgtccagttccgtacacagaaacagagcgcctggcacgcagcggcttgctggcgatcaccgttccggcggcgcatggcggggcggacgttccctggtcgaccgttgtcgaggttatccgcatcctttcaaccggcgacggcgcgatcgggcagttgccgcagaaccatttcctcttcgtcgaggcggtgcgcgaggacggcgacggggcgcagcaggcgctgttcttcggcgagctgctgcgcggcgcccggttcggcaatgcccaggcggagcgcgggtcgtcttccgccgtcgaccttcggacacggctcgtggccgaaggcgacgggttccgcctgagcggcaccaaatattactgcaccggcgcgatcgtcgcggactggatcccggtggcagcgatcgatgccgagggccggcaggtgctcgcctatgtcaagcggaacgcacccggggtggaggtacgcccagactggaatgccttcgggcagaagaccacgttcagcggcacggcggttttcgaccaggtccaggtgccagcgatccaggtcctttcgcactggcgtctgttcgagcgcaccaatgccttccatccctatggcgtactgctccatgcggccgtggacgtcgggatcgcccgggccgccttcgacgacacggtcgcgctggtgaaggcgcgaaccagaccgcgtcttggagcgcaggctgcgagctcgcgagaggacgtgctgatccaggccaagctgggtgcactctccaccgaactcgccgcgctcgaagcgctgctggcgcacgccgcagaggcgctcgatcgcgcgcgcttttcaggagaggacaggttcgtggcggaagcggcgaccctcgccttcggcaccaaggcgctggcggaggaagtcggtctcgccatcgcgagcgcgctattccccctggtcggtaccgcctccaccgatgcctcgctggggctcgatcggcactggcgcaatctgcgggtccatagcgttcacgatgcgaatgactggcgctatgtccaggttggggattgggtggtgcatgggagagccccc

SEQ ID NO: 41580 - DNA, 624 bp, SPHINGOMONAS
atgtcgctcaagattctcgacaccttccccgacttcacccaggaatcgacgcagggcccgctcaacttctacgactgggcaggcgacagctgggtcgtgctcttctcgcatcccaaggatttcaccccggtctgcaccaccgaactgggcgcggtcgcgaagctgaagcccgagttcgacaagcggaacgtcaaggcgatcggcctctcggtcgatgcggtcgcccagcacctcgcctgggccggtgacatcgagcggacgcaaggcacgacgctcaacttcccgctgatcgccgatgtcgatcgccgcgtggcgacgctgctcgacctgatccaccccaatgcctcggacaccaacaccgtgcgcagcgtgttcgtggtcgatccggccaagcgggtgcgcctcaccctcacctaccccgcctcgaccggccgcaacttcgacgagctgctgcgcacgatcgacagcctgcagctgaccgatgcgcacaaggtcgcgaccccggccgactggcgccaaggcgacgacgtgatcattctgccctcgcttggtgccgacgaggccaaggcggtgttcccggccggctggaccgagcacaccccctatctgcgcaccgtgccgcag

SEQ ID NO: 41581 - DNA, 1935 bp, SPHINGOMONAS
ggcttcgacatcgccggcatggatcgcagcgtgaagccgggcgacgactggtaccgcttcgtcaacggcagctggatggatcgcaccaagatccccgacgaccgctcgtccttcggcgccttcgcggtgctgcgcgacctttccgagatgcggctgcggaccctgatcgaaggctatcagccgaccgacaccgcccatcccgaccgccgcaaggcagcgatcctctatcgcggcttcctcgacgaggcggcgatcgagaggctcgacgccaagccgcttctccagcggctccagcctctcaaggccgccaagaccaaggccgaactggcgcgcctgatgggtgcctcgatcggtgggttcggcgccagcttcttcggcgtgggcgtcagcgacgatgccaagcagcccgatgtctatgcgctctatctgcgccagtcgggcctcggtctgggcgatcgcgacctctatctcgacgcgaagttcgcgccccaggtcgcccgctaccgccagtacgtcgcgcagctgctcggcatggccggctggccggacgcggccgccgcggccgacaaggtcgtcgcgatggaaacccgcatcgcccaggcgcactggacccgcgcccagagccgggatcgcgacaagacctacaacccggtgaccgtcgccgcgctgaaggcgcaagcgcccggcttcgcctgggatccgttctggcaggccgccggcctcaccaaggccagccgggtgatcgtggcgcagaacagcgcggtgccgaagatcgcacaggtcttcgccgacaccgatctcgcgacgctcaaggcatgggaagccttccggatcgcggacgatatctcgccgatgctgtcgaagcgcttcgccgatgcgcagttcgatttccgctccaagttcatgaacggccagcccaaggagcgcgagcgctggaagcgcgccgtctccttcaccgagcgggcgatcggcgagggcgtcggccgcgactatgtcgcgctctatttcccgcccgagagcaaggccaagatggacgttctcgtcggcaacctccgcgtcgcgctggcgggtcgcatcaagaacctcgcctggatgagcccggcgaccaaggagcaggcgctcgccaagctgcagggcttcacggtcaaggtcggctatccgacaaagtggcgcgactattcgaagctggacgtgcgccccggcgatctggtcggcaatgccgagcgtgccggcaggttcgagtgggactatcgccgcaaccggctgggcggcccggtcgacaaggccgagtggggcatgacgccgcagacggtcaacgcctattacaactcggtcaagaacgagatcgtgttcccggcggcgatcctgcagccgcctttcttcgatcccaaggccgacgatgcggtcaattatggcggcatcggcggggtgatcgggcacgagatcagccatggtttcgacgaccagggccgcaagtccgacggcaacggcgtgctgcgcgactggtggacgccggaggatgcaaccaagttcgaggcgcaggcggtgcggctgggtgcccagtacgaggcctacagtttcgaggggctgcccggcctgcacatcaacggccgtgcctcgatgggcgagaatatcggcgatctgggcggcgtgctgatcgcgctcgacgcctatcacgcgtcgctcggcggcaagcccgcgcccgtgctcgacggcttcaccggcgaccagcgcttcttcctcggctggggccaggtgtggcgaacgctgttccgcaacgaggcgctgcgccagcagctggtcagcgatccgcactcgccggggcagatccgcgcggtcaacccgctgcgtaacgtcgatgcctggtacgccgcgtggaacatcgatcccagccagaagcaatatgtcgcgccggaagaccgcgtccgcatctgg

SEQ ID NO: 41582 - DNA, 1350 bp, SPHINGOMONAS
atgttgttcaaagacctcggcctttccgagactgtccttgctgcgctttcggcgaagggctacaatgaagctacgccgatccaggcgcagtcgatccccgcgctgctcgaaggccgcgacctgctcggcatcgcccagaccggcaccggcaagaccgccgcgttcatgctcccctcgatcgaccgcctcgtcgccagcggcaagcgcgcccagccgcgcggctgccgcatgctcgtcctcgcgccgacccgcgagctcgccgcgcagatcgccgacaatgccaagcattatgccagcggcaccggcctgcgcatcgccaccgtgttcggcggcacctcggtccacaagaacaagaccgatctggcgcgcggcgtcgacatcctggtcgccacgccgggccgcctcgtcgacctgctcgaccagtgctacatgatcctgctcggcatcgagatcctggtgctcgacgaagccgaccagatgctcgacctcggcttcatccatgcgctgcgccgcatcgtgaaggagctgccggccaagcgccagtcgctgttcttctcggcgaccatgcccaagacgatccgcgagctggccagccagttcatccacaatccggtcgaagtgaaggtgaccccggtcgccaccacggcggagcgcgtcgagcagttcgtcacctatgtgaaccagaccgagaagcaggcgctgctgacgatgcagttgcgcaatctcgagatcgatcgcgcgctgatcttcacccgcaccaagcatggtgccgaccgcgtcgtgcggctgctcgccggcaacggcatcgccgcgaacgcgatccacggcaacaagagccagccgcagcgcgagcgggcactgggcgagttccgctcgggcaaggtcaagctgatggtggcgaccgacatcgccgcgcgcggcatcgacgtgtcgggggtgagccatgtgttcaacttcgagctgcccaacgtgccggagcaatatgtccaccgcatcggccgcaccgcgcgcgccggcgccgacggcatcgcgatcagctactgcgccgatgacgagcgtccgtacctgaaggacatcgagcggctgacccgccagaagctcaccgtgcagccgctgccggagaatttcatggccgaggccgacaagatcaagtcgacccgctcgccgatgccggcgagccgcgacgagcagaacggccgcaacggccgcgcgatgcagcatgcccagggtcgtcgtggcgacggccagccggcgcgcggcggtcgcggtggtccgcgcagcgatgcgccgcgcggtggcgagcagcgccgggccgagggcggtccgcgtagcgaccagccgcgtcgccag

SEQ ID NO: 41583 - DNA, 519 bp, SPHINGOMONAS
cgctacgcaaccgcgctgttcgagctggcacgtgacgccaaggccatcgaggccgtcgaagccagccttgcgaccgtgcgggcggcgctcgacgaatcgcccgagttcaaggcgctgaccaccagtccgctgatcggccgcaaggacgccggcaaggccgtggccgccgcagcgggtgcgatggcactggatgcgacgacgaccaagttcctcggcgtgctcgccgagaaccgtcgtctggcgcagctgccggcgatcatccgcaccttccgcgcgctggccaccagtcatcgcggcgagacgaccgcggaagtgacctcggcacacccgcttgacgccgaacaggtcgacgcgctcaagcagcagctccgcacccgtatcggccgcgaggtctcggtcgacctgtcggtagacccctcgctgctcggcggcctggtcgtgaagatcggcagccagatgatcgattcgtcgatcaagacccgactgaactccctcgcgcacgcgatgaaaggctaaggc

SEQ ID NO: 41584 - DNA, 1509 bp, SPHINGOMONAS
gcagaaatctcgaaggtcatcaaggaccagatcgccaatttcggcaccgacgcccaggtgtcggaaatcggccaggtgctgtcggtcggcgacggcatcgcgcgcatccacgggctggacaatgtccaggccggtgagatggtcgaattcgccaatggcgtgcagggcatggcgctcaacctcgaagccgacaatgtcggcgtcgtgatcttcggctcggacgcccagatcaaggaaggcgacaccgtcaagcgcaccggcacgatcgtggacgtccccgtcggcaagggcctgctcggccgcgtcgtcgacggtctcggcaacccgatcgacggcaagggcccgatcgaatataccgagcgccgccgcgtcgaagtgaaggcaccgggcatcatcccgcgcaagtcggtgcacgagccggtgcagaccggcctcaaggcgatcgacgccctggtgccgatcggccgtggccagcgcgagctgatcatcggcgaccgccagaccggcaagaccgccgtcgcgatcgacaccttcatcaaccagaagggcccgaacgcgtcggacgacgaccagaagaagctcttctgcatctacgtcgcgattggccagaagcgctcgaccgtggcgcagatcgtccgccagctcgaagagaatggcgcgatggaatattcgatcgtggtcgccgcgaccgcgtcggagcccgcgccgctgcagttcctcgcaccgtacaccggctgcgcgatgggcgagtatttccgcgacaacggcatgcacgccgtgatcgtgtatgacgatctttcgaagcaggccgtcgcctatcgtcagatgtcgctgctgctccgccgtccgccgggccgcgaagcctatccgggcgacgtgttctatctccacagccgcctgctcgagcgcgccgcgaagatgaacgacgccaacggctcgggctcgctgaccgcgctgccgatcatcgagacccaggcgggcgacgtgtcggcctatatcccgaccaacgtgatctcgatcaccgacggccagatcttcctcgagaccaacctgttctaccagggcatccgtccggccatcaacgtcggcctctcggtgtcccgcgtgggttcgtcggcgcagaccaaggcgatgaagaaggtgtcgggctcgatcaagctcgagctggcgcagtatcgcgaaatggccgcgttcgcgcagttcggttcggacctcgatgcctcgacccagaagctgctcaaccgcggtgcgcgcctgaccgagctgctcaagcagccgcagttcagcccgctgccgttcgaagagcagaccatctcgatcttcgccggcaccaacggctatctcgatgccgtcgccgtcaaggacgtggtccgcttcgaagctgcgatgctcgcgcacttccgttcgcagcatgccgcggtgctggacgagatccgcaccaccaaggcgttcgagaacggcacgcgagacaaggtgaaggccgtcctcgacgccttcgccaagaccttc

SEQ ID NO: 41585 - DNA, 873 bp, SPHINGOMONAS
atggccaacctcaaggaactcaagggccggatcgcctcggtcaagtcgacccagaagatcaccaaggccaagcagatggtcgcggcggcgaagctgcggaaggcgcaagccgccgcggaagccgcgcgcccctatgcccagcgcctcgagggcgtggtcgccagcctggcgagcaaggtgggggcgagcgacagcgcgccccgtctgctcgccggcaccggcaaggcggacacgcacctgctgctcgtcgcaaatggcgacaagggcctgtcgggtgcgttcaacgccaacatcgtcaaggcggcgatcctcaaggcgcgcgcgctgatcgccgagggcaagacggtgaagttctacctcgtcggccgcaagggccgcgcggtgatcgcccgtaccttccccggcatgatcgtcgcccagttcgacacgaccgcggtgcgcaccccgggcttcgacgaggcccgcgcgatcgccaaagacgtgaccgaccgcttcttcgcgggcgagttcgacgtggcgacgctgttctattcgcacttccgctcggcgctggcccaggtgccgaccgagcagcagctgatcccggtttcggtccccgcgaccaccgaggccagctcgggcgcggcggtggaatatgagccggacgaagagacgatcctcgccgatctgctgccgcgcaacctgacggtgcagctgttcaaggcgctgctcgagaaccaggccagcgagcagggcgcgtcgatgaccgcgatggacaacgcgacgcgcaatgccggcgacctgatcaaccggctgacgatccagtataaccgttcccgccaggccgcgatcacgaccgaactggtggaaatcatttcgggcgccgaagcgctc

SEQ ID NO: 41586 - DNA, 1416 bp, SPHINGOMONAS
ggccgcatcagccaggtgatcggcgcggtcgtcgacgtgacgttcgagaacaacctgcccgcgatcctttcggcactggtgaccgagaataacggccagcgcctcgtgctcgaagtcgcgcagcatctgggcgagaacaccgtccgcacgatcgcgatggacgccaccgagggcctgacccgcggccagaccgtcaccgacaccggcaaccagatccaggtgcccgtcggcccggcaacgctcggccgcatcctcaacgtcgtcggcgagccgatcgacgagcgcggcccggtcggcaccgacctgcgcgcgccgatccacgccgaggccccgctgttcgtcgaccagtcgaccgacagcgccatcctcgtcaccggcatcaaggtgatcgacctgctcgcgccctatgcgaagggcggcaagatcggcctgttcggcggcgccggcgtgggcaagaccgtgctcatccaggaactgatcaacaacatcgcgaagggccatggcggcacctcggtgttcgcgggcgtcggcgagcgtacccgtgagggcaacgatctctatcacgagttcctcgacgccggcgttatcgccaaggacgccgacggcaacgccatctcggaaggttcgaaggtcgccctcgtttatggccagatgaacgagccgccgggcgcccgcgcccgcgtcgcgctctcgggcctgacgatcgccgaatatttccgcgacgtcgaaggccaggacgtgctgttcttcgtcgacaacatcttccgcttcacccaggcgggcgcggaagtgtcggcactgctcggccgtattccgtcggccgtgggctatcagccgaccctgtcgaccgacatgggcgcgctgcaggagcgcatcacctccaccaacaaggggtcgatcacctcggtgcaggccgtgtacgtgcccgccgacgatcttaccgatccggcaccggccacgtcgttcgcccacctggacgcgacgaccgtgctcaaccgcgcgatctccgagctgggcatctacccggccgtggatccgctcgactcgaccagccgcgtgctcgagccgcgcgtcgtcggccaggagcattacgagacggcgcgtgcggtgcaggccattctgcagaagtacaagtcgctgcaggacatcatcgcgatcctgggcatggacgagctttccgaagaggataagctgaccgtcgcccgcgcccgcaagatccagcgcttcctcagccagcccttccacgtcgccgaagtgttcaccggcattccgggcgccttcgtgcagctggaagacacggtgcgctcgttcaaggcggtggtcgacggtgaatatgaccacctgccggaagcggccttctacatggtcggcggcatcgacgacgcgatcgccaaggccaagaagctcgccgacgag

SEQ ID NO: 41587 - DNA, 702 bp, SPHINGOMONAS
gtgctggtcacgggcggcgcacgacgcatcggcgcggcgatctcgcgcggactcgccgcccgcggctgggccgtcgccgtccaccaccatcactcgcccgacgaggcggaggcgttcgtcgccgccctgcggaaaaacggggcaagcgctgcggtggtctgcgccgagctcgccgaccccgcggccccccaggcactggtcgatgcgtgccgcgccgccttcggcgccccgctcgacgcggtggtcaacaacgcctcgctgttcgcctatgacgaagcgccgatcgccgaccatgcgctgctcgaccggcatatgcatgtgaacctggcagccccggtcggccttgcgatggcgctggccgcccaggccgatctcgaagccggcgcggtcgtgaacctgctcgaccagaaggtcggcaacctcaaccccgacttcttcagctacacctgctccaagctcgcgctcgaaggcgcgacccacatgctagcgcagaagcttgcgccgcgggtgcgggtgaacgcggtctcgcccggcctgaccctccccagcctcgaccagaccgaggaggaattcgcccgcaccggtacgcagaacctgctgcgccgcacggtcgatccggccgacatcgccgccaccgtcgctcatctactcgaaagccgcagcatcaccggacagaatgtgttcgtcgattgcggccagcat

SEQ ID NO: 41588 - DNA, 543 bp, SPHINGOMONAS
gaaaacgtggcagaggccattcgcacgctgctgcgctgggcgggagacgatcccggccgcgagggcctgctggatacgccccagcgcgtcgcccgcgcgtggaaggaatattgcgccggctatgccgaggatcccggccaccatctgtcccgcgtgttcgaggaagtgggcggctatgacgagatcgtgctgctgaaagacattcccttccagtcacattgcgagcaccacatggcaccgattaccggcaaggcatcgatcgcctatctgcccaggaaccatgttgtcggcatctccaaactcgcgcgtgtcctccacgccttcgcccgcaggctgcaggtgcaggagcggctcaccgcggaagtggcggattgcatctggaaccatctgcacccgcagggcgtggccgtggtgatcgaggcgcagcatggctgcatgaccggtcgcggcgtgcgcaccccgggcgtcggcatggtcaccagccggatgatgggggtgttccgcgaggacgagcgcagccgggccgaagtgctcaagctgatg

SEQ ID NO: 41589 - DNA, 891 bp, SPHINGOMONAS
cggcacctcaccggcatttcgggactccagccccacgaaatcatgttcctgctcgacgaggcggaacaatgggtcgaggccaatcgcagccgcgccaagagcgacaagcggctggaaggcctcacccagatcaacgcctttttcgagaattcgacacgcaccctgctctcgttcgagatcgccggaaagcggctcggcgccgatgtcgtcaacatgcacgccgcgcagagcagcgtgaagaagggcgagacgctgatcgacacggccgtcacgctcaacgcgatgcgcgccgacgtgatcgtcatccgccacgccagttcgggcgcggtgcggctgatcgccgacaaggtcgactgcccggtgctcaacgccggcgacggctggcacgagcacccgacgcaggcgctgctcgatgccctcaccatccgccgccggcgtggatcggtggcaggacagcgggtggtgatctgcggcgacatcctccacagccgcgtcgcccgatcgaacatcctcgcgctgaccgcactcgccgccgaggtgcgcgtggtcgccccttcgacgctgatgccgccggcgatggaccggatgttcgtcaccccgttcaccgatttcgacgccgcgctggaagacgccgacgtggtgatgatgctccgcgtccagaacgagcggatggatggcggctacatcccttcgactcgcgagttccacatgcgctacggcctcacccccgaacgcctcgcccgggccaagcccgatgcgctggtgatgcaccccggcccgatgaaccgcggcgtcgagatcgactcgatcgtcgccgatcatccggagcgcagcgcgatcaccgaacaggtggaaatgggcgtggcggtccgcatggcctgcctcgacgtg

SEQ ID NO: 41590 - DNA, 1221 bp, SPHINGOMONAS
tttccgaagggctttctgtggggcgccgcgacggcggggcaccagatcgagggcaacaacctcaacagcgacatctggctgctcgaacaggtcaagccctcggtcttctcggaaccctcgggcgatgcctgcaacagcctggaactctggccgatcgaccttgatctggtgaagtccctcgggctgaactgctatcggttcagcctggaatgggcgcgcatcgagcccgagccgggccagttctcgatcgcgatgctcaaccattacaaggcgattgtcgacggctgccgggcccgcgggctcgccccgctggtcacctactgccactatgcagcgccgcgctggttcgccgcgcgcggcggctggctcaacccggaagcgccgcagttgttcgcccgtttctgtgatcgcgcgacgcgccatctgggcgcgggcatccacaccgcgatgacgctgaacgagccgaacatcgtgccgatgctccaggtcgtgctgccaccccaggcgcagacgatcatcgccctgacgctggacggcgcggccaaggcgctcggcgtgccggaactagcggtggcgaacaccgccaagcaggccgacgttccccggctcaccgccgcgctgctcgccgcgcacaaggcaggcaaggcagcgatcaaggcggcgcgccccgatctcccggtcgggctgacgctggcgatgttcgacgacgaggcggtcggcgcgcccgccatgcgcgaccggatgcgtcagcagctttacggcacgtggctcgaagcggcacgcgacgacgatttcatcggcgtgcagaattacgagaaggtgcgctgggggccggaaggtcgcctgccgccgcccgccggcgcggtgcgcaacgacaatggcggcgaagtctatgggccgtcgctggccaatgcctgccgctatgcccatgcggtcgcacgcgtaccggtgctggtgagcgaacacggcgtcgcaacctccgacgacaggatccgggccaagctgatccccggcgccttggtcgaactccacaaggcgatggtggaagggttgccggtgctcggctatgtccattggtcgctgctcgacaattacgaatgggtcgccggctacaagtcccatctcgggctgttcgccgtcgatcgcacgacctttgcccgcaccgcgaagccaagcgccggcgtgctgggtgcgatcgcccgggccaacgggctgtgaaag

SEQ ID NO: 41591 - DNA, 1694 bp, SPHINGOMONAS
gcgttgatcgggctggtgctggcgatcggcggcgcctggttggcggtgctcggcggctcgctctactacctcgtcaccggcgtcgcgatggtgggggcaggggtgttgctggtgcgcgggcggacgcttggcggctggctctatctcgcgatcgtcgtcctcactttcctctgggcctggtgggaggtcggtgccaatgcctgggcgcaggtgccgcggattatcgcgctggtcgtgctgctggtggcggtgctcgcggcgatggcgacgatgcgcgtccgacgtgagcggtggcggttcgcgctggcaggcgtgctggccgcggtggcgatcaccggcgtggaccttgcggtggccgccaacggtcagcccgactgggtgcaggctgcgctccccgcgccgggcacccagggcatggccgatccgtcaggccagcagaccggcgccgactggccgagctatggcggtacgggtagcgcccggcgctgttccccgctcgcgcagatgaacgcgtccaatgtcggcagcctcaagcgcgcctggctgatccacaccggcgacatgcccagctcgcccaggatcgctgggcgccttcgggcgtgatccagggcttcgacgcgcgcaccggcaagctgcgctgggcgtgggacatgatgcacccggagtggaacggctatccgcccgcaggccaggaatgggcgcgcggcacgccgaacatgtggaccatggccagcggtgacgagcagctcggtctggtctacctgccgatgggcaatgcggcggcggactattattcgagcctgcgtcgcccggaagagaaccagttcgccacctcgctggtcgcgctggacgtgaccaccggcaagccgcgctggcgcttccaggcggttcgcaaggatgtgtgggactacgactttggcgcccaggcgacgctggtcgagtacaagggcgtcccggcgatggtgctgccctcaaagcagggcgacatctacatcctcgaccgccgcaccggtcgcccgctgatcccggtgggcgagatcaaggcgccgcagatcggcgtcgagccgcagcagcgcgcggccacccagccggtgtcgctctggcatacgctgcgccagcccgacctgaccgagcgcgacatgtggggcatgtcgccgatcgatcagatagtgtgccgcatccagttccgccgggcgagctacaagggcttctttacgccccccgaggcggaccgacactcgatcgaatatcctgggtacaatggcggcaccgactggggcggcatcgcggtcgacccgcagcgcggcgtgatcgtcgccaattacaacgacatgctcaactatgtccggctggttccacgcgccgaggcgaaccagcggggatggcaaccgcgcgaccaggcccgcggcaagatcggcggggcggaaggcgcaggcgatccccaggcgcacaccccctatgcgatcgacgtcaacgccggctggcagctgcccttcaccggcatgctctgcaagcagcccccctatggcggcatccgcgcgatcgacatggcgacgagcaagacgatctgggaccgcccgctgggcgaggcgcgcactaacgggccgttcggcatcccctcgatgctgccgatccccatcggtacgcccaacaatgggggatcggtggtgaccgtgggcgtgctgatcttcttc

SEQ ID NO: 41592 - DNA, 771 bp, SPHINGOMONAS
atgtcgaccgctctcatcaccggcgcgtccagcggcatcggtgccgtctatgcccgccgcctcgccgcgcggggccatgatctggtactcgtcgcccgcaacgccgagcggctggaggcgctcgcgaacgagctgcgcgcagcgaacggcgtcgccgtcgaaatcctcctggccgacctgaccaaggccgaggatctcgccgcggtcggcgaccgcctgcgcagcggcgcgccgatcgatctgctggtgaacaatgccggtgccgcgctgctcggcggcgtcgagaccgccgatccggccaagatggcggagctgatcagcctcaacgtcaccgcgccgacgatgctcgccgccgcggccgtgggcgggatggtcgcgcgcggttcgggcgcgatcgtcaacatcggctcggtcgtgtcgctgatgccggaatatttcccgggcatttatgcggcgaccaaatcctatctgctcaccctgtcgcagggcctcgccgccgaagtcggccccaagggcgtgtacgtgcaggcggtgctgcccgccgccacccgcaccgaaatctgggaacgcgccggcgccgatctcgcgcaaattcccaatgtgatggacgtcgaggaactggtcgatgccgcgctgtccggcttcgaccagcgcgaggcggtcacgatcccgccgctcggtgacgtggcgctgtggaccgcgctcgaaaccgcgcgggccaccctgccctcgggcctgggtgccgtcgccgccgcccgctacgcccccaag

SEQ ID NO: 41593 - DNA, 1407 bp, SPHINGOMONAS
atccccctctaccagtggatcgacggccagaagctgtcgggcgacggtcgcgcgaccagcgacatcctgaacccctttgacggcagcgtgctcggcgcgatgccgcacgcgacggcggcggacctgcaggccgcgctcgaatcctcgcagcgcgcgttccagcagtggcgcaaggtgccggcctgggagcgttcggagatcatcctcaacgcgaccgcgctgatcaaggagcggatcgagcagttcgcgatgatgctgaccctcgaagtcggcaagccgctggcggaagcgcagatggaaatgaacctgaccgtccagtcgatggtctgggccggcgaggaggccaagcgcatctatggccgtacggtcgaatcgcgcctgcccaacggccgcgccatcatcgcgcgcgagccggtcggcccggtcgcggcgttcgcgccgtggaacgtgccggcgctgctgaccggccgcaagatcgccgcggcgctggccgccggctgctcgatgatcatcaagccgtccgaggaaacccccgcgacctgcctgatgatcgcggaagcctttgccgatgcgggcctgccggccggcgtgctgaacgtcgtgctgggcgatccggcgatgatctcgaccacgctgatctcctcgccgatcatccgcaaggtctcgttcaccggtccggagccggtcggcaagcagctcgccgcgctggccgcccagaacgtgacgccggtgacgatggaactgggcggccacgccccagtgatcgtctgcgacgatgccgatatcgataccgtcgtcgccttctcggtgccgaacaagtattttgccgccggcgccagctgcatcgggccgacccgcttctacgtgcaggactcggtctatgacgcgttcgtcgagaagttcaccgccgccgccggcgcgatcaaggtcggcagcggcctcgatcccgaaaccaacatgggcccgctcgccaacgagcgccggctgcatgcgatggagcggctgatcggcgacgcggtggccaatggcggcaagatcaccaccggcggcaagcgcatcggcgatgcgggctatctgtgggagccgacggtgctggtcgacgtgccggaaaccgcgaagatcatgaacgacgagccgttcggcccggtcgccatcatctcgcgcttctccacggtcgaggaagcgatcgagaaggccaaccgcctgccgtacggcctggcctcctatgccttcaccgcctcgctgtcgcgtgccaaccagctcgccgacagcctcgaaagcggcatggtgggcatcaacacctattatttcggcatgccggaagcgccgttcggcggcgtcaagcagagcggctatggcagcgagaacggcaccgagggtatcgacgcctatctggtgaccaagttc

SEQ ID NO: 41594 - DNA, 1632 bp, SPHINGOMONAS
atggcagccaaggacgtaaagttttcgcgcgacgcacgtgagcgcatcctgcgcggcgtcgacatcctcgccgatgcggtgaaggtcacgctggggccgaagggccgcaacgtcgtgatcgagaagagcttcggcgcgccccgcatcaccaaggacggtgtgtcggtcgccaaggaaatcgagctcaaggacaagttcgagaacatgggcgcgcagatggtgcgcgaagtggcctcgaagaccaacgacgccgccggtgacggcaccaccaccgcgaccgtgctcgcccaggcgatcgttcgcgagggcatgaagtcggtcgccgccggcatgaacccgatggacctgaagcgcggtatcgacctcgccgtcaccaaggtcgtcgaggacgtcaaggcccgctcgaagcccgtctcgggcagccaggaagtcgcccaggtcggcatcatctcggccaatggcgaccgtgaagtcggcgagaagatcgccgaggcgatggagaaggtcggcaaggaaggcgtgatcaccgtcgaagaggcgaagggtctcgaattcgagctcgacgtcgtcgaaggcatgcagttcgatcgcggctatctctcgccctacttcatcaccaacccggagaagatggcggtcgagctcgcggatccgtacatcctgatccacgagaagaagctgtcgaacctgcagtcgatgctgccgatcctcgaggcggtcgtgcagtcgggtcgtccgctgctgatcatcgccgaggacatcgaaggcgaagcgctggcgaccctggtcgtcaacaagctgcgcggcggcctgaaggtcgcagcggtcaaggcaccgggcttcggcgatcgtcgcaaggcgatgctggaagacatcgccgtcctcaccaagggtgaagtgatcagcgaagacctcggcatcaagctcgagaccgtcacgctcggcatgctcggcaccgccaagcgcgtcaccatcgacaaggacaacaccaccatcgtcgatggcgccggtgaagccgagtcgatcaaggctcgcaccgagcagatccgccagcagatcgacgtcaccaccagcgattacgaccgtgagaagctccaggagcgtctcgccaagctcgccggcggcgtggccgtgatcaaggtcggcggtgcgaccgaagttgaggtcaaggagcgcaaggaccgcgttgacgacgcgctgcacgcgacccgcgcggccgttgaagaaggcatcgtccccggcggcggcacggccctcctctatgccacgaaggctctcgaaggcctgaccggcgcgaacgaggaccagacccgcggcatcgacatcgtccgcaagtcgctgaccgcgctggttcgccagatcgccagcaacgcgggccaggacggcgccgtcgtctcgggcaagctgctcgaccagaacgacacctcgttcggcttcaacgccgcgaccgacacctacgagaacctcgtggctgccggcgtgatcgacccgaccaaggtggtgcgcaccgcgctgcagaacgcggcttcggtcgccggcctgctgatcaccaccgaagccaccattgccgagctgccggacgacaagcccgcagccccggcgatgccgggcggcatgggcggcatggacttc

SEQ ID NO: 41595 - DNA, 285 bp, SPHINGOMONAS
atgaacttccgtccgttgcacgaccgcgtgctcgtccgccgcgtcgaagccgaggaaaagaccgccggcgggatcatcatccccgacaccgccaaggaaaagccgcaggaaggcgaagtcgtcgccgtcggcaccggcaccaaggccgaagatggcaaggtaaccccgctcgacgtgaagtcgggggatcgcatcctgttcggcaagtggtccggcaccgaagtgaaggtgaacggcgaagacctgctgatcatgaaggaaagcgacatcctcggcatcgtcggc

SEQ ID NO: 41596 - DNA, 762 bp, SPHINGOMONAS
accggattgatgcaagggaagcgtgggctcatcatgggcctcgccaacgacaagtcgctggcctggggcatcgccaaggcgctgcacgcccagggcgcggagatggcattttcctatcagggcgatgccctgctcaagcgggtgaagccgctggccgagcaggtcggctcggacttcctcatcgattgcgacgtatccgacatggcggcgctcgacaccacgttcgagacgctagcggcgcgctggccgacgatcgacttcgtcgttcacgcgatcggcttttcggacaagagccagctgcggggccattattacgacaccacgctcgaaaacttcctgatgacgatgaacatctcggtgtacagcttcaccgcggtggcccagcgtgcgcagaagatgatgccgaacggcggcagcctgctgacgctcagctattacggcgccgagaaggtggtgccgcactataacgtgatgggcgtggcgaagtctgcgctggaaacctcggtcaagtatctcgcgatggacctcggcccggagaatatccgcgtcaacgccatctcggccggcccgatccagacgctggcggcgcgcggcatcggcgacttcaactatatcctgaagtggaaccagctgaactcgccgctccgccgcaacgtaacgatcgaggatgtcggcggcgccgggctctatctgctgtcggacctcgcctcgggggttaccggcgagacgcaccatgtcgatgccggctacaatgtgatcggc

SEQ ID NO: 41597 - DNA, 870 bp, SPHINGOMONAS
gtggcagatccatacgtaacgctcggggtggcgcgcagcgcgagcgaggacgagatcaagaaggcctatcgcaagctcgccaaggagttgcaccccgatcgcaacaaggacaatccgaaggcgtccgagaagttcagccaggtcacccaagcctatgacctgctgaccgacaaggacaagcgcgcccgcttcgaccgcggcgagatcgacggcgacggcaatccgatcgccccgttcggcttcggaagcggcggtggcggcggcgggttccagccgggcggcgggcactttgatttcagcggcaacgatgccgatatcggcgacctgttcgagggattgttcggcggcggcaagcgcggcggcggtggcggcttcagcggcgggttcggcggctttggcgggttcgggcgtcgcgcccagcccaagggcgccaacaccgcctatcggcttgccgtctcgttcgaggatgcggccaagctggcgcctcagcgcatcaccctgcgcgacggcaagaccatcgatctcaagctccccgcgggcctggaggatggcacgcagatgcgcctggccggcaagggcgaggaagggccgggcggcgccggcgacgcgatcgtcaccctcgagatccagccgcatcggttctacacccgcgacggcgacgacatccggctcgacctgccggtgacgctggccgaggcggtgctgggcgcgcaggtgcgcgtgccgacgcccgatgggccggtgatgctcaccgtgcccaagggctccagctccggcaaggtgctgcggctcaaggcgcggggatttcacaagaaaggcggcgggcgcggcgatctgttcgtcacgctgatggtggagctgcccgtcaac

SEQ ID NO: 41598 - DNA, 1062 bp, SPHINGOMONAS
atgtcgttcaacagcttcggtcgcgtattccgcttcaccacctggggcgaaagccatggccccgcgctcggcgccgtggtcgacggctgcccgccggggctgagcttgagcgaaggcgacatccagcccttcctcgatcgccgccgtcccggccagtcgcgcttcaccacccagcggcaggagccggaccaggtccgcatcctctcgggcgtgttcgagggccgcaccacgggcacgccgatcgcgctgcacatcgacaatgtcgaccagcgctccaaggactattcggaggtcgccaaggcctatcgccccggccatgccgattacgcctatgaccagaaatacggctttcgcgactatcgcggcggcggccgttcctcggcgcgcgaaacggcggcgcgggtagccgccggtgcggtcgcgcgggcggtgatcccggaagtgacgattaccgcctgggtggaggcgatcggcggcgacgcaatcgactatacgaagttcaacgcggccgagatcggcaacaaccccttcttctgccccgacgcggatgccgcccagcgctgggaagcgctggtcgacgccgcgcggaaggatggttcctcgctcggtgccgtggtcgcctgcgaggcgaccggcgtccccgccggctggggggcgccgctctacgccaagcttgacagcgaactggctgcggcctgcatgtcgatcaacgcggtcaagggcttcgagatcggggacggtttcgcggcagctaccctgcgcggcgaagagaatgccgatgcgatgcgcccgcgcggcgacggcggcgtcgatttcctcgccaaccatgccgggggcatcgcgggcggcatcgcgacgggccagccggtgcggatgcgggtggcgttcaagccgaccagctcgatcctgatcccggtcgagacggtcacccgtgacggtgaggcaagcgagatccgcaccaagggacgccatgacccctgcgtgggtattcgcggggtgcctgtcgttgaagcaatggtcgcgctggtgcttgctgatcagaaattgctgcatcgggcacag

SEQ ID NO: 41599 - DNA, 885 bp, SPHINGOMONAS
cgcgcgatgttttctggatcgattcctgcgctggtgacgccgttccgtagcggcgcgttcgcggaggaggatttccgcgcgctcgtcgaatggcagatcggcgaaggctccgccgcgctggtgccctgcggcaccaccggcgaggccgctaccatgcccaaggacgagcatttccacatcgtgcgggtctgcgccgaccaggcgaaaggccgggtgaagatccttgccggggcgggctcgaacgacaccaaggtggcgatcgacaatgttcacgccgccaaggatgctggcgccgacgccgcgctgatggtgccgccctattataaccgccccagccaggagggcatcttccggcacttcgccgccgtggccgaggcgaccgacctgccgatcgtgctctacaacgtgcccggccgcaccgtgaccgacatccagccggcgacgatggcgcggatcgtgcaggccttcccggaaaccttcgtcggcgtgaaggacgcgaccggcaacctcagtcgggtgtccgagcagcgcgccggttgcggcaccggcttcgtccagctctcgggcaatgacgagacggcgctcgccttcaacgcgatgggcggcgtcggctgcgtgtcggtgacggcgaacgtcgcgccgaagctgtgcgccgatttccaggcggcctgggcagccggcgacaccgccaaggcgctggcgctccacgacaggctgtatccgctccacatcgcgatgttcaccgatgcctcgcccgggccggtgaagtacgccatgggccgggtgcgtcccggcttcccgcaggaactccgcctgccgatgaccgaggcgggcgaggcgagccgcaaggccgtcgatgcggcgctggaattcgccggcctgctc

SEQ ID NO: 41600 - DNA, 261 bp, SPHINGOMONAS
atggcgcagcaacgaatcctggtttcgggtcgggtacagggggtgggttatcgcgactgggtggtgcgcaccgcgcagcgcggcggcctgaccggatgggtgcgcaacctgcgcgacggccgcgtcgaggttctcgccgcgggcgaagacaccgcgctggcattgttcgtggaggcgtgccgcgaagggccgccgctctcgcgcgtcgagcatgtcgagagcgaggcggtgcccgaggacaaggcgcacaagggcttcacc

SEQ ID NO: 41601 - DNA, 582 bp, SPHINGOMONAS
gaacgggccgacaacgaatctgggcacgaaatggtgcccgaggaagtacaggaggccgttcgcaccctgctccgctgggtaggggaagatccggaacgcgaggggctggtcgatacgccgaagcgccacgccaaggcgtggcgggaatattgcgccggctacgaggaagatcccggcatgcatctcgcccgcaccttcgaggaggttgccggctatgacgagatcgtcctgctgaaagatattccgttccagtcgcactgcgaacaccacctcgcgccgatcactggaaaggcttccatcgcctatcttcccaaggaccgtgtggtcggcatttcgaagcttgcccgcgtcctccatggctatgcgcgtcgcctgcagattcaggagcgcctgaccgccgagatcgcccagtcgatctgggaacatctgaagccggccggggtcgccgtggtgatcgaggcgcagcatggctgcatgaccgggcgtggggtgaagacgcacggtgtcaacatggtaaccagccggatgctgggctgcttcctcgaggatcgcagcagccgtgccgaactcatgtcgctgatg

SEQ ID NO: 41602 - DNA, 2082 bp, SPHINGOMONAS
ttctggtatgtcgacaccgaccacggcgtgccgacgatcctgctggtagacgccgtcaagcgcaccaagaaggccgctttcgagaccacagcgctgctcgcctcgctcaacgcggccgggctgaaggcgcaggacgcgtcgaagctcaccatcagcgatttcgtgccggacctggcgaagaacagcgcggtgctcagcgtcggcggcaagcgctatgcgtgcgcgatggcgcagccctatgcttgcaaggaatcggcagcgccgagcgcggggcagatcgcaggctatctggcccagcagggcccggccgatgcggtgctctccccggacggcaagcgcgccgccttcgtgcgcgactggaacctgtgggtccgcgacatggccaccggcgcggagcggcaactgaccaccgacggcgtcaaggatttcggctacgcgacggacaatgccggctggaagcattcggaccaggcgatcgtgatctggtcgccggactccaagaagctggctaccttccagcaggatcagcgggcggtggcggacttttccatcaccacgacccaggtcggccattcgaaggtcgacacgtggaaatacccgttcgtcggcgacaaggagatcatccagatccagcgcgtcatcgtcgatgtggacgcaggccaggtcatccgcctcaagatgccggcggagccgcaccgctcgtcgctgtgcgacgacgtggtgtgcggcgagggtccgcaggacatgcaatgggcgaaggacggcaagacgctcgccttcgtttccacctcgcgcgaccacaaggtggaaaccgtccgcattgccgatgcggccagcggtgcggtgcgcgacgtgttcaccgaaacggtgccgacctggttcgacagcggttacaatgacgagggcatcaactggcgctatctttccgagcgcggcgagatcctgtggtggtcgcagcgcgacgactggggccattattatctgtacagcgccgccaccggcaaactcgtgcgccaggtgacccagggccagtggaacgtcgatcatccggtctatatcgacgagcgtagcggcacgatgctcgtggcgggtgtcgggcgggagccgggcaacgatccctattaccgcagcatctacgcgatcgacctgaagggcggggcgccgaagctgctgacccccgagaagcaggaccatatcgcgatcccgtcgagtgacgggcgctacttcgtcgacatttattcgaccccgcaggaaccgcagaccgcggtgctgcgccgtgccgacggatcggtcgtccagcagctggccaagggcgacgcgacgcggctgcgggcggcgggctggcaggcgccggagagcatcgccgtccagtgcagcgacggcaagacgctgtgccacggcctgttgttcaagcccgcggggctggatccgcagcgcaaatatccggtgatcgactatgtctatcccggcccgttcatggggacgatcccgtcgcggcagttcgccgcggcgcagggggatgcgggcgcgctggcgcagctgggcttcgccgtggtcgagatcgacgcgctgggcacgccgcgtcgctccaaggccttccaggactattattatcgcgacatgggcaagcaggccgtgcccgaccagaagagcggcatccaggatctggccaagcgctatgcctggctcgacctcgaccgcgtcggtatctggggccattcgggcggcggcaatgcgaccgcgaccgcgatgttcctatatccggacttcttcaaggtcgggatcgccgagagcggcaaccacgacaaccgcaactatgaggacgatttctacgagaagtatctcggcctgctggagagcgacgggaagaagaccaactacgacctgcaggcaaatcaggacatcgccaagaacctgaagggcaagctgctgctggcgcacggcatgctcgacgataatgtgccggtgtcgtcgacgctgctggtggtcgatgcactgcaaaaggcgaacaaggatttcgacctgatcctgtttccgcgggcgcaccacggctatggcgaccagtccatgtacatgatgcgc

SEQ ID NO: 41603 - DNA, 876 bp, SPHINGOMONAS
atgaagggcatcatccttgcggggggcagcggcacgcgcctctaccccgcaacgctgtcgatctcgaagcagctgcttcccgtctacgacaagccgatgattttctatcccctgtccgtgctgatgctgaccggcatccgcgacgtgttgatcatctcgacgccccgcgacctcccgatgttccaggcgctgctgggcgatggctcggccttcggcatgaacctgagctatgccgagcagccgtcgccgaacggcctcgccgaagccttcatcatcggcgccgatttcgtgggcaacaatccgagcgcgctgatcctcggcgacaacatctatcacggcgaaaagatgggcgagcgctgcaaggcggctgccgaacaggcgtcgcagggcggcgccaatgtgttcgcctaccatgtcgacgatccggagcgctacggcgtggtggcctttgatcccgagacgggcgtcgccaccagcgtcgaggaaaagccggccgtacccaagtccaactgggcgattaccggcctctatttctacgacaaggacgtggtggacatcgcgaagtcgatccagccctccgcacggggcgaactcgagatcaccgatgtcaaccgtacctatcttgagcgcggcgatctccacatcacccggctcggccgcggctatgcgtggctggacacagggactcacgacagcctgcatgatgccggctcgttcgtgcgcacgctggagcatcgcacgggcgtgaagatcgcctgccctgaggaaattgccttcgagaacggctggctcggggcggaggacctgctcaagcgcgcagccggtctcggcaagaccggctatgccgcctatctccgcaagctggtggctgccgca

SEQ ID NO: 41604 - DNA, 2184 bp, SPHINGOMONAS
atgacacccgacgagatgcacgcgcagctgcaggacgccttcgtcgcgcccgaagtcgccgagcgtgaagccgagctgcgcgaatccgggcttgtggcgctgtcgctgctgctcggcgtgcacaacatcgccatcacctccgaacagctccgctacatgcttggccatgccgaagcggcaacggtcgacgacctgatcctgctcgccaagcgacagcagggggtgcgcgccaaggcggtcgacgttccgcgcggcggcctcgcgcgccagccgttgccggcgatcgccgacgggccggagggctggttcgtgatcggcgggctgaccgaacatggcgtgatcatccagcggcccggccatgcgcccgagcaggttgatcgcgagggccttgacgcgctctggtccggcacgctggtgttgctgaccacccgcgcggtggccggccagacgctgcgcttcggtttctcctggttcaccgcgcagtttcaacgctatcgcaagctcttcctggaggtgctggggatcaccctggcgctcaacctgctcggtcttgccgcgccgctcctgttccagagcgtgatcgacaaggtgttggtccacaacagcatgagcacgctcagcgtgctcgccttcgccttcctcgccgtttcggtatgggaggtagcactgggctggatccgcacccgcctgttcaccgaaacgacgcagaagatcgatgtggaactaggcgcccgcctgttccaccacctgcttgcgctgccgctcggctatttcgagaagcgccgggtaggtgacacggtcacccgcgtccgccagctcgagacgatccgcgagttcctcaccaacgcctcgttgaccgtcatggtcgacccccttttcacgatcgtgttcctcggggcgatgctgttctactcgccgatgctgttcggtgtcgtcgtcgtatcgttggtcgcctatgccgtcgtctcgttcagcgtcgcggggccgctttgtacccgcgtcgaggacaagttcgagaagagctcggccagcaatgccttgctcgtcgagagcgtgtccggcatccacacgatcaaggcgaccgcagtcgagccgcactggcagaatcgctgggaacgccagctcgctgcctataccgcctcgtcgcagcgactgatcaacgtcgccaacaccggcagccaggcgatcgagctgatctcgaagctgagcttcgcggcaatcctgttcttcggggccaaggcggtgatcggcggcgcgatgagcgtcggcgcgctggtcgcgttcaacatgttcgcgcagcgtgtctccggcccggtgatccgcatggcgcagctgtggcaggacttccagcaggtccgcatcgccatcgagcggctgggcgacgtgctgaaccatccggtcgagccgcggcccgcctcggcggcgacgctgcccgtgctgcacggcgcgatccgcttcgagaatgtcaccttccgctatgccgaggaccagccgccggtcttgagcgacatcacgctcgacatcccggcgggcagctcgctcggcatcgtcggttcctcggggtcgggcaagtcgacgctggccaagctgctccagcgcctcaacgcgcccgatctcggccgggtgctggtcgacgaagtggacgtagcccagctcgaccccgcctggctccgccgccagatcggcgtggtgctgcaggagaacctcctcttcagccgctcgatccgcgagaatatcgcattgtccaaccccgccatgccgttcgagcatgtcgtggcggcggcgacgctggcgggtgcgcacgacttcatcctgcgccagccgcgcggttatgataccgaaatcgtcgagcgcggcgtgaacctctccggtggccagcgccagcggctggccatcgcgcgtgcgctggtcggcaatccgcgcatcctggtgttcgacgaggcgacctcggcgctcgatgccgagagcgaggaactgatccagaacaacctgcgcgccatctcggcgggccgcacgctggtgatcatcgcgcaccgcctgtccgccgtccgcgcctgcgaccggatcatcacgctggaacagggccgcatcgtcgagagcggccggcacgacgaactgctgcgccttggcggccgctatgccgacctgcaccgccgccagagcggctatggggagattgccgca

SEQ ID NO: 41605 - DNA, 1239 bp, SPHINGOMONAS
acccgcgtgcgctacgcgatcatcgcgctgatcttcctgatcacctcggtaaactatgccgatcgcgccaccttctcgatcgccggcagcgccgcggcgcgggagctggcgctgagccccgtccagaccggcttcatcctctccgccttcgcctgggcctatgtgctggcgcagatccccgggggcgtgctgctcgatcgcttcgggaccaagcgcgtctatgcggcggcgatcctgctctggtcgctgttcaccgccacccaaggcttcgccggctggatcgccgggatctcggtagtggcgatgctcttcgccctgcgcttcctggtgggcctggccgaggcaccctctttccccggcaacgcgcggctggtcgcggcgtggttccccgccgccgaacgcggcacggcggccgcgatcttcaactcggcgcaatacttctcgctggtcgccttcgcgccgctgatgggctggctggcccatcagttcggctggcgttcgatcttctgggcgatgggcggactgggcgtgctcgccacgctggtgttcgtccgcttcatccacagcccggcgcaccatcgccgcgtcaacgctgccgagcgcgcctatatcgaagccggcggcgggttgatccatctggaagagggcggcgcgacagccgcccaggccttcgcctggcgcaatgtcggccggctgatcgccaaccggatgatgctgggcatctatctcggccagtactgcatcaacgtgctgacctatttcttcgtcacctggttcccgatctacctgatcaaggagcgcgggctgaacgtcctggaggcggggttcgccgcggcggcccctgccctgttcggcttcgccggcgggctcgccgggggattcctctcggatcgtatcctcaagcgcaccggctcgctcgatcgggcccgcaagataccgctcgtcctgggcatgctgctcgcttcgctgatcatcggctgcgtctgggcgcccggcgaggggctggtgatcacgctgatgtcgatcgccttcttcggaaagggcatcgcctcgctcggctgggcgatcatggccgatgtcgcgccacggcggctggccgggctttcgggcggcgtgttcaacatgttcggcaacatcgccggcatcgtcaccccgatcgcggtcggctatatcgtgggcacgaccgggtccttcgatctcgccctcgtcttcgtcggcgcacactgcctgctgacgatc

SEQ ID NO: 41606 - DNA, 2040 bp, SPHINGOMONAS
ttgcccgccgccaacccgttcgccaagccgagcacgctgcccttccaggccccgccgttcgacaggatcaagagcagcgactatgcgcctgccctgctggcaggcatggccgaacagcgcgccgaaatcgccgcgatcacccgggttcgcagcgcagccaccttcgagaacacgatcgccgcgctcgagcggtcgggccgcctgctggaacgcgcaaccatggcgttctacggcgtggtcggcgccaacaccgacgacacgctgcagaagacccaggccgaccttgcccccgcctttgcggcgcatgccgatgcgatcgcgctgaatccggcgctgttcgcacgggtgaagacgctgtatgaccagcgccagtcgctggggctggatgccgagcagcttcaggtgctcaccctcacctatgagaacatggtccgcgccggcgccaagctgtcgcccgccgacaagacggcgctgagcaagctcaatgcccagctttcgacgctggagaccgccttccagcagaagctgctcgcagccgccaaggcgggcgcactggtggtggacgacaaggcgaagctggccggtctctccgatgccgagatcgccgctgccgaagaggccgccaaggcgcgcggcctagccggcaagtacgtgatcacgctccataacacgacccagcagcccgagttggcgacgctgaaggaccgtgcgacccgcgaggcgctgttcgaggccagctggacccgcgcggagaagggcgacgccaacgacacgcgcgacaccatcgcgcagatcgcgctgctccgcgcgcagaaggccaagctgctgggcttcgccacctgggccgattatgtgctgcaggaccagatggcaaagacgccgaagaccgcgctgggcttcatgcagcggctgggcacgccggtcgccgccgaacagcgtcgggagggggccgagctgcaggcgcaaatccaggccagcggcggcaacttccagctcaagccctgggactgggactattattcggagcaggtccgcaaggcgaaatacgacctcaaccaggacgagctgaagccctatttcgagatcaacaaggtgctgaccgacggcgtgttctacgccgccaaccagctctatggcctcaccttcacccgccgtaccgacctgcccgtctatcagccggacgtgatggtctatgaggtgcgcgaggaaaacggcacgccggtgggcctgatgtatttcgacttctggaagcgcgacaacaagaatggcggcgcgtggatgtcgaacttcgtcaaccagtcgaagctgctcggcaccaagccggtgatctacaacagctgcaacttcaccaagcccgcccccggccagcccgcgctgatcagcttcgacgacgtgacgacgatgttccacgaattcggccatgcgctacacggcctgttcgcgaaccagacctatcccagcgtatccggcaccaacgtcgcgcgggacttcgcggagtttccgtcgcagttcaacgaacattgggcgctcgatcccaaggtgctcccccactatgccgtcaactacaaggacggcagcgtcattccgcaggcgctggtcgacaagatcaagcgcgcaggcaccttcaattcgggctattcgttcggtgaggcgcttgccgccgccgagatggacatgagctggcactcgctggccgccgcggacggcaagcaggatgccgatgcgttcgagcagaaggcgctcgccgccaccggcctggacgtgaccgacgtgccgccgcgctatcgctccagctacttcctccacatctggggcaatggctattcggccggctattacgcctatatgtggaccaagatgctgagcgcgaacgcgttcaactggttcgagcagcatggcgggatgacccgcgccaacggacagcgcttccgcgaaatggtcctgtcgaagggccataccgaggactatgccccgatgttccgcgccttcaacggtgccgatccgcaggtggcgccgctgctcaaggatctcgggctgaac

SEQ ID NO: 41607 - DNA, 864 bp, SPHINGOMONAS
ctgctcgccaaggccgagaccctcaccgaggcgctgccctatctgcagcgctatgccggcgccaccttcgtcgtgaaatatggcggccacgccatgggcgatcccgaactggcgcgcgacttcgccgaagacgtggtgctgctgaaggcggtggggatcaacccgatcgtcgtccatggcggcggcccgcagatcgggcggatgctcaagcgactcggcgtcgaatccaccttcgtcggcggcctgcgcgtcaccgacaaggcgaccgccgagatcgccgagatggtgctcgccggctcgatcaacaaggaaatcgtcgcctggatcgcggcggcgggcggccgggccgtgggcatttccggcaaggatgccgggctggtgcgcgccgagaaggtgcagcgcagcgaggccgatccgctgcagggcatcgagcgccatgtcgacttaggcttcgtcggcgagccggtggcggtggacatctccattctccagtcgctcgccgcgtcgggcttcattcccgtcgtctcgccgattgcgctgggcgccgatggccacacctacaacatcaacgccgataccatggccggcgcgatcgccggcgcatgcggcgccaagcgcttcttcctgctcaccgacgtgccgggcgtgctcagcaagaccggcgacctgctgaccgatctcgatgcggcgcgggtgcaggcgctgaaggacgacggcacgatctcgggcgggatgatccccaaggtggagacctgcgtcaacgcggtcgcggcgggggtcgacgcggcggtgatcctcgacgggcgcatcccgcacggcatgctgctggaaatctttacccgccagggcgtaggcacgctcgtc

SEQ ID NO: 41608 - DNA, 834 bp, SPHINGOMONAS
atgacggctgagatcatcgacggcaaggcatttgccgcgggcctgcgcgcccgcatcgcgaccctggttcctgcattcgaagcggcggcggggcgcgtgcccgggctcgccgtggtgctggtaggcgaggacccggcgtccgccgtctatgtccgctccaagggcaagcagacccgcgaggccggcatggcgagcttcgagcacaagctgcccgccgacacgacccaggccgacctgctcgcgctggtcgaccagctcaatgccgatgcgagcgtggacggcatcctcgtccagctgccgctgccccgccacatcgacgagcaggcagtgctgctgcgcatctcgcccgagaaggatgtcgacggctttcacccggtcaatgccggccgcctcgccaccgggctcgagggcttcgtgccctgcaccccgctcggctgcctgatgctgctgcaggacaggctcggcagcctgtccggcctcgacgcggtggtgatcggccgctcgaacatcgtcggcaagccgatggcggccttgctcaccagggcgagcgcgacggtgacggtggcgcattcgcgcaccggcaacctgccgcactatctgaaacatgccgacatcgtcgtcgcggcggtgggcatcccgcacttcgtcaagggcgagtggctgaagccaggtgccaccgtgatcgacgtgggcatcaaccgcaccgaaagcggcctggtcggcgatgtcgacttcgacggcgcggcgagcgtcgccggcgcgatcacgccggtgccgggcggcgtcggcccgatgacgatcgcctgcctgctgcgcaacacgctggtcgccgcg

SEQ ID NO: 41609 - DNA, 915 bp, SPHINGOMONAS
acccgtttcgcccccagccccaccggtcgactccacctcggccatgccttctccgcgctgcaggcgcatgatttcgcgagagcgaatggcggcagattcaccctgcgcatcgaggatatcgacggcacccggtcgcgtcccgaacatgtcgcagcgatcctcgccgatctcgactggctggggctgatatgggacgagccgccgacctttcagtcgcggcgcttgcacctgtaccaggaagcgctggatcggctgcgcgcgatggggctgctctatccgtgcttctgtacgcgggccgacatcgcggcgagcctctccgcgccgcatggtcccgatggcccgctctatcccggcacctgccgcgggctggtcgaccccgacctgacgcgcccgcacagctggcggctggacatggcgaaggcggctgccctggccgggccgctaacctggcacgacgcacgggccggcaccgtgaacgccgcccccctcagccacggcgacgttatcctcgcccgcaaggatgcgccggccagctatcacctcgccgtgacggtcgacgatggcgcgcagggtatcagccatatcgtgcggggcagcgacctcttcgccgcgacccatgtccaccggctgcttcaggcgctgctcggcctgccgacgccggaatatcgccaccacgcgctgctcgcggggccggacggcacccgcctcgccaagcgccacggcgcgccgacactggaatcgctgcgactggcgggcgaggatggccgcgcgctcgccgacaaactgcgcaaaggggaagtaccggttggcttcggtccaatcgaggcgtagaacagcgcgatgatattcctcgcgatcctgttcctcgcagcggtcctgacgacgctgttcttcctgatcaaggggctggtcaac

SEQ ID NO: 41610 - DNA, 843 bp, SPHINGOMONAS
atgaagacggtaggcgtgatcggtgcgggccagatgggggcggggatcgcccaggtgtcggcgcaggcgggctatgccgtgctgctctccgacgtcgaccaggcccgcgccgatgccggcaaggcaggcatcgccaagcagcttgcccgggcggtggagaaggaaaagatcaccgccgccgatgccgaggcggcgctgggccgaatcaccccgatcagtgatctcgccgccatgggcccttgcgatcttgtgatcgaggccgcgaccgagcgggaggcgatcaagcgccagatcttcgagacggtcggcaaggtgctgggcgcggaggcgatcctcgccagcaacacctcgtcgatcccgatcacgcgcctcgcccaggcggcgcccgatgccgcccgcttcatgggcgtgcacttcttcaatcccgtaccggtgatggggctgatcgagctcatccgcggcctcgccaccagcgatgcgacggtgggcggggtagaggcgttcggccagtcgctgggcaagcggatcgtccatgccaacgacgcgccgggcttcatcgtcaaccgcgtgctgatgccgatgctcaacgaggcctgcttcgcgctgggcgagggcgtggcgaccattcccgacatcgacgccgcctgccagctgggcctcaaccacccgatggggccgttcacgctcgccgatttcatcgggctggacacctgcctggagatcacccgcgtgctcttcgaaggcaccggcgaccccaagttccgcccggcgccgctgctggtgaagtatgtggaagccggctggtacggccgcaagaccaagcgcggcttctacgactatacc

SEQ ID NO: 41611 - DNA, 1476 bp, SPHINGOMONAS
tccctgcccatccacgctgttttgccggcgctgctcgatgcgctgcggggggcgagcaacgcggtgctggtcgcgccacccggcgcgggcaagacgacggcggtggcaccggcgctgctcggcgaagcctggtgcaccggcgagatcctgctgctctcgccgcgcaggctcgccgcgcgcgcggcggcggagcggatggcggcactggcgggcgagagcgtcggcaagaccttcggctatgccacgcggatggatacgaaacgttcggcggcgacgcgcgtgaccgtcgtgaccgaaggcatcttcgtcaatcgcatccaggccgatcccgagctcgcgggcatatccgccgtgctgttcgacgaggtgcatgagcgcagcctcgacagcgattttggcctcgcgttggcgctcgatgcgcaaggcgcgttgcggcccgacctgcggctggtcgcgatgtcggcgacgctcgacggcagccgcttctcggggctgatgggcgcggcacccgtggtggaaagcgaaggccgcagctttccgctgacactgcgccatctcggccgcgcgaccgaggcgcggatcgaggactcggtcgcggcggcagtgcgccaggcactgcgggaggaggagggcggcatcctcgccttcctgcccggcgtggcggagatcgagcggacggccgagcggctgggcgatatcggcggcgcggtgctccaccggctgcacggcagcctggagcccgctgcccagcgcgccgcgatcgcgcccgaccagcaagggcggcgcaagatcgtgctggcgacctcgatcgcagagacctcgctgacgctcgacggcatccgcgtggtggtcgattcggggctggcgcggcggccgcggtacgaccgggcggcggggatgacgcggctggttaccgagcgggcgagccaggcggcggtcacccagcgcgcgggccgtgcggcgcgacaggggccgggaacggcctatcggctgtgggaagaggcggcgacggcgggactgccgcgcttcgatccgcccgagatactggaagcggatctgtcggcgctgatgctcgattgcgcactgtggggcgttaccgatccgcgtgcgctcgcctggctcgatccgccgcccgaggctgccattgccgaggcgcgggcgcgtctgggggcgctggaggcgatcgacgaagacggccgaccgaccgaccacggcaaggcgatcgcccgcctgccgctgccgccccgactcgggcacatgctggtgcgcgcgagcgaacgcgggctggcgcggacggcggcggaggtggcggtgctgctcggcgagcgcgggctggggggcaacgacgccgacctcgagctgcgcctgcgccgatggaagggcgaacgcggccagcgcgcggagaatgcgcgaaggctggcggaacgctggagcaagctggtccccgctcccgcgagcggcagggggttagggggt

SEQ ID NO: 41612 - DNA, 918 bp, SPHINGOMONAS
aacgcggtgatcctcgatcgcatgcagtcggaaatcccgctgattccggagcttgccggccatctgatcgccggcggcggcaagcggatgcggccgatgctgacgctcgcgagcgcgcggctgctcggctatgccggcacccgccaccacaagctggccgccgcggtggagttcatccacaccgcgaccctgctccatgacgacgtggtcgacagctcggacctgcgccggggtcgccgcaccgccaacatcatctggggcaatccggccagcgtactggtcggcgacttcctgttcagccgctcgttcgagctgatggtcgaggcggagagcctcaaggcactccgcatcctgtcgggcgccagcgcgatcattgccgagggcgaggtcaaccagctcaccgcggtgcgccggatcgacctttccgaggatcgctatctcgacatcatcggcgccaagaccgccgcgctgttcgccgccgcctgccgcatcgcgggcgtggtggccgagcgtcccgagacggaggaaatggcgctcgacgcctatggccgcaatctcggcatcgccttccagctggtcgacgacgcgatcgactatgtctcggacgcgtcgaccatgggcaaggatgccggcgacgatttccgcgaaggcaagatgaccctgccggtgattctcgcctatgcgcgcggcaacgagacggaacgcggcttctggaaggaagcgatttcgggccgccgcaattcggacgaggatttcgccgaggcgatccggctggtgcagagctgccgcgcggtggacgatacgctggcgcgcgcccgccattatggccagcgcgcgatcgatgcgctgggcggcttccgcgcctgcgaggcgaaggacgcgatggtcgaggcggtggaattcgcggtggcgcgcgcc

SEQ ID NO: 41613 - DNA, 1557 bp, SPHINGOMONAS
tggtggcagaagggcgtgatctaccaggtctatccgcggtcgtacgccgattcgaacggcgacgggatcggcgatctggcgggcgtcgccgcgcggctcgactatctggtcgatctcggtgtcgacgcggtgtggctgtcgccgatcttcccctctccgatggccgatttcggctatgacgtggcggactatcgcgggatcgatccgcgcttcggcacgctcgcggatttcgatgcgcttcgcgacgccgcgcatgcccgcggcctcaagctgctgctcgatttcgtgccgaaccacagctcgagcgagcacccctggttcctcgaaagccgcgcctcccgcgagaaccctaagcgcgactggtatatctggcgcgacgccgcacccgatggcgggccgcccaacaactggcagagctatttcggcggcagcgcctgggaatgggatgcggccaccggccaatattatctccaccagttcctcaaggagcagcccgagctcaactggcgcaacccggatctgcgcgccgcgatgctggaggcgatgcgcttctggttcgatcgcggcgtcgacgggttccgcatcgacgtgctgtggctggcgatcaagcatcccgacttccccgacaatcccgcaaatcccgcctggcgcgaggggatgcaggacatcgagcggctgctgcccgcccattcggccgaccagcccgagatgatggaaatcatcgcggcgatgcgcgacgtgacggatgcctatcccgagcgggtgctgatcggcgagatctatctgccgatcccgcgcctcgtcgcctattatggcgcgcgcgggaacggggtgcatctgcccttcaacttccatctgctcgacgcgacatgggacgcggcggcgctcgctcggttgatcgccgagtatgagggtgcgctgccggcaggcggctggcccaactgggtgctcggcaaccacgacaagccgcgggtcgcctcgcgggttggcccagaacaggcggcggttgcgatgatgctgctgctcaccctgcgcggcaccccgacattgtaccagggtgacgagctgggcatgcccaacgtgccgatcccgcccgaacgggtgcaggacccgcaggcgctccgcgagcccgataccgccttcaaccgcgacgaggtccgcacgccgatgccgtgggatgccagcgcgcatgccggattcagcacggtggagccctggttgccgctcaacccggactgggcggaacgcaacgtgatggcgcagcgggacgacgcaggctcgatgttggccttcacccgcgcgctgctccagctgcggcgggcgcattctgcactgtcggtggggagctggcatgccgtgtcgagcgacggcgcggtgctggcgtacgaacggcggcacggcgcggatcgcgtgctggtcgcgctcaacctgtcagatgcgccgcaggcgctggcgctgccggactgggccgtgacgctcgcccccgtgctcaccacgccccatcacgaccttcgtgcggagggcgccaccctcctcctcgccccgaaccaaggcatt

SEQ ID NO: 41614 - DNA, 1008 bp, SPHINGOMONAS
aaaaaggcgattattaccggtatctcggggcaggacggcgcttatctcgcggagtttcttctcgagaaagggtacaaggtcttcgctacgttccggcgcacgagttctgtgaacttctggcgtatcgatgagcttggaatcaccaaccatccgaacctcacgctggtcgaatacgatctgaccgatctggcttcgagcatccgactgttggagacgtgccagccggatgaggtctataatctcgcggcgcagagcttcgtcggcgtttccttcgaccagccggttaccaccgctaagatcacgggcatcggtcccctaaacctcttggaagcgatccgcatcgttaatccgcggattcgcttctatcaggcaagcacgtccgaaatgtttggcaaggtccaggctattccccagaacgaggatacgccgttctatcctcgcagcccttacggtgtcgcgaagttgttcgggcactggaccacgataaactatcgggaaagctatgacatcttcgggtgcagcggcattttgttcaatcatgagagtcctctgcgtggtcgcgaattcgtgacccgcaagatcacggactcggtggcgaagataaagcttggtaaaatggagtatcttgaactcggtaacattgactccaagcgcgattggggcttcgctaaagaatacgtcgagggcatgtggatgatgatgcagagcgacgttcccgacacctacgtgctggcgaccaaccgcacggaaaccgtccgcgactttcttcgtctcgccttcaaatgcgtggatatggacattgagttccgcggcaacggggaagaagagtatgcgctggatcgcggtaccgggaaaatggtgatgcggatcaatccagcctattaccgcccggccgaagtcgacctgctaatcggcaacccggaaaaggcgcgtaccgagctgggctgggaagctaagaccacccttgaggagttgtgccgattgatggtcgaagcggatctgcgacgc

SEQ ID NO: 41615 - DNA, 645 bp, SPHINGOMONAS
atgatcaccgtcagcgacgtatcgaaggtttatccgacgcggcacggaagcgtgcttgtcctggatggcgtgaacttcgacgtgaagcccggcgaaaaggttgcgtttcttggtcgcaatggtgccggcaagtccaccttggtccgcctgatcagtggggctgaagcgcccaccagcgggaccattcgtcgcgaaatgacggtatcctggcctctggcgtttggtggtgcctttcagagcgctctgaccggactggacaacatgcgattcatttgccggttgtacggtctcgattggaaagaacgcgtcgcgtacgtggaagagttcagcgagctgggcgcttatctgaaggagccggtgcgatcctactcggcgggcatgcgcgcgcgccttgccttcgcggtgtcgatggtcgttgagttcgactgtttcttgatcgacgaaatcatcgcggtcggcgatgcgcgttttcacgagaaatgtaggattgagctgtttgagaagcgtgcggatagggcgctcatcatcgtgtcgcatgatgccccgtacatccgagaccactgttctcgcgttggcgtcttgaacaaggggcgcttgacgatgtttgacgacatcgacgagggatacgtcttctacaagagcatc

SEQ ID NO: 41616 - DNA, 681 bp, SPHINGOMONAS
atcatcgtgaccgggggtagccggggtctcggacggtccatttgcgagcgtctgctgtcaaaggggcaggaggtccttgcgcttgcgcgttcggtggaggacgtgccctatgctgcgctagcgtgcgatgtgtccgactacgcgcaggtaaaagccgtcgcgaagcaccttcggcaaaataacatgaaggtttccggtgttgtaaatgccgccggtatcgctgccatgaatctggcggtcaccacgccgccggacactacggcgcgtgttgtgcaggttaatttgcttggtacgatctattgttgccaagtatttgcgccgttgatgatgcgtcagaagggcggatgctttatcaatttctcgacgattgcggtggcgctaggcctaaagggggaggcggtctacgccgcgtccaaagctggcgtcgaagggtttagccgcgcgttcgcgcgcgagatggcagactttaacatccgtgtgaactgcatcgcacctgggccgatcgacaccgccctcctgcgtgggattacatccgaccagatcgggaaaattgtttcccagcaaatattgccttggcagtttgggccggatgcggtcagcgacgtagtagaacttctgctcgacgatcgtagtggatcgctgtctgggcaggtctttggcattggtggcgcatgagcactc

SEQ ID NO: 41617 - DNA, 1908 bp, SPHINGOMONAS
aacccctggatgaagagcctgctcatctgggtaggaatcctcgcagccctggcgttgttcgtcacgctgttcgatacccgcaccgcgcagcccacgggcaacgcgatcccctattcgactttcctcgacaaggtgcagtcgggcgacgtgaaggagaccaacatcacgccgggaagcggcgcgatcggtttcaccacgagcgaaggcaagttccgcacgaacaatcccggcgatccgaagctggtcgagacgctgcgcgccaagggcgtggtgatcaacgcgcggcctgaggatacgccctcgatctggcagtacatcctggtccagtcgctgcccttcctgctgttcctcggcatcgccttcttcgtgctgcgccagatgcagaagaattcgggctcgggcgcgatgggcttcggcaagagccgcgcccgcctgctgacgcagaaggaaggcaaggtcaccttcgacgacgtcgccggcatcgacgaggcgcgcgaggagctgcaggagatcgtcgagttcctaaaggacccctcgaagttcgcacgcctgggcggcaagatccccaagggcgcgctgctggtcggctcgcccggtaccggcaagacgctgctcgcccgcgcgatcgccggcgaggcgggcgtgcccttcttcaccatttcgggttcagacttcgtcgagatgttcgtcggcgttggcgcgagccgcgtgcgcgacatgttcgagcaggccaagaagtcggcaccgtgcatcgtcttcatcgacgaaatcgacgcggtcggccggtcgcgcggtgcaggactgggcaaccagaatgacgagcgcgagcagacgctgaaccagctgctggtcgagatggacggcttcgaggcgaacgaaggcatcatcatcgtcgccgcgaccaatcgccccgacgtgctcgatccggcgctgctgcgtccgggccgcttcgaccgccaggtgcaggtgccgcgccccgatatcgagggccgcgtgaagatcctgcaggtccatatgaagaaggtgccgatcgcacccgacgtcgatgcccgcgtgatcgcgcgcggcacaccgggcttctcgggtgccgatctcgccaacctggtcaacgaggcggcgctgctcgcggctcgtcgcggcaagcggctggtggcggcgcaggaattcgacgacgcgcgtgacaaggtgctgatgggcgccgagcgccgctccatggtgatgaccgacgacgagaagcggatgaccgcctatcacgaggccggccacgccctggtgttcgcgcacgagccgaccgccgatccgatccacaaggcgacgatcatcccgcgcggctttgccctcggcatggtgcagccgctgccggagcgcgattcctacagctatcaccgtgacaagatgcacgccgacatcgccgtggcgttcggcggccgcgtcgccgaggagctgatcttcggctatgacaaggtcagctcgggcgcctcgaacgatatcatgcaggcgacccgtctggcgcgtgcgatggtcaccaagtggggcctgtcggacaatctcggcccgctcgacttctccgagagcgaggacagcttcaccggctattcggtgcagcgcgccaagccgatgtcggatgagaccgcgcgcctgatcgacgctgaggtgaaggcgttcgtcgagaaggggctcaaccgcgcgcggcagatcctgggcgaccataccgaccagctccacaccatcgcgcaagcgctgctcgaatatgagacgctgaccggcgaggagatcaagaagctgatcgccggcgagacgctggatcgcggcgatcccaccggcacgccgggtatgccggcggtgggcggcacctcgatccccaagacgcgcaagctgaaggatccgttcggcaatccggcgccgcag

SEQ ID NO: 41618 - DNA, 1719 bp, SPHINGOMONAS
ctcacgccgcttcccgccagcgtgcagatgggcaaaggcagcttcaccgtgacgaacggtacaggcatcgccgtccctgccggcgacaccgcagctgcgaacgccgcgaagctgctcgtcgcgcacgtgaaggtggaacgcggcctgaccctgggcgctgccggcaccaacggcgtgatccgcttcgaccgcgacgcagccgttaagggcgaagaggcctaccgcctcaccatcgacgccaagggcgtgcgcatcgccgcctcgagcgaccgcggtttgctctacggcgcgatgacgctggcgcagctgctcagccccgaccacggcttcggcaaggcggtgaagctgccggcgctcagcgtcgaggacgccccccgcttcggctggcgcgggctgatgctcgacgttgcgcgccacttccagccgatcgagttcgtctacggcgtggtcgaccagatggcctcggtgaagctcaacacgttgcacctgcacctgaccgacgaccagggatggcgcttcgaggtaaagcgctatcccaagctcaccgaagtgggcggctggcggaccccgccgagcaccggcggcgcgccgggcccgaaggtcggcggcttctacacccaggaacagctgaaaggcctggttgcctatgccgccgagcgcggcgtgaccatcgtgccggaaatcgacctgccgggccatgcccaggcgctggtcgccgcctatcccgaactcggcatcttcggtgacaagcccgaggtgtcgcacgactggggcgtgaacccctatctgttcaaccccggccccaagggcatcgccttcgtcaaggaagtgctcgacgagctgatggcggtgttccccggcacctatgtccatctcggcggcgacgaagcggtgaaggaccagtgggagcgctcgccggaggtgcaggcgcagatgaaggcgctcggcatcaagaccgaaaacgggctgcagagctggatgatcgaccagttcggcgcctatctggagggccatggccgccgcctgatcggctgggacgagatcctcgaaggtggcctgccgccctcggcctcggtgatgtcgtggcgcggcgagaagggcgcggtggaagccgccaatgcggggcatgacgtggtgctctcgcccgcccccaccctctatctcgacagcctgcagagcgatcgtcgcgacgagccgccgggccgcctctcgatccagacgctggccgatgtctacaagtacgagccgatgcccgtcggcatcgatgcggccaaggcgagccatgtgctcggcgcgcagggcaatgcgtggagcgaatatttgatcacgccgtaccaggtgcagcacatgctgttcccgcgcgccgcggcgatcgccgaaatcacctggtcgggcaaggacaagcgcgacttcaccggcttcgtgacgcgcctccagccgcagatcgcgcgctggcgccgttcaggcatggaagtcgccgacagcgccttcgccgtcgattacaagctgcagggcacgcgcggcgaggcgctgcgggcaaaccaggccaaggtgacgctcgccacccagaccggtttcggcacgatccgctacacgctcgacggcaagcagcccaccgccaagtcgccggtgtacaaggcaccgttggcgctcaagcccggcacgacgatcaccgcggcggcgttcgacgcagccggcatcgtcaccgctaccccgcgc

SEQ ID NO: 41619 - DNA, 2412 bp, SPHINGOMONAS
gccgcacgggccgtggagggtgacggcttccccatgcccccgcccaggaccgcgctgccgcagcgtttgccggatggcgatcccacgcggacccgcatcgaacgcggctggcgcttccatgaaggggatgtcgcccccgcgccgctcaaggaccatgacgatacctatggtagcgtgaaggcaggcaatgcccgcggtgccgctgcgcgggatttcgacgacagcgactgggcggaagtgcgcctgccgcacgactgggcttcgttccagccgttcgacaagaccgccaacgtctcgcagggctatcgcaagcgcggcatcggctggtaccgccgccggctgacgctcgatcctgccgatcacggcaagaccatcgagctgcatctcgacggtgtcgcgaccaatgccaccgtgtgggtgaacggcagcgtcgtcgcgcacagctggtcgggctatgccagcatccttatcgacatgacgccgttcgcgcggttcggcgacgaagacaatgtgatcgcgatccgcgtcgatgcggaggcgatggagggctggtggtacgaaggcgcggggctctaccgccatgcctggctggtgcgccggtcgccggtgtcgatcgtcaccgacggggtacattgcgatccgcgcaagaccgacaatggctggcaggtgccggtcaccgtcacgatcggcaatatcgagcgtgcgccggtgggcgtgacgatcgaggccgaactgctcgatccggccggcaagcgcgtcgccatcggcaccaccgccgcgacggcactggtgctcgatcgcgtcgaggcctcgatcgagctgtccgccggtgcgccgcagctctggtccgtcgagacgccgacgctctataccgtccacacccggctgctgcgcgacggcaagctgatcgacgagcgccgcaccgcgatcggcttccgcaccgtccgcttcgatgccgacaaggggctgttcgtcaacgacaagcccgtcaagctgaagggcgtgtgcatccaccaggaccatgccggcgtgggcgtggcgcaatatgacgcgttgctcggctggcggctcgagcggctcaaggcgatgggctgcaacgcgatccgcatgtcgcacaacgcgcccaccgccgagctgctcgactggtgcgaccggatgggcttcctcgtcatggacgagaaccgccacttcaatccggcgcccgattatctggcccagctcagctggatggtgcggcgcgaccgcaaccatccgagcgtcatcctctggtcggtgttcaacgaagagccgatgcagggcaccgaatccggcatcgagatggttcgccgcatggaagccgcggtgcgcaagctcgacgacagccgcccggtgacctcggcgatgaacgggtcgttctacaatccgtcgaacgtctcgtcggtcgtcgacgtgatgggcttcaactattaccagggcgagtatgacaagtggcaccggctgaaccccggccggcccagcaccagctccgaggataccagcgcgttcgaaacacgcggcgccttcgccagcgatcccgccgcgcacgtcatcacctcgtacgacgaggagcccgcgccctggggcaacacgcaccgcaaggcatggcagctgatcgccgcgcgcgagttcatcgcgggcggcttcgtctggaccgggttcgactatcacggcgagccgacgccctatgcctggccgaccatcgccagcttcttcggcatcatggacctgtgcggtttccccaagaccgcgttcgggattcacagcgccgcctggatcgatgacgccccggtggtgtggctggcgccgcactggacctggccgggcagggaaggccaggcgatcaaggtgttcgtcgcctccaatgccgagagcgtgacgctgctgctcaacgggaaggcgatcggcacccagaaggtcgatcggctgcagggcaatgaatggcaggtgccctatgcgcccggccggctggaagcgcaggcgatgcgcggcggcaaggtcgtggcgcgcatggttcacgagaccgccggcgagccggtcgcgctgcggctgacgcccgcccgcaccgtgatggcgggcgatgacgaggacgtccagccgatcaccatcgacgcggtcgacgccaagggccggcatgtgccgacggcgaacctcatgacgaatttcacggtcgagggcgctgcgatcatcggcgtgggcaatggcgacccgaactgccatgagccggagaagggcaatgcgcgctcgctgttcaacggcctcgcgcagatcctggtgcaggccggcaccggccgcggcaagatcaccgtcaaggcgaccgccgaggggctcaagcccgcgctgctgacgatcgaccgcgccgacatcgcgccgcgcccgcaggtcggcgtgaccccg

SEQ ID NO: 41620 - DNA, 1977 bp, SPHINGOMONAS
gaggtggtcgttcccctcgcccatggcatccatgcccgccccgccgcgcgactgcgcgaagtgctggtccccttcgccgccagggtgacgatcaccaaaggcgatcagagcgccgatgcgcgcagccccgtgcggctgatgacgctgggcatcaagctgggcgacaccatccgcatcaccgccgagggtggccgcgccgacgaagcagccgccacgcttgccgcgctgatcgagaccggcatgggcgagaaggccgatccggccaacgcccccgctcccgcgcctgccgccgccccggttgcagcaccggtatcgaacgagcccggcctgctgggcggcgtcaccgccgcgcccggtctcgccatcggcaccgcatgcttcttccgccttcccgagctcagcatcgatccggtcggcaagggcgccagcctcgaacgcgcgcgactggaggatggcatcgccaaggtggttcgcgcgatcgacgccgatctcagccacgccgccggaccgatgcgctcgatcctgacggcccaccgtaccatgctcgacgatccggacatgctggaaaccgcgcggcaggcgatcctcgacggcgccagcgccggccatgcctggcggctcgcgctgcgtccgcaggccgatctgctgcgggccagcggcgacgcccacctcgccgagcgcgccgacgacatggtcgatctggagcgccgcgtcgtttccgcgatcgagggactggaagacgcgccgctggtgttcccgccggacacgatcctcctcgccgacgacctgttgccgtcgcaggtaacggggctcgacccggcacaggtgcgcggcttcgccaccgtgcgcggcgggccgacctcgcatgtggcaatcctggccgccagcctcggcattcccgcgctggtcgccatgggtgcgccgctgcggggcatcgcggagggcgagacgctgatcctcgatgccggcgccggcacgatccgcatcgcacccgatactgcccagcgcgccgaggcgcaggcccgggtcgacgctcgcgccgccgcgctcgccggcgcccatgccgccgccgccgcgcccgccaagctggcggacggcacccgcatcgaggtattcgccaatctcggttcggtcggcgatgccgagcgcgccgttgccgcaggggcagaaggcagcggcctgctgcgcaccgaattcctgttcctggaacgagagacgccgcccagcgtcgccgaacagacggccgaatatcaggcgatcgcggacgcgctgcagggccgcccgctgatcatccggctgctcgacatcggcggcgacaagcccgcgccctatctgccgatcgccacggaagagaacccggcgctagggcttcgcggcatccgcgtcggcctcgcccacccacaggtgctggaagaccagctgcgcgcgatcctgggcgtgcgcccgatcggcatcgcgaagatcatgctgccgatgatcgccagcgtcggcgagcttcgcgccgtccgcgccgtgttggaccggctgcgcgacgaactcggcatcggtgagaaggtggagctcggcatcatggtcgaaacgcctgccgccgccgccaccgcagacctgctggcaacggaagccgacttcctgtcgatcggcaccaacgacctcacccaatatacgctcgccatggaccgcgggaacccggcggtggcaagcggcatcgacgggctgcatccggcggtgctgcgcctgatcgccgacacctgtcgaggagccgctgccaggggccgctgggtcggcgtgtgcggcggcctcgcctccgatccgctggcggtgccgatcctggtgggtctcggcgtcaccgagctttccgccaccgtatcggtggtgccggaggtgaaggccctgctcgctacccttacgctcgagcacgcccgtgcccatgccgccgcagcgctcaactgcgccaccgccgccgatgtccgccgcctt

SEQ ID NO: 41621 - DNA, 1395 bp, SPHINGOMONAS
accaacgactatgtcatcaaggacatcgcgctcgccgatttcggccgtaaggagatcgagatcgccgagaccgaaatgcccggtctgatggcgctccgcaaggaattcggcccgtcgcagccgctgaagggcgcgcggatcaccggttcgctgcacatgacgatccagaccgcggtgctgatcgagacgctgaccgcgctgggcgcgcaggtccgctgggcgacctgcaacatcttctcgacgcaggaccatgccgccgccgcgatcgccgcgaccggcgtgccggtgttcgcggtgaagggcgagagcctggccgaatattgggattatgtcggcgacatcttcaactggggcgccgacggtgacggcaccaccgccaacatcatcctcgatgacggcggcgacgcgaccatgttcgcgctgtggggcgccaagctcgaagccggcgcgacgctgggcgagccggagaatgacgaggaagtcgagttccagcgcgcgctgaaggcgttcgtcgccaagtatccgggctacctcaccaagaccgtgcagaacctgaagggcgtctcggaagagaccaccaccggcgtgcaccgcctgtacgagatcgccaagaagggcgagctgccgttcccggcgatcaacgtcaacgacagcgtcaccaagtcgaagttcgacaacctctatggctgcaaggaatcgctggtcgacgctatccgtcgcgccaccgacgtgatgctcgccggcaaggttgcgtgcgtcgccggcttcggtgacgtgggcaagggctcggcccagagcttgcgcaacggcggcgcccgcgtgatggtcaccgaaatcgatccgatctgcgcactgcaggcggcgatggaaggcttcgaggtcgtcacgatggacgaggccgtgaagcgcgccgacatcttcgtgaccgcgaccggcaacgccgacgtgatcaccgccgatcacatgaaggcgatgaagccgatgtcgatcgtgtgcaacatcggccacttcgacagcgagatccagatcgccgcgctgtcgaactacaagtggaccgaagtgaagcccggcaccgacctggtcgagttcccggacggcaagcagatcatcatcctcgccaagggccgcctggtgaatctgggctgcgccaccggccaccccagcttcgtgatgtcggccagcttcaccaaccagacgctggcgcagatcgagctgtggacccgcggcgagcactacaaaaacgaagtctacgtcctgccgaagcacctcgacgagaaggtcgcggcgctgcacctcgaaaagctgggcgtccagctgtcgaagctcagcgagaagcaggcggcctatatcggcgtgaagccggaaggcccgttcaagccggatcattatcgctac

SEQ ID NO: 41622 - DNA, 726 bp, SPHINGOMONAS
cgtcggaaactggtggctggaaactggaagatgcacgggatgcggtcgcacctggtggagatcgatgcgatcgtcgccgccgcacgggcgcacccgcaggtcgatacgctgttgtgcgtgcccttcacgctgatcgccgcggcggccgagcttgcgggcgacttcacgatcggcgcgcaggatgtccacgagaatgatttcggcgcgcataccggctgcgtttccgcgcagatgctggcggaggccggcgcaagggtggtgatcgtcggccattccgagcgccgtgccgaccagtccgagaccagccaccatgcctgggcgaaggcggccgcggcgcgccgacacgggctgggcgtgatcctgtgctgcggcgagaccgaggccgagcacgatgccggccgcgccgagcgcatcgtccagtcgcagatcgagaagtcgctgcccgacggtgccgcgcccgattggctgaccatcgcctatgagccgcgctgggcgatcggcaccggcaagacgccgacgctggacgagatcgcgaccatgcacgcgatcatccgcgccaagctgcgcggcatgatcggcgcttccgccaacgacatgcgcatcctctatggcggctcggtcagcgctgccaatgccgccgcgatcctcgccgtggaggacgtcgacggggccctggtcggcggtgccagccttacggccgagaaattcgtgccgatcattgaggcg

SEQ ID NO: 41623 - DNA, 1629 bp, SPHINGOMONAS
atgtacaagtacgacgaatatgacgcttccatcgtcgccgcacgcgtcgaggaattccgcgatcaggtccagcgccgcctcgccggccatctgaccgaggaccagttcaagccgctgcggctgatgaacggcctctacctgcagctccatgcctatatgctgcgcgtggcggtgccctatggcacgctcgacagccggcagatgcacatgctcgcccacatcgcgcgcaaatatgatcgcggctatggccatttcaccacccgccagaacctccagtacaactggatcaagctggaggacgcgcccgacatcctcgccgagctggcgacggtggagatgcacgccatccagaccagcggcaactgcatccgcaacatcagctcggaccagttcgccggtgcggccgccgacgaggtcaccgatccgcgcccctgggccgaactactccgccagtggagcaccttccaccccgaattcagctaccttccgcgcaagttcaagatcgcggtcatcgccagcgacaccgatcgcgcggcgatgcggctgcacgacatcggcatccagatcgtgcgtaacgacgcgggcgatctcggcgcgcgcatccatgccggcggcggcatgggccgcacgccgatgatcgcgcatctgatcaaggacttcgtgcccttcgccgatttcgtcagctatctggaggcgtgcctgcgcgtctacaatcgccacggccggcgcgacaatatctacaaggcgcgcatcaagatcctcatccatgcccttggcgcagaagaatatgcccgccaggtggaagaggagttccaggcggtgaaagcgctgggcatcgatccgccccaggccgaattcgaccgcatcgccgcgcatttcgcgccgcctgccttcgaggcaggcgccgtcgataccgtggaccgcagcgaccccgatttcgcggtgtggctcgaccagaacgtccatgcccacaaggcgccgggctatgcggtggtcacgatcagcctcaagccgatcggcggcattcccggcgacgcctcggccgaccagatcgacgcgatggccgatctcgccgagcgctacagcttcgacgagttgcgggtgactcatgcccagaacatcgtgctgccgcacgtccgcaaggccgatctctacgccgtatggaccgcgctgcgcgaggcgggcctcgccgaggccaatctcgacctgatcagcgacatcatcgcctgcccgggcctcgattattgcagcctcgccaacgcccgctcgatcccactcgcgcagaagatcagcgaacgcttcggtgatccggcccgccagcgcgacctgggcgagctcaagctcaagatctcgggctgcatcaacgcctgcggccaccatcatgccggccatatcggcatcctcggcgtcgaccggaaaggcaccgagaattaccagctgctgctcggcggatcgggcgcggaggatgtcagcctggccgacatcaccggccccggcttcagcgaggacggcgtggtcgacgcgatcgagcgcgcgacggacgtctatgtccgcgaacgcacgcccggcgagcgcttcgtcgacacctatcgccgcatcggcatggcaccgttcaaggaggccatttat

SEQ ID NO: 41624 - DNA, 2019 bp, SPHINGOMONAS
atgaccaatccgctgctcgacacgctggcccttccccatttcgacgcgatccaccccgatcagatcgcccccgcgctcgacgcggtgatcgccgagcatcaggcggcggtggaacgggtcatcgccagcgaatcgcgcagcttcgacgatgtgtggatgccgctggagcgtgcggaaacggcgatcgacgcgctttggtcgaccgtctcgcacctgcgcggcgtcgccgacacgcccgagctgcgcgccgcccatgccgccggccaggcccggctgatcgagaatcagctggcggtgatgcagaatcaggcgctgtacgaggtgctggtcgccctgacagcgacgcccgacttcgccgcccgcccccaggcggatcgcgccgcggtggagcacatggtccgcgatttccgcctgtcgggcgtggcactggatgccgaggcaaaggcgcgcttcgcggcagtgtcggtcgagctgtccaccctctccaccgggttcggcaatgccgtgctggacgcgaccgatgcctggttcgagcatatcgaggatccggcgctgctcgccggcatttcgcctgccgacatggcgatcttcgcggacgcggcgaaggcgcgcgggctggagggctgggtggtcacgctgcaggcgccgagcgtcagcgcggtgctgaccttcgccgagaatcgcgatctgcgcgcgcgcctctaccgcgcctatggcactcgcgcctcggatcaggggccgcatgccggccagttcgacaacggcccccgcatcgccgcgctgctcgagctgcgccgcgaggcggcgcagctgctcggcttccccgatccggtcgcctggtcgctcgccaccaagatggccccggcggcgggcgaggtgctggcgttcctgcgcgacctcggccgccgcgccaggccggcagcgcaggcggagttcgccgagctttcggccttcgccgcccgggaactcggcatcgacacgctccagccctgggacgtgcccttcgcctcggaccggctgcgcgccgcgcgctatgcggtggacgagcaggaggtgcgcgcgcacttccccgtggagcgcgtgatcgccggctggcaggcgctgctcgcgcggctgttcggcgtccggctggtcgcccgaccggacgtggccgtctatcatcccgatgcctgttattatgacgtggtcgatgccgagggggtggtgatcgccggcgtctataccgatctccatgcccgcgccggcaagcgcagcggtgcctggatggcgcaggcccgaccccgactgaacgacggcaatgtccgccgcgtgccggtggcctatctggtctgcaacttcgcgccgaagaccgagggcagcccctcgctgctcagccatcccgaagtcgtcacgctgctgcacgagaccggccactgcctccaccatctgttcacccgggtcgaccgtccgaacatcgccggcaccagcggcttcgaatgggacgcggtggagctgccgagccagctgatggaggatttcgcctgggaccgcgatgtgctgcgcggcatgtccggccatcacgcaaccggcgccccgctgccggatgtgctgttcgacaagctgatcgccgcccgccgtttccttgccggcatggcgctggtccgccagatcgaattcgcgctgttcgacctgctgctccatctgggcaccatgggcagcgatcccatggaggtgatcaaggcggtacgcgacgaggtggcggtggtccgcccgcccgaatggcatcgtttcccgcatgccttcagccacatcttcgccggcggctacgcctcgggctattacagctatctctgggccgaggtgctggcggcggacggcttccagggctttgccgaagccgggctgatcgaccgggcaaccgccgatcgcttccgcgacgaggtgctcgcgcggggcgccagccgcccggcggcggagagcttccgcgccttccggggccgggatcccgatccgcaggcgatgctgctccgccacgggctg

SEQ ID NO: 41625 - DNA, 1227 bp, SPHINGOMONAS
ggcgttgtccgcatggtacggcatggccatgtcgaagccaccggtccaaactgcgcgctgggggacctgtgtgaaattgcatgcgacgacggcgtcttgatggccgaagtggccggcgtggaggatgggagcctgaccctcgtgccactggaacagggccgccagctacgcccaggcatgcgcgtccacccggtaaagggcggtagcgctgcagcggtgggtgacggattcgccgggcgggcaatagacggcctcggtcgggcgatagatggcaagggccccgtatcgagggatgcatttgcgccgctcgcaggctcgatgccggggccgcttgagcgagtggccaccggccgccggctcacgaccggattgcgtgcaatcgatgggctattgacgctaacggaagggcaacgcgtcggcgtcttcgctgccgcgggcgtcggaaagactagtctgatcgagcagttcgcccgacagatcgcttctgatcgctgtgtgctgtgcctcgttggggaacgtgggcgagaggtggagagcctgtggcgcgtgctgtcggcgcgcgccgatgctacgcggttcacccttgtcgccgcgacatccgacgagacggcggcagtacgggctcgggcaccgcgccttgctcttagtctcgccgaatactggcgtgaccgcggcgagcatgtccttctaatcatcgattccatcacgcgcttcgctatggcacagcgtgagatcgggctggcggccggagagccaccaacagtgcgcgcctatacaccgaatgtcttcgccgccctacctcggcttgttgagcgctgcggagcggttcaagcgggtggtgccatcaccgcgctaatgacggtcttgagtgaaaccgatgatctcgatgatccgatcgtcgaggtgatgaagtcattgcttgatgggcatattctcctctcgcgtacgctcgcggagcgaggccatttcccggcgatcgatgtttcgcgttcgatcagtcgtcaagctgcgaaggtcatggactccagccatgcggctgtagcgcgtagcgccatttcgcaattgggggtttatgaagaagcccgaatcatgatcgagagcggcgtctacaaagccggctcgaacgcagagattgataaagcaatcgaaacgcgcgagcgcttgatggactttcttcgccagtcgcagaatgacaactcgagtttttcgaacacgctcgctggcctg

SEQ ID NO: 41626 - DNA, 777 bp, SPHINGOMONAS
caggcgttcggccagtcgttccagcggttcggctttgcggtggtgcgcgatcatggcgtgccgcaggaactgatcgagcgcgcctggcgcctgaccaaggcgttcttcgacctgcccgaggaagagaagcgcgcccacttcatccccggcggcggcggcgcgcgcggctacacgccgttcaagaccgagatcgccaagggtgcgacccatgtcgatctgaaggaattctggcacatcggccgccagctggccgccggccatcgttttgccgacgtgatggcgccgaacatctggccgacccggcccgagggctttcgcgagacctttatcgagctgttcgccgccttcgacgcggccggcgacaagctgctctcagcggtggcgcgctatctgggcctcgcacccgactggttcgacaccgcggtgaaggacggcaactcggtgctgcgcctgctccactatccgccggtcgccgccgatgcgcccgaggtgcgcgccggtgcgcatgaggacatcaacctcatcaccctgctgctcggcgccgaagaagccgggctcgagctgctcgatcgcgacggcaagtggctggcggtgaagccgcccgagggcgcgatggtgatcaatgtcggcgacatgctgcagcggctgaccaaccatgtgctgccctcgaccacgcatcgcgtggtcaacccgccggccgagcgtcgcggccattcgcgctactcgatgccgttcttcctgcatccggcgccggatttcctgatcaagacgctgccc

SEQ ID NO: 41627 - DNA, 1269 bp, SPHINGOMONAS
ttgcgcgtggcattggcggggctcgggacggtgggcggaggcgtgattcgcctgctcgacgccaatgccgagctgattagccgccgcgccggccgccgaatcgaggtggtcgccgtttccgcccgcgatcgcaccaaggaccgcggcatcgacctgtcgcgcttcgactgggtcgacgatcccgtcgaactcgcccgccatgccaaggcggacgtggtggtcgagctggtcggcgggtcggacggcccggccctggcgctcgcccgcgcggcgctgggcgccaacaagagcttcgtcaccgccaacaaggcgatgatcgcgcatcatgggctggagcttgcgcaggcggcggaagacgcttcggtcgcgctgaagttcgaggcggccgtcgccggcggcgtgccggtgatcaagggcctgcgcgaaggtgccgcagccaacgcgatttcccgcgtctacggcatcctcaacggcacctgcaatttcatcctgtcgaagatggaggccgagggccgcgacttcgccgagatcctcgccgaggcgcaggcgctgggctatgccgaggcggaccccaccttcgacatcgacggtatcgatgccgcgcacaagctttcgatcctcgccagcatcgccttcggcacccagcccgccttcggcgacctgaaggcgagcggcatccgccatatcctggccgccgacatcgccgaggcggcgacgctcggctaccgcgtgcggctgctcggcattgcggacgcgggcgcgcacgggctgttccagcgcgtccatccgcacctcgtttcgctcagccatccgctggcgcacgtgaccggttcgaccaacgccgtggtcgcggaaggcaatttcgtcggccggctgctgttccagggtgccggcgccggcgacggccccacggccagcgcggtggtggcagacctgatcgacatcgcccgcggcgaattcggcccgccctatgcgatgccggcgacggcgctcgtttcccagcccccggcggacagcggcgagcggcgcggccggtcctatgtgcgcttcaccgtggcggaccgggtcggcgtgctggcggagatcgccgcggcgatgcgggatgccggcgtctcgatcgagagcctgatccagcgcggcgtcagccccgacggcagcgcccttgtcgccatcgtcacgcacgaggcgccggaacggagcatcgcccaggcgctggaaaagctgcgggggtcgcagagcctcaccggcgagccgatgtggatgcacatc

SEQ ID NO: 41628 - DNA, 900 bp, SPHINGOMONAS
atcctgtcgctacgccaggtctccaagacctacgcgtcgggccataccgcgctcgaccatgtcgatctcgacatccaccgcggcgagatcttcgccctgctcgggccaaacggcgcgggcaagaccacgctcatctcgatcatctgcggcatcgtcacgcccagcacagggacgatcctggtcgacgggcacgacgcgatccgccagccgcgcgcggcgcgctcccggatcgggctggtgccgcaggagatcgcggtcgacatgttctcgcgcgtcggctcggccgcgcgctattcgcgcgggctgttcggcaaggcgcccgaccacgcctattgcgaccagctcctcaaggacctgtcgctgtgggacaagcgcgacgccaagatcatggagctgtcgggcggcatgaagcgccgcgtgatgatcgccaaggcgctcagccacgaacccgacatcctgttcctcgacgagccgaccgctggcgtcgacgtcgagctgcgccgcgacatgtggaagctgatcggccgcctgcgcgaccgcggcaccacgatcatcctgaccacgcattacatcgaggaggccgaggaaatggccgaccgggtgggcgtgatcaacaaggggcagctgctgctggtcgaggaaaagactgcgctgatgaagaagctcggcaagcgcgagctggacctcagcctggtcgagccgctcgccgcgatcccggccgagctcggcgaatggcagctgagcctcgccgacgagggccacaagctgcgctacaccttcgacgcgcaggccgagcgcaccggcatcccgtcgctgctgcgcaagctgcacgacctcaacatcgccttcaaggatctcgacacgtccaagtcgagcctggaggacatcttcgtcgacctg

SEQ ID NO: 41629 - DNA, 600 bp, SPHINGOMONAS
cgtgccgaagggcgccgagcattaacgattgctggcgacgtcggcgacaaggcgttctgcgaagaggccgtttccaaggtaattgccgagttcggccgcctggacatcctcgtcaacaatgccggggagcagcacccggacaaggatatcaccgacatcaccgagcagcagctccgccgcaccttccagaccaacatcttcgggatgttctttctggtgcaggccgcctcgccgcatctcaaggaaggcgccgcgatcgtcaactgcacctcggtgacgatgtatcagggcgagcccgagctgctcgactacagcgcgaccaagggcgcgatcacggccttcacccgcagcctgtcgatgaacttgatcgagaagggcatccgcgtgaacgcggtggcgccgggcccgatctggacgccgctcaaccccagcggcggcgcgagccccgagaagctcgagcatttcggcgagagcgtgccgatgggccgcccaggccagcccaacgaggtcgcccccgccttcctgttcctcgcctgcgaggattcgagctacatgtcggggcaggtgctccacccgaacggcggcaccgtcgtcaacggc

SEQ ID NO: 41630 - DNA, 1353 bp, SPHINGOMONAS
accgatccgcaggacatcgaaccctggctcaccgactggcgccgccgctatcacggcgccgcgcccgccatcctctcgcccgcctcgactgaggaagtcagcgcgctggtggcgctggccaacgatctcggtcagccgctggtgccgcagggcggaaataccggcatggtcggcggggcggtgccgccggtcgacggatcggcactgctgctctccacccggcggatgaacacgatccgccggatggatgccgaggcgaacctggcggtggccgaggcgggcgtgatcctcgccaccttccgcgacgcggccgaggctgcagggcgccgcttcccgctggacctcggcgcgcggggaagtgccacgatcggcgggctggtttccaccaacgcgggcggcgtgcaggtgctgcgcttcggcacgatgcgcgcgctggtcgccggcgtcgaggcggtgctgcccgacggttcggtgcacgacggcctgtcggcgctcaaaaaggacaatcgcggctacgacctcaaccagctgctgatcggcgccgagggcacgctgggcatcgtcaccgccgcgacgctgcggctggtgccggcggcggcggcgcgggcggtcgcctgggtggggctggaaagcccggccaaggcgctcaccctggtggcgcgcctccaggccgcgaccgacatgatcgaaagttttgagatcatgcccgacgataccgcggcgctcgtgctggagcatgtgcccggcacgcgcgtgccgctggccggcagccatcgctggcacgtgctgatcgaggcggtgacgagcgatgcaggcgccgaggccccggcggcggtgctggagcggatgctggcgggtgctttcgaggccgggctggccgaggatgcggtgatcgccgcgagcgaggcgcaggcggagagcttctggcgcatccgccattccatctccgaggccgagcgcgccgcgggccctgccgtgcagcacgacatctccgtgccggtggaggacatgccgcgcttcatggtggaaggcggcgcggaggccgaggcgcgttttcccggcacgcacgcgatcgcctatggccatctcggcgacggcaacgtccattttcatgtgcgtgcgcccaagggggcggaccgcgatcgctggtatgcggaggaggggccgcaaatcacccggctggtgcacgacatggtggtggcggccggcggctcgatttcggcggagcacggcatcggtcagatgaagcgcgacgaactcgcccgcctgtccccgccggcccgcatcgccgcgttgcgggcgatcaagagtgccttggatcccaagctgattctcaatccgggaaagctggtc

SEQ ID NO: 41631 - DNA, 1326 bp, SPHINGOMONAS
atgagctttgccgatctcggcctttctgacgaactcctccgcgcggtgaccgacgccggctatactgagccgactccgatccagcgtcaggcgatcccgtcggtgctgatgggcaaggacctgatcggcatcgcccagacgggcaccggcaagaccgcagccttcgtgctcccgatgatcgatgtgctcggcgaagggcgcacccgcgcgctgatgccgcgctcgctgatcctggagccgacgcgcgaactggcggcacaggtcgcggagaatttcgagaaatacggcctcaatcacaagctctccatggcgctgctgatcggcggcgtgcagatgggcgaccaggtcaaggcgctggaaaagggcgtcgacgtactcatcgccacgccgggccggctgatggacctttatggccgcggcaagatcctgctgaccggctgcagcctgctggtgatcgacgaagcggaccggatgctcgacatggggttcattcccgatatcgaggaaatctgcaccaagctgccgaagaaccgccagacgctgctgttctcggcgacgatgccgccgccgatcaagaagctggcggacaagttccttaccgatcccaagacgatcgaagtggcgcgccccgccaccaccaacgtcaacatcacccagcgcatcgtgcaggtgcccgccaccgcgcatgtgaagcgcgacgtgctgcgccgcctgctgcagcaggacgaggtgtcgaccgcgatcatcttctgcaatcgcaagacgaccgtgcgcgacctgaacaagagcctgaagaagcacggcttccgctcggccgagattcacggcgacatggaccagtccgcccgcatcgccgagctcgaccggttcaagaatggcgacgtcaacatcctcgtcgcctccgacgttgctgcgcgcgggctcgacgtgaagggcgtgagccacgtcttcaacttcgatgccccctggcacccggacgattatgtccaccgcatcggccgcaccggccgcgggggtgctaccggcaccgcctacacgctggtgacgccggaggacgccgagaacatcgccgagatcgagaagctgaccggccacaagatcgagcgcgtgccgagcccggtcgcgatcgatggcgcggacgaggcgccggcgccgaagcgcgcccgcggcggcaagcgtgacgccaagaaggccgagccgcgtcgcgaggaagccgtcgccgaggcgcccgcgaagcccaagtcccgccgtgcagccgcgccggtccgcgaggaaggcccggcgcccgccccgcgcgaggagcagcgcagccgtccgccgcgcgag

SEQ ID NO: 41632 - DNA, 2262 bp, SPHINGOMONAS
ctcgaagccaccctccacaaggcgctcgaggctgcgtcctcgcgccggcacgaatatgcaacgctcgagcatctgctgctcgcgctgatcgacgacgaacatgcctcgaaggtaatgggcgcgtgcggggtggacctgggcgaactgaaaaccaccgtcgcgcattatctcgataccgagctggaagcgctgaaggtggaaaacgccaccgatccctccccgaccagcgggttccagcgcgtcgtccagcgcgcgatcctgcacgtccagtcctcgggccgcgacgaagtgaccggcgccaacgtgctggtcgcgctgttcagcgagcgcgagagctatgcggtctatttcctgcagcagcaggacatgagccggctcgatgccgtcagcttcatcagccacggcgtcggcaagggcggcaccacgcccaccgaggcgagcacccccaagggcgctgccgaggaagacaagtcgaacaagcaggaggcgaagacgggcaagggtgagagcgcgctcaagcaattcaccgtcgacctcaacgagaaggcgaagatcggcaaggtcgatccgctgatcggccgcgcggccgaggtcgaccgcaccgtccagatcctgtgccggcgcagcaagaacaatccgctctatgtgggcgatcccggcgtcggcaagaccgccatcgccgagggcctggcgcgcaagatcgtcgagggtgaagtgcccgacgtgctcaaggaagcggtgatctactcgctagacatgggcgcgctgcttgccggcacccgctatcgcggcgacttcgaggagcgcctgaagcaggtcgtctcggagctggagaagctgccccacgcggtgctgttcatcgacgagatccacaccgtgatcggcgcgggcgcgacgagcggcggcgcgatggatgcgtcgaacctgctgaaacccgcactgtccggcggctcgatccgctgcatcggctcgaccacctacaaggaattccgcaaccacttcgagaaggaccgcgcgctgctgcgccgtttccagaagatcgacgtcaacgaaccgtcggtcgaggatacggtgaagatcctggccggcctgcgctcggcgttcgagcagcaccattcggtgaagtacacccccgacgcgatcaagtcggcggtcgagctgtcggcgcgctacatcaacgaccgcaagctgccggacaaggcgatcgacgtgatcgacgaagtcggcgcgatgcagatgctggtggcgccgtccaagcgcaagaaggtcatcacccccaaggagatcgagcaggtcatcgcgaccatggcgcgcatcccaccgaagaccgtctcgtcggacgacaccaaggtgctcgccaatatcgagcaggatctgaagcgcgtcgtgttcggtcaggacaaggcgatcgaggtcctgtcctcggcgatcaagctgagccgtgcgggcctgcgcgatccggacaagccgatcggcaactatctgttctcgggcccgacgggcgtcggcaagaccgaggtggcgaagcagctggccaacctgctcggcatcccgctccagcgcttcgacatgtccgagtacatggagcgccactcggtcagccggctgatcggcgcgcctccgggctatgtcggctatgaccagggcggcctgctgaccgacgcggtcgaccagaacccgcattcggtgctgctgctcgacgagatcgagaaggcgcatccggacctgttcaacatcctcttgcaagtgatggacaacggcaagctgaccgatcaccacggcaagaccgtcgacttccgcaacaccatcctcatcctgaccaccaatgccggtgcgtcggacatggcgaaggaaagcgtgggctttggcgagctgagccgcgaggacgtgcaggaagaggcggtgaagaatctcttcacccccgaattccgcaaccgcctcgatgcgatcgtgccgttcggctatctgccgccggaagtcgtcgcccgcgtggtcgacaagttcgtgctgcagctggagctccagctcaccgatcgcggcgtccacatccatctggacgaggaagcgaaggcgtggctcaccaagcgcggctatgacaagctgtacggcgcgcgcccgatgggccgcctgatgcaggagaagatcaagcagccgctcgccgaggagctgctgttcggcaagctcgtccatggcggcgaggtgaacgtgaagctgaaggacaatgcgctggccttcgagatcacgccggcggcgccgaagaag

SEQ ID NO: 41633 - DNA, 1302 bp, SPHINGOMONAS
ctcgccagtgccgcccgtgcgatccgagagatggtccccgaccgtcgcttcggtcgcgtggtggcggtgcgcggcgcgctcatcgaagtggagggcctggccggcgtcgcccagatcggcagccgcgtcgagatccagtcccccggcggcaaggtggaagccgaagtcaccgcgctcgaccgcggcgtcgccttgtgcctgcccttcgtcgatccccaaggcgtgggcctgggcgcgatcgccgagctgggcgccggccagttcaccgtccgcccctccaaggcgtggcttggccgcatgatcaacggcctggggcgcccggtcgacggcctcggcccgctggtcaacggcgccgatccgcaaccgatcaaggcctcgccccccgccgccgccggccgctcgcgcgtggccgagcggatcgagaccggggtacgctgcctcgataccttcgtgcccttgtgccgcggccagcggctcggcctgttcgccggatcgggcgtcggcaagtcggtcctcctctcgatgctcgcgcgctggacgcagtgcgacgtcgcggtgatcggcctgatcggcgaacgcggccgcgaagtgcaggaattcatcgaggacgatctggggcccgaaggcatggcccgatcggtcgtcgtcgtcgccacctcggacgagccggcgctgatgcgccggcaggccgcctggaccaccctcgccgttgccgaacatttccgcgaccaggggctgaacgtgctgtgcctgatggactcggtcacccgcttcgcgatggcgcagcgcgagatcggcctcgcctcgggcgagccgccggcgaccaagggctatacccccaccgtgttcgccgagctgccgcgtttgctggagcgcgccggcccgggcgcccccggccagggcatgatcaccggcctgttcaccgtgctcgtcgacggcgacgaccataacgagccggtggcggacgcggtgcgcggcatcctagacggccatgtggtgatgcgccgcgcgatcgccgagcgcggccgctatccggcgatcgacgtgctcaaatcggtctcgcggaccctgccccattgcctggaagccgagcagaacgacgtccgcctcgccgcgcgcaagctgctgtccacctatgccgacatggaagagatggtgcggctgggcgcatacaaggcgggttcctcgcccgaggtcgatcgcgccgtggcactggcgccgcgcatcgaggcgctgctcaaccagggcaagaacgaccagggccatgccgaggcggcgttcgccgaactggcggcgatcctt

SEQ ID NO: 41634 - DNA, 729 bp, SPHINGOMONAS
agcctgaagggcaagcgggtcctgataaccggcggtggttcgggcatcggcgccgggttggtcgaaggcttcgtccgccagggcgcggacgtgaccttcttcgacatcgccgaggcggattcgcaggcgctggtcgccagcctgaccgacgcggcgatcgcgccgcgcttctatcgtgtcgatctcaccgacattcccgccgcgcaggcgcaggtgcaggcgctgatcgaggccgagggcggcttcgacgtgctgctgaacaacgccgccaatgacgatcgccacacgatcgagcaggtgaccccggaatattgggacaaccgcctcaacgtgaacctgcgccaccagttcttcctggcgcaggcggtgattccggcgatgaaggccaagcgcgccggcgtgatcatcaacctcggctcgatctcgtggcacctcgccctggaggagctgacgctctaccagaccgccaaggcggcgatcgagggcctgacccgcagcctggcgcgcgagctgggcccggacggcatccgctcggtctgcatcgtccccggcaacgtcaagacgccgcgccagatgaagtggtacacgcccgagggcgaggccgagatcgtcaaggcgcagtgcctgcccggccgcctggtgccggacgacatcgccgcgctggcgctgttccttgcatccgacgatgcccggctgataacgagccacgaattcttcgtggatgcaggc

SEQ ID NO: 41635 - DNA, 804 bp, SPHINGOMONAS
gaaggcccggtatgggtggagcgcgatgccgcgctttggttcgtcgacatcaagagccacaagatccaccgctatgatcccgccaccggcgacaaggcgagctgggacgcgccggcgcaggtgggcttcgcgctgccggcggcgagcggcggcttcgtcgcggggctgcagaccgggctcgccaggttcgatccgacggacggcagcttcgtgcccctggtcgatcccgaacccgaactgcccggcaaccggctgaacgacggcaccgtcgattcggaaggccgcctgtggttcggcacgatggacgacggcgagagcgcggccaccggcaccatctatcgcctggcagcggacggcagctgcgtgccctccagccccaaggtatcgatcaccaacggcccggcggtctcgcccgacggcaagacgctctaccatgtcgatacgctcggcgcggtggtctatgcctgcgacatcgatccggacggcgcgctggtgaaccgccgcgagttcgtgcgcatcgccgagggcgaaggcttcccggacggcccgtgcgtcgacagcgagggctatgtgtgggtgagcctgtacgtcggctcggaggtgcgtcgctactcgcctgcgggcgagctggtcgagacggtgcccttccccgtcgatgcgatcaccaagatcgcgttcggcggcccggacctgaagacggtcttcgccaccaccgcgaacaagcacctttcggccgaagacaaggccgcacggccgagttcgggcgacctgttccgcttccgcgtgacggtggccggtcagccg

SEQ ID NO: 41636 - DNA, 1368 bp, SPHINGOMONAS
gccaatatcggcctgatcggcgccatcgtggcggtcgccacgatcggcggattgcttttcggatatgacagcggcgcggtgaacggcacccagccgggcctgcaggcggcgttcgcgctcgacgaggccgggctcggcttcaccgtcggttcgctgctgatcggctgcttcatcggcgccttcttcgccggcacgctggcagacgcgatcggccgccgcaacgtgatgcggctcgccgccttcatcttcctcgtcggcgcgctggcgcagggcttcgcgcacctccacggcgtgttcgtggtcgcccggatcgccggcggcatcgcggtgggcgccgcctcggtgctgtcgcctgcctatatctccgaagtcgcgcccgcgaacattcgcggccggatgacgacggtgcagcagatcatgatcatctccggcctcaccgccgcgttcgtggtcaactattatctcgcggctgccgccggcgcctcgaccaacgccttctgggccgggctcgaagcgtggcgctggatgtacctgatgcaggcgatccccgctgcggtattcctggtcgcgctgttcttcattccggaaagcccgcgcttcctggtcgccaagggccgcatcgaggaagcgaccaaggtgctgaccgacctgttcggcccgcagactgcgcgcaccaagctggaggaaatccgcgcgagcttcagcgccgaccaccgcccgagcttccgcgacctgatcgacccgcgcaccggcggcatccgctcgatcctgtgggcgggcctggtgatcgcggtgttccagcagctcgtcggcatcaacgtgatcttctactatggctcgacgctgtggcagctcgccggtttcaccgaggcggactcgctgctgatcaacatcgtctcgggcgcggtttcgatcgccgcctgcctcgtcaccatcggcctggtcgacaagatcggccgcaagccgctgctgctgatcggttccgcgggcatggcggtcacgctgttcgtgctggtctatgccttcggccacggctcgctcgacgccgccggcaagctggtcctctcgccggacctcggcaagaccgcggtgatcgccgccaacctgtatgtgatcttcttcaacgtcagctggggcccggtgatgtgggtgatgctcggcgagatgttcccgaaccagatccgcggctcggcgctggccgtgtgcggcttcgcccagtggttcgccaactatctgatcgcgcagagcttcccggtgatggcatcgaagctcggccttgccgccagctacaccttctatgccgtctgcgcggcggtcagcttcttcctcgtcctgaagttcatcaaggaaaccaagggcaaggaactc

SEQ ID NO: 41637 - DNA, 1038 bp, SPHINGOMONAS
gccgctgccgcctcgcccgcctatcaggtatcgacgcgctgcggcacgacgccgcgctgcttccccacgttgcaaggggcattggacgccgccgccggcgaccggtcgacctcctggacctcgatcaccatcgcgcccggcacctatcgggagaagccggtggtgcggcgcgaccgggtgcggatcaccggcgccggcgcggaccgcacgcgcatcgtgttcggggcggtggccgagaccgcgggccgctatgaccccgcccaatggggcacgccgggctcggcgacgctgaccatccatgccagcgacgtgacggtgcgcggcctgacgatcgagaacgacttcgactatctcgccaatgatgccctggctgcgggcgattcgaagaaggtcggcgcgtcccagggcgtggcactgctgctcgacaccgacagcgaccgggtggcgttcgacggggtatcgctgctcggctaccaggacacgctgtttacccgcggacgccgcgcctggttccggcgggggctgatcgcgggcaatgtcgacttcatcttcggcagcggcatgctgctgatcgaggatagcgaaatccgctcgcgtcgccgcgcccagcccacaccgccaggcgagtacgcctcgttcatcaccgcaccgtcgaccccgctgtcgcaaccgatcggcatcgtgatccatcgctcccgtctcacccgcgaggccggcgtggcggacggatcggtcgcgctcggccggccctggcatccgacgacgcggtttcccgacggccgctatgccgatccgcaggcggtcggccaggcatcctttctcgactgcacgatggatgcgcatatccatcccgatcactggaccagcatggccggcaccgcccgtgacggcaccaagacggcgatcttccggcccgaggagtcgcgcttctccgaaagcggctccaccggccccggcgcgcgccgcaacccgcaggcgatccgctggaccgctgcactgccgatcgcggccgtgcgggcgcggctgttcgagggctgg

SEQ ID NO: 41638 - DNA, 1257 bp, SPHINGOMONAS
atcgccgtcgccgccgcactggccggcctgttgttcggcttcgacaccgcggtcgtctccggggttaccgcaccgatcacccaggccttcgggctgagccccaccggcaccggcatcgcggtctcggccgcgttggtcggcacgctgatcgccgccctcggtgccggtatccccggcgaccgctacggcgcgcgcgcggtgctgcgctgggtgggcgtggcgttcatcctctcggcgctgggctgcgcgctggctaccggcctcaccagcttcgtgctgttccgcttcatcggcggcttggcgatcggcggcgcctcggtgctggcgccggtattcatcgccgagatcagccccagcgcgcggcgcggggcgctggtcgggctcttccagctctcgatcgtcagcggcatcctcgcggcctattgcagcaacgccgtggtctcggcgctcccgctcggcgaggctgcctggcgctggaagctgggcgtcatgatcgtgccggggctggtcttcctgctcgcgatgttcaccattccccagagcccgcgctggctcgccgcccgcggccgcgagagcgaggcgctggacgtggcagcccggatcggcctcaccgactggacgctggccccaccgcacggcgacgacggcgaacgcctttcctgggcgcgccaccgcacgccgatcctgctcgccatcgcggtggccagcttcaaccagctcaccggcatcaacgcgatcctctattatctgaacgacatcttcgccgccgccgggttcagccaggtctccgccgacgtccaggcggtctcgatcggcgcggccaacctgctggcgacgctgctcgcgatgacgctgatcgaccgggtcggccgccgcacgctgctgctggtgggcgcggccggcacggccgtgatgctggccggcgtggcgctggtctatgcgagccgggggctcgaggcgctactgctgccgttgctggtgctgttcatcgccttcttcgcggtgtcgcagggggcggtgatctgggtgtatctgtcggaaatcttccccacccgcgtccgcgcccgcggccaggccctgggcagcgccacccactggatctgggcggcgctgctcagcttcggcttcccgatcgtcgcgcagaatttcgatcgcagcctgcccttctggttcttcgcgggcgccaccctgctccagctgctcgtggtctggcgcttcttccccgagaccaagggcgtccggctcgaggacatggaa

SEQ ID NO: 41639 - DNA, 1032 bp, SPHINGOMONAS
atggccaccaaagcctatggcgcctatgccgccgacaagccgctcgagccgatcgagatcgaacgccgcgcgcccggtgcgcacgacgtgcagatcgacatcgcctattgcggcgtctgccattcggacctccaccaggtccgctccgaatgggaaggcacgctctatccgtgcgtgcccggccacgagatcgtcggccgggtcagtgcggtgggcgagcatgtgcgcaagttcgcggtcggcgatctcgtcggtgtcggctgcatggtcgacagctgccagcactgcgcttcgtgcgacgaggggctggagcaatattgcgagaacggcttcgtcggcacctataacggcccgacgcccgatgctcccggccatacgctgggcggctattcgcagcagatcgtggtcagcgacaagttcgtgctgaaggtgaaccatggcgaggaacagctcgccgcggtcgcgccgttgctctgcgcgggcatcaccacctggtcgccgctgcgccactggcaggtcggcccgggcaagaaggtgggcatcgtcggcatcggcgggctcggccatatgggcgtgaagctggcccatgcgctgggcgcgcatgtcgtcgccttcaccacctcggagagcaagcgcgccgatgcgctggcgctgggtgccgacgaagtcgtcgtctcgcgcgatgcggacgccatggcggcgcacgcgaacagcttcgacttcatcctggacacggtggccgccagccacaatctggatgcgttcaccaccctgctgaagcgcgacggcacgctgacgctggtgggcgtgcccgagcatgcgcacccttcgcccaacgtcgcggcgctgatcttcaagcgccgctcgatcgcgggctcgctgatcggcggcatcgccgagacgcaggagatgctcgatttctgtgccgagcacggcatcgtcgccgacatcgagatgatccgcgccgacgagatcgaggcggcgtacgcgcggatgctcaagagcgacgtgaaataccgcttcgtcatcgac

SEQ ID NO: 41640 - DNA, 1140 bp, SPHINGOMONAS
gcgactcaggcggtgcgcggcggtaccgcgcgctccgagttcggcgagaccagcgaggcgctgttcctcacctcgggctatgcctatgattgcgcgggcgatgccgccgcgcgtttcgccggcgagcaggtcggcatgacctattcgcgcctccagaacccgacggtggagatgctggagcagcgcatcgccctgctcgaaggcgctgaggcctgccgcaccatggccaccggcatggcggcgatgaccgccgcgctcctctgccaggtcagccagggcgaccatatcgtccagggccgcgccgccttcggctcgtgccgctggctgaccgacagcctgttgccgcgcttcggcgtgaccacgacgacgatcgacgcgcgcgatccgcagcagttcgtggatgcgatccgcccgaacaccaagatcttcttcttcgagacccccgccaatccgacgatggatgtggtggacctggcagcggtctgcgcgatcgcccggaagcacggcatcgtcacggtggtcgacaacgccttcgcgacccccgccctccagcggccgatggagttcggcgcggacgtcgtcgcctattccgccaccaagatgatggacgggcagggccgcgtgctggccggcgcggtgtgcgggtccgaggatttcatcaccaacacgctgctgcccttcacccgcaacaccggcccgacgctcagcgcgttcaacgcctgggtggtgctgaagggcctcgagacgctcgacctgcgcatccgccgccagagcgagaatgcgctcaaggtcggcagcttccttgaggaacgggtgccgcgggtgaacttccccgcgctgcccagccatccgcagcacgccctgttcatgcgccagatggcagccgccggcccgatcttcagcttcgaggtggatggcggccgcgaacaggcccatgcgctgctcgacggcctggagctgatcgatatctcgaacaacatcggggactcgcgctcgctgatgactcacccgtcctccaccacccattccggcctcgccgaggagaagcggctggagatgggcgtcaccgagggcatgatccgcatcaatgtcggcctcgaggacgcagacgacctgatcgcggatctcgaccaggcactg

SEQ ID NO: 41641 - DNA, 726 bp, SPHINGOMONAS
ctgagcgcctctgatctgtccgtaagcctcggcaagcgccgcgtcctgcatggcatcaacgcggtgctgcggcccggcaaggtcaccgcgatccttggtcccaacggctccggcaagtcgacgctggtgcgcacacttgccggtctgctcacgcccgacgcgggcagggtgacgctgggcggcacaccgctcgcccggctcgacccgcgcgagcgcgcccggcgcatgggctatctgccgcaggaagcgacggtgcactgggacgtgggcgtggcagacctggtggcgctcggccgcctgccccaccgcgcgccttttgccggactttccaccgaggatcatgctgcgatcgactctgcgatcgaggcgaccggcgtccggtcgctggccggccggctcgtcacccagctctccggcggcgagcgtgcccgggtgctgttggcccgcgtgctggccggggagccgcagtggctgctggccgacgagccgctggcgagcctcgatccggtccaccagctcgacctgctcgatcggctccgcgcgctggccgcgggtggcatgggcgtggtgatcgtgctgcacgacctggtgcaggccgcccgcgccgccgacgacgtgctgctgctccgcgagggccggccggtggcggtcggtccggccgcgacgacgctcgcccaccagccgctgcgcgaggcgttcggcgtggaagtgatggtgatcggcgac

SEQ ID NO: 41642 - DNA, 1170 bp, SPHINGOMONAS
ttcaagacgctcgacgacatgggcgatatcaccggcaagcgggtgctggtccgcgaggacctcaacgtgccgatggccgacggcaaggtaaccgacgacacgcgcctgcgtgccgcgatccagaccgtcgccgaactggcggacaagggcgccaaggtcctcgtcctcgcccatttcggccgccccaagggcgtgcccagcgccgaattctcactcgcccaggttgtgaagccgttcgagcaggtgctcggccgtccggtccgctatatcgactgggaaggcgatgccgcctcggtcgcgacgctgaacgacggcgacatcgcgctcctggaaaacacccgcttcttcggcggggaagagaagaacgatcccgccgtggtcgatcgcttcgccgccctgggcgacctctatgtcaacgacgccttctcggccgcgcaccgcgcccacgcctcgaccgagggcctcgcccacaagctgcccgcctttgccggccgccagatggaagccgagctcgacgcgctcgacaaggcgctcggcaatcccgagcatccggtcgcagccgtggtcggcggcgccaaggtctcgaccaagctcgacgtgctcaagcacctcgtggcacgcgttgaccatctgatcatcggcggcggcatggccaacaccttccttgcggcacgcggcgtggacgtgggcaagagcctgtgcgagcatgacctgaccggcaccgccgaggagatcctcgacgccgccgacgcggccggctgcaccgtccacctgccgtacgatgtggtggtggcgaaggaattccgcgccaacccgccagtgcgcaccgtcaatgtccatgaggttgcggccgacgagatgatcctcgatgtcggccccgccgccaccgaggcgctcgccgacgtgctcaagacctgcaagacgctggtctggaacggcccgatgggcgcgttcgagatcccgcccttcgacgcggcgaccgtctcgctcgcccgcaccgcggcggcgctcaccaaggaagggtcgctcgtttcggttgccggcggtggcgacacggtggcggcgctcaaccaggccggggtggccggcgagttcagcttcgtctcgaccgcgggcggcgccttcctcgaatggatggaaggcaaggaactgccgggcgtcgccgcgctc

SEQ ID NO: 41643 - DNA, 993 bp, SPHINGOMONAS
atgacgaaggttgcgatcaacggtttcggacggatcggccgtctggtggcacgcgcgatcctcgagcgcccggaaagcggtctcgagctggtcacgatcaacgatctgtcggacgccaagtcgaacgcgtggctgttctcgcgggacagcatccacggcaagtatcccggcacggtcgaagccgagggtaacgacatcgtcgtcgacggcaagcgtatcaaggtgaccgccgagcgcgatccggccaacctgccgcacgccgagaacggcgtcgacatcgtgctggagtgcaccggcttcttcaccgatcgcgcatcggcccagaagcacatcgacgccggcgccaagaaggtgctgatctcggctccgggcaagaatgtcgacctcaccgtcgtctacggcgtgaaccacgacaagctgaccgccgagcacacgatcgtctccaacgcatcgtgcactaccaactgcctggcgccggtcgccaaggtcctcaacgacgcgatcggcatcgagcgcggcctgatgaccacggtccacgcctataccaacgaccagaagatcctcgaccagatccacccggacctgcgtcgtgcgcgtgccgccgccatgtcgatcatcccgaccacgaccggcgctgcccgcgcggtgggcgaggtgctgccggagctcaagggcaagctcgacggttcggccgtccgcgtgccggtgccggacggcagcctcgtcgacctgaccttccagccgagccgcgatacctcggtcgaggaagtcaacgcggtgctgaaggcggcttcggaaagcggcccgctcaagggcgtgctggtctacaccgccgatccgatcgtctcggccgacatcgtgcacacgcccgcctcgtcgaccgtcgacagcctggaaacggccgtgatcgacggcaagctggtccgcgtggtcagctggtacgacaatgaatggggcttctcgaaccgcatggtcgacaccgcgaccgtgatg

SEQ ID NO: 41644 - DNA, 1914 bp, SPHINGOMONAS
gccaacgccatccgcgcgctttccatggacgcggtggaagccgccaattcgggtcaccccggcatgccgatgggcatggccgatgtcgcgaccgtcctcttccagcgctatctcaagttcaatcctgccgatcccgcctggccggatcgcgaccggttcgtgctgtcggcgggccatggctcgatgctgctctactcgctgctgcacctgaccggctatgcacgcccgacgctcgacgatatcaagaacttccgccagatcggcagcccgtgcgcgggccacccggagaatttcgagctcgccggcgtcgaatgcaccaccggcccgctgggccagggcctcgcgatggcggtgggcatggcgatcgccgagcggcacctcaacgcgaccttcggcgacgatctggtcgatcacaagacctgggtgatcgccggtgacgggtgcctgatggaaggcatcaaccacgaagcgatcggcatcgccgggcacctgaagctcaaccgcctgatcgtgctgtgggacgacaacaacatcacgatcgacggcccggtctcgctgtcgtcggtcgaggacattcccgcccgctaccgcgcgaccggctggaacgtgctcgaatgcgacggccatgacgaggcggatatcgtccgcgcgctcgaccaggcgatcgccagcgacaagccggtgctggtcaagtgccgcacggtgatcggcaagggcgcaccgaacaaggagggcacgtccaaggtccatggttcgccgctgggcaaggacgaagtcgccgccgcgcgcgccgcactcggctggaaccacccggccttcgagatccccggcgagatccgcgacgcctggctggccgccggtgcgcgcggcgccgcgccgcacgccgcgtgggccgagcgcctcgccgcgcacccggatcgcctcggctgggaacgccgcggtaccgtgcagccgaacctgctccggccgcatgtccagagcctgctcgccaacccgcaaaaggtcgcgacccgcaaggcgtccgaactggcgctggaggcggtcaacgcgatcctcgacgagacgatcggtggctcggccgacctcaccggctcgaacaacacgctgaccaaggggctgcagcggctcgacgccgacaattatggcggccgctacctcaattacggcatccgcgaattcggcatggccgcggcgatgaacggcatggcgctgcacgggggcgtgatcccctatggcggcaccttcctcgtgtttgcggattatgcgcgcgccgcgatccgcctctcggcacttcagcatgcgcgcgtcgtctatgtgatgacgcacgattcgatcggcctcggcgaggatggcccgacgcaccagccgatcgagcatctgatgagcctgcgcatgatcccgaacctcgacgtgtggcgcccgtgcgacgtcgtcgagaccgccgaggcctgggaagccgcgctcgccaagaccgacggcccggcgctgatcgcgctcagccgccagaacctgccgcagctgcgcaccgaagccgccgagaaccgctcggcccgcggtgcctatgcgctgctggaggccgaggcgccgcgcaaggtggtgctgctcgccaccggctcggaagtcgaagtcgccgtcgcggtgcgcgaggcgctggaggcgcagggcatcggcgccgacgtcgtctcggtcccctgcttcgagcggttcgacgcgcaggacgcgggctacaagcgcgacatcctgccggcagacgcgctcaaggtttcgatcgaggccggcaccactttcgggtgggagcgctatacgggcaccgacggcctgcgcttcggcgtggacggcttcggcgcctcgggcccctatctggggctctacgaacatttcggactcactgcgggcgccatcgtgccccagatc

SEQ ID NO: 41645 - DNA, 1458 bp, SPHINGOMONAS
atggccgaattgcttctggtgatcgacgaggggtcgacctctacccgagcgatgctcttcgcgccgtcggggcaatgtgttgcaagcaaatctgcagaactatcgcagcattatcccggccccggactcgtcgaacacgatgccgacgaaatctggcgacaaagccatgcctgtgccgccgagatcgtggcattggccggcggtcatcagcggatcgcagccatcggcatcaccaaccagcgcgagacggtggtgttctgggacaagaccaccggcattccgctggctcccgcgataagctggcaggatcggcgcagcgcgcccctgtgccagaaactgcgcgaggcgggcgaggaacccggcatccaggcgcgcaccgggctcctgctcgatccctatttttccgggaccaagatcgcctgggccatggcgaactggccacagctgaaggcagcgggtgaccggctggcgatcgggacggtggaaagctggctggtgtggaagctgaccggcggccttcacgtcaccgatgccaccaacgcttcgcgcacgctgctgatgggactgggcagcggggcgtggagcgacggactgatcgaccagttcgacgccccccgcgcggcactgcccgaaattgtcgactgcgccgagcggctcggcgtgacgcgggcgttcggcggggcgatcccgatctgcggcctggccggcgaccagcaggcggcgacgatcggccaggcttgcctgacgccgggcgacacgaaggcgacgttcggtaccggcgccttcgtgctcaccaatgcgggcacgctgcaaccgcgctcgcgccatcggctgctgtcgacggtgctgtggcagcttggcgggcgccgcacctacgcgctggagggctcggtgttcgtcgccggaagcctggtgcagtggctgcgcgattcgctgggactgatcgccaccgccgcggaaacggcgacgctggcgcgatcggtgccggacaatggcggtgtctattgcgtgcccgcgctgaccgggctcggcgcgccctggtgggagccggaggcgcgcgcggccatctccgggctcagcttcgccgccgggcgggcgcatatcgtacgggcagcgctggaggcgatggcgcaccagagccacgacctggaaaccgcgttcgccgccgatggcgcacaatgggcgcggctgcgcgtcgatggcggcatggtgaccaacgactggatcgcgcaggatctggcggatatcctcgccctacctgtcgaccgccccgatttcgcagagacgaccgcgctgggcgcggcaatgctggccggggtgggttgcgggatgttcgccagcctcgacgatgccgcaatgatgcgcggtaccttccgcaccttcgagccacaaatggaggcgcccgtgcgggcgacccgaatggccggatggcgcgatgccctggcccgggtggtagcg

SEQ ID NO: 41646 - DNA, 1667 bp, SPHINGOMONAS
ccgtcgacgccctgctcaccgcgcccggcgccaagttcgaaatggagacggtggagattcgcgggatcccgacgcgggtgtggaagaacagcccccccaacgccgcgatcctcgctcgcctggcgcgcggctatggcgatcggccgttcaccgtctaccaggacgagcgggtcagctacgaggcaaactatcgcgcgacctgccatcttgcctcgtggatgcaggcgcagggcgtggccaaaggagaccgcgtcgcgctggcgatgcgcaacctgcccgaatggccgacgatcttcttcgcggcggtaagcatcggcgcgatcctggtgccgctcaacgcctggtggacgggtgccgagctcgaatatggcatgaaggattcgggcgcgaagctgctcttcgttgacggcgagcggcacgaacggctgaagcaatgctatgccgcgttgccggatctggaacgggtggtggtcagccgcgcctgtacgccgctggaaagcgaggtggtcgcgctcgagtccatcgtcgggccctgcaccggctgggcggcactgcccgacatcgcctttcccgaggttgcgatcgcgccggacgatgacgtgacactgttctacaccagcggcaccaccggcaaccccaagggcgcggtgggaacgcatcgcaacctgatgaccaacatcctcacttcgggttactcggtcgcgcgcgccatgctgcgccggggcgagatgccgccacccgcaccgccctacaaggtggggctgctggtgattccgctgttccatgtgacggcgtgcagtgcggggctgatggcgctgatcgccgcgggcggtacggtggtgttcatgcgccgctgggagcctgtggaggcgatggagatcatccagcgggagaaggtcaaccagaccggcggcgtgccgaccatcgcctggcagctgctcgaacatcccgagcgcgccagctatgatctttccagtctcgacaccatttcctacggcggagcgccgtccgcgcccgaactggtgaagcgcatctacgaggagttcggcgcgctccccggcaatggctggggcatgaccgagacgatggccacggtcacccaccataccggcgaggattacatcgcccggccgaccagcgctggtccgccggtgccggtcgccgagctcaagatcatggatgtggacggcacgcgcgaacttcccgtcggcgaagtcggtgagctttgggccaaggggccgatgatcgtgaagggttattggaacaagcccgaagcgaccgccgagaccttccgggaaggctgggtccgcacaggcgacctggcgcggctggacgaggagggtttcctctacatcgtcgatcgcgccaaggacatcatcatccgcggcggcgagaacatctattcgtcggaagtggaggacgtgctctacgcgcacccggcggtgacggacgcagcgctgatcggcgtgccgcaccgcgcgctcggcgaggagccggtggcggtggtccatctcgccccgggaacctctgcgacagaggcggagctccaagcctttgtccgcgagcgcatcgcagccttcaaggtgccggtggcgatccgcttctcggaggaaaccctgccgcgcaacgccaatggcaagatcctgaagaaggatctgaaggcgctg

SEQ ID NO: 41647 - DNA, 1188 bp, SPHINGOMONAS
caggatctcgatagcttccggagcgaaacccgcgcctggctggaggcgaactgcccagccaccatgcgcgagccgatccggtccgagaaggacatcgtctggggcgggcgcaatcccgattgggcgcatcccgaccagaaactctggatggaccggatggcggaacgcggctggacggtgcccgactggccgacggagtatggcggcggcgggctttccccggccgaaaccaagatcctgcgcgaagagatgaagcggatgggcgcgcggaccccgctcaacagcttcggcatctcgatgctcggcccggcgctgctcaaatacggtaccgaggaacagaagctcgaacatctccccaagatcgcccgcggcgagatccgctggtgccagggctattccgaacccaatgccggttccgacctggccggcctccagacctgggccgaggatgccggcgaccattatgtcgtcaacggccagaaggtgtggaccagctatgccgacaaggccgactggatcttctgcctggtccgcacctccaaggaggccaagcagggcgggatcagcttcctgctgttcgacatggcttcgcacggcgtctcgaccaagccgatcctgctgatctcgggctactcccccttctgcgaaaccttcttcgacaatgtgaaggtgcccaagtcccagcgcgtccacgaggagaacaagggctgggacgtcgccaaatatctgctcggccatgagcgcgagatgatctcgggcatggggctcgaccgggccggcggcaatccgctgatcgagggcgcgatcgcgacgatcgggctcgacgatcagggccggctcgccgatccgatcctccgcgcccagatcgcgctgttcgaggtgcggatgcgcgccttctcggcgatgtccgagcgcttcctcgacgaattgaaggccggccgcgcccaccccgcccagccgagcatgatgaaatatgtcggcaccgagctgaacaagcagcgccacgagctgatcatggccgccggcggatcggatgcgctggaatgggagagcgcggcctcggccaagggcgccaagccgcgcgcctggctgcgcaccaaggccaattcgatcgagggcgggaccagcgagatccagctcaacatcgtcgccaagcggatcctcgaactgccgggctgaggcggcgga

SEQ ID NO: 41648 - DNA, 1116 bp, SPHINGOMONAS
ccagccatgccgctctacctcaacgacgaacagacgatgctccgcgacaccgcgcgcgagttcgtcgccgaacatgccccggtccgccacctccgcgcgatgcgcgacgccaaggaccctaccggcttcagccgcgacctgtggaagcagttcgccgagatgggcctcaccggcatcctgatcccggaggcatcgggcggcctgggcctcggccatgtcgaggcgggcgtggtgctggaggaggtcggccgcaacctcaccccctcccccttcctctccaccgccgtcgccgcggtcgaggcgctgaagggcaccgcgcacgccgagcgctggttccccggcatcgcggccggcgaggcggtgatcgcgatcgcgcatgacgaaaaacccaaattcggccgcgcggtagcgctcaaggccgagcgcgccggcaacggcttccggctgaccggcaccaagcgcttcgcccaccacgcccatgccgccgacctgatcctcgtcaccgcccgcaccgccggcagcgatatggacgcggaaggcatgaccctcttcgcgatcgatcccaaggccgccgggctcgacctccgtcccgagcgcctcgccgactccagcctagccgcgcacgcgaccttcgacggtgtcgaggtcaccaccgatgcggtggtgggcgagatcgatgcgggcgccggtccgctcggccgcctgctccgcgctgccggcgccggcgcctcggccgaactgctcggcgtcggtgcgggcgcgagcgacatgacgctgggctatctcaaggaacgcaagcagttcgggacgttgatcggcagctttcaggcgctccagcaccgcgccgcgcatctctatagcgagctggaagtcgcccgcgccgccacgctcaaggcgcagcagctgctcgatgccggcgaacctgccgacgaggcggtcgcgatcgccaaggcgatgaccgggcttgccaccacgcttgccgtgcaggagggtatccaaatgcatggcggcatcggcatgaccgacgaatatgacatcggcttctacatgaagcgcgctcgcgtgctcgccgagatgttcggtgattccaactatcatgccaatgcgctggccgaa

SEQ ID NO: 41649 - DNA, 1518 bp, SPHINGOMONAS
cttaccctggaaagccgtgtgcggggtgccgagggctggtcgctgacggtggataacggcgcgcgcattgccgaaggcccggccgcgctgccgccggggacgcgggtgcgggtggagggactgttcggccgcgtgccggcgcgacgcaagttcctgcgctccactcgcgcggaatatgcggcctgcctcgatggcatgaagcggttggcgatggcccggcccgacatcgccttctcggtcgagcacgacggccgcagggtgctgagcgtgcagggcggcgaaagccggccggcccgtgtcgcggcgctgaccgaccgcgccctgcaggagaatagcgtcgcaatcgacttcgagcgtgaggggctggtgctcggcggggtggcgagcatccccaccttcaaccgcggcgtggccgatcaccaatatttgttcgtcaatggccggccggtgaaggatcggttgctcgtcggcgcggtgcgtggcgcctatgccgagatgctggcgcgcgatcggcatccggtggtggcgctgttcctcgacgtgccgcccgaggtcgtcgacgtgaacgtgcatccggccaagaccgaggtccgcttccgcgatccggcattggcgcgcgggttgatcgtcagcggcttgcggcgcgcgctgaatgcggcggggcaccgcagcgtgcagcggccgagcgaggcggcgctgggattgtggcaggcgggcggcgggggctcctctagcccctcctccttggaggaggggttggggtggagggattccagaacaggcgttggtctcttcgagactcagccccaccccaacccctcccctgaaggggaggggctaaggcattattccggcgccgtacgcgattccggcacctttttcgccgccgcaccgctcgcccgtgccgagccagcgcgccacgaggcgccgcttgccaccgacttcccgctcggggtcgcgcgcggtcaggtcgccaagacctatatcgtcgcggaggccgaggacggcctcgtcctggtcgaccagcacgccgcgcacgaacggctggtgctggagcggatgcgccgagccatggccggcggcgccgtgccgagccaggcgctgctcctcgccgaagtggtcgaactggacgaacccggatgcgaccggctcgaagcccgaaccgacgaactgcggtctctcggcctcgagctcgaacgcttcggcccgcgcgcgatgctggtccgcgcggtgcctgctgcgctcggcaccggggacatccatggtctggtcaccgatctcgcggacgaactcgccagtttcgacgaggcactgagcctaaaggaacggctcgaccatgtcgctgcgaccatggcctgccatggttcggttcgcgcgggccgcatcctctcggttgccgagatgaacgcactgctccgcgaaatggaggtcaccccccattcgggccagtgcaaccatggccgccccacctggatcaagctggcgcatggcgatatcgagaaactgttcggccgaaag

SEQ ID NO: 41650 - DNA, 1437 bp, SPHINGOMONAS
atccggctggacatgttccactatcttaccggccaccatatcggcttcttccagaaccagcgcggcggctcgctcggccaccgggtgggggcgctgaccggctcgttcgcggcgctcacccatcggattcttatggaagtgacgccgccgctgatcgcctttggcggcgcgctgctgatcttcctgacgatcgactggcgcatggcggtggcgatcaccggcatcttcgtcgccgcgagcacgggcctggtctttctcggcctgcggggtgacaagtaccacaaggcctttgcccgtgccgccagcgagagcggcggcgagatggtcgacttggtcagcaatatcgccgcgatcaagtcgttcggcgcgcgcgcccgcgagtcggagcggctgcgcggcttcttcgagaccgaggcagctgcgcagaagcggggctggatgttcgtcgagcggatccgcgtgctgcatgacgtggcgctggtgctgctggtgggtgcggcgctggtctgggcggtggagcgctggagtgcgggcggcattacggcgggcgacgtggtcgtcgtcagcgccatgaccttccgcatgctcaacggctcgcgtgaccttgccatggcgctgatcgataccagccagcagttcagctatctgcgcgagacgctggagatcgtcggtgccccgcacgcgctggacgatgcgcccgatgcggcgccgttggtggcgacgcaaggcgaagtgcggatcgaaggcgttaccttcggccatcaccctggccgcccggtgctgcacgacctgtcgctgaccgtcgcgccggggcagaagatcggcatcgtcggtccctcgggcgcgggcaagtcgaccatcctccagcttgtccagcgcctgcacgatccgcaaggcggccgcgtgctgatcgacggccagccgatcgaccgggtgacgcaggacagcctgcaccaggccgttgccgtggtgccgcaggaagtgctgctgttccaccgctcgatcctggagaatatccgctttgcccgtcccgacgcgacggatgccgaagtccgtgccgctgccgaggcggcgcactgcgccggcttcatcgcgctgctgccgcagggctatgacacggtggttggcgagcgtggtaccaatctgtcgggtggccagcgccagcggatcggcatcgcgcgcgccttcctcagcaaggcgccgatcgtgctgctcgatgaggcgacctcggcgctcgacaccggctcggagatcgaggtgcagcaggcgctcgacgcgctgatggcgcaccgcacggtgctggcggtcgcgcatcgtctctcgaccgtggtgggcttcgaccgggtgatcgtggtcgagcacggccgcatcgtcgaggacggcccgccgctcacgctgctgcgcgcgggcggagccttccagcggctctggtcgctg

SEQ ID NO: 41651 - DNA, 1272 bp, SPHINGOMONAS
accgccaagctgcatgttgcaggcaaagacgtcgaatatccggtcctgaagggcagcaccggcccggacgtcgtcgatatccgcaagctctacgcgcagaccggcgccttcacctacgatccaggtttcacctcgaccgcaagctgcgaatcgggcctgaccttcatcgatggtgacgaaggcgttctgctgcaccgcggctatccgatcggccagctcgccgaacattcgagcttcatggaggtctcgtacctcctgctgaacggcgaactgccgactcaggccgagctctccaagttcgagaacacgatcacccgtcacaccatgctgcacgagcagctggccaccttctaccgcggcttccgtcgcgatgcgcacccgatggcggtgatgtgcggcgtcgtcggcgcgctttcggccttctaccacgactcgaccgacatcaccgatccgcagcagcgcatgatcgcgtcgcaccgcctgatcgccaagatgccgacgatcgcggccatggcgtacaagtacagcgtcggccagccgttcctctatccgaagaacgatctgagctataccggcaacttcctgcgcatgaccttcggcgttccggccgaggaatatgaagtgaacccggtggtggagaaggcgctcgaccgcatcttcatcctccatgctgatcacgagcagaacgcctcgacctcgaccgtccgcctcgccggttcgtcgggcgccaatccgttcgcctgcatcgcggccggcatcgcgtgcctgtggggcccggcgcatggcggcgccaacgaagccgcgctcaacatgctgcacgagatcggccgtccggagcgtatccccgagttcatcgcccgcgcgaaggacaagaacgatccgttccgcctgatgggcttcggccaccgcgtgtacaagaactacgatccgcgcgcgaccgtgatgcagaagaccgtgcgcgaagtgttcgccgcgctcaacgtttcggaccccgtgttcgaagtcgcgctgcagctcgaggaaatggcgctcaaggacgattacttcgtcgagaagaagctgttcccgaacgtcgacttctattcgggcgtgatcctgtctgcgatcggcttcccgacgacgatgttcaccgcgctgttcgcccttgcccgcaccgtcggctgggtggcgcagtggaacgagatgatctcggatcccgagcagaagatcggccgtccgcgccagctctacaccggcccgacgcagcgcgactacgtgcccgtcggccagcgc

SEQ ID NO: 41652 - DNA, 1374 bp, SPHINGOMONAS
aagcccgtcgtgacgcgcttcgccccctcgcccaccggcttcctccacatcgggggcgcgcgcaccgcgctgttcaacctgctgttcgcccgccatcatggcggcaagttcctgctgcgcatcgaggataccgatcgcgcacggtcgacccagccggcgatcgaggcgatcctcgacgggctgcgctggctcgggctcgattgggacggcgacgaagtctaccagtttgcccgtgccgctcgccacgccgaagtggcccaggcgatgctcgaaaagggcgcggcctatcgctgctacctgacccaggacgaactcgccgcgatgcgcgccgaggcggaagccgccaagaagccgctgcgcatccgctcgccctggcgcgaccgcaccgatggcgacccttcggtgccacacgtcgtccgcctcaaggcgccgaccgagggctcggtgacgatccgcgaccatgtccagggcgaagtaacggtgcagaatgccgagatcgacgatctcgtgctgctgcgctcggacggcacgcctacctacatgctggccgtggtcgtcgacgacaacgacatgggcgtaacccatgtgatccgcggcgacgaccatctcaacaacgccttccgccagctgccgatctaccgcgcaatgggttgggacgagccggaatatgcccatatcccgctgatccacggcgcggacggtgccaagctctccaagcgccacggtgcgctgggtgtcgacgcctatcgcgacgagctcgggctgctgcccgaggcggtgtccaactaccttctccgcctcggctggggccacggcgatgacgagatcatcagtcgggaacaggccgtcgaatggttcgatcttgcaggcgtcggcaaatcaccaagccggttcgatctgaagaagctcgaaaacctcaacggccattatatccgccagtcggatgatgatcgcctggccgatctggttgcggcgcgcctgccgttcgaagtcagcgactcgcaagccgaccttctgcgccgcagcatggcagccctgaagccgcgtgccgccaatctcctcgaactggcggacggcgcgggctttctttttcgcacccgcccactggaattggacgagaacgcggccgctctgctagagggcgacgcgcgcaccctgctcgcccagttgcacaccgcgcttgacggattggcaacgtgggatacggaggcgctcgaagcggcggtacgcaccgtcgccgacgacgcgggcgtgaagctcggcaatctggcgcagccgctgcgtgcggcgttaaccggccgccgaacttccccgggtatcttcgatgtcctggcgttgctgggacgcgaggaaagcctcgcccgcatcgcagac

SEQ ID NO: 41653 - DNA, 1350 bp, SPHINGOMONAS
gagcccgcaacgggtgccgtcctctggcggcacgcaatcggggacgccgataccgaagtcgcgatcgcccgcgccagttgggcgcagtgggccgcccgcccgctcgcggtgcggatcgaggcgctgcgccgtttcgccaacgtcgtgcggcagaaggccgatgcctttaccgacctgatcgcgcgcgagaccggcaagccgctctgggaagcgcgtacagaggtcgagacggtgatcgccaaggtcgacatctcggtcaccagctattcggaacgcaccggccagcgccggatcgaagcgccgatgaacacgcggctggcgctgcggcacaagccgcacggcgtgctggcggtgctgggcccctacaacttcccggcgcacctgccgaacggccacatcgtgcccgcgctgctcgccggcaatgcggtggtgttcaagccctccgagaagacaccggcctgcggcgcatttctcgtcgaatgcttccacgctgccggcatcccggagggctgcgtccgcctgctgatcggcggaccggaccagggcaaggcgctggccagtcatccggatatcgacggcctgctgttcaccggatcggcgaataccggcatcgcgctcaatcgccagttcgccgcccgtccggagaagatcctcgcgctcgagatgggcggcaacaacccgatcgtggtgtggaacacgcccgacatctactccgccgccgtactggtggtacagtccgccttcaccagtgccggccagcgttgcaccgccgcacggcggctgatcgtcgatcagaagctgttcgatccgctgatggaggaactccacaagctgatcggccgcctgatcatcggcgagccgcacgccgatccccagcccttcatgggtccggtgatcgacaacaacaccgccgacatgctgaccgagagcttcctgaccctctccaccatgggcgggcggccgctgcggcacatggaacggcccatcgagaaccgtcccttcctcacccccggcgtcatcgacatgaccgacgcgcgtgagaaggtggacgtcgagctgttcggcccggtgctccaggtattccgcaagacgagcttcgaggaggcgatcgcggaggcgaacgacacccgctatggcctctccgccagcttggtcagccaggatcccaagctctacgatcagttctgggcgaatatccgcgcgggcatcgtcaactggaacaagcccaccaacggcgcctcctcggcggcaccgttcggcggcgtgggctggtcgggcaaccatcgccccagcgcctattatgccgcggactattgcgcctatccggtcgtctcttcggaatccgagcag

SEQ ID NO: 41654 - DNA, 720 bp, SPHINGOMONAS
atgtccgttcgtcgccgttcgctgcttgccggcgcgcttgcgctgcccctcgtcgcccgcgcacagacgcaggaaagctgggagcagcgcaaggagcggctgttgcacgaggactttcccgaactcagccgttatgccgccgacaacgcccgcatcctgtcgtccggcgaaaaggtgaacatcgtcttcctcggcgattcgatcaccgagggctggaagagcaagcgccccggcttcttcacccccggtcgcgtcggccgcggcatcggcgggcagacgacgccgcagatggtgctgcgcatgatggcggacgtggtccatctcaagccccgtttcgtccacatcatggcgggcaccaacgacattgccggcaacacgggcaagatgacccgcgcgcagagttacgacaatttccgcatgatggcgcagatcgccaaggcgaacggaatcggcgtgatcctagcctcggtgccgccggccgatcatttcccgtggcgccaggggctcgacgtggtcgggccgatccgcgagatcaacgcctggctgcagggctatgccaaggccgagcggctgacctgggtcgactacacgcccgtgctgggggatgcgaagggcgcgatgaagcccggcctcgcctatgacggcgtccacccgaccgaagccggctatgacgcgatggccaccgtgatcgagccgatcctgaaggcccgccgcgcgtga

SEQ ID NO: 41655 - DNA, 1347 bp, SPHINGOMONAS
gcctcgcagttcgacgtgatcaatcccgccaccgccgagccctttgcgcgctgccccaaggcggacgccgatcagctgaacgccgccgtcgctgccgccaaggccgccttccccgcctgggccgcgacgccgatcgaggaacgcgcggccaaggtcgaggcggtcgccgcgcggttgcaggagcggctgagcgaattcgccagcctgctcaccagcgaacagggcaagccgctcgaccaggcgaccggcgaggtgatgggcacggtgttcaccctgcgcgccttcacagaaatgcgtccggaaaccaaggtgctgcgcgatgagggcggcaatcgcatcgtcgagcatcgcaccccgctgggcgtggtcgcggcgatcacgccgtggaacttcccgatgatccttgccgccaacaagatcggcccggcgctggtcgccggcaataccatggtactcaagccggcgccgacgacgccgctcaccacgctgctgatgggcgagatcttcgccgaactgctgccgccgggcgtgatcaacatcatctgcgaccagaacgatctgggcgcgctgctcaccacccatcccgatgtcgcgaagatcgccttcactggatcgaccgccaccggcaagaaggtgatggcgagcgccgccgacggcgtgaagcgcgtgacactggagctgggcggcaacgacgccgcgatcgtgctcgacgatgtcgagccggcgctggcggccaggaaggtcttccagggcgcgatgtacaatgccgggcagatctgcgtcgcggtgaagcgcgcctatgtgcccgaggggatgtacgaggaattctgcgacgagatcgccgaactggcccgcaacacggtggtcgatgatggcgccaagcagggtgccaaggtcggcccggtccagaacgcgatgcagttcgagaaggtgaaggcgctgatcgaggatgccaaggagcgcggcaccgtgctggccggcggcgatgcgctcgatcggcccggctatttcattccgccgacgatcgtccgcgatctcgacgacgacgccccgctggtccgcgaagagcagttcggaccggtactgccggtgctgaagtacagcgatatcgacgaggtcatcgcccgcgccaatgattccgaatacgggctgggcggcacgatctggggtcgcgacgtcgcgcgggcgaccgaagtggcgatgaaaatcgacagcggcacggtgtgggtgaaccagcacctcgccattgacccccgcatcccgttccgcggatcgaagcagtcgggcctcggcggcgagctcggccaggcggggctgcacgaatatacccaggcgcacatcgtcaac

SEQ ID NO: 41656 - DNA, 1395 bp, SPHINGOMONAS
gacatcgaagccgcgatgggcaccagccgcgatcccaacgagctgaaggagatgtgggtcagctggaacgacaatgtcggcgcggcgatgcgacccgattatgccaagctggtcggcatcgcgaatcagggggccaaggaacttggcttcgccgataccggcgcgctctggcgctcgggctatgacatgccgcccgccgaattcgcggcgatgaccgacaaattgtggaacgaggtgaagccgctctatgtcgccctccacacctatgtacgccgcaagctgaacgagaaatacggggatgcagtccaggccaggaccggcccgatccgcgccgatctgctgggcaacatgtgggcccaggaatggggcaacatctacgatctggtcgcgcccaagggcgccggcgacctcggcttcgatacgggcgagctgctcgaggccaagggctatgactggaagaagatggtccagaccggcgagggcttctactcctcgctcggcttcgaacccttgcccggcaccttctgggagcgttcgctgtttctgaagccggcggaccgcgaagtgctgtgccacgcctcggcctgggacatcgacgagaagaacgacgtccgcatcaagatgtgcatcaaggtgaattcggacgatttcgtcaccatccaccatgagcttggccataattactatcagcgcgcctatcaggcgcagccggcgctctatcgcaacggcgcgaacgatggcttccacgaggcgatcggcgatttcgtagcactttcgatcacgcccgaatatctggtccagatcggtctgctcgatcgcgcccgggtgccgagcgcggacaaggatatcggcctgttgctccgccaggcgatggacaaggtggcgttcctgccgttcggcctgctcgtcgacaaatatcgctggcagatcttcgacggcactatcccggcgaaccagtatgaggcgggctggaacaagctgcgccttcagtaccagggcatcgtgccgccggtggcccgcgacgagaccaaattcgacgccggcgccaagtaccacgtggcgggcagcgtgccctacacccgctacttccttgcgcggctgctccagttccagttctacaaggcagcgtgcgaccagtcgggctggaagggcccgctgcaccgctgcagcttctacggcaacaaggaagtgggcgcgcggctgaacaagatgctcgagatgggcgcctccaagccctggccggatgcgctgcagaccttcaccggcagccgcgaaatctcgggcaaggcgatggtcgagtatttcgcgccgctgaagaagtggctggacgaacagaacaagggccagccccagggctggtaaccgcgcgggactttctcctccggttcgtgcaga

SEQ ID NO: 41657 - DNA, 1593 bp, SPHINGOMONAS
cccttcgccgaactgcgccgcgacgcgctggagcaggcgcgccggctgatcgcggccggcatccagccgcaggatcgcatcgcgctgatcgcggagaccgggccggaattcgccgcgatcttcttcggcgtgatctatgccggcgcctggccggtgccgctgccgctgccgaccagcttcggcggcgcgcaatcctatatcgaccagctgcgcgtccagctcgagagctgcgacccgatgctgctgatctacccgcccgaaatcggcagcatgtgcgccgaggccgcgcgcatcaccgaggtcaacgggatcgactgggccgccttttcggagcgcgccgcacccgagacggtgctgccgcaggccaagtcggacgacatcgcctatctgcaatattcgagcggctccacccgcttcccgcacggcgtggcgatcacccaccatgcgctgctcaacaacctcgccgcgcacagccacggcatggagctggtcgaggcggaccgctgcgtctcctggctgccctggtaccatgacatggggctggtcggctgcttcctgtcgccggtcgccaaccaggtgtcgaccgattacatgaagaccgaggatttcgcccggcgcccgctcgcctggctggacctgatcagccgcaatccgggcaacagcatctcctactcgccgaccttcggctacgacatctgcgcgcgccgcatgtccagccagaccaaggcgagcgagcggttcgacctcagccgctggcgccttgccggcaacggcgccgacatgatccgcccggacgtgatgcagcgcttcgtcgatgcctttgcggatgcgggcttcaaggcgaccgcgttcctgccgagctacggcctggccgaggcgacgctggccgtttcgatcatgcccccgggcgaaggcatcgtcgtcgagctggtcgaggaaacccagctgtccggcggcaccgcccgcgccgatcgcccgcagcgctaccgcgcggtcgtcaactgcggcaagccggtgcgcgacatgaccgtcgagatccgcgaggaagacggcacgccgctccccgaaaaggcgatcggcaaggtctggtgcaagggcccgtcggtgatggtcggctatttccgcgacgaggccgccaccgaggcgtgcatggtcgatggctggctggataccggcgacatgggctacatgtcggacgggtacatttacatcgtcggccgcgccaaggacatgatcatcgtcaacggcaagaaccactggccgcaggacatcgaatgggcggtggagcagctgcccggcttcaagcagggcgacatcgccgccttcgcgatcaccacccccggcggcgaggaaaccccggcggtgctggtccagtgccgcacctcggacgaacaggaacgcgtccgactgcgcgaggaaatccgcgagcgcgtccgctcggtcaccggcatgaactgcgtggtcgaactcgttccgccgcgcaccctgccgcgcaccagctcgggcaagctcagccgcgccaaggcacgcaacctgtacctgaacggcgagatcaagccctacgcgatcgccgcctgatcggcgtgcgccggc

SEQ ID NO: 41658 - DNA, 1158 bp, SPHINGOMONAS
cagatcggcaccactcgagtagccgacatcgctaagcttcgtccggtccagccggtaacgctcgtccgcccgcacgccgcatcgcgtgcggcccggttcttcgccgagaagttcccgggtcgttcgatgtatgccgtgaaggccaatccctcgccggatctgatccagatcctgtgggagagcggaatcacgcatttcgacgtcgcatcgatcgccgaggttcgcctcgtcgccggtgtcgcgccggaagcaaccctgtgcttcatgcacccggtaaaggctgaggaagccatcgccgaggcatatttcgagcacggcgttcgcgtattcagcctggacagcatggaagagctggacaagatcgtgcgcgccaccaagggcgccaccgatctcacgctgtgcgtacgccttcgcgtctcctccgatcactcgaagctcagcctcgcgtcgaagttcggcgtcggcccgggcgaaagcaaggacctgctgatcgcggttcgccaggtggcggatgccctgggcatctgcttccatgtcggcagccaggcgatgtcgccggaagcctatgccaatgcgatggagcgcgcccgcgtcgccatcgttgaggcgggcgttaccgtggacgtcgtggatgtcggcggcgggttcccgtccagctatcccggcatggagccgccgccgctcgagcgctatttcgcgacgatccaccgcgccttcgaaagcctgccgatttcctattcggccgagctgtgggccgagccgggccgtgcgctgtgcgccgaatacagctcgctggtcgtgcgcgtcgagcgtcgccgcggcgacgagttgtacatcaacgacggcgcgtacggcgcgctgttcgatgcggcccatatcggctggcgcttcccggtccgcctgctgcgcgagccggattcgaacgccaaggacatgggcttcagcttctatggccccacctgcgacgacatggatcgcatggcgggcccgttcgagctgccggccgacatccaggcgggcgactatatcgagatcggcatgctcggcgcgtacggcgcggcgatgcgtaccggcttcaacggcttcacggccggcgatacggtgatcgtcgacgacgagccgatggtctcgctctacaccggcgaagacgaggcggtc

SEQ ID NO: 41659 - DNA, 768 bp, SPHINGOMONAS
cctttgaaaatcgtcagctataacgtcaacggcatcaaggcacgcatcgatcgcctggtcgagtatctcaccgagcagcagcccgacatcgtctgcctgcaggagcttaagagttccgacgacacgctccccgtcgcggcaatcgagactgctgggtacggtgccgtctggcacggccagaagggcttcaacggcgtcgcgatcctcgccaagggccagcagcccgtcgagcggcagcgcggcctcgcgggcgatcccgaggatgcgcacagccgctatatcgaggccgaggtgggcgatctgatcatcggcggcctgtatctgcccaatggcaacccgcagccggggccgaagttcgattacaagctgcgctggatggaccggctgtacgatcgcgcggcgcagctgctcgccgaggagcggccggcgatcctggcgggcgacttcaacgtcatccccaatgacgacgacaccttctcgatccgcgccatggccgaggatgcgctgatgcagccggaatcgcgcgagcgctaccgcaagctgctggcgcagggctggaccgatgcgctgcgcacccgctttcccaagggcggcgtgtggaccttctgggactatcaggcgggggcctggcagcgcgacgcgggattccgcatcgatcacctgctgctcagcccccaggcggccgaccggtttaccggggcgggcgtcgacaaggactatcgcggtcgcgagaaggccagcgatcacgcgccgacctgggtgacgctg

SEQ ID NO: 41660 - DNA, 1086 bp, SPHINGOMONAS
accgaggcggtgatcaagggcaaggacaccatcctgctcggcacctacaactatatgggcatgacgttcgatccggacgtcatccaggctggcaaggacgcgctcgaccggttcggttcgggcaccaacggcagccgcatgctcaacggcaccttccgcgaccatatggaagtcgagcaggcgctgcgcgacttctacggcgtgtcgggcgcgatcgtgttctcgaccggctatatggccaatctgggcatgatctccacgctcgccggcaagggcgagtacatcatcctcgacgccgacagccatgcgtccatctatgacggctgcaagcagggcacggcggaaatcgtgcgcttccgccacaatgacgtgaccgacctggacaagcgcctcggccgcctgccggccgaagcgggcaagctggtggtgctggagggcgtctattcgatgctcggcgacatcgccccgcttaggcaaatggtcgccgtcgccaagaagcacggggcgatggtgctggtcgacgaagcgcactcgatgggctttttcggccccaacggccgcggcgtgtacgaggaccagggtctcgaggaccaggtcgatttcgtcgtcggcaccttctccaagtcggtcggcacggtcggcggcttctgcatctcgaaccatccgaagttcgaggcgatccggcttgcctgccgtgcctatatcttcaccgcctcgctgccgcccagcgtggtggcgaccgcggccacctcgatccgcaagctggcgaccgcgcacgagaagcgcgcccggctgtgggcgaatgcccgcaagctgcacggcggtctcaccgaaatgggcttcaagctcggcaccgaaacgcccgaaagcgcgatcgtcgcggtgatcctggaggaccaggaacaggcggtgacgatgtggcaggcgctgctggagaacggcctgtacgtcaacatggcgcgcccgccggccaccccggccggcaccttcctgctgcgctgctcgctctgcgccgagcatcgccccgagcagatcgagcgcgtgctgggcatgttccgcgccgccggccaggcggttggggtgatc

SEQ ID NO: 41661 - DNA, 831 bp, SPHINGOMONAS
atggcgcttaagaattacaatccgacgtcgccgggcgtccgcgggctgatcctgatcgaccgctcgcagctcttcaagggtcgccccgtcaaggcgctgaccgaaggcaagacgaagaccggcggccgcaacaacaagggccatgtcacctcgcgtggcatcggcggcggtcacaagcagcgctatcgcatcgtcgatttcaagcgtcgcctgtgggacgtcgaaggcaccgtcgagcggatcgagtatgacccgaaccgcaccgccttcatcgcgcttatcaactacggcgccgacgaagccggcaaggatcgtctggcctacatcatcgctccgcagcgtctcgctgtcggcgacaaggtgatcgcgggcaagaagaccgacgtgaagccgggcaacgccatggagctgggccagatgccggtcggcaccatcgtccacaatgtggagatgaagccgggcaagggcggtcagatcgcccgctctgccggtgcgtacgtccaggtcgtcggtcgtgaccgcggcatggtgatcgtgcgtctgggctcgggtgagcagcgctacatccacgccgcctgcatggcgacggtgggtgcggtgtcgaaccccgacaaccagaaccagaacttcggtaaggccggtcgcagccgctggcagggggcgcgtccgctcacccgcggtgtcgcgaagaacccggtcgaccacccgcacggcggtggtgaaggccgtacctcgggcggccgtcacccggttaccccgtggggcaagccgaccaagggtgcgcgcacccgccacaacaaggcgacggacaagatgatcatccgttcgcgt

SEQ ID NO: 41662 - DNA, 2133 bp, SPHINGOMONAS
aaccggacctggtggcccaaccagctcgatctgaccgtgctccaccagaacccgcccgccggcgacccgatgggcgcggacttcgattatgtcgccgaattccggaagctcgatctggcggcggtcaaggccgacatcttcgcgctgatgaccgattcgcaggattggtggccggcggacttcggccattacggcccgctgttcatccgcatggcgtggcacagcgccggcacctatcgcatcggcgacgggcgcggcggcgcgggctcgggtacgcagcgcttcgcgccgctcaacagctggccggacaatgccaatctcgacaaggcgcgcatgctgctgtggccgatcaagcagaaatatggccgggcgctgtcctgggccgatctgatgatcctcgccggcaattgcgcgctcgaatcgatgggcttcaagaccgccggcttcggcggcggccgtgccgatgtgtgggagccggagcgcgacatcaactggggccccgagcgcgaatggctgcagaccagcgacaagccgggcggccgctattcgggcgagcgggacctgtcgaacccgctggcggcggtgcagatgggcctcatctacgtcaatcccgaaggcccggacggcaaccccgatccgctgctcgccgcgcacgacatccgcgagaccttcgcgcgcatggcgatgaacgacgaggagaccgtcgcgctgatcgccggcggccataccttcggcaagacccatggtgcggccgaccccagccagcatatcgggccggagcccgaaggcgcggggctggagatgcaggcgctcggctgggcgaacagctacggcaccggcaatgccggcgacacgatcaccagcggcctggaggtcacctggaccgagacgccgaccgaatggggcaacggcttcttcaagaacctgttcgaatatgagtacgagctcaccaagagcccggccggcgcgcatcagtgggtggcgaaggacgcgggcgaagtgatcccggacgcgcacgatccgtcgaagaagcatcgcccgaccatgctgaccaccgatctcgcgctgcgcttcgaccccgcctatggcccgatctcgcggcgcttctacgagaatccggaccagttcgcccatgcctttgccgaggcgtggtacaagctgacccaccgcgacagcggcccgcacgccaagctgctcgggcccgaagtgccggccgagccgcggatctggcaggatccggtgccggcggtggaccatgtactgatcgacgacgccgatgtggcggcgctgaaggcggaaatcctcggctcgggcctgtcgattgcgcggctggtgaagaccgcctgggcatcggccagcacctatcgcggatcggacaagcgcggcggcgccaacggtgcgcgcatccgcctcgccccgcaaaaggactgggcggtgaacgagccggccgaactcgccaaggcgctggcggtgctggaaggcatccaggccaggttcaacgcggcccagaccggcggcaagaaggtgtcgctcgccgacctgatcgtgctcggtggcaccgcggcggtggaagccgcggcgaagaaggcggggcatgacctggcgctgcccttcgtgcccggccgcaccgatgcgacggaggaacagaccgacgcgcacagcttcgaggcgctcgagcccaaggtcgacggcttccgcaactatgcgggcgacaccctgggctggtcggaagaggaactgctggtcgatcgcgccgcgctgctgacgctcaccgcgccggaaatgaccgtgctggtcggcggcctgcgcgtactgggtgccaatcatggcgactcgcagcacggtgtgttcaccgagtctccggaaacgctgaccaacgacttcttccgcaacctgctcgtcaccagcttcaccgccaagtgggaagcgcagggcgacggcagcttcgtggcgaaggaccgcaagaccggcgaagccaagtggaccggtacccgcgtcgacctgatcttcggctccaactcccagctccgcgcgctggccgaagcctatgcgaccgacgatgccgaggcggcgttcgtgaccgcgttcggcaaggcctggaccaaggtgatgcacgtggaccgcgtcgacctc

SEQ ID NO: 41663 - DNA, 1242 bp, SPHINGOMONAS
atcggcgatcgcaagctcaagccggcgacgatgatgatggggcacggctatgatccgatgctctccgaaggcgcgctcaagcccccgatcttcctcacctccaccttcgtcttccccaatgcggcggcgggcaagcgccacttcgagggcgtgaccggcaagcgccccggcggcgccgagggcctggtctattcgcgcttcaacggcccgaaccaggagatcctggaagaccggctcgcgatctgggaagaggccgaggacgcgctggccttttcctcgggcatgtcggcgatcgcgaccctgttcctgtcgatggtcaagcccggcgacacgatcgtccattcgggcccgctctatgcggcgaccgagacgctgatcgcgcgcatcctcggccgcttcggcatccactggctcgatttcccggcgggcgcgacccgcgaggagatcgacgcggtgctgagcaaggcggcgaccggcaatgtcgcgctgatctatctggagagcccggccaacccgaccaacgcgctggtcgacgtcgaagccgtcgccgccagccgcgacgcgatcttcaagggcgacaccaagccgccgatcgcgatcgacaacaccttcctcgggccgctctgggcgcagccgctccgccaaggtgccgacatcgtcgtctactcgctgaccaaatatgcaggcggccattcggacctggtggcgggcggcgtgctcggatcgaaggcgcacatcaacaccatccggctgatgcgcaacacgatcggcacgatctgcgacccgaacacggcgtggatgctgctgcgctcgctggagacgctggagctgcggatgagccgcgcgggcgagaacgccgccaaggtgtgcgaattcctggccgcccaccccaaggtggagcgcgtcggctatctcggcttcctcgagcgcggcgaggacaagcgccaggccgatatctatcgccgccactgcaccggcgcgggatcgaccttctcgctttatctgaagggcggcgagaaggaggcgttcgcattcctcgacgcgctcaagatcgccaagctggcggtgagcctgggcggcaccgagacgctggccagccacccggcgggaatgacgcacctgtcggtggccgaggcgcgcaagcaggcgctgggaatcaccgacaatctggtccgcatctcgatcggcgtcgaggatgccgacgacctcatcgcggacttcgagaatgcgctgaaggcggtg

SEQ ID NO: 41664 - DNA, 1278 bp, SPHINGOMONAS
atggaccgtatcctcatccgtggcggcaatcggctcgccggcaagatcgcgatttccggcgcgaagaacgccgccctcaccctgatgccgtgtgcgctgctcaccgacgagccgctcaccctgcgaaatctgccacgtctggcagatgtcgacagcttcggacatctactgaatgaactcggcgcatcgacctcggtagagggcacgcgcccgaacgaattcggccgggtgctctcggtgcgcgccagccggctgacctcgacggtcgccccctatgacatcgtccgcaagatgcgcgcctcgatcctggtgctcggcccgctgctcgcgcgcgagggcgaggcgacggtgtcgctgcccggcggctgcgcgatcggcaaccgcccgatcgatctccacctcaaggccctggaagcgatgggcgccgaaatcgagctgagcgccggctatgtgaaggcgaccgcgccgggcggccggatttcgggtggccgcttccgcttcccggtggtctcggtgggtgccaccgagaacgcgctgatggcggcctccaccgcgcgcggcaccacggtgctggagaatgcggcgcgcgagcccgagatcgtcgacctgtgcaatctgctggtcgcgatgggcgcggtgatccgcggcatcggcaccgagacgctggagatcgacggccgcgaccggctgcacggcgcgacctatgcggtgatgcccgatcgtatcgaggccggcagctatgcctgcgccgcggcgatcaccggcggcgacgtcgaactgctcggcgcctcggccgaggacatgcgcgcgacgctggatgcgctggtcgaggccggcatcacggtcgaggaaaccgtgaacggcgtgcgcatcgccgccgacaacggcatccgcccgctcacgctcaacaccgcgccgttccccggcttcgccaccgacatgcaggcgcagttcatggcgatgctgtgcaaggcggacggcgcgagcacgctgaccgagacgatcttcgagaatcgctacatgcacgtgcccgagctcacccgcatgggtgcggacatcgaggtgcatggccgcaccgcgatcgtgcgcggggtgggcaagctcaccggcgcgccggtgatggcgaccgatctgcgcgcctcgatgagcctgattctcgccgggctcgccgccgagggcgagacgcaggtcaaccgcgtctaccatctcgatcgcggctatgagcggctggaagagaagctgcagggggtcggcgccgatatcgagcgcgtcggcgac

SEQ ID NO: 41665 - DNA, 1272 bp, SPHINGOMONAS
gtcgtcgcgacccggagcgggcaggtgcagggcgcgatcgaagacggcgtcgcaagctggaaaggcattcccttcgccgcgccgacggtcgggcccttgcgctggcaggcgccgcagccggcggcggactggcagggcatccgcccggccctccagtatagtcacgactgcatgtagacgcccttccccagcgacgccgcaccgttgggcaccacgccggcggaggactgcctgtatctcaacgtgtggaggcccgccgcggccgccccggccgccaggctgccggtgatggtatggatctacggcggcggattcgtgaaccgcggtgcctctccccccacctatgccggcaccaacctggcgaagcagggcgtgctgttcgtcagcttcaactaccgggtcggccgcttcggcagcttcgccctgccgcaactcagccgcgaagacgcggatggcgggctggtcggcaactacaacttcatggaccagatcgccgcgctccgctgggtgcgggagaacatcgccgcgttcggcggcgatccggccaacgtcaccatcatcggcgagagcgcaggcggcatgtcggtccacacgctggtcacctcgccgctggccaaggggctgtttcacaaggcggtggtgatgtccggcggcaacggccagacggcgggcaacgccaccctccgcgatgccgagacgatcggcgagaacctcgcccgcgcccacggcatcgatcccgcagcgcccgacgcactcgccaagctgcgcgccctttccgccgagcaggtgaccgacggcctcagcatggtcgagctgttccagcccaagcccggccctcgcacctatggcggcccgatgctcgacggcaagctgctggtcgatcaggaaaaggcctatgccagcggggcgttcgcgcatgtaccgatgctgatcggagccaccagcgccgacatgggaggcaagagcggcttcatgatcgcaggtgcacgcgatgccagcgcaacgattgcggcacagaaggtacccgtatgggcgtaccgcttctcctatgtcgccgattcggtgggcaagccgggcgccggccacgcaaccgacattccgttctttttcgacaacgcccggatcaagtacggcgccgccaccacgcccagggacgagcagatgggcaagaccatcagcgcctatctcgtcaacttcgccaggtcgggaaatcccaatggcggcgaccttccggtctggccacgctacgccaaggcaagcgacgagatcctc

SEQ ID NO: 41666 - DNA, 1593 bp, SPHINGOMONAS
ttcgactatatcatcgccggcgccggctccgcaggctgcgtgctcgccgatcgcctgagcgcagacggccaggcgcgcgtgctgctgatcgaggcgggcggcgacaacgagaccgaactgatcaacatgccccgtgccttcatgaagatgttcggcaacccgacctatttctggcacttcccgatcaccgaacaggagggccggccgtcgggcgagacctggtcctatggccgcggcctcggcggatcgagctcgaccaacggcacctggtatctgcgaggcgagcccgccgactatgacggctgggcggcgatgggcttcggcgaatggcggtggagcgagatccagcgctgcttccaggcgatggagagctatcgcggcgccggtgccgatgccagccgcggccgcgacggcccgctacagatcacccagctgcccttccgctcgccggcgatcaacgccgcgatcgaggccggcacccagatcggcttgaagaaggtgacggacatcaacgcgccgggctcggtccgcatcggctatacccaggcaaccgtgtcacgccgcggcaggcgcgcctccagctatcaggcctttcttaagccggcgatgcgccgcccgaacctgtccgtgctgctcgatacgctggtggagcgcgtcgagatcacgaacggccgtgcgaccggcgtacgagtccggacggcgggaggtgcgcgctcgatcgcagcaacccgcgaggtaattctgtccgccggcgcgctgcagagccccaagctgctccagctttcgggcatcggccctgccgaggtgctggaacgcgccggggtgccggtggtgcaggccctgccgcaggtcggccgcaatctcgccgaccacctgatgttcaccatgtcgtggcggctgcacaaggatccgggcgcgaaccgagaattttccggctggcggctgaccagccatgtactgcgctactatctcacccgcaccggcatgatggcctatacctcgcccgaggtgaccgcgctgctctcgatcgactcgtcgcccgactggcccgacgcgcaattcggcgtcggcccctattcgctgcgcacgaccgaggaaatgaaggccgatcctggccgcggtgcgctggaagacaagccggggatcagcgtcaacggcatcgcgctgcgccccaagagccgcggcaccgtcgccatccgctcggcggatgtcgccgatccggtggacgtgcatgccaattggtggggcgatcctgccgacaaggcctttctggtcaagatggtgcgcctcgcccgccgctatatgcgtcagccggcgctgaagggtttcgtcggcgaggagcgcgtgcccggcgagcgcttccagagcgacgaggatatcgctcggcagctggagtggctcgccagccccggcctgcacagcaccggcacctgccgtatggggacaccggagaccggcgtggtagacggacgattgcgcgtgcacggcatccagggcctgcgcgttgccgactgctcggtgatgccgctccagcccgccggcaacaccaacggtcctgcaatggtcatcggctggcgcgcggcggagctgatc

SEQ ID NO: 41667 - DNA, 702 bp, SPHINGOMONAS
cgcggcattctgatcaccggcgggctcggcgatatcggtctcgccgtcgcgcatgccttcgccgcggagggtgcgaaccttctgctgttggacttgcgggaggatgatgggcgtgtcgctgccgacctgcaggcaagcggggcggcgatggtgctcagccgtgccgtcgatgtggcggacgagtcggcgctggccggagcggtggcgctggcggtcgagcggttcggggctctcgacgtgatcgtcaacatcgccggcatgatgctgtacaaaccgatcgccgaactggcggcggcggattggcggcgcctgctcgacgtcaatctggtcggtgccgcgctcctgacgggacacgggctgcgggtgatgcggcgcggcggctgcatcgtcaacatcgcctcgatccatgcccgtcgcacctcgccgctggtggcgccctatgcggcggcgaaggcggcgctggtcagcctcacgcggtccgcggcgatcgagggcaagcccctcggcatccgcgtcaacgcgatcctgcccggggccgtggataccgcgatgctgcgtgccagcccgaatatccggtcgggcgccgaggtggtcgatccggccgatctcggcgtgccgcaggacatcgcggcgatcacccgattcctcgcctcggacggtgcgagcttcatcaccggggaggatatcgtggccgatggcggc

SEQ ID NO: 41668 - DNA, 843 bp, SPHINGOMONAS
gtcattgagcgcgcgcaacgggacatgctgggcgaaggccccttatgggacgaggcgcggcaggcgttgctctgggtcgatattgtcgggcggcaggtgcatgccgtggacatcgactccgggcgtcataccgcgcttccggttccggaaccgatcggctgggttctgccgcgcgccgccgccgatgatttcgtggcgggctttcgcagcggcttcgcctttctggatatcgatagcggcgcgatccggccgatcggcaacccggaacccgaacgcccgcaaaatcgcctgaacgatgccaaggtcgacgccgccggccggatctgggccgggtcgaaagacgatcaggacgagcaggcgagcggcgcattgtatcgcctggacgcggatcttcgctggaagcggctcgacgacggctacggagtcgccaacggccccaccttctgcccggaaaacaaaactttatatcacaccgacagcgccgcccgcacgatctacgcgatggatctcgcgccggacggatcgctttccggcaaacgggtatggctccggttcgaggacgcatgggggtatcccgacggcatgaccaccgatgccgagggctgtatctggatcgcgcattggggcggcggccgcatctcccgcttttctccgggggggaagctgctccgatccatcgccttgcccgccaccaacatcaccagttgcacctttgctggcccggcgttggaccggatgttcgtcacgtcctccaggatcgacgcggcagaggagccgctggcaggctgcctcttcgaaatcgatcccggcgtacaggggctgccccagccccgcttcgccggc

SEQ ID NO: 41669 - DNA, 1359 bp, SPHINGOMONAS
tctggagcggtatggatgtctgccatggtggcggcgctgggcggtgtgctgttcggctacgactgggtcgtgatcggcggcgcgaagccgttctacgaggcggccttcggcctgaccgcgccgaccgatcaggcctgggcggtgagctgcgcgttgatcggctgcctcgccggggcaatcgcctcgggtgggctcagcgaccggttcggtcgccgtccggcgctgctgatcgccgccgtgatcttcgccgtttcgtcgctgggcactgcgttcgcggcatcctttcacggttttgtactttggcgcatcgccggcggtgtcgccatcggcatggcgtccggcctcgcaccgctgtacatcgccgagatcgcaccgccggccgcgcgcgggcgactggtggtgctgaaccagatcggcatcgtcgtcgggctcctgggtgcccagatcgtcaatctgttgatcgcggagcccgtcatcgccggggcggcgccggccgatatcgcggcatcgtggaacgggacgacgggctggcgctggatgttcgccgcggcggcccttccggctattgtgttcctggtcggttgcctgatgatcccggaaagcccccgctggctgttccagcatggtcgcaaggcgcaggcaagggcggtgctggtgacattcggtggagaggcccatgcggacgtggcgctggagcagattcgtgccgcgctgcaggcggggccggggcgctcgcttcgatcggtgctcggggaggcacggctgcgacgggttctgggaatcgcgatcgtccttgccgtcctccagcaatggtgcggcatcaacgtgatcttcaactatgcccaggagatcttcgcatccgcgggctatgccgtgtcggatacgctgttcaacatcgtcatcaccggcgtcgtcaacatggtcttcacgctcgtcgcgctgggcacgatcgagcggctcggtcgccggcggctgttgctgatcggctgtgccggactggcggcgatctatctggtcctcggcacctgctatctgtacgggctgcagggctggccgctcctcgcgctggtcgttgcagccatcgccctttacgcaatgacgctggcgcccgtcacctgggtagcgctgtccgaaatcctgcccggtgaggcgcgcggagccagcatggcggtcgccacgacggccttgtgggcggcgtgcttcctgctcacctattcctttcccctgctgaatgcggcggcggggacgggggtgaccttctggctctatgcgttcgtctgtgccgccggattcgcgttcatctcggctaagctgcccgaaacgaagaaccgcacgctcgaggatatcgaacagggctgg

SEQ ID NO: 41670 - DNA, 1335 bp, SPHINGOMONAS
aggttcgacgcgatcatcctcggcgccggccaggcaggcaccccgcttgccgggcggctgagcgatgccggcatgtcggtggcgctggtcgagcggcacctactcggcggcacctgcgtcaacaccggctgcaagccgaccaagacctgggtcgccagcgcctatgccgcgcacatggccaggcgggccgccgatttcggcgtgataatcggcggtgcggtgggcatcgacttcgcgaaggtgcgcgcgcgggcggacaagatctccgccgactcgcgcgcgtcgctgcgccaatggatcgacggcatggcgcactgcacgctgttcttcggccatgcgcgcttcgaatcgccgcaccgtgtgcgcgtcggcgacgcggtgctggaggcggaccgcatcttcctcaacgtcggcggccgcgcgctggtgccggacatgcccggcgtgaacgacgtacccttcctcaccaacagcacgatcctgaagctggatgcggtgccgcgccacctggtggttgtcggcggcagctatattggcctcgagttcggccagatgttccgccgcttcggcgccgaggtgacgatcgtcgagaaaggccccacgctgatcggccgcgaggatcccgagatttcggacgcggtgcacgacatcctcgaagcggaaggcatcgcgatccgcaccggcgccgagtgcatccgcttcgcacgccaaggcgaggacgtgctcgtcggcgtcgactgccacgagggcagtcccgaggtgctcggcagccatgtgctgctggcggtcggccgcacgcccaataccgacgatctcgggctcgacgcggcaggagtggcgactgatgcgcgcggctatgtgcaggtggacgactatctccgcaccaatgtcgagcacatctgggcgctgggcgactgcaacggccgcggcgccttcacccacaccgcgtataacgacttcgagatcgtcgccgacaatctgctggccggcgccgaccgcaaggtgaccgaccgtatccccgcctatgcgctgtatatcgatccacccctcggccgcgtcggcatgggcgaggcgcaggcgaagaaggccggtcaccgcatcgaggtcggccggcggccgatgacgcgggtgggccgcgcggtcgagaaggacgagacgctcggcttcatgaagctggtgagcgatgccgatagcggccgcatcctcggcggcgcgatcctcggtaccagcggcgacgaggcgatccacggcgtgctcgacctgatggtgaagcaggggacggccacggacctgtcccacgccgtgcccatccacccgaccgtctccgagctattg

SEQ ID NO: 41671 - DNA, 1110 bp, SPHINGOMONAS
atgaagacccgcgccgccgtcgccttcgaagcgaagaagccgctggagatcgtcgaactcgatctggaaggccccaaggccggcgaagtgctggtcgagatcatggccaccggcctctgccacaccgatgcctacacgctggacggcctcgattcggaagggctgttcccctcggtgctcggccatgaaggcgccggcatcgtccgcgaggtgggcgccggcgtcaccagcgtgaagcccggcgaccatgtgatcccgctctacacgcccgaatgccgccagtgtaagtcgtgcctctcgggcaagaccaacctgtgcacggcgatccgcgccacccagggcaaggggctgatgcccgacggcaccacgcggttcagctacaagggcatgcccgtcttccattacatgggctgctcgaccttctcgaacttcaccgtgctgcccgagatcgcggtggcgaagatccgcgaggacgcgccgttccagaccagctgctatatcggctgcggcgtcaccaccggcgtcggcgcggtggtcaacaccgccaaggtccaggtgggcgagacggtcgtcgtgttcggcctgggcggcatcggcctcaacgtgatccagggcgcacggctggccggcgcaggccagatcatcggcatcgacgtcaatccggaccgcgaggaatggggccgcaagttcggcatgacccacttcctcaacacgcgtggcatgtcgcgcgaacagatcgtcgccaaggtggtcgagctgaccgacggcggcgccgactacagcttcgatgcgaccggcaacaccgaggtgatgcgcaccgcgctcgaatgctgccatcgcggctggggcgaatcgatcatcatcggcgtggccgaggcgggcaaggaaatcagcacccgcccgttccagctggtcaccggccgcgtctggaagggcaccgcgttcggcggcgccaagggccggaccgacgtgccgaagatcgtcgactggtacatgaacggcaagatcgcgatcgacccgatgatcacccacgtgctggcgctggaggagatcaacaagggcttcgacctgatgcatgcgggcgagagcatccgcagcgtcgtcgtctac

SEQ ID NO: 41672 - DNA, 2013 bp, SPHINGOMONAS
gttgacggaatcgaagtcgaggtgccgcagggcgccaccgtgctccaggcctgcgaggccgcgggcaaggagattccgcgtttctgctatcatgaacggctgagcatcgccggcaattgccgcatgtgcctggtcgaggtgaagcccggaccgcccaagccccaggcttcgtgcgcgctgccggccgccgacaaccaggaagtccgcaccgacagcccgatggtgaaggccgcgcgcgaaggcgtgatggaattcctgctgatcaaccacccgctcgattgcccgatctgcgatcagggcggcgagtgcgacctgcaggaccagtcggtcgcctatggtcgcggtagctcgcgctacaccgagaacaagcgcgcggtgaccgagaagtatatgggtcccatcatcaagacggtgatgacccgctgcatccagtgcacccgctgcgtccgcttcggcgaggaagtggccggcgtggaggatatcggcgcgatctatcgcggcgagaacatgcagatcacgacctatctcgaaaaggcgttcaagagcgagctgtcgggcaatgtcgcggacctgtgcccggtcggcgcgctgacccacaagccggtcgcgttcgagtatcgcccctgggagctcaagcggaacctgtcgatcgacgtgatggacgcggtcggcaccaacatccgcctcgacagccgcggccgtcaggtgatgcgtgtcctgccgcgcatcaacgaggacgtgaacgaggagtgggcgcacgacaagacccgctaccatgtcgacgcgctggtccgccgccgtctcgaccgcccgttcgtccgcaagcatggcaagctggtcccggcgagctgggaagaggcgttcgacgcgattgcgggcgtggccgccaatgccggttcgagcgtcgcggcgatcgccggcgacctgctcgatgctgagaccatgtatgccgccaaggcgctggtgaaggcgttcggttcggacctgctcgaaggccgccagaccggcatggcctatgacacgtcgagcctctcggcagtggcgttcaacaccaccatcgcggcgctcgaagacgccgatgcgatcctgctggtcggcaccaacctgcgctgggaagcgccgctggtgaacacccgcgtgcgcaaggcgatcaagcgcggcgccaaggtgttcgcaatagggccgcaggtggatctcacctacaaggtcgagtggctgggcgacgatctggggctgctcaacagcctgccggagaacctcgctcaggcgatcgacaatgccaagaagcccgcgctgatcctcggcccgggcgcgctcaagaacggccatggcgccgcgctcgcgatcgccggtgcgttccagcgcgctgcgaccgaaaccgaagcagcgtggaacggcttcaacgtcgtccacaccgcggcggcgcggatggcggggctgatgctcggctatgcgcagaagggcggcattgccgacatcgtcgcggcatcgccgaagctcgccttcttcctgggcgccgacgaggtggacttctcgaagtttaccaatagcttcaaggtctatatcggccaccacggcgaccagggcgcgcatcatgccgatgtgatcctgccgggcgccacctatgccgagaagccgggcacctatgtgaacctcgaaggccgcgtgcagcgcgccgaccgcgcggtgttcgcaccgggcgaggcgcgcgaggactggacgatcctgcgggcgctctccgaaaagctcggccgcacgctgccgttcgacagcttcgacgagctgcgcgccgcgatggcgagcgaggttccggcgctcggccaggaaggtctggccgaattcgcatggaacccgccgtcgctggcggcccaggcttcgggtccggtgacctatccggttgccgacttctatctcaccaacgccatctgccgtgcgtcgccgacgatgcagcgctgctcggccgaactgctccatggcgaagcgtttgcggaggcggccgagtgatcagcctgc

SEQ ID NO: 41673 - DNA, 1014 bp, SPHINGOMONAS
aatccgctcggcctcaacggcttcgagttcgtcgagttcacctcgcccgatccggacgcgatggcgcgccagttcgagcagctgggcttcgttgccagccaccgccacccgcgcaagaacatcacgcgctacaagcagggccgcatcaacctgatgctcaaccgcgacgatgccggccgcgtcgccgccttccgcggcgagcatggcccttcggccagcgcgatggcgttccgcgtagcggacccgaaaaaggcgatggaatgggcgctcgcccacggcgccaagcctacggacgaggacgacaccgtcatccagggcatcggcggctcctatctctatttcatccaggacgagatcgacctctatgccgactgggccgagttccccggctggcgcgaggcagaggcggcgaacagcgtcgggctcgacctgctcgaccacctcacccacaatgtccgccgcggccagatgcgggtgtggagcgaattctaccgcacgctcttcggcttcgaggagcagaagtatttcgacatcaagggcaaggcgaccggcctgttcagccaggcgatgatcgcgcccgacaaggcgatccgcatcccgctgaacgagagccaggacgacgccagccagatcgaggaattcatccgcgaatacaacggcgaaggcatccagcacctcgcgctgaccacggacgacatctacgacacggtcgagcgcctgcgcgcccgcggcgtgcggctgcaggacacgatcgagacctattacgagctggtcgacaagcgtgtccccggccacggcgaggacctcgagcggctgcgcaagaaccgcatcttgatcgacggttcggtagagaatgacgagggcatcctgctccagatcttcaccgagacgatgttcgggccgatcttcttcgagatcatccagcgcaagggcaatgaaggcttcggcaacggcaatttccaggcgctgttcgagagcatcgagctcgaccagatccgccgcggcgtgatcaag

SEQ ID NO: 41674 - DNA, 1287 bp, SPHINGOMONAS
aggacgagccttgtgaccacctatttccccggcttcggcaaccatgtctccaccgaagcggtgcccggcgcgctgcccatcggccgcaacagcccgcagcgtccgccctatggcctctatgccgagcagctttccggcaccgccttcaccgcgccgcgtgccgagaatcgccgcagctggctctatcggctgcgtcccagcgccgaacatcccccttatcagccctacgcaggcgctccgctgttctcgccgcacaccccggcaaagccgcttgcgcccaaccgcctgcgctggaacccgatccccacccctaccacgttggtcgactggatcgacggcgtggagacgatgctcgccacgcgtgatcccgctgatctggagggcgtggtcgtccaccgctacgccgccaatcgcgacatgcacaatcgagccttcgtcgatgcggacggcgaactgctgttcatcccccaggcgggcgcgctgacgctgctgaccgagctcggccggatcgatatcgcgccgggccagatcgcggtgatcccccgcggcatccgcttccgcgtgctgctgcccgaaggcagcgccgccggctatgtcgccgagaattacggggcgccgttccgcctgcccgatcttgggccgatcggcgccaacggcctcgccaacccgcgcgacttcgagacgccggccgcctggttcgaagatcgggacgagccgttccagcttgtgcaaaagtcgttggcaagtctgtggataaccacgcttccccacagcccgctcgacgtggtggcatggcacggcaacctcgccccctatcgctacgatctcgcccggttcaacacgatcaacacggtgagcttcgaccatcccgatccgtcgatctttacggtcctcacctcgcccagcaccgtggcggggcgtgcgaacgccgatttcgtgatcttcccgccgcgctggatggtcgccgaggatacgttccgcccgccctggttccatcgcaacgtgatgagcgaggcgatgggcctgatccacggcgcctacgacgccaaggcggagggctttgcgcccggcggtctttcgctccacaatctgatggccggccacggccccgacgtcgccagctggcgcggcgcgaccaatgccgcgctcaagccgcacaagatcgacggcaccatggcattcatggtcgagacctgctggccctatcgcccgaccgagcatgccctggcgcaagcccagccagactatgacacggtgtgggaaggcttcccgaaggcacagctgccg

SEQ ID NO: 41675 - DNA, 1158 bp, SPHINGOMONAS
tggagaggaacaagcatgaccccggacttcgacttcgccctcggcgattccgccgacatgatccgcgataccaccgcccgcttcgcccgtgacaggatcgccccccttgccgcacggatcgacgcggaggactggttcccgcgcgacgaactctgggcggcgatgggcgaactcggcctgcacggcatcaccgtgcccgaggccgatggcggcctcggcctcggctatctcgaacatgtcatcgcctgcgaggaagtcgcccgcgcctcggcctcgatcgggctcagctacggcgcgcattcgaacctgtgcgtcaaccagatcgcccgctggggcaatgccgagcagaaggccaaacatctccccaagctgatctcgggcgagcatgtcggcagccttgcgatgtccgaggcgggcgcgggctccgacgtcgtctcgatgaagctcaaggccgagaagacggatcgcggctatgttctgaacggcaccaaattctggatcaccaacgcggcctatgccgacaccctcgtcgtctatgccaaaaccggcgaaggttcgcgcggcatcacgaccttcctgatcgagaaggacatgccgggcttcgccatcggccagaagatcgacaagatgggcatgcgcggctcgcccacggcggaactggtgttcaccgattgcgaggtgcccgaggcgaacatcatgggcccgctcaacggcggcgtcggcgtgctgatgagcgggctcgactatgagcgtgcggtgctggcgggcatccagctcggcatcatgcaggcctgcctcgacgtcgtcctgccgtacctgcgcgaacgcaaacagttcggccaggcgatcggcagcttccagctgatgcaggccaaggtcgccgacatgtacgtcgcgctcaattcggcgcgggcctatgtctatgccgtggcgcgcagctgcgacgcggggaagacgactcgcttcgacgcggcgggcgcgatcctgctggcgagcgagaacgccttccgcgtcgccggcgaggcggtgcaggcgctgggcggcgccggctataccaaggactggccggtcgaacgcttcctgcgcgacgccaagctgctcgatatcggcgccgggaccaatgagatccgccgcatgctgatcggccgcgaactgctg

SEQ ID NO: 41676 - DNA, 1926 bp, SPHINGOMONAS
tccggagcgccacccgtgatccagtccctgctcatcgccaatcgcggcgaaatcgcctgccgcatcctccgcaccgcccgcgcgatgggcatccgcaccgtcgccgtctattcggatgcggacgccaacgcgctgcacgtccgccaagccgatgacgcggtgcatatcggcccgtcgccggcacgcgaaagctatctggtgggcgagaagatcatcgccgccgccaaggcgaccggcgccgaagcgatccacccgggctatggcttcctctccgagaatgccgagttcgccgaggcggtgctcgccgccgggctcgtctgggtgggcccgaagccggacagcatccgcgcgatgggcctcaaggacgccgccaaggcgcggatgatcgcggcgggcgtgcccgtcacgccgggctatctcggcgaggaccagagccccgagcggctccaggccgaagcggaggcgatcggctatccggtgctgatcaaggcggtcgccggcggcggcggcaagggcatgcggcgggtggaaagcgcaggcgacttcgccgacgcgctcgcgagctgcaagcgcgaggctgcctcctccttcggcgacgaccgggtgttgctcgagaaatacatcctctcgccccgccatatcgaggtgcaggtgttcggcgacagccatggcaatgtcgtccacctgttcgagcgcgactgctcgctccagcgccgccaccagaaggtgatcgaggaagcccccgcccccggcatggatgccgggacgcgcgcggcgatctgcggcgcagccgtgcgcgcggcccaggcggtcgactatgtcggcgcaggcacgatcgagttcatcgccgatgccagcgagggcctccgcgccgatcgcatctggttcatggaaatgaacacccggctccaagtcgaacacccggtgacggaggagatcaccggagtcgacctggtcgaatggcagctccgcgtggcaagcggcgagcccttgcccaaacggcaggacgagctgtcgatcaatggctgggcgatggaagcgcggctctatgccgaggatccggccaaggggttcctgccgagcgtcggtcggctggagattttccgcccctcgcccgacgtccgctacgagaccggcgtgtacgaaggcgcggagatcaccggcttctacgatccgatgatcgcaaagatcgtggtgcatgccgaaagccgcctcgacgcgtgcgaggcccttgctcaggcctgcgccgcaacggacatcttcccggtcaagaccaacgcaccgttcctgtggcgggcgctggatgaccaggatttccgggcagcccgcatcaacaccggcttcatcgcggaaaagggcgacgccctgctgcccccggcagagccgaccgacgacatggtcaagcaggccgcagccgcgctgatcgtccaggaatatcaaggcgcgcccaccatgctgcacggttgggacgacgaccttctgggcgcaccgcagcctcatccgtggcgcggcgccctcgggttccgcctgaatgcagcggtcaaccggcgcgttgcggtggccgtcgacgggaaggtgcatgtcaccgaactgcctgcgaactggcgaaacgccacggtcatcgccgaacccgtggcagacggcgtggcggtgaacgacgacggcctgtcgttcctcgccgcgctgccacgcacgggccccacgagcggggccgcggccgctgacggcgccctgctcgcccccatgcccggccgaatcaccgcggtggatgtcgcccccggcgcgcaggtcaccaagggccagcggctcgtcacgctggaggcgatgaagatggagcacgccctcaccgcgccgttcgacggcattgtcgccgagctgccggtcaccgccggcggtcaggtgaccgagggcagcctgctcgtccgc

SEQ ID NO: 41677 - DNA, 1167 bp, SPHINGOMONAS
atcgtcatcctgtcctatgcccgcaccccgatgggcagcctgcagggtagcctcgccgatgcctccgccaccgatctgggtgcgaccgcggtcggtgccgcggtcgagcgcgctgggctgaagggggaggcgatcgagcggatctatatgggctgcgtactgcccgcgggactaggccaggcgcccgcccgccaggccgcactcaaggccgggctaccgcagcacatcgaggcgacgacgatcaacaagatgtgcggatcgggcatgcaggcgacgatcatggccgcggaggcgctggcggcaggctcggtcgacctgctgatcgccgggggcatggagagcatgaccaacgcgccctacctttcgatgcgccaccgcagcggcgcgcggatcggccatgacgtgctcaaggaccacatgttcctggacgggctggaggacgcctatgagcccggccgcctgatgggcagcttcgccgaggagacggcgaaggagtatcagttcacccgcgaggcgcaggacgccttcgccatcgccagcctggagcgcgcgaaggccgcgcagaccagcggcgccttcgaccgcgagatcgtccccgtcgagctgcagggccgcaagagcgtgacgacggtggcactcgacgagcagccgaccaaggccgatccggccaagatcccgacgctcaagcccgccttcaccaaggacggcacgatcaccgcggccaatgcctcgtcgatttcggacggcgcggcggcgctggtgctggcccgcgcttcggtggcggagaagctgggccttacgccgatcgcccggatcgtcagccacgccgcgcacgcccatgccccggcacggttcaccacggccccggtgttcgcgatgcgcaaggcgctggagaaggccggctgggaaaccggcgatgtcgacctgttcgaggtcaacgaggcctttgcctgcgtgacgatgatcgcgatgcaggaactcgggctcagccacgaggcggtgaacgtccatggcggcgcctgtgcgctcggccacccgatcggcgccagcggcgcgcgggtgctggcgacgctgctgtccgcgctcgagaccaagggccagaagcggggtctggcctcgctgtgcatcggcggcggcgaggcaaccgccgtcgcggtagaactgatg

SEQ ID NO: 41678 - DNA, 2007 bp, SPHINGOMONAS
ttcaagaaaatcctcgtcgccaaccgtggcgaaatcgcgtgccgggtgatgcgtaccgccaggaagatgggcatcgccacggtcgcggtctattcggacgcggatgcccgcgcgccgcatgtgcggatggcggacgaggcggtgcggctcgggcccgcgccggcggcggagagctatctcaaggccgacctgatcctgcaggcggccaaggagaccggcgccgacgcgatccaccccggctatggcttcctctccgagcgcgagagcttcgccaaggcctgtgccgaggccggcatcgcctttgtcggcccgccgccgagcgcgatcgcggcgatgggcgacaagatcgaatccaagaagctcgccaagcaggcgggggtcaacgtcgtccccggcttcctcggcgagatcgcggacaccgagcatgccgtccggatcgcgactgagatcggttatccggtgatgatgaaggcgtcggcgggcggcggcggcaagggcatgcggctggcctatagcgagcaggacgtccgcgaaggcttcgaggcgaccaagcgcgaggggctggccagcttcggcgacgaccgggtgttcatcgagaagttcatcgagagcccgcgccatatcgagatccaggtgctgggcgaccagcacggcaacatcgtctacctcaacgagcgcgaatgctcgatccaacgccgccaccagaaggtggtcgaggaagcgccgtcgcccttcgtcacgccggcgatgcgcaaggcgatgggcgagcaggcggtcgcgctggcgcgggccgtggggtactacagcgcgggcacggtcgagctgatcgtctcgggcgccgacaagacggggcagggcttctactttctcgagatgaacacccgcctccaggtggagcatccggtcaccgaggcgatcaccgggctcgatctggtcgagcagatgatccgcgtggcggcgggcgagaagctggcgttcggccaagacgaggtgaagctggacggctgggcgatcgagaaccgcgtctatgccgaggatccctatcgcggcttcctgccgagcaccgggcggctggtgcgctaccggcctcctgtggccgaaaatgcgggcgagggctatgtccgcgtcgacgacggtgtgaccgaaggctccgagatcagcatgttctacgacccgatgatcgccaagctgatcacctgggcgccgacccgcgatgaggcagcggacctgcaggtccgcgcactggaccggttccgcatcgacggcatcggccacaatatcgatttcctctcggcgatcatgcagcacccgcgcttccgctcgggcgaactgaccaccggcttcatcgccgaggaatatcccgagggcttccacggcgcgccggcggacgcggcgctggtgcgcaagcttgccgccgtggcggtggtgctcgatcttgcccgtactacgcgggcggcggcgatctccggccaactgggcgaccagcccgcacggtcaaccgcccgctcggtccgcatcggcgagcatcagttcgacgcctcggtcgaggatcgcggcaccgatatgctggtgacgctttccggcagcgaggcgccgcttgcggtatcgggcacctggcgtggcggagagccgcagtttgcggcaaccatcaacggcgccgagttcgccacggccgtcgatcgcctccgcaccggctggaagctgaccgcgcatggtgccgcccaccgggtcgaggtgctgcccctgcacgtcgcgccgctgcgccggtacatgatcgagaaggtgccgccggacatgagcaagttcctgctcgcgccgatgccggggctgctcacccgcctgcacgtccagccgggggacaaggtggaggccgggcagccgctcgcggtggtcgaggcgatgaagatggagaacatcctccgcgccgagcgcgcgggcaccgtcaagctcgctcatttcagcgcgggcgacagcttggcggtggacgctcctattcttgaatttgaa

SEQ ID NO: 41679 - DNA, 960 bp, SPHINGOMONAS
cttcgcctccgccgctcccgcgcctcggcctggagccgacgcctccacgccgaaaccgtgctcacccccgccgatcttatctggccggtcttcgtgacagagggcagcgccgaggaaccgatcgcggcgctgcccggcgtctcgcgctggggtctgcagggaatcgtcgagcgcgcgcgcgaagcccgcgacctcggcatcccgtgcctggcgctgttccccaataccccccatgcgctgcgtaccgaggacggccgcgaggcggtcaatcccgacaatctgatgtgccgcgccatccgcgccatcaaggatgcggtgccggaagtaggcgtgctgaccgacgtggcgctcgatccctataccagccacggccatgacggcatcgtcgacggcgccggctatgtgctcaacgacgaaacctcggcggtgctgaccgagcaggcgctggtgcaagcggccgccggcgcggacatcgtggcacccagcgacatgatggacggccgggtcggccagatccgtagcgcgctggaggcgaacggtcatgtcaacgtgcagatcatggcctatgccgccaaatatgccagcgccttttacgggcccttccgcgacgcggtcggcagccgggggctgctcaagggcgacaagaagacctaccagatggatcctgccaatgccgaggaggcgttgcgggaagtggcgctcgaccttgccgagggtgcggacagcgtgatggtgaagccggggctaccttatctggacatcgtggcgcgggtgaagagtgccttcgaagtgcctgttttcgcatatcaggtatccggtgagtatgcgatgatcgaggcggcggcggccgtcggcgcgggcgatcgggaggcgctggtgctggaaacgctgatggcgttcaagcgcgcaggctgcaccggcgtgctgacctatcacgcgccgctggcggcccggctgctc

SEQ ID NO: 41680 - DNA, 420 bp, SPHINGOMONAS
atggccgcgacccggaccttttcgatcatcaagcccgatgccacccgccgcaacctgaccggcgccgtcaccaagatgctggaagaggctggcctgcgcgtcgtcgcctccaagcgcatccagatgagccgcgagcaggcagaaggcttctacggcgtccacaaggagcgccccttcttcaacgacctcgtcgagttcatgatctcgggtccggtcgtggtgcaggtgctcgagggcgagaacgccgtgcagcgcaaccgcgacatcatgggcgccaccaacccggcgaacgccgagcccggcacgatccgcaaggaactggccgagtcgatcgaagccaactcggtccatggttcggattcggaagagaatgccgcgatcgagatcgccttcttcttcaagccggaagaaatcgtcggc

SEQ ID NO: 41681 - DNA, 1215 bp, SPHINGOMONAS
ttcacgctgaatgcgcgcgagacccatttccgcgatcgggtgaaggcctttgttgatgccgaaatccgcccgagggagactgactttcgtgcggccgcagcgacagcggatcgctggtcggtcaacccggtactcgaagcggtgaaggcgcgcgccaaggccgcgggcctgtggaacttcttcatgccgccgcactcgggccagagccatgtcgacgacagcttcgtgttcgaaggcgagcagctcaccaatctggaatatgccctgtgcgccgaggaaatgggtcgggttggttgggcatcggaggtgttcaattgctccgcgccggataccggcaacatggaggtgctgcaccgctacggcacccgtgcgcagaaggacacatggcttgcgccgctgatgcggggcgagatccgctccgccttcctcatgaccgaacccgacgttgcctcgtccgacgcaaccaacatcgaaacgcggatcgagcgcgacggcgaccagtatgtgatcaacggccggaaatggtggtcgtcgggcgctggcgatccgcgctgcaagatcgcgatcctgatgggcaagacggatttcagtgccgccaaacatgcccagcagagcatgatcctggtgccgctggacaccccgggcgtgaccatcgagcggatgctttcggttttcgggtatgatcacgcgccgcatggccatgccgaaatcctactgcgcgacgtgcgcgtgccggtggagaacctgctgctgggcgaaggtcgcggcttcgagatcgcgcaaggccggctggggccggggcggatccaccattgcatgcgcaccatcggcgtggcggaggaggcgatcgccgccatggccaagcggctggtctcgcgtgtcgcgttcggcaagcgcatcgccgatcattcgatctgggagcagcgtgtagcccgcgcgcgcatcgacatcgagatgacgcgactgctctgcctcaaggcggccgacatgatggacaaggcgggcaacaaggcggcccagctcgagatcgcgatgatcaaggtacaggcgccggccatggcgttgcagatcctggacgacgcggtccaggcgcatggcggggcaggggtgagcgacgatttcgatctcgcgcacaattggggcagcatccgtacgctgcggctcgccgatggaccggacgaggtccatgcccgcgccatcgcccgtgccgaattc

SEQ ID NO: 41682 - DNA, 1081 bp, SPHINGOMONAS
aaggctgccgttctgtttgaggccaataccccccctccagatcgaggaggtggaggtctccagtcccggaccgcgcgaggtgttgatccgcaccgcggcggtgggtgtctgccggtccgacctccatttcgtcgacggcgccttcccgcacccggtgccgacggtaccggggcatgaagctgcgggggtcgtggaagcggtcggctcggacgtggcgcggttgcggcccggcgaccatgtcatcaccttcttcacggccttttgcggttcgtgcgagctgtgcgtgaccgggcggccctcgctgtgcgtcgacccatcgacgcagcgtccggccgatgccgaaccgcggctgaagctgaagagcggcacgccgctggcccccttcctcaatctttccgcctttgccgaaatgatgctggtgcacgaaaatgcgtgcgtcgcgatcagcaaggcgatgccgctcgatcgcgccgcgctgctcggctgcgcggtcatcaccggggcgggagcgatcttcaacgacagtcgcgtgcgccctggtgagagcgtggcggtgatcggtgccgggggcatcggcctggcggcggtcaatgccgccaggattgccggcgccgggcagatcatcgcactcgatcccgtggaggaaaaacgcgcgcttgcgaggaagatgggcgccacccatgtcttggatccgggggcggaaggagtcgtgaagcagctgctcgccctgaccggcggcggcgtgcactatgcaatcgaggcggtgggccgccccgccacggccgaactcgcctggcagatcttgcggcgcggtggcaccgcgacgatcctcggcatgatcgcgccgggccagggcgtcagcctgcccggccccagcttcctcaccggcaagaagatccaagggtcgctgctcggcagcacgcgcttcccgatcgacatgccgcggctcgtccagctctatctcgatggcgtgctcgatctggacaccatggtcgccgaacgaatccgcctgccccaggtgaacgacgcgctggacaagctgcgccagggcacgagcgtccgctccgtgatcgaattcgca

SEQ ID NO: 41683 - DNA, 744 bp, SPHINGOMONAS
ttcactggcaaggttgcggtcgtgaccggcgccgcctcgggcattggccgggcgacggtgcgcgcgttcgctgcggcaggcgcgcaggtggtggcggcggaccgcgcagccgcggtgcacgagacggttgtcggacttcgcgatacgttggcggtggaaatggacgctggagacgaaggggacatccagcgacttgtggaagccgcctgcgaccgcttcggcggcatcgacattttctatgccaatgccggtatctcgggcggagcggcgggaattttcgatgcggacatagcgctttggaccgaagtgttacgggtcaatctcatcggcccggcgctcgccatcaagcatgccgcaccgcacatcgtccaacgcggaggcggggcgatcctgtgtaccgcgagcgtcgccgggctccgctcgggggcagggggaacgccctattcggcatccaaggccggcgtgatcaatctggtgcagaccgctgcccagcaactcgccacatcgtgtgtgcgggtcaacgcgatttgcccgggcctgatcgagaccggcatgacccagcgcgccttcgaccatgctcgcgagcgcgacaaggaggacaagctcggccagctcaacccgcttcgccgcgcgggccggcctgatgagattgcacaggtggcgctgttcctcgcctccgatgcggcgagctatgtcaacggccaagcgatcgcggtcgatggcgggctttccgccagtcacccg

SEQ ID NO: 41684 - DNA, 441 bp, SPHINGOMONAS
aacatcggcccgctcgatatcgggcgggtgatggcggcgctgccccatcgatttccgatgctgctggtcgaccgggtcgaggagctgatcctcgaccagtcgatcgtcgcggtgaaagccgtgacgatcaacgagtcgttcttccagggccatttccctggccgtccgatcatgccgggcgtgctcaccgtcgaggcgctcgcccaggcggcgggcgtgctggcggtggagtcgctcggcctcgcgggctcgggcaagctcgtctacttcatggcgatcgacaacgtgaagttccgcaagccggtggagccgggcgtgctgctcaagctccatgtcgagttcgtgcagaagcgttcgcgcgtctgcaagttcgccggcaaggcactgatcgacggcgaactggcggccgaatgcgaattcaccgcgatgatcgcggatccg

SEQ ID NO: 41685 - DNA, 690 bp, SPHINGOMONAS
ctccagatcgtccgcctgcccgccttcaccgacaattacctgtggctcgtccatgatcccgtgtcggcggagacgatcgtggtcgatcccggcgcgtcggagccggtgctggcggcgctcgacgagcgcggctggacgctgacggcgatctggaacacccattggcaccccgatcacaccggcggcaacgcggcgctcaagacggcaaccggctgcaccgtgattgcccccgccgccgaggcggcgaagattccgacggcagatcgtctggtggcggacggggatgtcgtcgcgatcggtgcgcaccaggcggcggtgatcgcggtacccgcccacaccgccgggcatatcgcctatcatctggccgaggatgcggtgatattcgtcggcgacacgctgttcgcgatgggctgcgggcggctgttcgagggcaccgccgacgacatgttcgccgcgatgcgccgcctggacgcgctgccgggcgaaacgcgggtctattgcgcacacgaatataccctcagcaacgcgcgctatgccgtggtggccgaaccggacaacgccgccatcgccgtccgcctggccgaggtcgagcgcctccgtgccgcgggcgaggcgacggtgccgacgacgatcgcggacgaacgcgccaccaaccccttcctgcgggcagcggatgcggtcattctggcc

SEQ ID NO: 41686 - DNA, 765 bp, SPHINGOMONAS
aagtccgcgatcgtcaccgggtccacctcgggcatcggcctcgcttatgccaaggcgctggcggccgaaggcgcgaacgtgctgatcaacggcttcggcgatgcagaggcgatcgagaaggagcgcgcggcgctggccgaggccagcggcggcaaggcgctctacgacgcggccgacatgaccaagccggaccagatcgccgccatggtcgcgcgtgccgaggccgaattcggcgcggtcgacatcgcgatttccaacgccggcatccagcacgtcgccccgatcgacgaattcccgatcgagaagtgggacgcgatcctggcgatcaacctcagctcgaccttccacctgatgcgcgcggcgattcccggcatgaaggcgcggaaatggggccggatcatctccaccgccagcgcgcacagcctggtcgccagcccgaacaaggcggcgtacgtcgccgccaagcacggccttgccggcctcaccaagacggcggcgctggaagtggcgacgcacggcatcacggtgaactgcatctcgcccggctatgtctggacgccgctggtcgagaaccagatccccgacacgatgaagacgcgcgggctgacccgcgagcaggtgatcaacgacgtgctgctcgatgcccagccgaccaagcagttcgtgctgcccgagcaggtcgcggcgctggccgtgttcctgtgccgcgacgaggccgcgcagatcaccggatcgaactattcgatcgacggcggctggaccgcc

SEQ ID NO: 41687 - DNA, 987 bp, SPHINGOMONAS
cagcgccacggcgcggtatcgctgctcgcccacccctcgccgatcgagcggctggcgcggctggaggcggcgctcggcacgggggtgcagatctatgcgaagcgcgacgatgtggcgggcatcggcggcggcggcaacaagctgcgcaagctcgaattcctgctcggcgacgcgatcgcgcgaggctgcgacaccttcgtcaccaccggcggcctgcaatccaaccatgcccggctgagcgcggcggcggcggcgcggatggggctcgcctgcgagctggtgctggccgatgtcgtgccgcgccacgaccccgactatcgcggcaacggcaacctcctgctcgacgcgatcttcggcgcgaccgtgcaccgcgtgcccggcgacaccgacccgctcgccttcgcccacacccgcgccgcgacgctgcgggcggcggggcgcaaaccctatgtggtcggtgcgggcggatcgtcgccggtcggcgcgctcggctatgtcgcctgcgcctgggaaatcctggaccaggaggcggcgctgggcgagcgcttcgcccgcatcgtcgtgcccaatggcagcgccggcacccatgccggcctcgcagccggcatggcggccgcgggcgcggaggtggcgcgcgtccagtcctacgccgtcctcgccgcccccgagcgcgcccatgccgaaacgctggcgctggccgaggcgacgctcgccgccaacgccctgccgggtagcgtgtcggcggcggaggtggtgatcgacggcagccagcgtgggcccggctatggcatccccacggaggcgatgcgcgaagcggtggaactgctcgcccgcaccgagggcctgctgctcgaccccgtctacagcggcaaggcgttcgccgggctgctggcggcgatccggggcggcgcgttccagccgggcgaggcggtgctgtacgtcatgaccggcggcgttccggggctgtttgcgtatcgggaggtgttt

SEQ ID NO: 41688 - DNA, 843 bp, SPHINGOMONAS
ctctggaccggcgtctatcccgcggcgaccacccagtttgccgaggatctttcgatcgatttcgatgccacgcagcggacgcagatcgcgctcgtcgacgacggcgtcgacgggctcatcctgctcggcacctgcggcgagaacaattccctggagcccgacgagaagcgccaggtgctccgcgccggtgtggaagcggtgggcgggcgcgtgccgctggtcgcgggcgtatccgaattcaccaccgcccgcgcgatcgactatgcccgcgatgccgagaagatcggcgtcgacgcgctgatgctgcttcccgccatggtctatgtgccgaccgccgccgagctggaggcccatttccgcgcggtggcggcggcgaccacgctgccgatcatgctctacaacaacccgcccgcctatcgcgtgtcgatcgacaccgcgacgctggaccgcctgaccgatgtgaagaacatcgtcgcggtcaaggaaagcgcgccggatccacgccgcttcaccgatctcttcaaccggtacggcgatcgctacacgctgatggcgggcctggacgacgtggcgctggagggcctgttcctcggcgcctcgggctgggtctcgggcctcaccagcgcctttccggaagaatcggtgcggctggtcgcggcgttcaacgaaggccggttcgacgaggcgcgcgcgatctatcgctggttcatgccgctgctccatctcgatgccgagcatgacctggtccagtcgatcaagctggccgagcagatcatgggccgcggcagcgagcgggtccgcctgccgcgcctgccgctcgccggcgagcgccgcgcccaggta

SEQ ID NO: 41689 - DNA, 1350 bp, SPHINGOMONAS
tccagtgagcatcggctgcgccccagcctttcctggccgcacctgatcgcgctgggggtcggcgcgatcgtcggcaccggcatctacacgctgaccggggtcggcgccgagcgggcggggcccgccgtgatcctcgccttcgtcatcgccggtgcggtgtgcgcctgcgccgcgctcgcctatgccgagctggcgacgatgattcccgccgccggcagcgcctatacctatagctattcggtgctcggcgagacgatcgcctgggtggtcggctggagcctgatcctcgaatattcgctcgcctgctcggcggtggcggtcggctggtcgggctatctggtcggctggctgcaatcggcaggggtgcatctgccgccgctgctgctcgaggggccgcatgccggcggcctcgtcaacctgccggcggtgctcgtatccttcgccattgccggcatgctgatgctcggcacccgcgagagcgcgacgctcaacatcgtgctggtcgtcatcaagctggtggcgcttggcctgttcgttgcactcgcgctgccgggcttcgatgcggccaacttccacccgttcatgccgcacggcttcgccagccatgccgagggggctgtgacgcgcggcgtgatggcggccgccgcgatcgtgttcttcgccttttacggcttcgacgcggtcgccacgtccgccgaggaggccaagaagccgggccgcgacctcaccatcggcatcgtcggatcgatggcgctgtgcaccaccatctacatcctcgtcgcggtcgccgcggtgggggcgatgccgacggcgacgctcggcaattcgcccgagccgctggcgctggtgctgcgcacgctcggccaccccttcgccgcctgggcgatcgccgccgccgcgctggtcgcgctgccctcggtgatcctggtcatgatgtacggccagagccgcatcttcttcgtgatggcgcgtgacggcttgcttccccgcgcgctcgccaaggtctcgccgcgcaccggcgcgccggtactggtgaccggcattaccggactgttcgtcgcaggcgtggcggggttcctgcggctcgacgagatcgccgagctggccaatgccggcacgctgatcgcgttcatcgcggtgggggcgtgcatgatgctgctccgccgccgggcgcccgatgcgccgcgcatcttccgctgcccgcagccttatgtggtcggcacgctggcggtgctgggctgcctctatctgctcttctcgctgccggagaagacgctggtgcgcttcctgctctggaacgtcgccgggcttgccgtctacttcctctatggccgcgcgcgcagcgtgctg

SEQ ID NO: 41690 - DNA, 2100 bp, SPHINGOMONAS
tttgtccggctcgatggccgcgccacctgcctgatcgtcgattgccgcggcgaggcgccggcgatcctctactggggccgccgcctgcccgacgatctcgatcccgccgcgctggcgctgctgggcgtgcggcaggaagccccctgctcgcccgcgaccacgccgcccttgggcctcacgccgctgatcggtgcgggctttcccggccgccccgggctgtcggcgcatcgcgacggccaaggctgggcgacctggaccgcgatcaccgcgatacaccggatcgacgccgcaaccgtcgagatcgattcggaagataccgcccacggcatcggcctcgtccaccggctgcatcttgccggcgacgtgctgcggatgcggaccacgctgatcaaccgcggcgacaccgcgctcagcgtcgaggcgtgcgatgcccccgccctgccggcccccgaggcggtgaccgactggacgctgttcgagggccgctggtcgggcgagctgcagacccgccgcgtggcccgcgcgatgggcgcggtggcgcgcgagaaccggcgcggccgcaccagccatgatgccttccccgcgatcctcgccgaagtcgggccctgcggcgagcaggcgggcgaggtgttcggcgtgcagctcgcctggagcggcaaccatcggctctgggcggagacgctgtccgacggacgcgcctatctccagctgggcgagctgttcctgccgggcgagtgccggctggcgccgggcgcgcgctataccagccccgatctggtctgcgcctggtccgatgccgggcgcagcggcctcgcccgcgccttccacgcccatgtccgcgcgcggccgcagcacgatcggctgcgcgccaagccgcggccggtccactacaacacctgggaagcggtctatttcgaccacaagcccgcggccctgatggcgctggcagacaaagccgccgcgatcggcatcgagcggttcgtgctcgacgatggctggttcctcggccgccgcgacgacaccgtgggcctcggcgactggatcgtcgatccggcgatctactcggacggcctggggccgctggtggcgcatgtgcgcaagctcggcatggagttcggcctgtgggtggaacccgagatggtcaatccggacagcgagctgttccgcgcccatccagagtgggtgctcggcacaccccctgccccgcagctgcgcttccgcaaccagctggtgctcgatttcggtcaggcggcggtgcgcgagcatctgttcgaacggatcgatgcgctgctgcgcgaacacgccatcgcctatctcaaatgggacatgaaccgcgacatcacccatcccggcggcgccggcggggccgccggcgcgcatgcccatgtgctcgggctgtacgaggtgctcgcccggctgcgcgcggcgcatccttcggtcgagatcgaaagctgctcggccggcggcggccgtaccgacttcggcattctcgactataccgaccgcgtgtggacctcggacaccaacgacgcgctcgaccggctgacgatccagcgcggcctctccaccttcgtgccggccgagctgatgggcgcgcatgtcggcccggccgattgccacatcaccggccgacgggtgggcatggcgacgcgcgtcgccaccgcactgttcggccattttggcgtggaagcagacctcaacgcgatggaggatgccgagcgggccgagctcgccgccggcatcgcgctccacaagcggcaccgcgcgctgattcatacaggcgacctctaccggctcgaccggccggaaagcgagatcgccttcggcatcgtcgccgccgaccagcgggaggcgctgttctcctacacccaggtcaccgagccgcgcggctattttgccgctcccttgcggctcgacgggctcgatccggcggcgcgctaccgggtgacgctggcctggccgggcagcggctatcccgcctcgccgctgttcgcagcactgggcgaaggcgcggtgttctcgggcgcggcgttgatggcggccgggctccagccgccgcgcctcaagccgcaggcggcgttcctgctccacctcgaacgg

SEQ ID NO: 41691 - DNA, 1956 bp, SPHINGOMONAS
gtgcttggcgtctgctattacccggaacattggtcgcgcgcgctgtgggcggaggatgcccgccgcatgaaggcgctggggctgcgctatgtccgcatcggcgaattcgcctggtcgcggctcgagcccgagcccggcacctatgacttcgcctggctcgacgaggcgatcgagacgctggccgccgccgggctggaggtggtgctcggtacccccaccgcgacaccgccgaaatggctgatcgaccgctatccagagatcctgccggtcgacccggagaccggccgcacccgcggcttcggctcgcggcggcattatgatttctccagcgacgtctacttacgcgaatccgagcggatcgtgaccgcgctggccgaacgttacggcagccatcccggcgtggtgggctggcagaccgacaacgagttgtgctgtcacctcaccacgctcagcgcgtcgccggtcgcccgcgatgcgttccgcctttggtgcaaggcgcgctacggcacgatcgaggcgctcaacaccgcctggggcaacgtcttctggtcgatggaatatcgcagcttcgacgagatcgaactgccggtcggcgcggtgaccgagacgagcccggcgcaccgcatggcgtggcggcgtttctcgtccgaccaggtcgcgcgctatcacgatgcgcaggtggcgatcctgcgccggctgtcgcagggcaagttcatcacccacaacttcatcccgatgaacgagaccggggtcgacaaccaccggctcgcccgcgacctcgatttcgcggcgtacgacaattatccgctcggccgcaccgatctgtggatggcggacgcgcccgccgaggaattccgccgctacatgcggaccggccaccccgatttcggcgccttcttcttcgaccagacccgtggcctcgcccccggcgccttctggatcatggagcagcagccggggcccgtgaactgggcgatgcacaatccgcgccccgcgccgggcatggtgcggctgtggacgctggaggcgttcgcgcacggcgccggcgtggtcagctatttccgctggcgccaggcgcccttcgcgcaggagcagatgcacgccggcctgctccggcccgacagcagcgcggcggcggcgtggcccgaggtcgaggcggtcgtccgcgaccttgccctgctcggcctggaggagcgcccgcgcggccgtgccagggtggcgctggtcgtcgatgtcgaggcgcagtggctcggcgatatcgagcggcagggcgacagctacgactatacacgcatcctgctcggctattaccaggcgttccgccggctgggcgtggatgtcgactttatcgccccggacggcgatccggcggattacaggctgatcgtcgtgccttcgctggcgatcgcgcgggcggacacggcggcgcatctggcgcgcggcggcgcggtggtgctctatggcgcgcgctcgggcgccaagaccgaggatttcaccctgcccgagacgctggcgcccggcgccctgcaggcggtgctgccgatccaggtgcagtcggtcgagacgctgcgtccgggctgcgagggcagcattgcgtggaacggccgcgtctatccgagcggcggctggcgcgaggagctggggctggatgcctcggtcgagacgctgggccggttcgaggatggcggcgcggcgctggtccgcaaggacaaggcgctgtatctcgcgaccctttccgacgcgacgctgctgaccgacctgctggaggcgctctgtgccgaggtgggcgtggcgacggtgcggctgtccgaggatctgcggatctgccggcgcggcggcctcgtctttgccttcaactatgccgagaccgccgcgatggcgccggcaccgcaggacgcgaccttcgtgctcggcggccacaccatcgccccgcgcgacgttgccatctggagcgag

SEQ ID NO: 41692 - DNA, 1023 bp, SPHINGOMONAS
cggggagtagacaggatgaaggcactggtttgcgtgggtccgcatcaagcccatatcgaagagcgaccccgccccgagccccgcgagggcgaggtgctgatccgcatgcgccgcgtcggcatctgcggcacggactatcacatcttcgacggaagccagcccttcttcacctatccccgcctgatcggccacgagctttcgggcgagatcgccgaggcgccggagggcagtggcctggcgccgggcgacatcgttaccgtcaatccctatctgccctgcggcacctgcgtcgcctgccgtcgcggccggccgaactgctgcagccggatcagcgtgctgggcgtgcacgccgatggcggcatggcggaatatatgacggccccgctccacgcggtgatccccactcccggcctctcgctcgatcacgccgccatggtggagttcctcgcgatcggcgcccatgccgtgcgccgggccgcgatcgagccgggtgcccgcgtgctcgtcaccggcgcgggcccgatcgggatcggttgcgccttgtttgcccgcatcgcaggtgccgcggaggtgacgctgctcgatcgcagcgcccggcggctggcgaccgctgcagaggccttcggcttcacggacggcgtgatcgccggaccggaggcgaccgagcagctcgaagcgcgcaccggtggcgagatgttcgattatctgttcgacgcgaccggcaacatccaggcgatgaacgccggcctcgccaacctcgcgcatgccggcacctatgtgctggtcggcctcaaccgcgatacgctgagctttcccgatcccgaattccacaagcgcgagacgacgctgctcgccagccgcaacgcgctctcggccgatttcgagcaggtggtggcggcaatccgcgacggcaccatcccgatcgaccgcttcctcacccaccgcgtggcgctggccgaagcgcccgcggcgctgcccgggctgatcgccgtgcaggaatcggtgctcaaggccctcgtcacc

SEQ ID NO: 41693 - DNA, 735 bp, SPHINGOMONAS
ttggaggggaagacggtgctcgtcaccggcgggtcgaccgggatcggccgggcggcggcgatcggggcggccgaggccggcgcggatgtggcgatcaactatcacagccgcgacgacgatgccgcagcggtggtcgccgcgatcgaagccaagggccggcgcggcctggcggtgaagggcgacgtcgccgatcccgccaccgccaccgatttcgtcgcccgcgcggtcgacgcgttgggcaaggtcgacgtgctggtctcgaacgccggcatctgccccttccacgcgttcctcgatatgccggcggagaccgtgcagcggacgatgcaggtcaacctgctcggcggctatttcatgtgccaggcggcggcgaaccagatggtcgcgcaaggccatggcggcgccatcgtcgcggtctcgtcgatctcggcgctggtcggcggcgaatatcagacgcactacacccccaccaaggcggggctccattcgctgatgcaatcggcggcgatcgcgctggggcggcacggcatccgctgcaactcggtgctgccgggcacgatcctcaccgagatcaacaaggacgatctcgccgacgacgagaagcggaaatacatggaaggccgggtgccgctcggccggctgggccagcccgaggatcttgccgggccgatcgtgttcctcgcctccgacatggcggcctatgtcaccggcgccgcgctgctggtcgacggcggc

SEQ ID NO: 41694 - DNA, 717 bp, SPHINGOMONAS
cgcttcgccgggcgcacggcggtgatcaccggcggcgcctcgggcctcggcctcgcggtcgcccggcggatggaggcggagggcggccaggtcgcgctctgggatctcaaccccgatcagctagccgtggcggcggccgaactgggcggtgcacatgtcgagcagctcgacgtctccgatgccgaggcggtcgcccgtgcggcggacgcgacggcggcggcgctgggtaggatcgacatcctggtatgctcggccggcatcaccggcgcgaccgtgccggtgcacgagttcccgctcgacagctggcgccgcgtgatcgacatcaacctgagcggcctgttctattgctgccgcgcggtggtgccgcacatgctggccaacggctatggccgcatcgtcaacgtcgcctcggtggcgggcaaggagggcaatcccaacgcctcggcctattcggcctccaaggccggcgtgatcggcttcaccaagtcgctgggcaaggaactggccggcaagggcgtgatcgccaacgcgctgaccccggccacgttcgagagcccgatcctcgcccagctgccgccgagccaggtcgaatacatgcgctcgaagatcccgatgggccggctgggcgaggcggaagaaagcgccgcgatgatctgcttcatggcgagcgaggagtgcagcttcaccaccgcctcgaccttcgacacctcgggcggc

SEQ ID NO: 41695 - DNA, 1677 bp, SPHINGOMONAS
tcaatgacaaagcccgaaatggtctggaagaccgcctatcggcatccaggagagtgggaccgcagctacgcgccgcggtccatggtagacctgttcgaggagagcgcggccgcccatccgcacgcgcccctgctcgatttcatgggtcgcatctacagctatggcgagacgctggacggtgccaaccgggtcgcctgcggcctgcgcgcgctgggctacgggccgggcgaccggatcggcctattcctgcccaatgtgccgcactacgtcgctgcctattacggcatcctcaagctgggtgcgacggtggtgaacttctcgccgctctactcggtcgaggaactggccgcgcaggtcgccgattcgggcacaaggctgctcttcaccctttccgccacggcgctgctgcccaccgcgctcaaggtgctggaaaagagcgatctggaacggctggtggtcggctcggtcgcgggcgcgctgcccaccgccaagtcgctcttctaccagctgttccgcggcagcgaggtgacggcccggccgcacgatccgcgtatcctcgccttctccaagctgatcgccaacaagggcgactgcacgatccccgacatcgatccggagcgcgacatcgccctgatccagtataccggcggcaccaccggcacccccaagggcgcggtgctcacccaccagaatctctccgccaatgcccggcaggtggcggagctggatcccgagcgcggccagtcggaggattcggtcctcggcgtgctgccgttcttccacgtcttcgccaatacctgcgtgctcaaccgcacagtgatcaacggcggcaagatcatcatgctgccgcgcttcaacgcgcagcaggtgctcaccgagctgcgccgcacccgtccccgctcgctgcccggcgtgccgaccatgtaccaggcgctgctcgacgcgccgggcatgcagccttccgacttctcgtcgctgcgtttctgcatttcgggcggcgcgccgctccccgagcagctcaagctcaactgggaatcgaccaccggcgcccacatcatcgagggctatggcctgtcggagagctcgggcgtggtctcggccaacccttatgtcgggctgaacaagagcggcacgatcggccagccgatcgccggcacccgcgtgcggctggtcgacaaggaggatccccgcaagcccgcgccggaaggcgagccgggggagatcgtcgtgcagggcccgcagatcatgcgcggctattggaaccggccggaggccgatgccggcaccttcgtcgacgatcactggctgcgcaccggcgatgtcggcatcatcgacgaggacggctatatccagatcgtcgaccggctgaaggacatgatcgcggtcggcgggttcaaggtgttccccagccagatcgaggcggtgctctacacccacccggcggtgaaggagacgctcgtcctcggcctgcccgatccgtatcacggcgaactgccgcacgcctatgtcgcgctgaacgacggcatgaccgcggacgccaaggagatgtgcgactggctcaacgcccagctcggcaagcatgagcgggtgaaggaagtggtgatccgcgacagcctgcccaagacgatgatcggcaagctcagccgcaaggacctgctgaacgaggtgaaggcgggg

SEQ ID NO: 41696 - DNA, 1338 bp, SPHINGOMONAS
atcaacccggcgaccggcgagaccgtggatcgtattgcggagctggacgatgccgggatcgaggcggcgctggcgcgcggggctgccgggtacaagcagtggcgcgaaacctcgatcgagacgcgcaccgcgctgctgaccaggatcgccgatagctgggaagccgacaagcagcatcttgccgaactggcggtgcgcgagatgggcaagacgatcacgagcgcgctcgccgaggtggagaagtgcatcagcggcttccggcactatgccgagcacggccccgcctatctggagccgacgaccgtcaagaccgcgagtggccatgccgtggcgcgctggctgccgctggggccggtgctggcggtgatgccgtggaacttcccctattggcaggccgtgcgcttcctcgcgccgacgattcttgcgggcaatgtggcgctgctcaagcacgcctcgtccgtccagggctgcgcggcggcgatggaggcgatggcgcgcaaggccggcgcccccgaagggctgttccagaacctcgcgatcaaatcggacaaggtcgatgcgatcatcgccgacaagcgcgtggtggcggtgacgcttaccggctcggaaggtgcgggcgcgaaggtggccgaggcggcagggcgcgcgctcaagaaggtggtgctggagctgggcggttcggacccgttcatcgtcatgccctcggccgatctcgacgcggcggtgaagaccgcggtgaccgcgcgcgtgcagaatgccgggcagagctgcatctgctcgaagcggatgatcgtccatgccgacgtatacgacacctttctggagaagttcgtcgccggcatggccgcggtgaagatcggcgatccgatggacaaggagaccgtgatggggccgctttccagcacccagcagcgcgataccgtgctggggcaggtggctcgcgccacggcggaaggggcgcggctgctgaccggtggtgcgacgatcgacaggccgggggcctggatgatgccgggcgtgctggtcgacatcgacccggaaagcgacgtcgccaaggaagagatcttcggtccggtcgcggctgtgtacaaggttgccgatatcgacgaggcgatcgcgctggcgaacgacgtaccctatggcctcggttcgtcggtgtggacgcaggacgaaggcgaaatcgagcggctcgcccgagagatcgaggcggggatgacggcggtcaacacgctgctcgcctcggtgcccgaggcgccgttcggcggcgtgaagctttccggccatggccgcgagttgggcccctgggggctgcacgagttcatgaacctgaaggcggtg

SEQ ID NO: 41697 - DNA, 882 bp, SPHINGOMONAS
tcgctcgcgctcgaatcggcgctgcgccaggtcgccgccgagatcgacgaccagttcgaccggctgctcgaggtgccggacgatccccgtgccgacctctaccgggcgatgcgccacgccgcgatcggcggcggcaagcggctgcgcccgctgctggtgttcgccaccgcccagctgttcagcgtcgacaagagctgcgccgcgcgcgtcgccacggcactcgaatgcatccatgtctattcgctgatccatgacgacctgccggcgatggacgatgacgacatgcgccgcggcaagcccaccgtgcacaaggcgttcgacgaggcgaccgcgatcctcgccggcgactgcctccacgatctcgctttcgagctgctcgcgcatgaggcgacgcatgccgacccgttcgtccgtgtcgaactgatttccgaactggcccgttcctcgggccccgccggcatggccggcggccagatgatggatctggaggccgagaaggccagcttcgatctcgccaccgtcacccggctgcaggcgctgaagacgggcgcgctgatcagttgcgcggtcgaatgcggcgcgatcctcggccgcgtgccgcacgagggccgcacgggcctgcgcggctatgcgcgggacatcggcctcgccttccagatcgtcgacgacattctcgatgccgagggcgacgaggcggtggtcggcaagaagctgggcaaggacggtgcggcgggcaaggagaccttcctttcgctgctcggcatcgatcgcgcgcgcgaacaggcgcggatgctggtcgatcaggcgatcgcccatctccacgcctacggcccccaggccgatctgctgcgcgacgtggcgcgcttcacgctcgaacgcgac

SEQ ID NO: 41698 - DNA, 744 bp, SPHINGOMONAS
cgtgtgggagatacctacggggtgacgcgcccgcgcgctcgcgctagggcatcgcccatgaccacccatatcctcctcaccggcagcagccggggcatcggcgcggcgacggcggtgctgctgggcgacgatgcgcgcgtgaagctcgtcggccagggcacgcgcagcggcattcccgccgacttcaccgatcccgccgcaccgcaagcgctctggcagcaggccctcgacgcgctcgacggccggatcgacgtgctgatcaacaatgccggcatcttcgaggccaatccgctcgatgccgagcacgacgactgggtcgagggctgggagcgcacgatgcgcgtcaacctcaccgcctcggccgagctgtgccggctcgccgtgcgccactggcaggacagcggtaccggcggccggatcgtcaacgtcgccagccgcgccgcctatcgcggcgacagcccggcgcactggcattatgccgcctccaaggcgggcatggtcggcatgaccaagtcgatcgcgcgcggctatgcgggcgagggcatcctcgccttcgcgatctgccccggcttcaccatgaccggcatggccgaggactatctggccagccgcggcggcgacaagctgctggccgacatcccgctcggccgcgtcgcgagcccggaggagatcgccgccatcgccaaattctgcgcgctcgatgcgcccccctcgatgaccggcgcggtcctcgacgccaatgga

SEQ ID NO: 41699 - DNA, 1791 bp, SPHINGOMONAS
gcctacaagatcatcgatcatatctacgacaccgtcgtcgtcggcgccgggggctcgggcctccgcgcggtgatggaagtggcgcagtcgggcctcaagaccgcctgcatcaccaaggtgttccccacccgcagccacaccgtggcggcgcagggcggcatcgccgccagcctcggcaacatgggtccggaccactggacctggcacatgtacgacaccgtcaagggctccgactggctcggcgaccaggacgcgatcgagtatctgacccgcgaggccccggccgcggtctatgagctcgagcatgccggcatgccgttcagccgcaccgacgagggcaagatctaccagcgcccgttcggcggcatgatgcagaacatgggcgaaggcccgcccgcgcagcgcacctgcgccgcggccgaccgtaccggccatgcgatgctgcacacgctgtaccagcagagcctgaagtacgacgcggacttcttcatcgaatatttcgcgctcgacctgatcatggaaaatggcgagtgccgcggcgtgatcgcgctgtgcatggaagacggttcgatccaccgcttccgcagccatgcggtggtgctggcgaccggcggctatggccgcgtctaccagtcggccacctcggcgcacacctgcaccggcgacggcaacgcgatggtgctccgcgccggcctgccgctgcaggacatggagttcgtccagttccacccgaccggcatctacggcgcgggcgtgctgatcaccgagggtgcgcgcggcgaaggcggctatctcaccaactccgagggtgagcgcttcatggagcgctatgcgccgtccgccaaggatctcgccagccgcgacgtcgtgtcgcgctcgatggcgatggagatccgcgaaggccgcggcgtcggcaaggagaaggaccatatcttccttcacctcaaccatatcgacccgaagatcctggccgagcgcctgcccggcatcaccgagaccggcaaggtcttcgccggcgtcgacctcacccgccagccgctgccggtggtgccgaccgtccattacaacatgggcggcatcccgaccaactatcacggcgaagtcgtccatctgaaggacggcaatccggatgcggtcgtccccggcctgttcgcggtcggcgaagcggcctgcgtgtcggtgcacggcgccaaccgcctcggctccaactcgttgatcgacctcgtggtgttcggccgcgcgacgggcaagcggatcgtcgacatcctcaagccgaacaccccgcaccacccgctgccgaaggattcggaagcgctggcgctgggtcgcctcgaccatttccgcaacgccaatggcggcacccgcacggcacagctgcgcgccgacatgcagaagacgatgcagcgccactgcgccgtgttccgcaccgaggagctgatggccgagggcgtcagccacatggagcaggtctacaagggcctggaggacgtgcacgtcagcgaccgttcactggtgtggaacaccgatctcgtcgagacgctcgagctggacaacctgctcggccaggcgatggtgacgatccgcagcgcgatcaaccgcaaggaaagccgcggcgcccacatgcacgaggacttccccgagcgcgacgacgcggagtggatgaagcacaccatcgcgacgttcgacggctggggcggcaagggcggcaagaccgacatcgactaccgcccggtccacgactacacgctcaccgacgcgatcgactacatcaagccgaagaagcgggtgtac

SEQ ID NO: 41700 - DNA, 1419 bp, SPHINGOMONAS
atgacacaggcgatctccccccgctcgcgcaaggtgcgcgttctggcaacgctgggccctgccagcgcctcccccgagatgatcgagaagctgttccgggccggcgccgatgcattccgcatcaacatgagccatggcgaccaggcctcgaagatcccgctgttcgaggcgatccgcgggctggaggccatcaccggccgcccgaccacgatcctggccgaccttcagggcccgaagctccgcgtcggcaagttcgccgagggcaaggtgatgctggtcaccggccaccagttcacgctggaccgcgatcccaccccgggcgacgcgacccgcgtcgaactgccccaccgcgagatcttcgaagccgcgcatcccgatgcgcgcctgctgctcgacgacggcaagctggtgctgcgcgtgaccgacgtggcgcccgaccggctgaccacgatcgtcgaggtcggcggccccttgtccaacaacaagggcctcaacgtccccgacatggtgctgccgcttgccgcgctcaccgagaaggaccgcagcgacctcagcttcgcggtggagcagggcgccgactggatcgcgctcagcttcgtccagcgccccgaggatctgatggaggcccgccgcctgatcggcggcaaggcagcgttgctcgccaagatcgagaagccctcggccatcgcccgcctggaggagatcctcgaacagtgcgacggcgtgatggtcgcgcgcggcgacctgggtgtcgagctgccgccgcagcaggtgccgccgctgcagaagcgaatcgtcgaatcggcgcgccgcctcggccgcccggtgatcgtcgcgacgcagatgctcgaatcgatgatcgagagcccctcgcccacccgcgccgaagtgtcggacgtggcgacggcggtgtatgacggcgccgacgcgatcatgctctcggccgaaagcgccgcgggcaagtggccggtcgaatcggtgtcgatgatgaactcgatcgccgatgcggtggagcgtgatcccgcacatggtgaccgcgttcacttcacggtcctcaagcccgatccgaccactgccgacgcgctgtccgaagccgcgaagaacatcgccagcaccatctcggccgcagcgatcatctgcttcaccagctccggttccaccgcgcgtcgcatcgcccgcgagcgtcccagcgtgccgatcctggtgctgaccccggaacgcgagactgcgcgtcgcctgggcctgttgtggggcacgcacgcggtgaacacccgcgacgtcgactcgttcgaggagatggtcgccaaggcaaagcgcatggcgctgcgccacggcctcgccaaggccggcgaccgggtgatcgtgtgcgccggcgtgccgttcaagacgccgggttcgaccaacgtgctgcacgtcgtc

SEQ ID NO: 41701 - DNA, 1203 bp, SPHINGOMONAS
gacgacgatgtcgcgcgcaacgtcacccacatcatcaagcgcgtccgcgacgagggcgatgtcgcgctgcgcgacctgacccggctgttcgacaagcacgacctcgcagcgtcgggctggacgatcgaccgcgccgattgcctcgccgcttacgaggggctcacccccgaattgcgcgacgcgctcgaactcgccgccgagcggatcgcggtttatcacgccaagcagcgccccgaggatcgcgacgaaaccgatccgcagggcatccgcctcggcgcgcgctggacgccggtcgatgcggcgggcgtctatgtgcccggcggccgcgcggcctatcccagctcggtgctgatgaacgccatccccgccaaggcggcgggggtgcgccggctggtgatggtcacgcccacgcccaacggcgaggtgaacccgctggtcctcgccgccgcgcatgtcgccggcgtcgacgagctctaccgcgtcggcggcgcgcaggcgatcgccgcgctcgcctatggcaccgacacgatcgccccggtcgacgtcgtcaccggccccggcaatgcctgggtagcggaagccaagcgccagctctacggcgtggtcggcatcgacatggtcgcagggccttccgagatcgtcgtggtagcggacggcaagaacgatcccgagtggatcgccgccgatctgctcagccaggccgagcacgaccccaccagccagtcgatcctgttcaccgatgacgccgccttcgccgacaaggttgccgctgccgtcgacgcgcagatcgcgacgctcgccaccggcgccaccgcgcgcaccagctgggacgccaacggcgcgatcatcctggtgccggacttgccgacggcaatgccgctggtcgatcggctcgcgcccgagcatctcgaactcgcctgcgacgatgccgaggcgctgttcgacatggtccgtcacgcaggctctgtgttcctcggccgctatacgccggaagccgtcggcgattatgtcgccggccccaaccatgtgctgcccaccgggcggcgcgcgcgcttcgcatcgggcctttcggtgctcgatttcatgaagcgcacctcgttcctgagcctggatccgtccgggctcgccgcgatcggccccgctgccgttgcgctcgcagaagccgaaggcctgcccgcgcacgcaaagtcggtggcgatccgt

SEQ ID NO: 41702 - DNA, 654 bp, SPHINGOMONAS
atgaaccgcctcgccctgttcgattgcgacggcacgctggtcgacagccaggcgagcatctgcctcgccatggagcattgcttcaccggccagaagctggagccccccgcccgcgagtcgatccggcgaatcgtcggcctcagcctggtcgaggcgatcgcccggctgctgccggaggcggaggacgatctccaccgccacctcgccgaagaatataagcgcgcctatttcgccctgcgcaccgccggccacatcgaggacgagccgctgtatgacggcatccccgaagccatcgagacgctggacgcgaacggctggctgctcggcgtcgccaccggcaagtccgatcgcgggctgatccgggtgctggaggcgcacggcctgcgccggcacttcgtcacgctgcagacggcggaccgccacccctccaagccgcacccctcgatgatcgagaccgcgatcgccgaggcgggcgcgagccccgagacgacggtgatgatcggcgacaccagcttcgacatggcgatggcggtggcagccggcgcgcatcccttgggtgttgcatggggctaccacaccccccatgatctgcacgcggccggcgcggtgcgggtcgtggagcatgcgtcggcgattccggcgcatctggaggcc

SEQ ID NO: 41703 - DNA, 1473 bp, SPHINGOMONAS
aaaggcaagttaactagtgttgctgatcccgcttgggttcgcgggcccggacgcctaaatcgcgcccaaagcaagcggagaaatgcagtgacggccacacgcaccgaaaccgattccatcggcgcgatcgaagtccccgcccatgcctattggggcgcgcagacccagcgatcgatccagaactttccgttcggacccgaggagcggatgccgatcggcatcgtccatgcccaggcgatcgtgaagcaggccgcggcgcgggtgaacgtcaagcacgggctcgatcccgagatcgccgaggtgatcgaccaggtcgcgcaggaagtgatcgacggcacgctggacgaccagtttccgctggtgatctggcagaccggcagcggcacccagaccaacatgaacgtcaacgaggtgatcgccggccgcgccaacgagatcctcacgggaaatcgcggcggcaagagcccgatccaccccaacgaccatgtcaacatggcgcagtcgtccaacgacagcttcccgactgcgctgcacatcgccgcggcgcgtgcggtgacgctcgacctgttcccggcgctggagcggctgcacgcctcgctcgatcgcaaggcgcaggaatgggatcacatcgtcaagatcggccgcacccatctgcaggatgcgacgccgctgacgctgggccaggaattctccggctatgccgcgatgctcgcctcggcgcgcgcgcggttccagagcgtgctggagctcgacatcttcaagctggccctcggcggcacggcggtgggcaccgggctcaactcgccaccgggctatgccgaggacgtggcggcggaaatcgccaggatcaccgggctgcccttcgtctcggcgcccaacaagttcgagatgctggcgaccaaggatcagctggtgaacctctccggcgtctgcaacacgctggcggtgtcgctcaccaagatcgccaacgacatccgcctgctcggctccggcccgcgctcgggcctcggcgagctggagctgccggcgaacgagccgggcagctcgatcatgccgggcaaggtcaatcccacccagagcgaatcgctgacgatggtcgcggcccaggtgatcggcaaccacaccgccgtcaccgtcggcggcatgcagggccatttcgagctcaatgtgttcaagccgctgatcggggcgaacgtgctgcgctcgatcacgctgatggcgatcggcatgaccaacttcgccgagcgcgcggtggacggcgcgatagccaacgaggcgcggatcaaggaactggtcgatcgctcgctgatgctggtgaccgcgctggcgcccgcgatcggctacgacaacgccgcaaagatcgccaagaacgcgcacgagaaggggcttacgctaaaagaatcggggctggcactcgggctggtcgacgaggcgacgttcgacgcgttcgtccgccccgagacgatgaccggc

SEQ ID NO: 41704 - DNA, 1905 bp, SPHINGOMONAS
atggctaaagttatcggtatcgacctgggcacgaccaacagctgcgtcgccgtgatggaaggcggcaagcccaaggtcatcgagaatgtggaaggcgcgcgtaccacgccgtcgatcgtcgccttcgccaaggatggcgagcggctgatcggccagccggccaagcgccaggcggtgaccaacccggacagcaccatcttcgcggtgaagcgcctgatcggccgccgcttcgacgaccccgtgaccaagaaggacaccgagctggtgccctacacgatcgcgcgcggcccgaacggcgacgcctgggtcaaggccggcggcgaggaatatagcccgtcgcagatctcggccttcatcctgcagaagatgaaggaaaccgccgaatcctatctcggcgagagcgtgacgcaggccgtcatcaccgtgccggcgtacttcaacgacgcgcagcgccaggcgaccaaggatgccggcaagatcgcgggcctcgaagtgctgcgcatcatcaacgagccgaccgcggcggcgctcgcctacggcctcgacaaggacaacaacaagaccatcgcggtctatgaccttggcggcggcaccttcgacatctccgtcctcgaaatcggtgacggcgtgttcgaggtgaaggcgaccaacggcgacaccttcctcggcggcgaggacttcgactcgaccgtcgtccagtatctggccgacgagttcaagaaggccgaaggcatcgacctcaccaaggacaagctggcgctccagcgcctgaaggaagcggccgaaaaggcgaagatcgagctgagctcggcgcagaccaccgaggtcaacctgcccttcatcaccgccgaccagaacggcccgaagcacctggtgaagagcatcacccgcgccgatctcgagcgtctggtcgatgatctgatcaagcgcaccctcgagccgtgccgcaaggcgctggccgacgcgggcgtgaaggctgacgcgatcgacgaagtcgtgctcgtcggcggcatgacccgcatgcccaaggtccgccaggtcgtgaaggacttcttcggcaaggagccgcacaccggcgtgaacccggacgaagtcgtcgccattggtgctgcgatccaggccggcgtgctgcagggcgacgtgaaggacgtgctgctgctcgacgtgaccccgctgagcctcggtatcgagacgctgggcggcgtgttcacccgcatgatcgaccgcaacaccacgatcccgaccaagaagagccaggtctactcgactgccgatgacaatcagcaggcggtgacgatccgcgtcttccagggcgagcgcgagatggcggcggacaacaagctgctcggccagttcgacctggtcggcatcccgccggcgccgcgcggcgtgccgcagatcgaggtcaccttcgacatcgacgctaacggcatcgtcaacgtgtccgccaaggacaagggcaccggcaaggaacagcagatccgcatccaggcctcgggtggtctttcggacggcgacatcgaacagatggttcgcgatgccgagaagttcgccgaggacgacaagaagcgtcgtgccgcggcggaagccaagaacaacgccgaaagcctcgtccacaccaccgagcgtcagctcgccgagaatggcgacaaggtcgacgcgtcgctgaagggcgagatcgaggcggcgatcgccgagaccaagtcggcgatcgagagcggcgacgccgatgcgatgaccgccaaggcccagaatctcgcccaggtggcgatgaagctcggccaggcgatctacgagaagacggctgccgaaaacgcctcgccgaacgcgggcgccgcggccggcggcgaagccggggctgaagaagtggtcgacgccgagttctcggaagtggacgacaacaag

SEQ ID NO: 41705 - DNA, 585 bp, SPHINGOMONAS
gcgaccatcagccgcaagaccagcgaaacctcgatcgacgtcaccgtcaacctcgacgggaccggcgtctacaccatccacacgggcatcggcttcttcgatcacatgctcgaacagctgagccgacactcgctgatcgacatggacgtgaagaccgtgggcgacctccatatcgaccagcaccatacggtcgaggataccgggctcgcgatcggcgaagcgatcgccaaggcgctgggcgacaagaagggcatccgccgctacgccgacgcgctgtcgccgatggacgagacgctgacccgcgtcgcgatcgacatttccggccgcccctatctcgtgtggaagaccgaattcagccagaagaagctcggcgagatggataccgagatgttcgaacactggttccacagcttcgcccagaccgccggcctgacgctgcacgtcgagacgctgtatggcagcaacaaccaccatatcgccgaagccgcgttcaagggcctggcccgcgcgctgcgcgaagcggtggagatcgatccgcgcaaggccggggtgatcccgtcgaccaagggagtgctgtgatgatcc

SEQ ID NO: 41706 - DNA, 300 bp, SPHINGOMONAS
ctcgacacgctcgaacagactatccgcgaccgccgcctgggcgatcccgcgaccagctatgtcgccaagctcaccgcccgcggccgcgccaagatcgcgcagaagttgggcgaggaagccaccgaagcggtgatcgccgcgatccaggacgatcgcggcgagctggtgaaggaatcggcggacctgctcttccatctgctcgtgctgctcgccgatatggggctcagcctcgacgatgtccgcgcagagctcgcgcggcgcgaaggcgtgtccgggattgccgaaaaggcggcgcggggg

SEQ ID NO: 41707 - DNA, 1455 bp, SPHINGOMONAS
atattcgggcgcgtaaagcctctcgatgccattctagccacagccgaaaagaaatcgctccaccgctcgctcggcgccttccagctgaccatgctcggcatcggcgcggtgatcggcaccggcatcttcgtgctaaccgccgaggccgcacagaaggccgggccgggcatgatgatctcgttcgtcatcgccgggttcgtctgcgcggtggcggcgctctgctatgccgaaatggcggcgatggtgccggtctccggctccgcctacacctatagctacgccgtgatgggcgagctggtcgcctggatggtcggctgggcgctgatcctcgaatatgcgatcgcggcgggggccgtgtcggtcggctggtccggctatatgatggggttcatccagaacaatttcggcatcgtcgtgccgctgcagctgatccgaggaccgttcgacggcggcatgatcaacctgccggccatggcagtcgccgcggtcgtcaccgcgctgctggtgaagggcaccaaggaaagcgccacggtcaacgccgtgctggtcggcatcaagatcctcgccctggcgatgttcgtgatcgtgaccatcccggtgctcaagaccggccagttcacgccgttcgcgccgctcggctttgccggcatctcgggtgcggccgcctcgatcttcttcgcctatgtcggcttcgacgcggtctcgaccgccgccgaggagaccaagaacccgcagcgcaacatgccgatcggcctgatcggcagcctcgcgatctgcaccatcttctacatgctggtcgcctcgggcgtgatcggcaccgtcggcgcgcagccggtccatggcccggcgggtgaggtgctgtcgcccggcacgccggcgctgtcgcaggcctgcgcggcgatgtccgaacaggccgtggtctgctcgaaggaagcgctggcctggacgctgcgctcgatcggccatccgttcctcggctggctcgtcggcgccgcggcgatcatcgcgctgccctcggtcatcctgatgatgatgttcggccagacccgcatcttcttcgtgatgagccgcgacggcctgctgccggccttcttctcgcgggtccacccgaagttccacacgccgcacgtcatcaccatcctgaccggcatcttcgtgtcgctgttcgccgccttcttcccggtgggcctgctggcggacgtgtcgaactcgggcacgctgttcgccttcgccgcggtgtcgatcgcggtgatcgtgctgcgcaagaccgatccgacgcgccaccgcccgttccgcacccccgcgatcatggtgacggcaccgatcgcgatcgcgggctgcgtctatctgttcttcagcctctccggcccgacgatcgccttgttcttcggctgggctgcgatcggcctggtggtctattacggctatagccgctcgcgcagccatgtcggccgc

SEQ ID NO: 41708 - DNA, 954 bp, SPHINGOMONAS
tatgacgtggtcgcgatcggcaacgccatcgtcgacattctcgcccaggccgacgacgccttcatcgaatcgatcggcgtgcccaagggttcgatgcagctgatgttttcgcccgaagaggccgatgcgctctacgccaagatgggcccgggtcgcgaggtctccggcggctcggcggcgaacaccgtggcgggcatcgccgcgctcggcggcacggcggcgttcatcggccaggttgcggacgaccagctcggcaccgtcttcgcgcacgacatccgcgccgccggcgtgcatttcgacaccgcggtccgccccggccagccgaccaccgcgcgctgcctcatcttcgtgacgccggacggccagcgcacgatgaacaccttcctcggcgcctcgcagttcctgcctgccgccgcgctcgacgagcagctgatcgccaatggcgcgatcctctatctcgaaggctatctgtgggatccggaagagccgcgcgccgcgatgcgcaaggcgatcgagatcgcccgtgccgccggccgcaaggtcgccttcactctgtccgacgtgttctgcatctcgcgccacggcgatgatttccgcaagctgatcgcggacggcctgatcgacatcctgttcgccaacgaggccgaactgctcgctttgtgcgcgcatgaggatttcgaagcggcggtccagcacatccatggcaaggtgccgctactcgtcgtcacccgcagcgagaagggtgcgatcgccctccagggcgacgagcgggtggaagtctccgccgagccgatcgcggcgctggtcgacaccaccggtgcgggcgacatgttcgccgccggcttcctgcacggccaggcccagggcaaggggctggaggagtcgctccgcctcggcgcgatctgcgcggcggagatcatccagcattatggcgcccgcgccgagaaggatctg

SEQ ID NO: 41709 - DNA, 1858 bp, SPHINGOMONAS
ccaatttttagggtctcaatgtctatttcgaatctaccgacgcgcctcgccgaggcgctggaacagcgtggctattccacgctgacccccgttcagtccgccgtcctggaagaccaggccgcgggccgcgacctcatcgtttccgcccaaacaggctcgggcaaaacggtcgccttcggccttgccatggcgccggagctgctcgccggcgaagagatgctgccgcccgccggcgcgccgctcgccctgatcatcgcgccgacgcgtgagctggcgctgcaggtcagccgtgagctgatctggctctacagcccggccggcgcgcgcatcgccacctgcgtcggcggcatggacgcctccaaggagcgtcgcacgctcaaccacggcgcccatatcgtcgtcggcacgccgggccgccttcgcgaccatctcgagcgcggtgcgctcgacctgtccagcctgcgcgtcgcggtgctcgacgaggccgacgagatgctcgacatgggcttccgcgaggagctcgaggcgatcctcgacgcgacgcccgaaggccgccgcaccctgctcttctcggcgacgatgccgcgcccgatcgtcgcgctggccaagcgctaccagcgcaacgccttccagatcaccaccaagagcgacgatcgcggccacggcgatatcagctaccaggcggtgacggtcgcgccggccgatatcgagcatgtcgtgatcaacctgctgcgcctgcacgaggcggagacggcgatcctgttctgcgcgacgcgcgacaatgtccgccatctccatgccagcctgatggagcgcggcttcgcggccgtggcgctgtccggcgagcattcgcagtccgagcgcaaccatgcgctgcaggcgctgcgcgatcgccgcgcccgcgtctgcgtcgccaccgacgtggcggcacgcggcatcgacctgccgacgctgacgctggtcgtccatgtcgaactgccgcgcgatgccgagacgctccagcaccgttcgggccgtaccggccgcgcgggcaagaagggcaccgcggtcctcatcgtcccctatccgcgtcgtcgccgcgtcgagcagatgctgcacggcgcgcgcattccggcggtgtggatcgatgcgccgacgcccgagcagattcgcgcggccgatcgcgagcgcctgatcgccgcgctgctccagccgatcgagaccgacgaggaagacgtggccctcgccgagcgcctgctcgccgagaagacgccggccgagatcgccgccgcactggttcgcgcgcaccgctcgcagctgcccgagcccgaggaactgatcgaggcgacccccgaggcgcgccgcgccgcgcagcaggagcggcaccgccccggtttcgacgacacggtgtggttccgcatggatatcggacgtcgccagaatgccgacccgcgctggatcctgccgctgatctgccgccgcgggcacatcacccgcaacgaagtcggcgcgatccgcatcgcggcgaacgagacgcacttccagattccgtcgcagctcgcggcgaagttcgcggcagcggtcgacaagttcgcgcgcacggccggcgatgacgatgacggcatccgcatcgagcgcgcgaccgaagcgccgcagccgggcgcgcgtgccgatggtccgacgcgtcgcggtcctccgaaccgcagcaacgccaacggcaagcccggcggcttccgcaagggcccgccgcgccgctgaggattggggtgctccccttcctgaggtggaaggggagcggcttgctctactttaaagctgtcatcccggcgaaagccgggatccattcgccactgcgccaaagcaaaagccgcatcggcgc

SEQ ID NO: 41710 - DNA, 2569 bp, SPHINGOMONAS
actccgatgatggcccagtatctcgcgctcaaggaagaggcgggggattgcctgctgttctaccgcatgggcgactttttcgagctgttcttcgacgatgcgaagatcgcgagcagcgtgctggatatcgcgctcacctcgcgcggcgagcatgagggcgacaagatcccgatgtgcggcgtgccggtgcacgcgatggaggcctatctcgcccggctgatcaaggcgggccaccgcgtcgcgatcgccaaccagaccgagacgcccgaggaagcgaagaagcgcgccggatcgaaggcgctggtggcgcgcgcgatcgtccgcgtcgtcaccgccggcacgctgaccgaggaggcgctgctcgacagccgcaccgccaactggtgcgtggcggtgggcgaggccgggggcggcgtcgcgatcgcctgcgccgatatttccaccggccggttcgagctgatcgaaaccgatgccgcgcggctggaggccgaactcgcccgcctcaatcccgccgagacgatcgcctgcgacgccaccgagttcgccgaactgacgaccgcactccgccccaaagtcgatttcgacagcgccggcggcgaggcgcggctgaagcggctgttcggcgtggcgacgctggacggcttcggccagttttcgcgcgcggggctcgccgcggcgggcgggctggtcgcctatctggagcataccgccaagggctcgctgccgttccttcgcccgccacgggtcagccgcgcagaggcggcgatggcgatcgacgcggcgacgcgcgagagcctggagcttaccgtcagcgccgccggcgcccgcaagggcagcctgctcgacgccgtcgaccgcacggtcaccggcgccggcgcgcggctgctcggcgccgatatcgccgccccgctgatggaccgcgccgcgatcgacgcgcggctcgacctcgtcaccctgttccacgacgatgcgggcctgcgcgacggcatccgtgcgacgctgcgcgcgctgcccgatatcggccgcgccctcggccgcctcgccgccggacgcggctccccccgcgacctcggccagctccgcgacggcctggacggcgcctggcggctgggcgcgcggatcgatcgtctcaccgatgcccccgccctgctccgcgagctcgcgccgcagctgcgcggccacggcgcgctgatcgacctgctcacccgcgcgctggtgcccgaacccccggtcgacgcccgcgcatggcggctatatcgccgaaggctacgatgccgcgctcgacgatctgcgcgatgccggcgccggcggccgccgggcgatcgccgcgctggagggcgaataccgcacccgcaccggcatcaccgcgctcaagatccgccacaacggcgtgctcggctatcacatcgaagtgcccgcgcgctcggccgatgcgctgatgaagcccgacagcggcttcacccatcgccagacgctggccggcgtcgtccgcttcaacgcgcccgagctgcacgacgtggccgtgaaggtgacccaggccggcgcccacgccctttccgccgaagccgcgcatctggaggacctgaccgcgcaggcgctcgcccgccgcgagcccgtcgccgccacggcggatgcgctcgcccggatcgacgtcgccgccggcctggccgaacgcgccgccgagggcggctgggcgcggcccgaactggtcgagcatcgctgcttcgagatcgagggcgggcggcacccggtggtggaggccgcggtggcgcgcgccgtcggccggttcgtggcgaaccagtgccggctgtccgaggactcgcacctgtggctggtcaccggcccgaacatgggcggcaagtccaccttcatgctccataacccgctgatcgcggtgctggcccaggccggcagctacgtgccccccacgcgcccaacgctggggctggtcgaccggctgttcagccgcgtcggcgcctcggacaatctggcgcgcggccgctccaccttcatggtcgagatggtcgagaccgccgcgatcctggcgcaggcgaccccgcgcagcttcgtgatcctcgacgaggtcggccgcggtacctccacctatgacgggctcgccatcgcctgggcggtggtggaggcgatccacgaggacaatcgctgccgctgcctgttcgcgacgcactatcacgaactgacgaggctggccgagcgctgcgacgcgctcaccctccaccatgtccgcgcccgcgaatggaagggcgatctggtgctgctgcacgaactggccgacggcccggcggatcgcagctacggcatcgccgtcgcccgcctcgccggcatgtcgcccgccacggtcaagcgcgccaaggcggtgctcgacaagctggaagccggccgcgccaagaccggcgggctggcggcaggcctggacgacctgcccctgttcgccgccgccgtgcaggccgaggaagagaaggtcgacgcgctgcggcaggaactggaatcgattgatgtcgacgcgctcagcccccgcgacgcgctggacgtactctaccgcctgaagggg

SEQ ID NO: 41711 - DNA, 684 bp, SPHINGOMONAS
atgcccacgctcgtcctgatccgccacggccagtcggcctggaacctggaaaatcgcttcaccggctggtgggacgtcgacctgaccgagcagggcgtgcgcgaagcgaccgccgccggcacgctgatgaaggagaagggcctcgacttcgacctcgccttcaccagcttccagagccgcgcgatcaagacgctgcacctggcgctggaggcgatggaccggctgtggctgccggaagagaaggactggcgcctcaacgagcgccattatggcggcctgaccggcctcgacaaggcggagacggcggccaagcacggtgacgaacaggtgaagatctggcgccgcagcttcgacgtgccgccgccgctccccgaggcgggctcgccctgggacctgacccaggacccgcgctatgccggcatcccgatcccgcagaccgagagcctgaaggacacgatcgcgcgcgtgctgccctattgggaacagcgcatcgcccccgagctgaaggccggcaagcgcgtgctgatcgccgcccacggcaattcgctgcgcgcgctggtcaagcacctgtccggcatcgccgacgaggatatcgtcagcctggaaatcccgaccggccagccgatcgtgtaccagctcgacgacgagctgaaggaaatcgagcgctattatctgagcgagcgg

SEQ ID NO: 41712 - DNA, 1785 bp, SPHINGOMONAS
tatccggtcgaggtcgatcatgcgcgcgacgcgctgctcaccgatttcggcaaggagacgctgaaggaccgctatctcctccccggcgaaagctatcaggacctgttcgtccgcgtcgcctcggcctatgccgacgaccaggcgcacgcccagcgcctgtacgactatatctccaagctgtggttcatgccggccaccccggtgctgtcgaacggcggcacgggccgcggcctgccgatcagctgctatctcaactcggtgccggacagcctggacggcatcgtccagacctggaacgagaatgtctggctcgcctcgcgcggcggcggcatcggcacctattggggcagcgtgcgcggcatcggcgagccggtgggcctcaacggcaagaccagcggcatcatcccgttcgtccgcgtgatggattcgctgacgctggcgatctcgcaagggtcgctgcgccgcggctcggccgcctgctatctcgacatctcgcaccccgagatcgaggagttcctcgagatccgcaagccctcgggcgacttcaaccgcaaggcgctgaacctgcaccacggcgtgctgatccccgacgcgttcatggaagcggtgcgcgacggccgcgaatggcagctgaagagccccaaggacggctcggtccgcgccacggtcgatgcccgcgcgctgttccagaagctggtcgagacccgcctcgccaccggcgagccctacatcgtgttctcggaccacgtgaactcgaccatgccgaagcaccaccgcgatctgggcctcaaggtctcgacctcgaacctgtgctcggaaatcacgctgcccaccggccgtgaccatctcggcaatgatcgtaccgcggtgtgctgcctgtcctcgctcaacctcgagacctgggacgagtggaacaaggacaagctgttcatcgaggacgtgatgcgcttcctcgacaatgtgctgaccgactatatcgagcgagcgcccgacgagatggcccgtgcccgctattcggcggcgcgcgagcgctcggtcggcctcggcgtgatgggcttccactcgttcctccaggcgcgcggcattccgttcgagggcgcgatggcgaagagctggaacctgcgcatcttcaagcatgtcagcgcacaggtgaacgaagcctcgatggcgctggcggtcgagcgcgggccctgccccgacgccgccgacatgggcgtgatggagcgcttcagctgcaagatggcgatcgcgccgaccgcgtcgatctcgatcatctgcggcggcaccagcgcctgcatcgagccgatcccggcgaacatctacacccacaagacgctcagcggctccttctcggtgcgcaatccgtatctggagaagctgctcaaggagaagtcgaaaaattccgacgcggtgtggaattcgatcctcgaacagggcggctcggtccagcatctcgacttcctgaccccggaagagaaggacacgtacaagaccagcttcgagatcgaccagcgctggatcctggagctggcgggcgatcgcgcgccgttcatcgaccaggcgcagtcgctcaacctgttcatcccggcggacgtggagaagtgggatctgctgatgctccacttccgcgcctgggagctgggcatcaagtcgctctactatctgcggtcgaagtcggtgcagcgcgccgggttcgccggcggggtcgaggccgacaacacgatcgagaagcccaagttcgatcttggcgagagcaccgattacgacgagtgcctggcctgccag

SEQ ID NO: 41713 - DNA, 969 bp, SPHINGOMONAS
atgtcgcttctcgaagcccgcaagacctacaagcccttcgaatatccctgggcctatgaatattggaagcgccagcagcaggtccactggctgccggaagaagtgcccttgggcgaggattgccgcgactgggcgcagaagctgtcggatcacgagcgcaacctgctcacccagatcttccgcttcttcacccaggccgatgtggaagtgcaggattgctaccacgagaaatacggccgggtgttcaagccgaccgaggtgaagatgatgctcaccgccttctccaacatggagacggtgcacatcgcggcgtacagccacctgctcgacacgatcggcatgcccgagaccgagtattcggccttcctccagtacaaggagatgaaggacaagcatgattacctcagcaccttcggcgtcgacagcgacgaggatatcgccaagacgctggcgatgttcggcggcttcaccgaggggctgcagctgttcgccagcttcgcgatgctgatgaacttcccgcgcttcaacaagatgaagggcatgggccagatcgtcacctggtcgatccgcgacgagagcctgcactgcgaaggcatcatcaagctgttccacaccttctgcaaggaacggaactgcatgacgccgagcgtgcgcgacgacattctggacatgtgccagaagaccgtgcgcatcgaggacgcgttcatcgacctggtgttcgaaatgggcccggtgaacggcatgacgccgaaggacatcaagaaatatgtccgcttcatcgccgactggcgcctcggccagctgggcctgaagccgatctacatgatcgacgagcatcccctgccctggctcgccccgctgctcaacggcgtcgagcacgccaacttcttcgagacgcgggcaaccgaatattccaaggcggcgacgcgcggcaactggaacgaggtgtgggacagcttcgacaagcgt

SEQ ID NO: 41714 - DNA, 543 bp, SPHINGOMONAS
gctgctcatcatcctgggctgcctggccgcgatccgcggccgcgtggcagccgctccccagaccgaggccggcgcatgacccagatccgtttcgcgagcccgcacgacgttccccagatcctcgcctttgtccgtgaactcgccgacttcgagcgcgagcccgacgccgtggtcgcgaccgaggcgatgctggaggccgcgctgttcggcccgcgccccgccgccgaagcggtgatcgcggaggggccggacggcacggcgcagggcttcgcgctgttcttccagaatttctccacctggaccgggctgcccggcatgtatctggaagacctgtatgtcacgcccgccgcgcgcggtgcgggcgtgggcaaggcacttctccgccatttggccgatatcgcggtgacgcgcggctatggcaggttcgaatggtcggtgctcgactggaaccagtcggcgatcgatttctatcgcgcgatgggggccgtgggcatggaggaatggacggtgcagcgggtgaccggcgacgcgctgcgcgccctg

SEQ ID NO: 41715 - DNA, 1320 bp, SPHINGOMONAS
agaaaatatttcggcaccgacggcattcgcggcgcgaccaacctctccccgatgaccgcggcgatggcgatgaaggtaggcatggccgccggcgcgcatttccgccgcggcgaccaccgccaccgcgtggtgatcggcaaggacacgcggctttccggctacatgctggaaaacgcgatggtcgcgggcttcaccagcgtcggcatggacgtggtactggtggggccgatgccgaccccggcggtggcgatgctcacccattcgatgcgcgccgatctgggcgtgatgatctcggccagccacaacccctatttcgacaatggcatcaagctgttcgggccggacgggttcaagctctccgatgccgatgaggaagcgatcgaggcgctgatcgatggcgacgtggctttggcgccctcggccgcgatcggacgggcccgccgcgtcgaggatgcccgcggccgctatatccacttcgccaaatcgaccttcccgtccgagctgacgctcgacggcctgaaggtcgtggtcgattgcgccaatggtgccgcctatcaggtcgccccctcggcgctgtgggagctgggcgcggaggtcgtctcgatcggcgtctcccccaacggcaagaacatcaacgacggcgtcggctcgacggcgccgcaggtgctgagcgagacggtggtcggctccggcgcggcgctgggcatcgcgctggacggcgatgccgaccggctgatcgtggtcgacgagaccggcacggtgatcgacggcgaccagctgatggcgctgatcgccaccggctgggcgcggcagggcaagctcgccggcggcgggctggtcgccaccgtgatgtccaatctcgggctggagcggcaccttgccgcacagggcctcgggctggtgcgcaccaaggtgggtgaccgctatgtgctcgagaagatgcgcggctccggctacaatgtcggcggcgagcagagcgggcacatcatcctttccgactatgcgaccaccggcgacgggctggtcgcggcgctgcaggtgctggccgagatcgtccgggcaggggccccggcgagcgaggtgctgcaccgtttcgagccgctgccgcagctgctcaagaatgtccgcttcgccggcggcaagccgctggaggacgcgcgcgtcaaggacgtgatcgccgccgccgaggccgagctgaagggccgcggccgtctggtcatccgcgcctcgggcaccgagccggtgatccgggtgatggccgagggcgacgacagggcacaggtggaagtggtggtcgaccgcatctgcgacgccgtgcgc

SEQ ID NO: 41716 - DNA, 1473 bp, SPHINGOMONAS
tggacgccgatccaagccctccccacccccaagctcaccgatctgttcgcggccgatgccgatcggctgtcgcggctgagcgccgatgtcgccggcatccatttcgactggtccaagacgcacctgaccccagaggccgtcgccgccttcgccgcgctggcgcagcagatggacttcgccgccaagcgcgacgcgctgttcgcgggcgaggtggtcaacgtgaccgagggccgcgccgccgagcataccgccgagcgctatgagggcgcgcccgagagcgtcgcccgcgcccgcagccagcatgcgcggatgcgcgggctgatcgatgcgatcgaggccgaggcgctggggccgatccgccacatcctccatatcggcatcggcggctccgcgctggggccggacctgctggtcgacgcgctgggccgcgacatggaccgctatgacgtggcgatcgtctccaatgtcgacggcgtggcgctggaaaacgcgatggacgtgttcgatccgcaggcgacgctgttggtgatcgccagcaagaccttcaccaccaccgagacgatgctcaacgcccggagcgcgctcgcctggatggccgagggcggcgtcgaggatccctatggccaggtgatcgcgctgacggcctcgccggagaaggccatggaatggggcgtcgacgagacgcgcgtgctgcccttcttcgagagcgtcggcgggcgttattcgctgtggtcgtcgatcggcttcccggcggcgctggcgctcggctgggacgcgttcgaggaactgctggaaggcgcggccgagatggaccgccacttccgcctgaccgatctggcgcagaacgcgcccgcgctcgcggcgttcgcggacctttattacacccaggcgcgcggctgcgagacccgcgccaccttcgcctatgacgaacggctgaagctgctgccgagctatctccagcagctggagatggaatccaacggcaagcgcgtcaccgccgagggcgagatcgtgacctacccgacttcggcgatcacctggggcggtgtcggcaccgatgcgcagcatgcggtgttccagctgctccaccagggcacgcacctggtgccggtcgagttcgtcggggtgatcgaggccggcgatgcgctcgcgcccgagcatcaccgccagctgctgctcaacatgttcgcgcaaggcgcggcgctgatggcgggcaaggggcatgaagacccggctcgcgcctatccgggcgaccggccgtcttcgacgctgctgctcgacagcctcgatccgcgcacgctgggcgcgctgatcgccttttacgagcaccgcgtgttcgtgaacgcggtgctgctcggcatcaatccgttcgaccagttcggtgtcgagctgggcaaggaaatggccaaggcggcggacaggggcgggctcgatttcgacccctcgaccaacgacctgatccagcgggcgttc

SEQ ID NO: 41717 - DNA, 2121 bp, SPHINGOMONAS
ccgcccgcgttgctgaaggtactccccgacagcgtcaggtccccggcattggtacggatcaggccgccgtcattgtcgatcgcaccgctggcgacgatcgacagcgcccccgtgccggtcaccgtgatcgagccgccgcggttccgcagagctccgatggtcgtcgacagggttgccgccgagatccccccgccggaagtgtcgagcaagcccgcggcaacggtgagaccgttcctggcgacgaaactcccgttgagcgtaccggtggcggacagcgcgagatcggtgccgctgatctgcgcgcccatgagatcgccggcagtcgcggtcgcggtgatcgcttgcccggtcagccgcccgccctgccccagcccgattgtgctcccggtcaccgtggcgtcgccggtcgccgccagcgtcgccccgaccgccgagaccgcgccgcggctggcgatccgcagcatgttggcatcgccggccgccgtaaagtcgccggcgaggaggcgcccaccgtcggcgttcacgcggtcggcatcgatcgagagaccgcccaggcccgccagggtgccgccggcggatccgatcgcgccgcccgtcaccgtcatcctgccgcccgcaacgatgctaccgccattcgccaatgccccggcaacggtcagggcggcgtctccggccgccgtgatcgtgcccgcattgctggcgttggtcgccgccaaggcgagcgtgccgtcggtctgaagggtggccgcattcgagaaggttccggccttcaggcgcaacacgccgcggccatgatggcttagcgtacccccgccggttgcgacgaagctgccggccgcgatggtcagatcggccgcgttggcttgcagatcgccgcccgaaaggtcgaaggtcccggcaagcgacaagttcagcggcccggtgtctgcgacccagagcttggcgcccgaggtcaccgccagattgccggcatcgagcgccagtcctgccacctgcaggctggccgcgccgtccagtcgcagggagccggcagcgatcgtcgccacgccgggcgtcgagagttgcgcgcccgcgctggcaacgaagctgccggtcgctcccagtttcagcgtgccgccgctgatcgcgccccccgccagggcaaagtcacctgccgtcgccgccagatcgagcgtccccgccgccgtgacggtcccgcccgacacggcggcggactgcgcatgcacccaaaggtcgccattgccgcccagggtgccggcgcccgtccaggcgccggccacggcgactcgcatcgtgtcggtaccggtcgcgacgatcttgccgtcgttcaccagcgcgccgaccgtcgccagcacgccatggccggtgatggtgccgctgttggcgagcgtgccgtccatggtgagcgtcagtgcacccggcgtggagatatccccggcgttgaccagcgattgcgccgcgagggtcaggccgccatggccggcgatcaccccgcccccatcgttgctggccgcaccgcgcaccacgaaatcgagcgatcccgtcgcggcgccgatcgtgccggttccgttggcaagcacgcccgcagatacctccagcgcccccgcatccgcctgaatcgtgccgccattggcaagcaccccgccgatcgacagtcggctatcgccccccgttcccagcgcacggatcgcgccggcggtgttgaccaagctgcccgcgctggcgacgaaccgcccgttcgagccgatcatgccgccaccgttggacagcgcggcgctggcggcgaccgtcaggacaccggcgccggaatgtacgatcgtgccgccattgttgttcaagctgccgctggacagcgtcaggtcggcggcattggtctcgatcctgccgccgccattctcgatgtcgccggtggcgcggacatcgaagggaccggcaccgaggacgtggatcgcaccgccgacattgttcagcccccccagcgtcgcggtgagcccctgcgcggaaaggacggcgttcgacgtgtcgagcaggccggccccaaccacgatgttcccgctggcgagcaggttcgcttgcagcataccgacgacatgcagagcgagggctccgccgtcgatctgc

SEQ ID NO: 41718 - DNA, 2466 bp, SPHINGOMONAS
gcgccggagacggtgccgccggtgatcgagaacgcgccgcctgtcgcctgggcgcgcagcatgcccgccgcgctgagcgttcccccggccgagcgaatcgcatcgcctttcagcgacacgtcgccattcccgccgagcgtcccgctattggcgagaaggccggtcacggacacggcaagcgcgtcggtgccgagcgcgacgatctgcccgctattgctcagcgcctcgctgccgatcgtgacgccctgttccccggagaccaggccgctattgaccagcgcgccggtgctggtgacggtggtcgccaggccggacagtgtcccggcgttgttcagtgtgcccgccgccacggaaacggcaccgttggcgacgatctgtccggtggcgcgattgtcgagcgcgccgtcgatgacgagggaaacggcgcctgcaccggcgttttcgatcccgccgctgttgctgagcatgccggcgtgcagcagcagatcgccaccgttgacctgcagggtgccgctattggccagcgtgccggtaaggctgaccgcacccgatcgcgcccccagcagcgtgccgccgaaattggaaagggtcgcggcggaaagcgagaagctccccgacgagagcatcgccagatcggtcacgatcgcatgcgcagccgtgagttcgacgcggtcggcgaccagggtggcgccgccgaggccgagaccgcctcccgtcgctgccaaggccagccccgtgccgaagctgaactgtgccccaccggcatcgatttccgccgcccgcagcgtgcctgcgctggcgccgacgacgacggcctcccggaggtccaccgcacccgtcgctacgatcgcgaccgcgccatcgctcgacagaaactgccccccccgcgccgacagatcgccggcagagagcgagagcgggcctgccgcttgaaagagacccgactccgtcgcaatcgcctctcccgaaacggacagcgcgccgccggccaagatcgagcctttggctcccgagagcgcgccactggtcgtgacatccaggtcgccagcggcactgacgatgccgcctgcgttgacaaggctgccggcggcgaggcgcaggctgccattggtcgcgatcgtgccgtcgatgttggacacggtgcccgtgacatcgagaaggaattctccgctgccactatggagaatcttcccgccatcgaccgagaggtctgcagcgcgaatggtgaagtggtccgcagcggaacggagcgttgcgcccgcataatcgagcgtgccggcgctgctgagggtgacgtcacccgtgccgatctgctcgatcgcagcgccgttcaggcggatcgttcccgcatcgaagcgaaaggcgcccgccgccagcgtggccgccgcgagcgaaaggtcgcctgcctgccatgtaccctgcccctcgatccggaagctggagccgtcgccgatcaggtcgccggccatgaactgggcatcccccgcggcctggatcgacgctccgccgtccagccgcagcacccccgccgcaccgacgctgagcggcccgcccgcgatcagccgcgattgcgtgccacccatgtcgatggagcctgcatcgatctggaccaatccattgccaccgatcgtgcccgatcgcccgtcaagcacggcaccgatgcggagcgtcagcgcctgactgccggtctgcgtgatggtcccgccagcgctgttgtccagcgtatcggcggtcagcgacagtccccgcgcgctctgcaacaggccacgcgcgttagtgaccgccgcgcccgtcaccgccagactaccgcccgccgcaatggtgccctgactgttgtcgagcaagccgccggcgatcacgctcaccgcacctgcgccggtcatcgtcccgccatggttggcgacggcaccgccccggacggaaagcgcaccgttggtgacaatccgcccggcgctcccattgtcgagcgactgctctcccgcgagcgacaaggtgccggatccggcgtgcgcgatgacgccgccctgattgatcagcgtcgacgtggagagcgccgcgttggcgccgttgagggcgatggtgccgccgatattcgagagctggtccgacacggtgatggccgaatcgccgcccccgacgagcgagaccaacccgccgtcattctcccaataggtcgccgtcgcgttcaaggtgccggcggtgagctggcccttgcgcgtgtcgatggtggcggctgcgaggtgggcacgcccccctgccgccaacgtgccccccgcgctcgcatcgatgatcgtgccggcactgaccgtgacgtcgtcgccccccgcgatgctgccaccaccggccaggctgaccccctgcgcgaccgtagccgccatcgtgcccccggcgacaatctgcccgcctgcgctgaccgcaacgctggtcgctcggagcgacacatcgccattcccgccgaggatgcca

SEQ ID NO: 41719 - DNA, 783 bp, SPHINGOMONAS
atggcattgctcgatcgcatctggctggtcggggccggcaatatgggcggggcgatgctccgtcgctgggctggcgccgggatcgacgcgtccgcgatcaccgtcatcgatccgggcagcccggcgattccggaaggtgtgcggcatgtgaccgcgccgccggagggcgagcggcccacggcggtcgtgctcgcggtgaagcctcagcaactccatagcgtcgcgccggtgctcgctccggcggtggcaggcgtgccgctgctcgtttcgatcctagcgggcgtggaagtcgcgacgctcgcgcaggcgctgggcgcgaagaccgtggtgcgcgccatgcccaatctgccggtcgcgatcggcaagggcgtcgtcggtcttaccacgccgagcgacgatgccgcagcgcgggctgccgccgagacgctgatgcggccgctcggactggtcgaatgggtgccgagcgaaaccatgctcgacgcgttgaccgcccttgcaggctgcggccccggtttcgtgttccgcttcgtcgacgcgctggccgaagccggcgcggcgctgggtctgccggccgatcaggcacagcggctggcactcgccacggtcgaaggctccggcctgatggcggcggcggcgagcgagagccctgcggtgctcgctgatcgcgtcgccagcccgggcggctcgacgcgcgaggggctgaatgtgctcgatcgcgacgacgcgctgaaggcgctgctgggcgagacgctggccgcctcggcgcggcgcaatgccgaaatg

SEQ ID NO: 41720 - DNA, 1875 bp, SPHINGOMONAS
aagacgccgctgctcgacacggtcgacacgccgcaggacctccggaagctcgcccccgcccagctgcgccagctggccgacgagcttcgcgccgaaaccatcagtgcggtgggctccaccggcggacatctcggctccggcctcggcgtcgtcgagctgacggtggcgatccattatgtgttcaacacccccgacgaccggctgatctgggacgtcgggcatcaatgctacccgcacaagatcctgaccggccggcggaatcgcatccgcacgatccgccagggcggcggcctttccggcttcaccaagcgcagcgagagcgaattcgacccgttcggcgcggcccactcgtcgacctcgatctcggcggcgctgggattcgcgacggcgaacaagctgaagggcgcgccgggcaaggcgatcgcggtgatcggcgacggcgcgatgagcgcgggcatggcctatgaggcgatgaacaacgccgaagccgccggcaatcgcctgatcgtgatcctcaacgacaacgacatgtcgatcgcgccgccggtgggcgggctttcggcctatctggcgcggctgatctcgtcgtccgaatatctcggcctgcgtagcctcgcccgccgggtaacgcagaaggtctcgcgccgcctcaccgccgccgccggcaaggcggaggaattcgcgcgcggcatggcgaccggcggcacgctgttcgaggagctgggcttctattatgtcggcccgatcgacggccacaatctcgagcatctgatcccggtgctggagaatgtccgcgacgccgagcagggcccgatcctcgtccatgtcgtgaccaagaagggcaagggctatgcccccgccgaaaaggcggcggacaaatatcacggcgtccagaagttcgacgtgatcaccggcgcgcaggccaaggcgcccccgggcccgccggcctataccaaggtcttcgccgacgcgctgctcgccgaggcggagcgcgacgccaccgtctgcgcgatcaccgcggcgatgccctcgggcacggggctcgacaagttccaggcgatgttcccggagcgcaccttcgacgtgggcatcgccgagcagcacgccgtcaccttcgcggccggcctcgccgcgcaggggatgcggccgttctgcgcgatctactcgaccttcctgcagcgcgcctatgaccaggtggtgcacgacgttgcgatccagaacctgccggtccgcttcgcgatcgaccgcgccgggctggtcggcgccgacggcgcgacgcatgccggcagcttcgacgtgacctatctcgccagcctgcccaatttcgtggtgatggcggcggcggacgaggtcgagctcgtccacatgacccacaccgccgcgctgcacgacagcggcccgatcgcgctgcgctatccgcgcggcaacggcatcggactggaactgcccaaggttccggagcggctggagatcggcaagggccgcgtggtgcgcgagggcaaagaggtcgcgatcctatcgctcgggacccgcctctgcgaggcgctcaaggccggcgacacgctcgaggccaagggcctatcgaccacggtcggccgatcttgggctttggccagccggttggacagggatctgatccgccgcctgctcaccacccacgaagtggcggtgacgatcgaggaaggcgccatcggcggcctcggcgcgcatgtgctgacgctcgccagcgacaccgggctgatcgacgccggcctcaagctgcgcacgatgcgcctgccggacatgttccaggaccaggacaagcccgagaagcagtatgacgaagccggcctcaacgccgcgcatatcgtcgacacggtgctgaaggcgctgcgc

SEQ ID NO: 41721 - DNA, 456 bp, SPHINGOMONAS
ctcgcccgcgccgacaacggcgtgatcggccgtgacgggcagctgccctggcggctgccggccgatctcaagcggttcaaggcgcagacgatgggccgcccgatgatcatgggccgcaagaccttcgagtccttccccgcccccctgctcggccgccgccacatcgtgctgacccgcgacaccgcttggtccgcctcgggcgccgaaatcgcgcacagcgtcgaggaagccctggcactggccggcgaggatgccgcggtgatcggcggggccgagatcttcgcactgttcctcgatcgtgccacccgcatcgagctgaccgaggtgcatctcgatgccgaaggcgacgccagcgtgcccgctttcgatccggcccgctggcgcgagacggcccgcgaggcgtaccctgccgagggtgaacgcccggcctatgccttcgtgacactcgagcgccgg

SEQ ID NO: 41722 - DNA, 1932 bp, SPHINGOMONAS
ccctggggcgtggacctgaccacgatggaccgcagcgtgaagccggggaacgacttctacgcctatgctctcggcagctggctgcgcgacgcacccttcccgcccgacaaagcgcgcatcggctacaattacgacctgcccgaccagaccgaactcgaggtccgggaactgatcgaaggcgccggcagcgcaccggacgatcccgtgctgcgccaggtatcgaccttctaccgcgcctatatggacgaggccggcatcgaggcgcgcggcaccgcaccgctcaagccctatctcgcccgcatcgacgccgtgcaggaccgccgcgcgctcgaactgctgatggccgaccatggctatgccagcccgatcggcatcggcatctcggccgacgagaaggacccgacccgctacaccgtgatggccggccaggcggggctgggcctgcccagccgcgactattacctgctgccgggcgcgaagtacgagacgatccgcaaggcataccgcgcctatatcgtgaagatccagcagctggccggcatcgccgacgcagaggccaaggccgacgcgatcctcgcgctggaaaccagcctcgccaaggaccagtggacgcccgaggcgcgccgcgatccccagaagacctacaacccgatgaaccgcgcgcagctcgccaaacttgcgcccgaattcgactggaacgccgtgctcgcccatcagggcctgggcaagatgccgaccgtcgtggtgcgcgagacgaccgccgtcaccgccgccgccaagcggctgggcgacgtgccgctcgccacctggaaggactggctgcgcttccgcttcgtcagcgaccatgcaagcctgctgcccaaggcgttcgacgcggcccgcttcgacttttacagccgcaccctgcaggacgtgcagcagcagtccgaacgctggaagcgcggcgtgcggatggtcaacggtgcgctcggcgaggcgatcgggaaggtctatgcggagcgccactggggcaaggatgccgaggcgctgtccaaggaactggtcgaggatctgcgtgccgcctatgcggacaagatcaacggcgcggcctggatggacgagcccacccgcaaggaggcgctgaagaaactcgcggcgttcgagccccggatcggccatccggacaaatatatcgattacgccgcaatgccggtcagcgccaccgatccgctggccaacgacctcgcctcggacgcgttcgagtggcagctggagctgtcgcggctcggcaagccggtcgatcgttctctctgggcgatgacgccgcagacggtgaacgcctattacgatccggtgatgaaccaggtgaccttcccggccgcccagctctccccgcccttcttcgatcccgcggccgatccggcggtgaactatggcgagaccggcgccaccatcggccacgaaatgggccatggcttcgacgacgaaggccgccagttcgacgccagcggcaagctccgcgactggtggacgccgcaatcggccgcccgctacaccgcccatgcgcaggaactggtgaagcagttcgatgcctatgagccgatccccggcacccacatcaagggccagctgacgctcggcgaaaatctcgcagacctgggcggactggaagtcgcctatgccgcctatcgccgctatgtcgcccgccacggcgagcccaaggtgctggacgggctgaccggcgaccagcgcttcttcctcgcctatgccgccagctggcagggcaaggcgcgtgagggcgcactgcgcgcgcagctgctgtcggatcctcacagccccgaacagtatcgcgtcaacgggatcgtgcggaacatggacgcctggtacaaggcgttcgacgtgaagcccggcgacgcgctgtatctcgcgccgcaagcgcgggtgcacgtctgg

SEQ ID NO: 41723 - DNA, 1182 bp, SPHINGOMONAS
ggaaccccaatgcgctccgcagtcatcgtttccaccgcccgcacgggcatcggccgggcctatcgcggggcgttcaacgccaccccggcgccgacgctgggcgcgcacgcgatccgcgccgcggtcgagcgggcaggcatcgagccgggtcaggtcgacgacgtggtgttcggcgccgcgctccagcagggcagccaggcgcccaacatcgcccgcctcgcgctgctccgcgccggcctgccggtggacgtgccgggcatgtcgatcgaccgccagtgcgcgtcgggcctgatggcgatcgcgacggcggccaagcagatcgtcgtcgacaatatggacatcaccctgggcggcggcgtggaatcgatcagcatcgtgcagaccccgcagatgcgcgtcgagcccgatcgcgagctgatcgcgctgcataacgacacgtacatgccgatgctccagaccgccgaggtggtcgccgcgcgctacggcatcggccgcgatgcgtgcgacgcctacgcgttccagtcgcagcagcgcaccgctgccgcacaggccgcgggcaagttcgatgacgagatcgtgcccgtcaccgcgacgatgaatgtcgtcaacaaggagacgaaggaggtctcgcagaaagagatcaccctcgccaaggacgagggcaatcgacccgaaacgacgctggagggcctgcaggcgctccagccggtggtgccgaacggcaccgtcactgcaggcaatgccagccagctgtcggacggctcgtcggcctgcgtgctgatggaggagaagctcgcctcgcagcgcggccttaccccgctcggccgctatgtcggcatggcggtggccggcaccaagcctgacgagatgggcatcggcccggtctatgccatccccaagctgctcgagcgcttcaacctgaagatggacgatatcggtctttgggagctcaacgaggcgttcgcggtgcaggtgctctattgccgcgacacgctgggcattcccaatgagctgctcaacgtcaacggcggcgcgatttcgatcggccatccgtacggcatgtcgggcgcgcggatgaccggccatgcgctgatcgaaggcaagcgccgcggtgccaagtacgtcgtcgtcaccatgtgcatcggcggcggcatgggcgcagcgggtctgttcgaagtcctc

SEQ ID NO: 41724 - DNA, 2973 bp, SPHINGOMONAS
aactggaaaatgccgactgccgtaccgtcacaccaccgcgaaatgatggccaagctgcaccgtgcggccgaacccgatgttctaaaaccgcttctggagcgggcgcgactcacgcctgagtcgcgcgaacgggtgatggatcacgcgctggcgctgctggcggacctgcgcgcggcgcagacccgcggctgggtgaaccagttcctccaggaatacaggctgaactcgtccgagggcgtggcgctgctcagcctcgccgaggcgttcctgcgcgtgcccgatcccgaaaccgccgacctgctgatcgccgacaagatcggcgatgccgactggaaggcgcattcgggcaagtcgaactcggtgctggtcaactcggcgacctggggcctgatgctcggccgcgcgctggtcggtgacgagaagacgggtgcacttcgccgcctgatctcgcgcgccggcgagccgttcgtccgccaggccgtgggcgccgcgatgaagcggatgggcgaggtgttcgtgatgggccgcaccatcgacgaggcgatgaagcggatgaagaagcccgagaacaagggcttcaccgcgagcttcgacatgctgggcgaggccgcgcgcaccaaggccgatgccgaacgctatttccaggcctatttcgaggcgatccgcgcggtcgggcgtgatcccaaggcgggccattcgatctcggtgaagctctccgcgctccacccgcgctacgaggtcgcgcagtacgaccgctgcgtgcccgagctgaccgacatgctggcgcagctcgcctcggaatcggcggcgcagggcatcccgctcacggtcgacgccgaggaaagcgaacggctggagatgagcctcgacatcatcgcctcggtcgcgcggcggcccgagctcaagggctggaacggcttcggcatggcggtgcaggcctatggcaagcgcgcgcgtgcggtgatcggctgggccgacgatctcggccggccgatgcatgtccgcctggtcaagggcgcctattgggatagcgagatcaagcgcacccaggtggagggcctgtccgactatccgctgttcacccgcaaggcggcgaccgacgtgtcgtacctcgcctgcgcgcgcgacatgctcgcggcgcggaacatcgtgcccgccttcgccagccacaatgcgctgaccgtcgccaccatcctcgactgggccggcgacagccgcgacttcgagttccagcgcctccacggcatgggcgaaggcctgtacgagcggctggtaaacgagcagggctatcactgccgcatctatgcgccggtgggcgggcaccgggatctgctggcgtacctcgtccgccgactgctggagaatggggcgaattccagcttcgttcaccagctcgccgacgagcagctgagcgaagccgaactgctcgccgatccggtggagaagattgcagcggtgggcggcacgcgccacccgagcattccgctgcccgtcgagctattcggcgcgtggaagaactcgggcggcatcgatctcgccgagcggacgatcctcgcggagacggcgatggcgatcgcggcaaagcccgtgcccgccgccggtgcgaccgcgccggtcgacgtgcgcgccgcgatcgaccgcgctaccgccgccttccccggctgggccgccacgccgctcgccacgcgcgccgcgacccttgagcgcctcgccgatctgctcgaagaaaaccgcatcgaactgatggcgctcgccgtcaaggaagccttcaagaccatccccgacgcactcggcgaggtccgcgaggcggccgatttctgccgttactatgcgcttcaggcccgcaccggcctcgccccgatcacccttcccgggccgacgggcgagcgcaacgaactgcgcatggaaggccgcggcgtctgggcgacgatcgccccgtggaacttcccgctggcgatcttcctcggccagaccgccgcagccttggtcgcgggtaacgccgtcgtcgccaagcccgcgccgcagacgcccgagatcgcccgcgtcgccgtgcgcctcgcgcatcaggcgggcgtgccggaggatgcgctggtgctggtgaccggcgggccggaggtgggcgccgcgctcaccgccgatccgcgcatcgccggcgtggccttcaccggatcgacgcctaccgccaagaagatcgccgcagctttgctcgaaggcgaggatcgcccgctggtcccgctgatcgccgagaccggcggcatcaacgcgatgatcgtcgattcgaccgcgctgcccgagcaggtggtggccgacgtgctcacctccgccttccgctcggccggccagcgctgctcggcactgcgcctgctgctgctgcaggaggagatcgccgagggcgtgatcgagatgctgcgcggcgcgatggagctgctgatcctcggcgaccccgccgatccgcgcaccgatatcggcccggtgatcgaccaggcggcgtacgacaagctgatggcctatcgcgacagcgccaaggcccagtggatcaagacggtgccggtgcccgccaccggcctgttcgtgccgccgacgatgatccgcatcgatcgccccgaggatctgacccgcgaatggttcgggccgatcctccacgtcgccacctggaaggcgggccagcttgccgagacggtggcgcgggtcaacgccaagggcttcggcctgacgatgggcctgcacagccgcatcgcccgctcggccgagctggtcgaggcggaagcgcgggtgggcaatctctacatcaaccgctcgatgatcggcgcggtggtgggctcgcagccgttcggcggcgagggcctgtcgggcaccggccccaaggcgggcgggccgcactatctgcaccgcttctgcgccgagcgggcggtgtcggtggacacgaccagcgcgggcggcaacgcgacgctgctcagcctggacgaagggggg

SEQ ID NO: 41725 - DNA, 1518 bp, SPHINGOMONAS
gtggcggaacggaccgtggcggacctgcgcgtggcggtacaccgcaacctgctgcgcctgccgccgaaatggttcgaggaaaaccgcccgtccgagatcgcctcgcgactcacctcggataccgcgctggtcgagcaggtggtggggtccaccgtctcgatcgcgctccggaacctgctgaccggcgtgggcggcgtgatctatctgttcgtgctggcccccaagatcgccgcctatctgatcgtcggcatgccgctcaccgtgctgccgatcgtctggctgggcgggcgggtgcgccaatattcgcgcaacagccaggaccgcgtggccgatatcggcgcgatcgcctccgaaacgctgggggcgatgcgcatcgtccaggccttcgggcaggagccccgcgagagccagcgcttccaggatgcggtggtgcgcagcttcgccgccgcgcagaagcgattcgccctgcgggcggtgatgacagcattggtcatcgggctgctgttcaccgcgatcacgctgatcatgtgggatgcggtgtcgggcgtcgccgccggccagatcaccggcggggcgatcaccgccttcgtgatcaccgccggtctcgtcaccggatcgttcggcgcgctgaccgaggtttatggcgacctgctgcgcgcctcgggccccgccacccgcctcgccgaactgctccagcaggagccggacatcgccccgcccgcccacccggtcgcgctgcccagcccggccgagggtgcgatcgcgttcgacgcggtcaccttccgctatcccacgcgccccgaagtttcggcgcttcaggatttctcgctgttcgtggcacccggcgagacggtggcggtggtcggcccctcgggcgcgggcaagtccaccctcttccagctgctccagcgcttctacgatcccgaagcgggcgagatccgcatcgacggcgtcgccatccccagggccgatcccgcggaggtgcgcgcccgcatggcgatggtgccgcaggaaacggtgatcttcgccgcctcggcgcgcgacaatctgcgctacggcaattggaacgccagcgacgacgcgatctgggccgccgccgaggccgccaatgccgccgagttcctgcgcgaattgccggacgggctcgacaccttcctcggcgaaggcggcgcgcgcctgtccggcggccagcgccagcggcttgccatcgcccgcgcgctgctccgcgactcgccgatcctgctgctggacgaggcgaccagcgcgctcgacgccgagagcgaaaagctggtgcaggatgcgctcgagcgactgatgcaaggccgcaccacgctggtgatcgcgcaccgcctagccaccgtccgcgcggcaggacggatcatcgtgatggacggcggccgcatcgtcgagaccggcacccatgccgaactggtcgcgctgggcgggctctacgcccggctggcagccctgcagttcagcgaagcggcctgatcagcgtacggcgagcatgctcgccgc

SEQ ID NO: 41726 - DNA, 1260 bp, SPHINGOMONAS
ctgcgcggcaccgtcaccgtccccggcgacaagtcgatcagccaccgcgcgatcatgttttccgcactcgcggtcggcgaaagccggatcgaggggctgctggagggcgaggacgtgctcgccaccgccgccgcgatgcgggcgatgggcgccgaggtggaacgcggtgaagacggcatctggcgcgtccacggcgtcggcgtcggcgggctgcaacagccggcccaggcgctcgacatgggcaatagcggcacctccacccgcctgctgatggggctggtcgcctcccatggcatcaccgccaccttcactggcgatgcctcgctctccggccgcccgatgggccgggtgatcgagcctttgagccagatgggcgccgagatcaccgccagccccggcggtcgtctgccgctgatgctccgcggcatgtgcccggcggtgccgatcgcatataccctgcccgtcgcctcggcgcaggtgaagtcggcgatcctgctcgccgggctcaacacgcccggcatcacccgcgtgatcgagcccgttcccacccgcgaccatagcgagcggatgctgcgcggcttcggcgccgaactgaccgtggaggactcgcccgagggcaagatcatctcggtcaccggcgaggccgagctcaagccccagcacatcgtcgtgccgggtgatccctcctcggccggcttctggatggtggcggcgtcgatcgtgcccggctccgaaatcaccatcgccaatgtgtgcatgaacccgacgcggaccggcctgatcaccgcgctgcggctgatgggggcggacatcgccgagaccaacgcccgcaccgtcggcggcgagccggtggccgatctcgtcgtccgccatgcagccctgaaggcgatcgaggtgcccgccgatctcgccccgagcatgatcgacgagtatccggtgctgttcgtggccgccgcactggccgagggccgcaccgtcgcgcgcggcgcgcacgagctgcgcgtcaaggaatcggaccggatcagcacgatgcgcaccgcgctggaagcctgcggcgtggtgaccgaggagtttgaggacggcctcgccatccagggctcgggcggcgcgccgctcgccggcgggggcacggtcgcgacccggctcgaccaccggatcgcgatgagcatgaccgtcgccgcgcttgccgccgcgcagcccatcgccatcgacgacgtggcaccggtggcgaccagctatcccaatttcttcccgacgctg

SEQ ID NO: 41727 - DNA, 1465 bp, SPHINGOMONAS
atgaccgcgcccgccgttcatctctggcgcctattcaaatggggccgtattctcgcccgccacggcgcactgcgcggcatcgagcgcgacgccaacacgccgcgacccgtacgccgcttcgtgcgcgtgctgcgaattggtgcgcgtttaccggcagtaccttcctatgccgatgccttccaggcgatcggccccgccgcgatcaagctcggccagacgctcgcgacgcgccccgatctcgtcggcgaggaagccgcgcacgacctgctccgcctgcaggacgcgctgccccccgtccccttcgacatcatccgcgaacggatcgagaccagctatggccgcccgctctcggcgctgttcgcggaagtggaagagcgcccgatcggcgccgcctcgatcgcgcaggtccaccgcgcggtgaccaccgacggccgccgcgttgcggtgaaggtgctgcgcccgggcatcgagagcgatttcgcccgcgcgatcgacacctatgaatgggccgccgcccagctcgaggcctatggcggcgaggcccgccgcctgcgcccgcgcctggtgatcgagagcttcaagcgctggaccgcgcgcgaactcgatttccgccgcgaggccgcctcggcctccgaactcgccgagggcatgaccgccgaaccggacttcatggtcccccagatcgactggcagcgcaccaccggcaaggtgctgacgctggagtggatcgacggcatcaagctgagcgaccgcgacgcgctggtccgcgccgggcacgacatgccgggcctggccggcaagctgatcaaggcctttctccgccaggcgatcgccgagggcttcttccatgcggacatgcaccagggcaatctgttcgccctgcccgacggccgcatcgccgcgatcgacttcggcatcatgggccgcatcgatcgccgcgcccgggtgtggctggccgagatcctctacggcctgatcaccggcgactataagcgcgtggccgagatccatttcgaggccggctatgtccccgcccaccacaatgtcgccgagttcgcgacggcgctgcgtgcggtaggcgagccgatgcgcgggctgccggtgaaggagatgtcgatcggcggcatgctcgacggcctgttctcgatcacccgcgacttcgacatgatgacgcagccgcacctgctgctgctccagaagacgatggtgatggtggaaggcgtcgcgcgcgggctcgatccggacatcaacctgtgggaagtctcggcgccgttcgtgcgcgaatggatccgtaccgagctggggccggaagccaaggtcgccgatcgcctgatcgaggacctccgcacgctcgcccgcctgcccgagctggtgcgcaacatcgagcgtcgcttccccgcccctggcggtgccccgcccgagccgcccctgcgcgagatccaggtggtgcgcgtcggtggcggct

SEQ ID NO: 41728 - DNA, 1304 bp, SPHINGOMONAS
atgacctttgaatggccggcgcacggactgacgctgcaagcccggattgaaagccgcacggcgacgatcggcgtgatcggcatgggctatgtcggcctgccgctggcagtggccttcggcgaggcgggatgctccgtcctcggcttcgatctcgatcccgagaaggtcgtcgcgctcaaccagggcgagagctatatcaagcatattccgggcgaccgcatcgccccgctggtcgccgagcagcgcatcaccgcgaccgccgatctcgaccggctgggcgaagtggacgtgctgctgatctgcgtgccgacgccgctgacccgccatctcgaacccgatctgaaatatgtcgagcacaccacccgcgcgatcgcgcggagcttgcgcaagggccagctggtgatcctcgaatcgaccacctatcccggcaccacccgcgaggtgatgcagccgatcctggaggaagaggggctggtcgccggacgcgacttcttcctcgcctattcgcccgagcgcgaggatcccggcaacccgaccttctccaccaccaagatccccaaggtcgtcggtgccgacgatccggcgtcggcggggctggcgatggcgctctatcgccacatcgtgccccaggcgatccaggtctcgtccgcggcgacggccgaagccgtgaagatcaccgagaacgtgttccgcgcggtcaacatcgcgctggtcaacgagctcaagctgatcttcaccgcgatggacatcgacgtgtgggaagtgatcgacgcggccaagtccaagccgttcggcttcatgcccttctatcccggcccgggcctgggcgggcactgcatcccgatcgaccccttctacctcacctggaaggcgcgggagtataaccagcatacccgcttcatcgagctggccggccagatcaatgccgatatgccgcagcatgtgatccgcgtgctggcggatacgctggatgcccgcttcggccggggcctgcgcggcgcgcgggtgctggtgctgggggtcgcctacaagaagaatgtcgacgacatccgcgaaagcccgtcgctccgcctgatggagatgatcgaggcgcgcggcgcgaccgccgatttccacgatccgcacgtcgcccagatcaacggcacgcgcgaacatccgacgctcaacttccgccacggcatcgcttgggacgaagccacgatcgccggatacgacccggtgctgattgcgaccgatcacgacccggtgggactatgcccgcgctggcggcctcggcgaagctggtgatcgacacgcgcaacgcc

SEQ ID NO: 41729 - DNA, 822 bp, SPHINGOMONAS
atcaagccgctgcgtaaggccgtgttcccggttgcgggactcggcacccggttcctgcccgccaccaaggcgatgccgaaggagatgctcccggtcgtcgaccgcccgctgatccagtacgcggtcgacgaggcggtggaagccggcatcgagcagatgatcttcgtcaccggtcgcggcaagtccgcgctcgaggaccatttcgatatcgcctatgagctggaagcgaccatggccgcgcgcggcaagtcgctcgacgtgctggacggcacccggctgaagcccggcaacatcgcctatgtccgccagcaggagccgatgggcctgggccacgccgtgtggtgcgcgcgcgacatcgtcggcgacgagccgttcgcggtgctgctgccggacgacttcatgttcggccagccgggctgcctgaagcagatggtcgacgcctataacaaggtcggcggcaacctgatctgcgccgaggaagtgccggacgaccagacccaccgctacggcatcatcacgccggggacgcaggacggtgtgctgacggaagtgaagggcctggtcgagaagccggcgcccggcaccgcgccgtcgaacctgtcggtcatcggtcgctacatcctgcagcccgaggtgatgcgcatcctggaaaatcagggcaagggcgccggcggcgagatccagctgaccgacgcgatgcagcgcatgatcggcgatcagccgttccacggggtgaccttccagggcacccgctatgactgcggtgacaaggccggcttcatccaggccaatctggcggtcgcgctgtcgcggccggatctg

SEQ ID NO: 41730 - DNA, 1221 bp, SPHINGOMONAS
gttgcggtgctcggcctcggctatatcggcctgcccacggcggcggtgatcgcccgcaccggcgcgcaggtgctcggcatcgatgtcgatgcgcatgtcgtcgagacggtgaactccggccgcgtccatatcgaggagatcgatctggacggcctcgtctccggcgtggtcgcccgcggcaatctccgcgcctcgctggcgatcgagccggcggacgtgttcgtcatcgcagtgcccacccccttcggcgccaaccatgcgccggacatcggctatgtcctgcaagccgccacgacgatcgcgacggtgctgaaggccggcaacgtggtgatcctcgaatcgacctcccccgtcggcaccaccgagaaggtggcggaactgctgtcgcagctgcgcccggatctgaaggtaccgggccacagcagcggcagcgcggatatcgccatcgcctattgcccggagcgcgtgctgccaggccgcatcctcgtcgagctgatcgagaacgaccgggtgatcggcggcatcaccccgcgctgcgcccgcaaggcgctgcatttctaccgccgcttcgtgcgcggtgcctgcgtcaccaccaccgcccgcgcggcggagatgaccaagctgaccgaaaacgcctttcgcgacgtgaacatcgccttcgcaaacgagctttcgatcctggccgagggcatgggggtggatgtgtgggaggtgatccgcctcgccaaccgccatccgcgcgtcaacatcctctcgcccggcccgggcgtgggcggccactgcatcgcggtcgacccctggttcctcgtccactccaaccccgagcagagcccgctgattcgcacggcgcgcgaggtgaatgacggcaaggtcgcgcatacgatcgcgcgcgcggaggcgctgatcgcccggctgccggctgcgccgatcgcgtgcctgggcctggccttcaaggcgaatatcgacgatttccgggagagcccggcgctcaaggtcgcgcaggcgatcgccgaacgccacggcgcccgcgtccgcatcgtcgagccctatgcgcaggcgctgccccctgcactggctgcgacgggcgcgacgctgaccgacatcgacagcgcgatcgaaagctgcccgatcttcctcgtgctggtcgatcacgacctgttcaagtcggtcccgctcgacgagcgctcgggcaagctggtgtacgacacgcgcggcatctgg

SEQ ID NO: 41731 - DNA, 1641 bp, SPHINGOMONAS
atccgccgcagccgcaatcaggtccgtgccgccaacgcggtgctcgccgctaccaatgtcgcgctcgaaaaggcgctgcatgcgaagacggagttcctggcaacgaccagccacgagatccgcaccccgctcaacggcatcctcggcatgacccaggtgatgctggcggaccgtgcgcttgcggccgacgtgcgcgagcggctggaactcgtgcagggcgccggtctcacgatgcgggcgctggtggacgacatcctcgatgttgcgaagatggagagcggcaacctgaccatcgatccggtgccgatggacttccgtgcgctcgcgaccgatgtggcgcgcctctggtcggaaccggtcgccgccaagggcctgcgcttcgtctgcgcgctggacgatgcgcccgattggatcgtcagcgaccccggacggctgcgccagctgttgttcaacctgctgtccaacgccacgaagttcaccgcagccggggaggtcggccttcacgtagccgtcgtccccgcatcggcggatgccggggagcggctccagatcgccgtctccgacaccgggatcggtatcccggcagagaaattgggggagatcttcgagagcttccgtcaggccgattccagcaccacgcggcaatatggcggcaccggcctcggtctcgccatctgccgaaacctcgcgcacgcactgggagggacggtgctcgtcgccagcacgccgggggagggctccactttcacgctcgacctgccgctggtccgcaccgcgccgccccaggcttcggtaccggccgcatccggcccggccggggtactgctcgtcgagcgcaacccgatcacccgcgcaatgctgcgcgccgtgttcgagaaggcggtgccgaacctgcatttcgccgccgatgccggggaggcggcaaagctactcgaattggaagacttcgccgcgttgatcgttgacgaagccgcgctcggcaccgcaacggaggacggtctggtcgagttggccaatctctgccgggtccagcccgggatccggatcacgatattgacggccgccggtggcgatggcgcgcggcgggtacaatttatggacgcgggcgtaacacaagttatagaaaagccggtcgctggcgcagaattgctggaagccgcggtgccggcatctgcgcggacgacggatgatgtggggaaagacccgcttgtaacacgggcggcttagggcgataatacactccgacatgcaaattttggctgaaacgctggtgtctgccctggtgggcgagcctcgatgaacatcctgttcatcgaagacgacccaatgaatcgccgcgttgtcaaagacatgctggacgtggcgggcgcaaccatggccgaggccgcttgggcggaggaggggctcgcccgaatcgactccgaaacgttcgacatcgttctggtcgatctgcgcatgcccggtaccgacggtttcgagacgatccgccagatccgtgcgcgcaccgatgccaaggcggggctgccgatcatcgtcgtcaccgccgacacggcggtcgacctgcgcgagcggtgcctggcaacgggcgccgatgacgtgctgttcaagccggtggcgatggacgcgctgttcgatgcgatc

SEQ ID NO: 41732 - DNA, 1305 bp, SPHINGOMONAS
gtgcgcattgcgatgatcggcacgggctatgtgggcctggtttcgggagcctgcttttcggacttcggccatgaagtcgtctgcgtggacaaggacgcgcgcaagatcgagctccttcaccagaatgtgatgcccatctacgagccgggtctcgatgcgctcgtcgccagcaacgtcaaggcgggccgcctgtccttcaccaccgacctcgccgagggcgtgaaggatgccgatgcggtgttcatcgccgtcggcacccccagccgccgcggcgacggccatgccgatctttcttacgtcttcgccgccgcgcgcgagatcgccgagaacctgaccaagccgagcgtgatcgtcaccaagtcgaccgtgccggtgggcaccggcgacgaagtcgagcggatcatcgccgaggtcgcccccaacagcggcgccaaggtcgtctcgaaccccgaattcctgcgcgaaggcgcggcgatcgaggacttcaagcgcccggaccgcgtcgtcgtcggcaccgaggacgagttcgcgcgccaggtgatgcgcgagatctatcgcccgctgtcgctcaaccagtcggcacccgtcctgttcaccggccgccgtacctccgagctgatcaagtacgccgccaacgccttcctcgcggtgaagatcaccttcatcaacgagatcgcggacctgtgcgagcaggtcggcgcggacgtgcaggaagtgtcgcgcggcatcggcatggacaaccgtattgggggcaagttcctccacgccggccccggctatggcggctcgtgcttcccgaaggacacgctggcgctgatgaagaccgccgccgacaacgagacgccgctgcgcatcgtcgaagcgacggtgcaggtgaacgacgcccgcaagcgcgcgatgggccgcaaggtaatcaaggcgatgggcggcgacgtccgcggcaagaccgtcggcatcctcggcctcaccttcaagccgaataccgacgacatgcgcgacgcgcccagcctctcgatcatcgcggcgctgcaggatgcgggcgcgacggtgaaggcctatgacccggaaggcgtcgagcaggcgagcaagatgctcaccgatgtcgagtttgtcgaaaacccctatgcggccgccgacggcgcagacgcgctggtgatcgtcaccgagtgggacgcgttccgcgcgctcgacctcacccgcatcaagaacagcctcaagtcgcccgttctggtcgacctgcgcaacatctatccgccggccgaactcgaacgcgccggcctgcaatacaccggcgtcggcaagccg

SEQ ID NO: 41733 - DNA, 1836 bp, SPHINGOMONAS
atctctgcctatctcgacctgcaccagcacaagtcgctgctgcgcttcctcacctgcggatcggtggacgacggcaagtcgacgctgatcggccggctgctctacgattcgaagcagatcttcgaagaccagctcgccgcgctggagaatgattcgaagcgcgtcggcacccagggccaggcgatcgatttcgcgctgctggtcgacggcctcgccgccgagcgcgagcagggcatcaccatcgacgtcgcctatcgcttcttcgccaccgagaagcgcaagttcatcgtcgccgatacccccggccatgagcaatatacccgcaacatggtgaccggcgcctccaccgccgatctcgccgtgatcctgatcgacgcgcgcaagggcgtgctcacccagaccaagcggcacagctatctggcgcacctgctcggcatccggcatctggtgctggcggtgaacaagatggacctggtcgagtatgaccaggcggtgttcgatcgcatcgtggccgactatgccgcgttcgccggctcgatcggcatccgcgactttaccgccatcccgatctccggcttccggggcgacaatgtcaccacgcgcagcgacgcgatgccctggttcaccggcccggtgctgctcgaccatctggaaatcgtcgacgtcgatgccgatgccgatcgggtcaagccgttccgcatgcccgtgcaatgggtgaaccgccccaatctcgactttcgcggctttgcggggctcgtcgccagcggcaccgtgcgcccgggtgacccggtccgcatcctgccctcggggcgcaccagcagcgtcgcgcgcatcgtgtcgatgggtggggacctggacgtcgcggtcgcaggtcagtcggtcaccctgacgcttgccgacgaggtcgactgctcgcgcggtgacgtgattgccgccgccgatgcgccaccgcaggccgccgaccagttcaaggcgaccctcgtctggatggacccggccgaattgctgcccggccgcgcctattggctgaagctcggtacccagacggtcagtgccgtcgtccgcgcgccggaatatgcgatcgacgtcaacaccatggcacgtagcgcggcgaagacgctggcgctcaacgacatcggcgtggcggagatcgccaccgaccggccgatcgtattcgagccctatgccgaaagccacgaccttggcggcttcatcctgatcgacaagctgaccaacgccaccgtcggcgccggcatgctcgaattttcgctccgccgcgcccagaacgtccactggcaggcgatcgagatcacgcgcgaggcgcacgcccagcaaaagggccagcagccgcggctcctttggttcaccggcctgtccggctcgggcaagtcgaccattgccaatctggtcgagaaaaagctgtacgcgctcggcaagcacagcttcctgctggacggcgacaatgttcgccacgggctcaaccgcgatctgggctttaccgatcaggatcgggtggagaatatccgccgcatcggcgaggtcgccaagctgatgaccgatgccggtctgatcgtgctgaccgccttcatctcgcccttccgcgcggaacgggcgatggtgcggtcgctgctggcggagggcgaattcttcgagatcttcgtggacacgccgctggaagaggccgagcgtcgcgacgtgaaggggctctacaagaaggcgcgtgcgggggagatcgccaatttcaccggcatctccagcccctacgaacccccgctcgcgcccgagatccgcatcgacaccagccgcaccagccccgaggaagcggccgagcagatc

SEQ ID NO: 41734 - DNA, 1821 bp, SPHINGOMONAS
atgtgcggaatcgttggaatcgtgggcaaggaagacgtcgcggagcgtctgttcgaaggcctcaagcggctggaatatcgcggctatgattcggccggcatcgccacggacgtagacggccgcatcgagcgccgccgcgcctcgggcaagctggtgaacctgggcaaggaactcggcgccaacccgctgcccggcaccaccggaatcgcgcatacccgctgggcgacgcatggcggcccgacgaccaacaacgcgcatccccatgccaccggcgaagtggccctcgtccacaacggcatcatcgagaatttcaaggcgctgcgcgaggagctcaccgcccgcggtcgcagcttcaccagcgagaccgataccgaggtcgtcgcgcatctgctgagcgagaaggtcgaggccggcatggcccccgccgatgcggtgcgcgaggtgctgccgcgcctccacggcgccttcgcgctcgccatcctgttccgccagcatcccgatctgctgatcggcgcgcggctcggctcgccgctggtcgtcggctatggcgagggcgagacctatctcggttcggacgcgctcgcgctggcgccgctcacccagcggatttcctatctggaagagggcgactgggtcgtcatcacccgggacggcgccgatatcttcgacaaggacaacaatcccgtcgagcggccgatcaccatctcgggcgtcaccggcgagctgatctccaagggcaaccatcggcattacatgctgaaggagatctacgagcagccgatcgtcgtcgcccagacgctgcgcgcctacctccagcgcatggaggagaaggtgacgctgccgatccccgacttcgatctctccgcgatcaagcgggtgacgatcgtcgcgtgcggcaccagctactatgccggcatggtggcgaaatactggttcgagcagttcgcccgcgtgccggtcgacatcgatgtcgcctccgaattccgctaccgcgcgccggtgatggaagaaggcgggctgatgatcgtgatcagccagtcgggcgagacggcggatacgctcgcggcgctccgccatgcccgcagcgaggggcagaagatcgccgccgtggtcaacgtgccgaccagctcgatggcgcgcgaagcggacctgctgctgccaacccatgccggcccggaaatcggcgtagcctcgaccaaggcgttcacctgccagttggcggtgctggcggcgctggcggccaatctggccaaggccaaggggcggatggacgaggccgaggaacgccgcatcgtccgccatctgggcgaggcgccggcctcgctcaacgcggcacttgcctatgacgaatcgatccaggcgatggcgggcgtgatcgcggcggcgcgcgacgtgctgtatctcgggcgcggcaccgattatccgctggcgctggaaggcgcgctgaagctcaaggaaatcagctacatccacgccgagggctatgccgccggcgagatgaagcacgggccgatcgcgttgatcgacgatgccgtgccggtgatcgtgatcgcgccctcgggcccgctgttcgacaagaccgtcagcaacatgcaggaagtgcaggcgcgcggcggcaaggtggtgctgatctccgattatgacggcatccaggcggccggcgacggctgcatcgcgacgatcaccatgcccaaggtgcatccgctgatcgcgcccctggtctatgccgtgccggtgcagcttctcgcctatcatgtggcggtggccaagggcacggatgtcgaccagccgcgcaacctggcgaaatcggtgacggtggag

SEQ ID NO: 41735 - DNA, 1578 bp, SPHINGOMONAS
gatgccgaccgcgccggtcgcagcttccgcctgaccaatctcgatccgatgggctacgacgcggagacgagcgatccgcagtacaagtcgatcccctatgtgctggtggccgatggcgaagggcgctgccacggcgccttttacgatagcgtcgccgacatggcgttcgatttcggccgcgagctggacaattatcacgggccctatcgccacatggccgccgatcacggcgatctggacctgtggatgatcgcgggccccgatccgctggcggtgacccggcgcttcacctggctcaccggccgcccggcgctgatgccgcgctggtcgctcggctattcgggctcgaccatgacctataccgacgcgcccgacgcggcggtgcagatggccgggttcctggagaagctcgccgagcatgacatcggctgcacctcgttccatttgtcctcgggctacacctcgatcggggacaagcgctatgtgttccactggaaccgggacaagttccccgatcccaaggcattcgtctccagctatgcgcaggcgggcgtcgagctggtgccgaacatcaagccggcgctgctgcgcagccatccgcgctatgacgaggtcgccgccgcaggctatttcgtcagcgatgcggacggccagccggtcgaggcgcagttctgggacgaggtcggcagctatatcgacttcaccaaccggcaagccgccgcctggtggcgcgaccaggtgaagtccgcgctgctcgatcagggcatccgctccacctggaacgacaataacgaatatgaggtgtgggacgcccgtgcccgcttcgcaggcttcggcacgaccctgccggcggcggcgatgcgcccggtgcagccgctgctgatgatgcgtgcctcgcgccgcgcccagatcgaggcgcggccggacgagcgcccctatgtggtgacgcgcgccggcatggcgggcctgcaccgctatgcccagacctggaccggcgacaaccgcaccgagtggaagacgctgcgctacaacgcccgcatggcgctggggctggcgctctccggcgtgtcgaacagcgggcacgacgtgggcggctttgccggccccgcgccggatgcggaactgctggtgcgctgggtgcaggccggcgtgctgatgccgcgcttcagcatccacagctggaacgacgatcgcaccgtgaacgagccctggatgtacccggaagcgctcccggcgatccaggcgctgatgcggcttcgccagcggctggtgcccttcttctacgatcttctgctgcgctaccatgccgaatatgcgccgatggtgctgccgacctgggcggcattcccgcaggatcggcagtgctgggaggagtgcgacgagcatctgctcggccccaacctgctcgccgcgccggtggtggagcagggcgcgaccgaacggcggctctatctgccggcgggtgcggactggacccatgtgtggagcggcgagacctttgccggcggtgcctgggtcaccgttgccgcgccgctcgacgggcctccgccgctgttcgcgcgggccggcgctgcgatg

SEQ ID NO: 41736 - DNA, 1479 bp, SPHINGOMONAS
gagcgtttcgatctgctggtggtgggcggcggcatcaacggcgccggcatcgcccgcgatgcggcggggcggggcctctccgtgctgctcgtcgagaaggaggatctggccagccacacctcctcggcctcgaccaagctgatccatggcgggctgcgctatctggaatatggcgagttccgcctggtgcgcgaggcgctgatcgagcgcgaacggctgtggggcatggcgccgcacatcatctggccgctgcgcttcgtgctgccgcagacccagtcgccgcgctcggcctggatggtgcggctggggctgttcctctacgaccatctcggcgggcgcgagaagctgccgggtaccgaaaccgtgaagctggcgcatacccccttcgggcgcggcctcaagaccgccaagggaaaggcgttcgtctattcggactgctgggtggaagacagccgcctggtcgtgctgaacgcgatggacgcggcggagaagggcgcggtgatccgcacccgcacggcgctgaccggtgcgcggcgcgagggcggcgattgggtggcgacgatcgccgacggtgcgggcgagcagacggtgcgggcgcgtgccctggtcaatgccgccggcccctgggtcgcggacgtgctgggtcgcgtgcccgacgtcgtcgccgatcgcgggttgcggctggtgaagggcagccatctggtcgtgccccggttgtacgagggcgaccacgccttcatgctgcagaaccccgatcggcggatcgtcttcaccgtgccgtatgagggggaattcaccctgatcgggaccaccgacgaggtatgggaaggcgcccccggcaaggcgcagatcagcgccgaggaaacccgctatctgctcgaaaccgccgcgcgctatttcgcgcatccgccgagcgaggccgatgtggtgtggagctatgccggcatccgaccgctctacgacgacaaggccggcaatgcctcggcggtcacccgcgactatgtgctcgatcttgatggcgacgaggcccgcgcgccgatgctgagcatcttcggcggcaagatcaccacctatcgcaagctcgccgagcacgcgatggcggagctggcgcgcttcttcccgaaccgcggcggagcctggacggcgggggcggtgctgccgggcggggacctgcccgacggcgacttcgatcgcttcgtcgccagcctgcagcgggcgcggcccggcttgccggccccgctgctgcgccggctggcgcgggcctatggcacgcgggtggaggcgctgctcggtaatgccgcgacgacgttcgatctcggcgccgatctgggcggcgggctgacggtgcgcgaggtcgagtatctgcgcgcctatgaatgggcggtgacggcggaggatattctctaccgtcgcagcaagctgggcctgcacgtgccgccgggtacggccgaacggctggaggaatatctggcgcgcgcg

SEQ ID NO: 41737 - DNA, 1431 bp, SPHINGOMONAS
cacattctcgcgatcgatcaggggacgacctcgacgcgcagcgtgatcttcgattcggccggccgccgcgtctccaccgcccagaccgagttcgagcagcattatccgggccagggctgggtggagcatgatcccgagacgatctggcacgacgcgctgaccaccgcgcgcgaggcgctgctgaaaagcggggtcggcgtggcgggaatcgcggcgatcggcatcaccaaccagcgcgagaccacgctggtctgggaccgcgccaccggcgaaacgctccaccgcgcggtcgtgtggcaggaccgtcgcaccgccgatcgctgcgccgaactgaaggcggaaggggtggaggccgaggttcgggcccgcaccggattgctggtcgatccctatttctcggcgaccaagatcggctggatcctcgaccatgtgcccggcgcgcgggcgcgggccgagcgcggcgacctcgccttcggcacgatcgacagcttcctgctctggcggctcaccaagggcgcggtgcacgcgaccgacgtgaccaacgccgcgcgcaccagcctgtggaacatccacaagggcgaatgggacgcggagctgtgccggctgttcggcattcccatggcgctgctgccggaggtacacgacaacgcccatgtctatgggatggccgaccccgaatggttcggcgtggccgttccgatcgcgggcatggcgggcgaccagcaggcggcgctgttcggccagtgctgcttcgcgccaggcactgccaaatcgacctatggcaccggctgcttcctgctgctcaacaccggcgacaaggcggtgacctccgagcaccggatgctgaccaccccggcctatcgcatcaatggccgcaccgcctatgcgctggaaggctcgatcttcgtggcgggggcggcgatcaagtggctgcgcgacggcatcggcgtcatcacccatgcccgccagaccaacgacatggcgacgcgcgtttcggacagccacggcgtctatatggtcccggcgttcgtcggcctcggcgcgccgcactgggatcccgaggcacgcggcgcgatcttcgggctgacgctgagcgccacccaggcgcatctcgcccgcgcggcgctggaggccgtggcctaccagacctatgacctggtgcaggcgatggtgcgggacggcggcacgcgcccggcgatgctgcgcgtcgatggcggcatggcggcgaacgactggctgtgccgcttcctcgccgacatcctcgacgtcgcggtcgagcggcccgacgatctggagaccaccgcgcgcggcgcggcgttccacgcgggactcgcggtgggcctgtggtcggggctggacgagctttcggcgatctggtcgcgccaggcctgtttcgagccggcgatggcggcggaccaccgcaccaccctt

SEQ ID NO: 41738 - DNA, 1590 bp, SPHINGOMONAS
agcgatgtcctggtcctcggttccggcgcggcggggcttaccaccgcgctgcatctggcggacaagttcaaggtgacggtgctggccaagggcggctttgccgagggatcgaccgcctgggcgcagggcggcatcgccgcggtgctggaggagggcgacaccttcgaaagccatatcgacgacacgatggttgccggcgccggcctcaacgaccgcgcgacggtggagatggtggtcgagaacgcccccgccgcgatcgagcggctggtgaaactgggcgtgccgttcaacaccgagggcaatgccctgcacctgacgcgagagggcggccacagccatcggcgtatcgcccatgtcgacgacgcgaccggcctcgcggtgcagaccgcgctgctccgcgccgcgcaggcgcatccgaacatcacgctggtgcccgacatggtggtgatcgacctcgccaccagccggcacgagctgcgctattcgggcgcgggcaatgtctggggcgtctatgccttcaaccgccagaccaaccgcgtcgagctgttcaccgcccgtgcgacggtgctggcgaccggcggggcggggcggacctatctgttctccaccgccccgcgcggcgcgaccggggacggcatcgcgatggcgtggcgcgcgggctgccgcatctccaacatggagatgatgcagttccacccgacctgcctctacaatctcgacgtcaagaacttcctgatcacggaagccgtgcgcggcgagggcgggcacctgctgctgccccccgatgccggcgaggaggcgggccatcgcttcatgcccgatttcgattcgcggctggagctggcgccgcgcgacatcgtggcccgcgcgatcgaccatgagatcaagcggctcggcctcgactatgtccatctcgacatcagccacatggggcctgagttcgtccagcaccatttcccgaccatctaccaccggctgctcgacctcgacatcgacatgaccagggcgccgatcccggtggtgcccgcccagcattatacctgcggcggcgtggtgatcgaccgcgacgggcgcaccgacctgccgggcctctatgcggcgggcgaggtgagccagtcggggctgcacggcgccaatcggctggcgtccaactcgctgctcgaatgcttcgtgttcggcgaggcggtggcgaatcacatcggcgcgcattggggcgagctcgcgccgccgccggcgatccggccgtgggacgagagccgggtgaccgattccgacgaggaagtcgtcatcaagcagaactggaccgagatccgccgcttcatgtggaactatgtcggcatcgtgcggacgaccaagcggctggagcgcgccgcgcaccgcatcaagctgctgcgcgaggaagtggccgactattacggccatttccgcgtcacgcccgacctgatcgagctgcgcaacctgctggaaagcgccgacctgatcgtccgttcggcgctccaccgcaaggagagccggggactgcactatacgctcgactatccggagacgctgccggacgcggtcgacacggtgctggtgccttgatcgggt

SEQ ID NO: 41739 - DNA, 918 bp, SPHINGOMONAS
gcgatcgcgatcgacacactctgcaagacctatcagggcggcaagcgcgcgctggacggcgtgaccttcgacgtgccgcgtgggcagatcttcgggctactcggccccaatggcgccggcaagtcgacgctgatcaacatcctggccgggctggtcaacaagaccagtggcgcggtctcgatctggggcttcgacatcgacgcttccccacgcaacgcaaaggcgagcatcggcatcgtcaaccaggagatcctgttcgatcccttcttcacgccgaaggagacgctggagatccaggccgggctatacggcgtggccaaggacaagttcgacgcgatggcgctgctccgcgcggtgcatctggaagacaaggccaatgcctattcgcgcacgctgtcgggcggcatgaagcggcggctgatggtcgccaaggcgatggtgcattccccgccgatcatcgtgctcgacgagccgaccgcgggtgtcgacgtggaactgcgccagcagctctgggcctatgtgaagcagctcaaccagcgcggcgtcacggtggtgctgacgacacactatctcgaagaggccgaggagctgtgcgaccgcatcgcgatcatcaaccacggccagctgatcgccaacaagccgacgcgcgagctggtcggcatggcgcaggaaaaggtggtcgaggtgacggtggaccgcgacatcgccgcggcaccggacaatgcctgcttccagaaggtggagcggaagggcgagcgggtgctggtgatcacctaccgcaaggaccaggcgaacgccggcgaagtgctgggcgcggtgcaggcggcgggtctggggatcgtcgacgtgtcgacccgcgaggcggacctggaggatgtgttcctgaacctgacgcgggcggcgtagggggcggaagcc

SEQ ID NO: 41740 - DNA, 780 bp, SPHINGOMONAS
gtgaagatcgcctcctggaatatcaactccgtccgcttccgcctgcccatcgtcgagcagttcctgcgcgaggaagcccccgacatcctgtgtctccaggagaccaaggtgatcgacggcgatttccccgaggcgccgttccgcgagatgggctacacccacatcatcaagcacggccagcggatgcaccacggcgtggcgatcctgagccgtgtgccggtaaccgaagatgaccgcctcgactggcaggcgaatcaggaggcgcgccatgtcggcgtgcggctgccgaacggcgtgcggctcgagaatgtctatgttcccgccggcggcgacgtgcctgatcgggagctgaaccccaagttcggccagaagctcgatttcatccagcggatgaccgaatggtcgacgacgctcgacgtgccgacgatccttaccggcgacttcaacatcgccccgctcgaatcggatgtgtggagccacaagcagctgctcgacgtcgtcagccacacgccgatcgaagtggaagcgctgggccggctgcaggccgcgcatggctgggtcgatctgggccgcacgttcatccccgcgccggcgcgctgctacacctggtggagctaccgcgccaaggactgggccgcctccgatcgcgggcggcgactcgaccatatgtgggccagccccgaggttgcggcaaaggcgacggcgcacaaggtgtgcgagccgtgccgttcctggctcaagccatcggaccatgtaccaatcgttacggagttcgacttt

SEQ ID NO: 41741 - DNA, 564 bp, SPHINGOMONAS
gtgcggttcgacggtatcctcttcgatttcgacggcgtgctgctggagagcgagtatgccggcaacaagcatgtcgccgattatctgaccgccatcggccacccgaccacgcccgagcattcgatggcgcatttcatggggctggcggggcaagacttcctcgccgcaatcgagcgctggatcggccgaccggtgcccgaggacttccacgccgcccgtgccgaggaggatgcgcgggtgctggaagaaggcttgcccgcggtggcgggggcgctgcgcttcctcgaaagcctgcccgccgatctgcccaaggcgatcgcctcgtcgagcccgacgcgctggctcgacacccatctccgccatctcggggtgcgcgatctgttcggtgacaagctgttcagcggccgcgaacatgtcgtcaacggcaagccggcgccggatctctacctccatgccgctgcggcgctgggcgtgccgatcgaggcttgcgtgatcctcgaggactcgccggtgggcgtaaagggcgcagttgcctcgggcgcaacggtgatcgggctatgcgcc

SEQ ID NO: 41742 - DNA, 999 bp, SPHINGOMONAS
aagccgctgctcgcgaccctgcaagggactcgccagcccgttccgcccgtctggctcatgcgccaggccggccgatacctgcccgaatatcgcgcgctccgtgccgagaagggcgggttcctggcgctcgcgatggactccgacgcggcggccgagatcacgctgcaaccgatccgccgcttcggcatggacggcgcgatcctcttttccgacatcctggtggtgccgatggcgctcggccagaggctgtggttcgagaccggcgaaggccccaaactcgcgccgacggtaaccgcgcgaagcgtcctcgacggcttcgatgccgattccagcgtcctggagcccatctacggcacgataaagcgggtgaaggcggccctggacccctccaccaccttcctgggctttgcgggctctccctggaccgtcgcgacctatatgatcgccgggcagggcagccgcgagcaggcagaggcgcgccgcctcgcctatcgcgacgaaggcctgatgcaggcgctggtcgaccggatcgccgatcagaccatcgcctatctgcgcgcccaggccgaggcgggcgtggaggcggtgcaactgttcgacagctgggccggcagcctcagcccggcccagttcgaacgctgggtgatcgcccccaacgcccggatcgcggccgccgttcgggatctggtgcccgtgattggattccctaagggggcagggggcaaactcgccgcctatgcgcgcgaaaccggcgtcgacgcgatcggactcgacgagacggtcgaccccgcatgggcgaacgcggtgctgccggaggggctgccggtgcagggcaatctcgatccgctggcgctgatcaccggcggcgcggtgctggagagcgcgatcgaccggatcctcgcggccttcccggagcggccgcacgtgttcaatctggggcacggcatcctgcccgacacgccgatcgcgcatgtcgagcagctgctggcccgcgtgcgg

SEQ ID NO: 41743 - DNA, 765 bp, SPHINGOMONAS
gtgactcgctatgccgaggtgatcggcgatccgatcgcccattccaaatcgccgatcatccacaaattctggctcgatgcgctgggcatcgagggcgattatcgccgcacccatgtgctgggcgacgatcttgccggctatttcgcccgggccaaggacgatgccgactggcgcggctgcaacgtcaccatcccccacaagctggcggtgatggacctggtcggcgatcccggcggcgtgcggaacacgatcggtgcgatgaacacggtgattcgcggcgaggacggcgcgctgatcggcaccaataccgatgccggtggcttcttctcgccgatcgccgggctggagctggaaggccgccacgcggtggtcgttggcgcgggcggcggtgcgcgggctgtgctgttcgcgctgtcgcgtgtcgggatcggccgggtgaccatcctcaaccgcaacgtgctcaaggcggcggcgctgctctccagcttcggggtgaagggcgatgcgctgccgatcggcacacccctgcccgctgccgacctgctggtgaacgccagcccgctcggtatgcagggccagccgccgctcgatctggatctcgcgccgctgccggagcatgccgtggtgtacgacatcgtctacgccccgctggagacgccgctgctcgcccaggcgcgcgaccgcgcgctggatacggtcgacggtctggaaatgctggtcggccaggccgcccttgccttcgaactcttcttcggcgccgagccc

SEQ ID NO: 41744 - DNA, 339 bp, SPHINGOMONAS
gtcaacgtcaaggatccctatggatcgggcgaggccgcgctgcacatcgtcgtcaagcgccaggatccgacctacctgaccgtgctgatcaaccagccgggcgtgaacgtgaacatccaggatcgtgacggcaacacgccgttgatcttcgccgccggcctgggctggggccccggcgtggacgcgctgatcgccaagaaggcgaacgtcaatctcgccaacaacggcggcatcaccccgctgatccgcgcggttctggcgcacgatgccgagatcgtgaagaagctgctggacgccggcgccgatcccgatcgcgccgattttggcggcggcttgtcg

SEQ ID NO: 41745 - DNA, 2214 bp, SPHINGOMONAS
gatgacgaatcccgcacccgccgcctgcaggtcgccaatgcgcggcccgaggacagcggccgcggactcgcccatatcccccgcagcctgatgggcgcgctaggcattaccgaaggtgacgtgatcgagatcgtcggcaagcgcagcacgcctgcccgcgcggtcctcccctattccgaagacgaagggctggagctgctccgcatcgacggcctccagcgcgccaatgccggcgtcggctcgggcgatttcgtcgaagttcgccgcgccgattcaaagcccgcgactcgcgtcgtgttcggccccgcccaggcgaatctgcgcctgcgcggcaccggcgaggcgctgaagcgcaccttcttcacgcgccccctcaccgccggcgacacgatcgccacggtcggccaccagcgcgccgacatgccccccaacgtccagcagttcgtccgcgcgccggcctatgcgctgcaggagatccgcctgacggtgctctccaccgtgccgcggggcgtggtgcatatcgacgagaataccgaggtcgagctgcgcaccgaatatgaggaggccaaggaaagccgccgcgccgatgtgacctatgacgatatcggcggcatggccggcacgatcgatcagctgcgcgagatggtcgagctgccgctgcgctatcccgagctgttccagcgcctgggcgtcgatccgcccaagggcgtgattctgcacgggccccccggtaccggcaagacccgcctcgcccgcgccgtcgccaatgaaagcgatgccagcttccacctgatcaacgggccggagatcatgggctcggcctatggcgaatccgagcagcggctgcgccaggtgttcgaggaagcctcgaagaacgcgccctcgatcgtgttcatcgacgagatcgattcgatcgcgccgaagcgcggccaggtgaccggcgaggcggaaaagcgcctcgtcgcccagctgctgacgctgatggacgggttggaggcgcgcgccaacatcgtcgtgatcgccgcgaccaatcgccccgaggcgatcgacgaggcgctgcgccgtccgggccggttcgaccgcgagatcgtcgtcggcgtgccggacgatcgcggccgccgcgagatcctcggcatccacacccgcggcatgccgctggccgacgatgtcgacctgcccgagctggcgcggacgacctatggctttgtcggtgcagaccttgccgcgctgacccgcgaggcggcgatcgaggcggtgcggcggatcatgccgcggctcaacctcgaggaaggcacgatccccgccgacgtgctcgatacgctgtcggtcacccgcgacgatttcctggaggcgctcaagcgcgtccagccctcggcgatgcgcgaggtgatggtgcaggcgccgacggtccgctgggaggatgtcggcgggctcgacgatgcgcagatgcggctgaaggaaggcgtcgagctgccgctcaaggatccggacgcgttccggcgcctcggcatccgcccggccaagggcttcctgctctatggtccgccgggcaccggcaagaccttgctggccaaagccgtcgcgcgcgaggcggaggcgaacttcatcgccaccaagtcgagcgacctgctctccaaatggtatggcgagagcgagcagcagatcgcccggctgttcgcccgcgcgcggcaagtggcgccgtgcgtgatcttcatcgacgagctcgactcgctggtgccggcacgcggcggggcgatgggcgagccgcaggtgaccgaacgcgtggtcaacaccatcctcgccgagatggatgggctggaggagctgcagtcggtggtggtgatcggcgcgaccaaccggcccaacctgatcgatcccgccctgctccgcccgggccggttcgacgagctggtctatgtcggcgtgcccgacaaggccgggcgcgagcgcatcctgcgcatccagaccgagaagatgccgctggcggcggacgtcgatctgggcgcgattgccgagcagacccagcgctacaccggcgccgatctggaagacgtggtgcgccgcgccggcctggtggcacttcgccagtcgctggcgacgcgcgaggtgacgatggcgcatttcgaggatgccctgaaggattcgcgcgccacggtcacgcccgagatggagaacgactatgcggcgatgcagggcaagctgaaacagcaggcc

SEQ ID NO: 41746 - DNA, 2028 bp, SPHINGOMONAS
acacggcggggcgtgctgaagcgcggcctcggggcagcagccgccgcgacgctccctgccgcgatcgcccgggcggcggcgatccccgccgacgtgcgcagcggaacgattgcggacgtcgcccatgtcgtcatcctgatgcaggagaaccgcagcttcgatcattatttcggcacgatgcgcggggtgcgcggcttcggggatccgcttgcgctgccgctgccgggcggacggaccgtctgggcgcaggaggccgaggacggaaggctggtcgcgcccttccacctggcgacgcgggaacagttcgcgctgatgcgggtcgccggcacgccgcacagctggccggacgcgcaggccgcctgggatcagggacggatggccggctgggccgcggccaagaccgatcgggcgatgggccattacgcccgcgacgacctcgccttccagttcgcgctggccgaacagttcacgctttgcgacgcctatcactgcgcggtgcacaccggcaccaataccaaccgactgttcctgtggaccggcaccaacgatcctgccggcacgctgggcggcccggcgatcggcaattcgcatgacgaactgcccgagaagggcggctatccggactcctatcgctggaccacctatcccgagcgcctccaggcagccgggatcgactggcgtatctaccaggacatggcggacaatttcaccgacaatcccctggtcggcttcgccgcctatcgccaggcccggccgggatcgccgctgcacgagcgagcgctgaccacgcatggccttgatcggctgcgcgcggacgtgcttgccgggcgattgccgcaggtgtcgtggatcattgccgatgcgaagggcagcgagcatccctccccctccagccctgcccagggcgccgcctataccgccgcggtgatcgacgccctgacctcgaacccggcggtatgggcacgcaccgtgctgatcgtcaatttcgacgagaatgacgggtttttcgatcatgtgccgccgcccgccccgccgtctcctgatccggccgcgcccggcgggctggccggcacctcgcagatcggcgcaggcgacgagtatcaccgcatcgccagcgtcgccgatgccgccgccgaacgctcgaacctgatcgggcgtccctatggcctgggtccgcgggtgccttgctatatcgtctccccctggagccgcggcggctgggtgaattcgcagctgttcgaccacacctccatcctccgctttctggaagcgcggttcggcgtggccgagcccaatatctccgcctggagacgtgcggtgtgcggcgatctcaccagcgccttcgacttccgcagcccgaaccggcccgtgcccgccgccctgccggatccccggccggtcgccgcccgcgcggcggcactgcagcaccagcccgagccgcgtgcgcccatcgcgacgggcgccgctccggcacaggaaccgggcattcgccccgcacgcgccctgccctacgcgctcgacgtgcacgaagccgcgctcgatccgcgggcgatcacgctgcgcttcgaatgcccgggcgcgccggcggtggtccatgtctacgaccgcctgcacctcgatgcgcttccgcgacgctacacgctggcggaaggcgggtcgctggaggccgaatggccgctcgacgagacgggtcgctacgatctgtggctgctcgggcccaatgggttccaccggcattttgccggccgcggcacggcgcatgcgggcagggtccggtgggaacagcagcagcggcgcgggctcccctcgctgatcctggatgctccagccggcctcgatcttgggtggccgcgccatcccgccctcgcggctgcgttcccgcaaacgcgcaacagaatgcacatcccgctgaacaaatccggcggctggtacgacctcgtcctaaccgatccagatgaccccggtttccatcgacgtctcgctggtcggatagaaaatggccaggacggctggtcggagccgactttg

SEQ ID NO: 41747 - DNA, 1170 bp, SPHINGOMONAS
ctgatgcgcgcactcacctggcacggcaagcatgacgttcgcgtcgatacggtggacgatcccgagatcctcaacccgcgcgatgcgatcatcgagatcacctcgaccgcgatctgcggatcggacctccacctctatgacggctttatcccgacgatgatggcgggcgacatcctcggccatgaattcatgggcgaggtggtcgaggtcggcgccggctcgacgctcaagaagggacagcgtgtggtggtgccgttcaccatctcgtgcggctcctgctatcattgcggcaagcatcaatattccgcctgcgagaacggattgcccgcggacaaccaggacatcgcacaggaaatgtacggccagcccatgtcggggctgttcggctacagccacatgaccggcggctatgcgggcggacaggcggaatatgtccgcgtgccgttcagcgatgtcggcccgatcgtcattcccgacggcatcgaggacgacaaggtgctgttcctatccgacatcctgcccaccggctggatggcagcggaaaatgccgagatcgagccgggtgacaccgttgcggtgtggggctgcggcccggtggggctattcgcggtgcaatcggccttcctgatgggcgccgagcgcgtcatcgcgatcgaccatttcccgcgtcgtctcgaactcgcccgtcgcttcggtgcggagacgatcaacttcgaggaaacggatacggcggcggcgctgttcgagatgacgggcggcatcggcccggatgccgtgatcgacagcgtcggcctggaggcgcacggcttcttcgtcgacaacgtgctcgaccagatcaagaagtcgacctttctcggcaccgatcgcatccattcgatccgccaggcgatcctcgcctgccgcaagggcgggcgcgtctcgatgccggccgtctatggcggcttcgtcgacaaattcccgctcggcgcgctgatggagaaggggctgacgctcaagacggggcagacgcatgtccagcattacatgccggcgctgctgaatgcgatcctggaagagaagatcgatacgaccttcctgatcagccacattctgccgctggagcaggcgccgcagggctacaagatgttccacgacaaccagaatgaggtgaccaaggtcgtgctgaagccc

SEQ ID NO: 41748 - DNA, 768 bp, SPHINGOMONAS
atgaccaacccgttcgatcttaccggccaggtggccgtcatcaccggcgcgaacaccggcatcggccagggcatcgcgctggcgcttgccgcagcgggggcggacatcgccgccgtcggccgcacgcccgccgaggaaaccgtcgccaaggtgcgcgatctcggccgccgcgccgagatcatctccgccgatctttcgaccatcgagcctgtgcaaagggttgtggacgaggctgtggataagctggggaaaatcgacatcctggtgaacaatgccgggatcattcgccgcgccgacagcctcgatttcaccgaggaggattgggacgcggtggtcgataccaacctcaaatcggtgttcttcctttgccaggcggcaggcaagttcatggtccgccgcttcggcgagaccggcgagcggggccgcatcatcaatatcgcctcgatgctcaccttccagggcggcatccgcgtgccgagctacaccgcgtccaagtcgggcatcggcgggcttaccaagctgctggccaatgaatgggcggcgaagggcgtgaacgtgaatgcgatcgcgccgggctatatcgccaccaacaacaccgccgcgctgcaggccgacgagacccgcaaccgccagatcctcgagcgcatcccggccgcgcgctggggcgatccggaggatctggggggcgcggcggtcttccttgcctcgcgcgcttcggactatgtgcagggccatgttctcgccgttgacggaggctggctggcacga

SEQ ID NO: 41749 - DNA, 984 bp, SPHINGOMONAS
tttggggaaatgatgctgcggctgtcgccgccgggccgcgaactgctgctgcagacgcccaagctcgacgtggcgatcgcgggcgcggaggcgaatgtcgccacgggccttgcctgcctggggcacgacgtggcgatgatcagcgcggtggcggacaatccgctgggcggcgcggcgatcggcgaactgcgccggcgcggcgtggatgccgccaaggtggtgtccgaagccggtcgcatgggcctgtatttcctcaccccgggcgcggggctccgcgcatcggagatcgtgtacgaccgggcccattcggtattcgccgaccggccggccgcggcatgggactgggatgcgctgctggagggcgtgacgcgcctccacctctccggcatcacgcccgcgctggggccgaacaccgccgccgccgccatcgccgcggccgaggcggcgagcgcacgcggcatcgccgtctccttcgacggcaactatcgcgccaagctgtgggaagcctgggacagcgatccgcgcggcgtgctgacccggctgatcggccatgccgacatcctgttcggcaaccaccgcgacatctcgctgctgctcggcaagcccttttccggtgacggtgccgatcgccggcgcgaagcggcggaggcggcgttcgcggcgttcccgaagctccagctgatcgcttccaccgcgcgccatgtcgacgatgtcgacagccaccggatcgccgcgcgcgtcgatacccgcgcgggcagccaccagaccgaggaattgcgcgtcagcggcatcgtcgaccggatcggcggtggcgatgcgtttgcggcgggcgtgctgcacggcctgctcgaggacggcaacgccaaggcgatggccgaggcggggctggcgctcaccgcgctgaagcactcgctgcccggcgacgcgagcctgttcacccgcgccgacctgaccgccttcgccgagggcgggctggacgtgcgg

SEQ ID NO: 41750 - DNA, 1326 bp, SPHINGOMONAS
gcccatgcgctgggcctcaaggtactgatcgaccaggtctattcgcacagctcggaccagcatccctggttccaggagagccgcaccagccgcaccaatgcccgcgccgactggtatgtctgggccgatgccaagcccgatggcagcccgccgaacaactggcagtcggtgttcggcggcccggcctggacctgggacgcgcggcgcggccaatattatctccacaatttcctgcgcgagcagccggacctgaacttccacaacccggaggtgcaggcggccacccttgccacggcgaagttctggctcgatcgcggcgtcgacgggttccggctggatgcgatcaacttcacgatgcacgatccgcaactgcgcgataacccgcccgcgccggacacggggctcccccgcacccgtccgttcgatttccagcagcacatctataaccagagccatgcggacattccgctgctgctcgagaagctgcgcgcgctggcggatctctatcccggtcggttcaccgtcgccgaagtgggcggccccgcgccagaggcggagatgcacctgttcaccgccggcgagtcgcgcctcaacagcgcctatggcttcaatttcctctatgccgatcgcctgacgcccaccttggtgcgcgacgccgtcgccgagtggccggacacgccgggcacgggctggccgagttgggcattcgagaaccacgatgccccccgcgccatctcgcgctgggtggcaccgccgcaccgcgccgccttcgccgcgatgaagatgctgctgctgctctccttacgcggcaacgccatcctctattacggcgaggaactgggccttacccaggtcgagatcggctatgaggacctgcaggatcccgaggcgatcgccaactggccgctgacgctcagccgtgacggcgcccgcacgccgatgccctgggtggcggatgcaccccatgccggcttctccgtcgcccgcccatggctgccgctcggccccgatcacggcatgctcgccgtggatcgccaggaggccgatccggcgtcgctgctgcggctgacccagcgactgatcgccttgcgccacgcccatcctgcgctggtcgaaggcgcgatggaggtgctgcatgcggacgagtcgctgctcgttttcgcgcggacgctggccgacacgcgaatcgtctgcgccttcaacttctcggacacgaccgttgcgatccccaccgacctgctcgggagcgcggcgccggtagaggcgctgaacgacgccagcctcgaccgtcttcccccctatgccgcgctgatcgcgcgctgagac

SEQ ID NO: 41751 - DNA, 2139 bp, SPHINGOMONAS
atgcccagccatgaagaattcgtccgcgcgcatggtgccgccgacacggagattgccgcgtgatccgcaagaccgccctcgccctgctcgccggcgcgctcgccgtggcgcccgccgccgcccagagctaccgcgaccgcctgcccgaagatgaggtgctctacttcctcctccccgatcgcttcgaaaatgccgatcccaccaatgatcgcggcggcctgaccggcgaccggctcgtcaccggcttcgatccgacatccaaggccttctaccatggcggcgacctgaagggcgtggtggcgcgtctcgactatatccaggcgctgggggccaccgcgatctgggtcggcccgatcttcaagaacaaggccgtccagggacccaaggggcaggaatcggccgggtatcatggctattggatcaccgacttcacccaggtcgacccgcatttcggcaccaatgccgagttcaaggcgctggtggatgcggcgcacaagcgcggcatcaaggtctatatggatatcgtggtgaaccacaccgcggacgtgatccagttcaaggagtgcggcgactgcgcctatcgcagccgcgccgactatccgtaccagcgcaagggcggcatctccggcgcgcccatcaatccgggctttgccggcgacgacaaccacagcgccgccaatttcgccaaactgacccgctccgattacgcctacacgccctctgtccccgaggcggaaaagcggatgaaggtccccgcctggctcaacgaccccatctattaccacaatcgcggcaactcgaccttcacgggcgagagttcgaccatgggcgatttcgtcgggctggacgacctgatgaccgagcatccgcgcgtcgtcgccggcatgatcgatatcttcggcggctggatcgatcgcttcggcatcgacggcttccgcgtcgacaccgcccgccacgtgaacccggaattctggcaggccttcgtccccgcgatgctggcccgcgccaaggcccggggcatccccaacttccacatcttcggcgaggtcgccgatccggaggtggcggcgctcacccggcacacccgggtcgacaaattcccggccgtgctcgatttcgccttcaaccaggcggtaaccgatgtcgcgagcggcaagggcaccgaccgcctcgccaaggccttcgccgccgatgtgctgtacgagggcggcgaagccaccgcccgccgcctgccgaccttcgtcagcaaccatgacgcgggccgcatcgccaccttcatccgcaaggctttgcccaagatcggccaggacgaactgctccagcgcgtccagctcgcccaggcgatgctgctgctactgcgcggcgtgccgaccatctattcgggcgacgagcagggctttgtgagcgacggcaacgaccaggacgcacgcgaggacatgttcgccagcaaggtggcgagctacaacgacaaccggctgctcggcacgacggcgaccaccgccacgcccagcttcaaccccggccacccgctgttccgcgcaatcgccacgcttgcccggctgcgcaccagccacccggcgctcacccgcggccggcaggtcacccgcttcgccagcgagaagcccggcctgttcgccgtctcgcgcttcgatccgaagaccggcgcggagatcgtgatcgcgttcaacaccagccccgagccctggaccggcaacgtccaggtcgagaccggctccaccgccttccgcacgctggccggcgcctgccctgcccgcgccgctgccccgggcagcctccccctttcccttcccgcgttcggctatgccgtctgcgcggctggagcctccaagtgaacctgatgtcgatgcgtgacctttccaccgaaacccgcccctggtggcgcggcgcggtgatctatcagatctatccgcgcagcttcgcggactcgaacggcgacggtatcggcgacctgcccggcatcaccgcgcggctcgatcatgtcgcggcgctgggcgtggatgcggtgtggatctcgcccttcttcacgtcaccgatgcgggacttcggctatgacatcgccgatttctgcggcgtggatccggtgttcggcacgctgtcggacttcgacgcgctgatcga

SEQ ID NO: 41752 - DNA, 477 bp, SPHINGOMONAS
ctgctggtggtcaacctcggcacccgggggtcgtccactggcccggccgtgcgccgctacctggccgagtttctcagcgaccgccgcgtggtcgccatcccgccgctgttctggaagccgctgctgtatggcgtgatcctgcccatccgcggccccaagtcggcagaaaaatacgccaaggtgtggctgccggatggctcgccgctggcggtgtacacacggcgtctgaccgaaggcctgcagcaggtcatgcccgactggcacgtcacctgggccatgcgctacggcgcgccggccctgcgcaaggcgctggacggcctgcgtgcgcgcggcatcaagccataagtggtgctgccgctgttcccgcagtattcgaccaccaccaccgcctcgatcaagaaccgggtcgatgcctggcgcccgagcccgccaaaaacgtggtggaaggtgatccaagactattgcgaacacgccgct

SEQ ID NO: 41753 - DNA, 603 bp, SPHINGOMONAS
gtattgaactcacccggccatttcaatgcctacactcgcgatgaagtcggcgccggatctgaacccgaagaacttcaccgccagctgcgcctggaccacaaccgtgcgctgagccagctctcgctcaagctcggcaagccggtcggcggcatcgagaagctggtggtgtggggcaaccacagcccgaccatgtacccggattaccgtttcgccacctccgatggcgcgtccatcggcgatgcgatcaacgaccaggaatggaacgccggcaccttcatcccgaccgtgggcaagcgcggcgcggcgatcatcgaagcgcgcgggctgtcgtcggccgcatcggctgccaatgccgccatcgatcacgtgcgtgactgggtgctgggcagcaatggcaagtgggtcaccatgggcgtgccgaccgacgggtcctacggcattccggaaggcgtgatcttcggcttcccggtcacgaccgagaacggccagtacacgcctgataaggatctgccgatcgacgacttcagccagaagtacatcgacaagacccttgccgagctggaagaagagcgcagcgacgtgtcgcatctgctgggctgagtg

SEQ ID NO: 41754 - DNA, 1751 bp, SPHINGOMONAS
  unsure (1)..(1751): unsure at all n locations
caatcccaacaaacaaacacaccaaaaccaaaagaaaccagaacaacggaacaagagcagaaggaggacaacagagaggccacagacaaacatcacaacggacacgacacacacgacgagcacacatacaagggacggcgagaggtagccggagaagagacagcacggaccaagagaagggagacagacaagtggagcacacgagagacaggacacacgggacaagcaacacgaagagcgagaagacgaaaagcggcgagcacagccatgaccacaccgagacacacagacagtgcagccgacacaacagacggcgaggagaaggaaagaaccaagaggcacagacagcaacggacgccaaccacagagcaagactgcgcgaagccgcactcgacaangacatcaggcgcacgaacaacgcactcaggagagacaggaacgaaagaacgtacaacgagacacagctacagacgtgacgagagaagcacacagacagagaatgacaacacagcagcgtcaggcgaacgacggcgtanacagacagagaggaagagaagcgacaggcgcagaccaaacaacagaaatagccgcaaggacagcgacacacagaacgagaacgatggcgccgagagaacggacacatacgagaaaccaaaggatggactgcagacgacgagacacacagagacacaggacgactcacgcgagccgacgagagaacaaccgactatggaggccaacaacgcaacggagacagcgcgaaaaccgggaacacacgggaagcagacagaaccagcaacaatagctacagacgacgagtaanagggagacgaacaagaggcgcacagagcacagaaacaaacagtgacgcaacaaggacgcacgcacatgacgacgagcacgaacaaggcaaggcgaagaagacgcgagcaagtgacgcgcagatagagcagcgacgacacgacacgaacgggacacatacacagcacgagctagagaccgatgagaggagctcgcgagatacgacgacagagagtgacagacgagcgcacgcggatgaacacacaagaagaacgaagcacgacgagcacacgaaagcaacacagatagagaacggcaccaagagaacgagacacatacgaacaaaccgcacagcacgaggaggacaggacagaaacaggaagcaagagcgagcgcggaacacaaacacacggcgagaaccatcagacagcgactgaagagaccgcgggcagacaggtacacgagcagagagcgacggcagacaagagagagaganacggtagagacaaccgacgacgaagaagagacacgacancaacgcgaccgataacgacggcgacatggcacagagatgaactggagaaaacacagacatgagaggagagagaaacgagcagagagacgaaaaagaggngccaggacaaggaagacgaggacacccagagaacaggacgcgcgagagcccggaggagaccgaagcacagagcgaganacacagagatcgagactacggaaagaaggagggaacgaagacgaaaaggggaacgcaactcacgaggaagagagcgcacagacacgagaggacgatgcacacagagcgccacacacacgcacggccgacgacacgacaaggacgacgaagacgacgacggccacgaagcgacagacgagaaacgcacggagacacgcgcggaagcagcagagacgacgaagacgcacacgtgacaccg

SEQ ID NO: 41755 - DNA, 609 bp, SPHINGOMONAS
gatgtcgagctggaggccgggggcagtatggtagtccgctcgccggtccggagcaagagcaagcaggctccgtagctgacatacctgcgctcaagcggcgtgcggatctgcggtaaatgctggctcaagatggcggacaagaaggtcctcgcctagaccgagaacctcaagaaccaaccgggcgcgtggcagatgaagccgcggccgattgtattataggtgaagatcatcgaatggccgtgcaggcggttttttgccaacaatacgcccttcacctcgtcgatattctcgaccgaggccatgcccttgagcccgaaaccattccagacgacgtagagccccgagacgatagacggactgtacaagtccattctgtgccgaaggaggccgacgcattccgaatacaacacgtagaccaatgacgctggactgggccggacggtgctcgcgcacttgtatggccgattgcatctacctcatgaataaaagacccgattaaataaacgccgactgcaggaatcattccgacattatcgccagcatgacataatatactggacgacatccgctccgagaggcattagccgatccaacgagtgatcgcaagta

SEQ ID NO: 41756 - DNA, 333 bp, SPHINGOMONAS
tttacgctcgaggccgcccaccggctgcccaacgttccgccgggccataagtgcgctcggctgcatgggcattcgttccgggtcgagctgcatgtcagcggcgaaccgggtgccgagaccggctggatcatggacttcggcgacatcaaggctgccttccagccgatctacgaccggctcgatcaccactacctcaatgacatcgaggggcttgaaaaccccaccagcgaacgcctggccatctggatctggcagcagctcaagccggccttgccgcagttgagcgaaatcgtggtgcacgagacctgcacttccggctgccgctatcgcggt

SEQ ID NO: 41757 - DNA, 1094 bp, SPHINGOMONAS
aggcaaccggaccccggacccaaagaaacaaaccgggaggggccaaaacggaccgcatttggttttaccacccagaggggcaacgaaccaccgagcgggggggtcacggggaaagccgaagggcaccaacccagggcagaaaccgaggccaagaacacccgcgagagaaaggaccgaacagcaaaaccgaagcaacacagggggaagacaaaaagagcgggcccacggcgcccaacaaaaagaaagaaagcggggccaaacggaagccaaggaacaaaaagagggggccaaccacaaacgcggacgcaaaaaggggacagcccagacaaacagaaacaaacccggcccgaacgaccaccacccaaacagaccgcagaacagccaaacgcggggacgaacaagagagccgagaagacacgggcaacacggcgagcggaagacgcagcaccgaacaacaaagacacaaacaggaggcagcaaagcagaacagaccggacgagacggaccccaaaagaggcacacacaccacgcacagaagaacagcacgaagcaacagggaccagagaagcggaaaagagcagccgcacggaacaagagcggagggcgacccagaaagcgaaagccacaagggagacaaacagcgggaacagccgaacgggccagaacaacacgggaggggaagaacaaggaacaacagaccacgcgaccaacgggcaagcggcccgcagggacagcgcaacaaacagacagacgcccggccacagaggccaccaacgcccgagcaccgcccaccgcgaagggaccacacagcggagcgcacccgacaagcggggcgcagcaagccagcaaggccaggaaacgcgagccacgaagaaagaccccaaaggcccccgcacaagacgagaccaagccagaaagaagaacaggagcagacaaccgagcgcgggacaaaagggccagcacgaagaaaccgcgcaaagcgacaagaacgggaagggagaaaaggggaggagaaaacggaccagacaagaaaagcgggagcgaacgacagagaaccaacgggcggagagcaacacgacacggaccacggaacc

SEQ ID NO: 41758 - DNA, 675 bp, SPHINGOMONAS
ccacaccccgccgacaccgacgcgccccgagaggaaccggaagcaggacgcgacaaaagagcagaagcacacacagagacgcacaggacaccgaagcccacgaaaacacgcaaccccaccaagcaccaagcgcccaccgacacgaccacaaaaccaaacaaaccacaaacaaacgaggagacccagacagaacacagcacgaccacccgaccagaaagcaaacaagcgaaacgcgcccgacgagcaacagacccgaccgaccagaagaacaccgaccacaaacgaaagcgacagaacagaacgaaaggagaagaccccgaaaacacgcaaccccccaaagaaccaacaacacaaccaacacaaacggcgacacccgaaaaagaagagcaagagaccaacgaaccacaacgcgaaaacacacgagcccagccacacaaaaaagaacggacagacaaaacagaccgagcagacgcaaccgcgacgcccaagcacaccgccacaacacaaggacaggccgacaaagaagaaacaccagagaggcacagacccccaaaagaaaacagagacaccagataaccggcgagagagaaacgacaaccaaagaaaaccagaacacacaaacaaagcaaacaaccacaccagcacaacacgaggagaccgaggcaagacagacca

SEQ ID NO: 41759 - DNA, 938 bp, SPHINGOMONAS
  unsure (1)..(938): unsure at all n locations
cctgtcgcgcggttgcgcatttccccggtcctccaacccaggacagagtatatcttgtgcgcccgcgctcctccatgtgcgtgtgagtattgaaacccccgaccacagataccttgcncccacacgaacgacacgggagttacccgttcctcatacccttggcccgacacagagcatccaattctccaccttgccccgtcccgcaccccccgccctatctagcggcatccacctcaaaatttcaggctccacccccttgctaagaaccaagcgctcccgggtctcctcaaccggtctggtgggccccccaccgcagtctggttctacccgggccccgcccgataggcctaccaacgcctatatcattccgtgtcatggtccccttcccgggtgatcgccccaatcttagacggtgtagggatctaccagggcgccgccgtccttttcaccatggcacagcgcaacgaccgccccccctgccttgggtgcgctgtcctcgggccttggcgcatgtctgctctgacgtgctcccatgcgtgactactccgcgagcacacggcacgtgtccgcgcgccggacccctccccgttcctcgagcgcttcagcctcgctttggcacctcacccatggatgctcccgggcatgctccaagcataggtgcgcttcccgagccgtttcgcccaccaccccgcctgccgtgtagttagtggccccgctggactaaaacgaagaaacccgccggccaaggcgttcctcatggagctctagccccgccgcggccgggttatagttaaccgctccggggttcctcacaaaggaatataaaattcaatccttgcacccccacctaagggagagtggctgaagagacgtaaacgattccacaaaatcaacgccagacggtgcaggatgaagagccgtaagatcagcggtgtcac

SEQ ID NO: 41760 - DNA, 1027 bp, SPHINGOMONAS
  unsure (1)..(1027): unsure at all n locations
ggcacaaagaaccgggcacacccaagacccgaaaaaggcacgggaaaagggcccagggaccaccagaaacggtcaccatgcggcaagggagcatacaaggccaaacggggccaacgccggacgaaggggcccgacaaaaaacggggggcaaaacagaacaggagagccggacagccggccgaataggaacaaaagaggcgagggcgggaaacgaaatgggccaaccagggggccgtaaggattagccacaggcacataagcaaacccaccgacgaggcgtgagcacccgaggccgaaacacaaaagtctgacgggggaggaagagagcggaacgaaacaaccccccccaacagagcagaggcntacctggagagattacgaagagcggacagagcacaaacaacggggagggcaaaagagagaacggccaagaccacgaggatgtgcccatgagttactcaaacaacaccttaggaaggggccggaggaaaaccagccagaggagataacaagaggacagcgggtgcgccgacaaatagaacaaaccactccccggcacgagggccacatccagaacaacgaaacaagaactgagacccacgcaaggaacgggagaacaccagaagcacgaaggagcgaggagcacctccgagtccacgaagacagtgagaacacacgaaggacacaggagaacaaaaacagaggccaccaccacgggacacaaggacaaccggatacggccgcagggaaaaggtacaggggacataagacaagaggaccactcgtgaaagcgagcaacacctgaaagacgagaggacaggagccaagccacggaaacgccaggaaggcacccacagggcgggacaggagacgcgatatcacaatcctgcggaagcgagtaaagcaaccagaaaacactctaaaagagcggcgggcgggggagaaacacaaaacaccccatgggagccggggggagagcaatacagcggagccacccgcacgactaaataagacataaaagacacga

SEQ ID NO: 41761 - DNA, 1633 bp, SPHINGOMONAS
  unsure (1)..(1633): unsure at all n locations
aggcaaaggaacgacagagaaggcaaaccgcccggcaaagtaacgagcaccacccggcaaggatgccgagaattcccagaagcggcgaccgaaggcacaaacaggggaaccggggagcaaaacaaacaaagaggcaccccggaagcccacaaaaaaccacaaaatacgagcaaggacaaacgaaaaaaacgggggacagaggaccaaaaagcgcaaagacggaaaaatgagacaaaatcgcgcgacaaagacctgaaaaagggaaacagacaggcacaaaaagagagggaaacacacggaagaaaacagtgcggaagtaaaggggagacagaggccgcaaaaaaacagcgggagaacgagaccagcgaacaacatgcagagtggaaacactcacagcgagagaaccaaggaggatagaagaacacagcgcaaaaaagagcagagaagaaacagaaagggggccgcaaacaccactgacgggaagactcagagcgggcggcaacaaaaaagctgagcatcaacaccagagtggcgcgaacaaacagacgcggagcaacaatacgcacccaaagagaacacaccagcgcgggcacagaaacatctgagaatcacaaaagacgcgcaccaatgaacagaaagagtggtgcacaatatagcgtacacagcgaaaacacgcgctcacgagagagcaagatagaccgcgctcacgagaaaaaagcgcacgagggcgacgaacaccgcggcgcgagacacactcgaagccgcgagacacaataagcaggcactcgacacaaccgcgcgagaagagcacatagtagagaagcgataaaagaatcagaaggaacgacacacagggaggatacagaagacacagtctgcaagatacgacagatcgccgcagacaacaaacacacgtgcaagatacaagaaggagcggagcgaacaacatgcagacgtcgaaacgtaacgagcgagggcgcatatatacacgagcggtaagaanacagaagacgcgaatggaacacaacacgcgcgcgacacaaaaaaagcaacacgcgagagaatacacaccgcgagccgaaacagaactcagcaggctacaacaacacagtgtggcgcaaaaagtattcatgcgatcgcagctagctatagacgcgaggtgacgacaatacaggcgggaaatatataacacatagcgactagcagatacagaacagggcagagaacacgacagtgcgtgccacacgactacagcacgagagcacaaacataccacgcgaggaagaatacagcggacggaggaacaagatagagccgcgcgacacaaacaggacgacgacgacccacaaaagaccgaggagcaaagaacaagacagatagaaaagacgagacggagacagcaaatcgacgactgaaaacaataacaccgagacgaacacatcaaggaagagatagacanaccgagtcgatcgaacaagaatcagagcgcacgaacagagagcgagagaataatctcacgtagaacagcaatctcacgggcataaaaatacacaggagacgcaaaacatagagcggagtgacaaacgagaagagggaggaacaataccacaggcggaagacaacaacaggaccc

SEQ ID NO: 41762 - DNA, 1799 bp, SPHINGOMONAS
  unsure (1)..(1799): unsure at all n locations
gatgaagaacaaagacggacaaaaacaaaaaagcaacagagaagtccacacgaacagaaaaacagaagaaccgaacccgaaaacggaagaaagggaaggacaaaccaacccccactacaagacaggaacccttgaaaatcaatttgccatggcaaaacacccgaccgcattgaggaagcaaagccaacgacagaagaccaggaccgacagaaggaccggaggacacggccgagccaattatacaaccaaaccaaatacggaaaaacaggcgaggcgggggaaacagacacgagaaaacacccaaagaaagctcaccacaaccagaagcaagaaacgagcaaaaccacaaaaaacaaaaggcccgagcgcaacgcaaagaggagccagacgaacccaaaaaaaaagaaaagaccgaaatcgacgaaaccccaaggagaagaccgagaaagagaacaacagaagccaaccacaaacacaacagaacacagagagcaagggcatgcgagaccataaacaaacaagagacaacacctcagcagaagacgacaaacgcaagaacacacaagaccgaaagcaacgagagcgcgaacgaaaggccagaacacaacacacaacagacacgacagncaaaggacgacggacacgagggaaaacgacagtagcgccgtgcgcgagacatagaggcagggaaggacgctcagagaacaacgggaggacatggagaggccacaagtagacgcacggataagtacgcacgaacgcggcaacggcgcaggaacgccacagcacgtgagcgcgacctaaggacacaacatctaacaacggaggacaggaaacacacagacgacgcgcatctacacaaacatgaagaagaaacgagacaagagcactcacaccacacgagaggacacacacagcggacaaatgaagcacgcaccaaaaggtccgagcgataccagcatgtgagagaacacaacaggagacgaaacacccggagacctcgctcgacacacaaagcgacaggcgcggagacgaacggcagacgagcaccccgcagagaaacacagacgagcccgcgtgcgcgcaaacgggcaccaaaaccaggaagaacctcacaccagacgagggcacagaacgataacacacacgcgacgagcggcgagaancacgcagtgcaccgcgagagcgcaacgcaagcgcgcagacatcagagaaacgaccgagcagacacagggagagacagagcaagaagtgacagaaaggacggagacagagcaagacgacgcagagaaacaaagcactacacggacgaaccgcgacgagggagacagcgcagcagagaagcggcaccaatcgccagaacgccaaacacagccgggggggacgaactaggagagagcacaaacgaacacgcagagagacggagcgtcaggaaaaagcgacgccacaagaggtacaacacgacacacagaggacgacaaagcacgacaccaggaataagaagggccacaaaacacgccacaagcagcggagataaaaagacacgagccgaggacaccgacgcaaagacagagaaagcgacacggcgacgcgcgccacagaaaagaacgaacgtgaagagagcacaggacccgcggaagagacaacgacccacgcacaaaatccgaggaacgccagacgtaaagagcaaagagccgagagtcgactgggcgcagacaggagcaacaaacgagacgagacgaccgaagccgagaagacaaacataacaccgccggagaaagagaaccatacagcaaccc

SEQ ID NO: 41763 - DNA, 1454 bp, SPHINGOMONAS
  unsure (1)..(1454): unsure at all n locations
ggaagantccatnggcaagncccagcaagtcatgaaggccgcaaaaaagtgggccaaaagaaaccaaaaagaggggaggagagccacaggagcaacaggacaaatttacagccctttgcaggcaacgacaacgcgcaggggggaaaggggcgggacggcggcgccaacacgaagcgacccaacggacaccgagccacagacacaaaaaagcagcgcgagcccccgggcggggcggacaaaaagcgcgaaacggaaaaaagaccgaacacggccggacagaccgagcaggacagagaagagacgcaggaagcggaggacaagcgcgcgaagcacaaggagggagggggagcacgaaagcaaaccaaagaggggacgcaccacgggcaccgcaggacacaggaacgaggacgagcggagcagacaacatcgaacaggcggtactcaagagangacacaccgacacaaagaaacaagagagaaggacgaagcagacagagcgcnacngaaagaacggagcagacaacgcagcgacgctgaacactgcaggnggcacgcacagactgcacaatgggcgacaagagagaacacagganagcgcagcgaggacagagacgtggagctcacacatgtcacgacaggnaangcgacacanggatgcccacgcacaaataaaccgcacgngggcaggcatacggagccaagacgagcaccacacactgagcgccacagagcatgacacaacaagtggagaagcgcgccggcacaggcacagcgcgacggtagaccacacngacacgcgaggacacgtgagcgagagcaagaaagagcagaacacgcagcagacagcagccggagcgccaggcaaagaggaaacaggggacaggggacgaaacaaaacacggcacaccgacagcaacagagaaagaacgagaacgaagacaaaacagggcccagcaccaggaacaaggcacagagaacgcggcggaccggcaccgacgaaaagacgacgcagcagaccgaagggaaaagccaaaaacacagaagagaagagacactaggcaaggcaaagacaaggagaacagaaacggaacgacaccaaggaacaaggacagaggccagcagcgcaggacccaagcgaacaccacgaagcacagagagaggaggagacgagcgacaagaacgcacagaaggggacaagaggcgccgaagggcaacgcaagcnatcggcgacggnaacacgctangagcatngccgngcaggagacgtgcgtgcgcgacacgancaccggcggcacatgcagctgacttcaacacgagcaggtcagcagcgcattatgagggacacngcacatangcangaacgaaccgagaatgggaacacacgggtaggacacagacacgacgacatgcacaaacgaaacgcgtcacacagagagcacatgctgcgaaacaca

SEQ ID NO: 41764 - DNA, 765 bp, SPHINGOMONAS
gaaatataaggggccaacagggaggcccccggcatacaggcaagcaaagaaccagcgcaagcaaccagaaaatcaccgcacagaggttgtacatacaaatcttggagcgacaaacacgaacaggagaagcaacaaacacacgcggggaccaagagggaggacgaacaacacaaccaaggaggggagcgcccagaaaaacaccccgccgaacgaggcacactaccaccagcgaaaaaacagaaaagagacagagaagccgcgcagcgaccagacccacagggcggaaaacaaagaaaacaggcatagagcgatctgagacaacccacagaacagggcacaacacagaccgccaaggggacaaaggagcccagcaaaaccaggacagaggagggcccaccacgaaaaaagacaggaagcaccaacaagaggaccatactaacagaagagcaaacacagggagagccagagcaagaaaaaggaccaaacgacacaggaacaagaacacaccagaggcgaagcaacgaacacagggaaaggaacagaaagcaggaggacgggaaaccacagaaagcgagagacgaccaaccgaggaaacacggcaacaaccacccacagcgaagagacgaccaaacacaagacagaaacgcaaaggcagggaggcgacagaacacgcgggcccggcagaaaagcacaagtagcaaccaacaagagaacaacccaccaggggacgacaaaaagcgagacgagacgaacaaccgaagaaac

SEQ ID NO: 41765 - DNA, 1435 bp, SPHINGOMONAS
  unsure (1)..(1435): unsure at all n locations
aagagggnccatgtaggggcaatatggcgcgcccccagacccgccaaggccgaagcgcgagctgcgggccagcacatcacatacacgggggacggaacagagaccagttttgagaacttttacgccccgccagccaaacccaccgaagatcagcggggcccggggggagaacccagaggaagacaaaaggcagggccaccgccaccgaagacgaagaagcacaggcagacaagcacgacgcaagcaagacagaaggggagagggacaacgcagaagaacaaacaaacacgcgacaagaaagaacaatcaaggcggaacaaaaagggaagaagagaagagaacggcaggagacaaagaacacaacacacgaacagaagtcgagaaaaggggaaccaacagccgcatacacacagaaagcacggagaaacgcccaacaacaccccacgccacccccggcagacgcgagaacgatacatccaaaccccacacaggcgaacagggcaggaaacaaaaacacggacgcagacatacaaacaggagccacgacgacacagggcacagaaccaggagacacacgcaccacccaaacggaacgacaggcaagacgagcgcagaagcaaggcaatgcaggaccgaccgaacaaccagagaaccgcactcagnacaccacagacaacatgcggagcacaaaacaaagcaacacagaccacggcgcaagcaaacgcacggaccgaagacaaacacacagccgcacaaggacagacgaggaagcagaaccgcgggaaggccaccacgcggcactgaaaaccggcgacaccggcacgacagggagacaccaacagccgcacactcacgagacgatgacggagccggcagccacagacagaggacgaacggaccaagtgcaacgagagcgaggcgacccgacagagcgacagcgcgcaggaccacacctccacagcacgcacaccacaccgagcagagaggagcggaccagagatgaaccaataacaccgggcgagacacaggacaaaagacgcaggcaacgagagacagcaacaacgagcgtacgagagaaacgagcagcatcaacaaagcgagcgagaataacgtactagagacgggcacgacagcacacgacagaagcgtctccatggctgcccaaacagatgaggagcnacgcgtaagcggcacaatcaaaacaaccagatatgcggccggcataacagacacagactagcgcgagagtgagagggaagacagaagcacacgacggacgacaccgcacacgaagccgacagacgacaggaacagacgccaaaaccacgagaagcgaggcgcaacgacgacgagagacacaaaagccgcgcggcgaccaacgagagcaaacacgtgccagagaagaaacgcaagagaacccagagcaaacaaaggc

SEQ ID NO: 41766 - DNA, 1259 bp, SPHINGOMONAS
  unsure (1)..(1259): unsure at all n locations
aaatnggaaaaaaaaagcccccggggggataaacacagcagggccttaccacacaacaaggccagggataaggaaaccaggagcgaacgaagaggacaaggcggccttagcaaggcgaaccggggcccccaaccccacacggacaggaacgcaacaaacacaaaaaaaacaacggacgggcaccaaagcccacccaaagcgacaaaaacacacacacagcacccaacacaagaaaaggcccagccggaacacaaaaccgaacgagaacaaacacccacccaaaacaagaacgcaacaagcacaaaaacacgaccaaacaaaaaaacacgcaacaagccaataagaagcacgcagaaccacgagacgagcaacacaggcacgacaaccgacgcgccagaaccaaacaacgacgaccgtcaacaaacacgccaaaaatgacgagcgagacccacaaccaccacgcgaacgaacgacgacacgcaagccgcagccaacaagaggaacaacagaggcaagcacacggaccgacggacaagcaagcaaacagaaactacggaacaagacccacgcgggaaaacaccgagcagtgacgcacgccatcaatcacgcgcacaagataaatccacccaagggaccgcacatagaccacgacgacagggagaaaaaccacagacagcacgaacgcacgatcgagcacaaaaacaaaacacaccacaaccaacgacaagacacacaaaacgcgaaatccacagggggggacaaaccgggcaacaacacacttggcgcgaaaaaaaaaagaaaaagagccccacaggaccgaaacgccaaaaccgcaccgagccccacgacaccccaagaaggacaaatgaaccaaagaacaaaaggcaccaaaacccacacgagccacaaagagacgacaaaccgacagacaacacaacacaacaaaaacagaaacgaaacgagaaaccaacacaaaaccaagaccacacaacaccaacacaaccacaacgaacaacaaggacggancaaaaagagggggcggaaacacacggaaagcccgcggaaaccaaaaaaacacggagcaaaaccgacacacacaacaccaaaaaaacaccccccacccagaaggccccggaaacgccccccccccacaggaaaaacacgataaccacggaaaacaccccacggggacccgggccaagagacacagggagaacccccccaggaaaaaaaaagaagaaccgcgaaacaaacacccc

SEQ ID NO: 41767 - DNA, 1130 bp, SPHINGOMONAS
  unsure (1)..(1130): unsure at all n locations
ccaacagacaaagacacgaacacacaaacgccaaaagcgaagcgaaacatcgacagacaaaccacgagaacacgacccaaaggccccgacaccagacccagcgacacaacagtcagaacaaagagagcacccgagaacaaaaggaccacgcaaaccaaccagcagcacacgcgaagaatagcgaagagaaacgcaacacacagaaacagtgacagtagtacgacanacacacacacgccacgcacaccgcaaaacaaccgaaggcagaccgaacagaacagcacacgcgcacaagaagtaacgactgtgccggacgcgagtacagacagccacggagcacgcacaggcgcaggacagaagagagagatctacctgacggaaccagagcacagaatcacggacgagacgacattaacaaaacacacggacgacacagacacaccacaaaagagcctatcactaaggacacgaggcacaagcatcaagaacgtacacagcaaaaccacagaaacaccgaacgaagcaggacacaaacgaagaagcacggaccaccacgacagaggaaaaaacagaccaacaaaacaagcgagacccagacaggagggacaaggaagggacaaacggaacacaagcagaaagcgcaccgcgaaaaaacgacgaagacactcacaaccaagcgcaccggcacaacggcgaagatacaacggggcacgaacaacgcacacagtcacaaagcgaagacgaaaacggacacacgaatatgacagcacaacaacaagaaaagagcaaggacagaacggaaggaacacgagaggcaaacaccaaagacacgaaccaagcctaagcaacacagaacaaccgaagacggacgagaaacaaagcaaaagaaaagagacaacaagataaaagaagcaaagaagccaccacaccagaaccacagaacgccagaaccagagacacacgcagaacgagacacgacgaacccaaacgacgcacgagacaatgaacgccgagacccaaagcacgcagacaaagcagatcggcagaaggaaccacatagcaaaagggagagggacacgacgaagcagaacgacggacaagacacacgaaacgacaaagcacacggcaca

SEQ ID NO: 41768 - DNA, 2295 bp, Thermoplasma acidophilum
atgggaaagataatcagaatttcaggtccagtagtcgtggctgaagatgttgaagacgccaagatgtacgatgttgtcaaggtcggagagatgggcctcatcggtgagataataaagattgaggggaacagatcgaccatacaggtctatgaggatactgcaggcataaggcctgacgaaaaggttgagaacaccaggaggccgctgtcggtggagctcggcccaggcatactcaaatcgatatacgatggaatacagaggccactggatgtgatcaagatcacttctggagatttcatagctcgcggtctgaacccacccgcacttgacaggcagaagaagtgggagtttgttcccgctgtaaaaaaaggagagacggtctttcctggccagatactcggtaccgtgcaggaaacctcgctgataacccacaggataatggttcccgagggtatttcaggaaaggtgacgatgatcgccgatggggagcacagggttgaggatgtgatagcgacggtatcaggaaatggcaagagctacgatattcagatgatgacaacgtggcccgtcaggaaggcgaggagggtgcagaggaaactgcctccagagatcccgctggtaacgggacagagggtaatagatgcgcttttccccgtggcgaagggcggaactgccgccgtacccgggccattcggaagtggaaaatgtgtgtctggcgatacaccggtacttctggatgccggcgagaggaggataggcgacctgttcatggaggccattcaggaccaaaagaacgcggtcgaaataggccagaacgaagagatagtccggctccatgatccgctgcgcatatattccatggtcggttctgaaatagtcgaaagcgtctctcacgccatatatcacggaaagagcaatgccattgtaaccgttaggacggagaatggaagagaggtcagggtgacacctgtccacaaactctttgttaaaattggaaactctgtaatcgagaggccagcctcagaggtgaatgagggcgatgaaatagcatgcgcaagcgtaagtgagaacggtgattcccaaaccgtcaccacaacgctggtattgacattcgatagagtggtatcaaaggaaatgcatagcggcgtattcgatgtctacgatctgatggttccggattatggatacaacttcataggcggaaatggcctcatagtccttcacaacaccgtgatacaacaccagctggcaaaatggagcgatgcaaacatagttgtttacataggctgtggcgagcgcggaaatgagatgactgaaatactcaccaccttcccggagctgaaagatcctaacacgggccagccgctgatggacaggactgtccttatagccaacacttctaatatgcccgtggcagcaagagaggcgagcatatacacaggtataacgatagcggagtactacagggacatgggatacgacgttgccctgatggcagacagcacatcacgctgggcggaggcactcagggagatctcaggcaggctggaggagatgccgggagaagagggatatcctgcctatctgggtagaagggtttcagaattctacgagagatccggaagggcgaggctcgtatcgccggatgagaggtacggatcaataacggttatcggtgctgtatcaccgccgggaggagacatatccgagccggtatcgcagaacaccctgcgtgtaacaagggtattctgggctctggatgccgccctggccaacaggaggcattttccatcgataaactggctcaacagctattcgctttacaccgaggatctgagatcctggtacgataagaacgtatcatccgaatggtctgctctaagggaaagagcgatggaaatactgcagcgggagagcgagctccaggaggtcgcacagctcgttggatacgatgccatgcctgaaaaagagaaatcaatactggacgttgccaggataataagggaggacttcctgcagcagagcgcgttcgacgagatcgatgcttactgctccctgaaaaagcagtacctcatgctgaaggcaataatggagatcgatacctatcagaacaaggcgctcgactccggcgcaacaatggataacctggcttctcttgcagttagggagaaactctcgaggatgaagatagtgccagaggcgcaggtagaatcctattacaatgatcttgttgaggagatccacaaggagtatggaaatttcattggtgagaaaaatgccgaagctagcctataa

SEQ ID NO: 41769 - DNA, 1431 bp, Thermoplasma acidophilum
ttgttgaggagatccacaaggagtatggaaatttcattggtgagaaaaatgccgaagctagcctataaatctgtttcacaaataagtggcccactgctcttcgttgagaacgtgccaaatgccgcttacaacgagatggttgacatcgaacttgagaacggggaaaccaggcaggggcaggttctggacaccaggaagggcctcgccatagtgcagatattcggtgcaacaaccggtataggcactcagggaaccactgttaaattcaggggagagaccgccaggcttcctatatctgaggacatgctgggcagggtattcaatggcattggcgagcccatagacggtggccctgagataatagcaaaggagagaatggagatcaccagcaacgccataaacccttattcaagggaggaaccttccgaattcatagaaaccggaatttcggcaatagacggaatgaatacgcttgttaggggccagaagctgcccatattctccggttccgggctgccgcacaaccagcttgccgctcagatagcaaggcaggcaaaggttctggattcctcagagaatttcgcggttgtcttcggtgcaatgggcataacgagcgaggaggctaattatttcacgaaccagttcagggaaactggtgcgctatcaagatcggtcatgttccttaacctctcttcggatccgtccatggagaggatcatcctgcccaggatagcactcacaactgcagagtacctggcattccagaagggcatgcacatactcgtaatattgacggatatgacgaactactgtgaggcccttcgtgagatatctgccgccagggaggaggttccgggaagaaggggctacccaggatacatgtacacggatctgagcaccatatacgagagggcaggaaagctgaagggaaacaatggatccataacgcagatccccatactcaccatgccaggcgacgatataacgcatcccgtgccggatctcacaggctacataaccgagggccagatagtgatttcaagagatctcaacagaaaggacatgtatccaggcatagacgtgctcctctccctctcaaggctgatgaaccagggcatagggaagggaaggacaagggaggatcataggggcctggcggatcagctttacgctgcatacgcttcaggaaaggatctgagatcactgactgcaatcgttggtgaggaggccctcagccagaacgacagaaagtatcttcactttgcagacacctttgagtcaaggtacatcaagcaggggttcttcgaggatcgctcaatagaggatacgcttggcctgggatgggatcttcttgctgatcttcctgttcaggacatgaagagggttaagcctgatcacatccagaagtatggcagatggaagaaggagtga

SEQ ID NO: 41770 - DNA, 1914 bp, Thermoplasma acidophilum
atggagaagatcaggatcatagccccgtattcctacagggatcctgtcatatccgcccttcatgacctgggcgtcatgcagatagaggagatgagggaagatgttgacaggcttctgtctcctgccaaagcttcggaacaggcaaaaaccgttatggattacctgcagaagttccgaggatacgagaacatacttccgaagaggccagtgagaacaagagccaaattcacctctcttgcagatatcctcaacgaggcatccaagataaacatagacgatgatatacgcatagctgtgaacagggaaaacgacattgcagcagccatgaaggatatcgatagcaggctttctgcgcttgaatacatgaagggatatgatttcgacgtatccatattcaacgggaagcacttcgagtcttacataatacctgataagaatgtggatatcaaggcgttctccagcctgaacgcagaaattgtgccgctgaagaatgcattcataataaccgtggctgaggacagaacacaggatctcagcaggatcgccaattcgattggagcaaggctcattcacattccagatctcaagggaaagcctgatgatgtaatagctatgctcaatgacgaaagggcaaagctggatcaggcaatgcaggagataagaaagcaccttggcgatctttccgataaatattatgagaagatagcccagatcagggaagccctggagatcgaggcaaagaagatagatgtggaggataaattaaaaggaactgagtacacatttgccgtggaggggtggataccatcagattcgttcggcagagtgagcgatgccatcaacagagttactgggaacagctgcataataagcacagtgaagaccaacgagatgccgccaaccctgctcagaaatcccaggaggatctcgcttttcgaattcttcatcaaattctattcgcttccagagggtacggagtatgatcctacgctcatattcgcactggtctttcccgtattcttcgggttgatggtcggtgattggggctacgggctggccatcctgctgatctctcttttcataatacaccgcgttgatcatccaccggcaaagagtcacatacccagagtcataagcagatttgttctgatgataatgtcgccgcaatccctgaagacgctggcaaaggccctgattccgtcatccatagtagcaatcatagctggcttacttttcaatgaattcttcggattcgctatcctgccattcaccgttttccatgtgtacgcggttcttccgaagctgatgctgatcgccggatacataggccttggcatggtggtattcggcttcatactcggattcattgaggatttgtggatgaaggatgtcaagggagccatggatagactcggatggcttttctttgcggttggaatcgcaaccatagggcttaacctgatacaccacgatctgacgttcagcgtaagtaccgggatatcgaatctgattgcagttgcactgatagttatcggcatacctctgatagccatcaaggagaagtcgcagggattcatagagatgccttccataataagccacatactctcatatctcaggcttgtgggaatactgatagccagcgtcgtcatcgctgagataatagacctggtattcatgaagagcatagtttcgcattccatcgggcttgccatcgccggtgttgtcatactgatattcgggcagatgttcaacttaatacttgcagtattcgagccaggaatacagggagcaaggctgatatacgtggagttcttctcaaagttctaccacggaaacggaagaatgttcaggccattcaggagccagagaaaatacaccgaggatggcctcgattttgataaggctagataa

SEQ ID NO: 41771 - DNA, 939 bp, Thermoplasma acidophilum
atgaatggaaaacatgtgatgataactgggggcgcaggtttcataggatcgaatatggtggaaatgcttcttgaggacaacgatgtcacggttatagataacctgagcataatggatgacagatacataaaaccgttcatgggaaaaaagaacttcaggttcataaaggaagacataacggaatccgttacgcctggagattacgatcttgtcgtccatctcgctgctgattccgatgtgaggaacggatccgtggatccgacgatagatctgagatcaaacgtcatagggactgtcaacgtgcttgagatgatgaggaagaaagatgtcaaagacatactgttcgcctccagttcaacgatatacggagaggcaaaggttatgcccacgcctgaagactacgggcccctcctcccaatatcctcatacggcgcctccaaactctcggctgaggctttcatatcatcatactcgcactattatggaatcaacgccaagatcttcaggttcgcaaacatagtgggaaagaattccacgcatggcgttatattcgattttataaacaagctaaaaaagaacagcaaagaactggaagtactcggggatggaacgcaggcgaaatcgtacatgcacgtcacggactgcgttggaagcatgttctacatctatgacaggatcagcggaacggaagtgttcaaccttggaaatgacgatgtaacaaacgtggatacgatagcaaagtacgtcatagaggccatggggctcagggatacaaggatagtgcgcaaaggagggtacatgggcagaggctggccaggcgatgtgaaatacgcaagaatggatataaagaagctcaaggcaacggggtggaagaacagatataacagcgatcaggccgttaaggtggccataggcgagataatgaagcagattatatga

SEQ ID NO: 41772 - DNA, 903 bp, Thermoplasma acidophilum
gtgctttcgagatatcctgaggtatctccaggcgatattgaaaagatgatactgcagtacaccggtgcaaaatctcttcgagtcattatcgggccgggacttacacacttcatttacagaatacctgcatggatggggttgaggcgatcgcttatcatagaaccaaacttcaacgaatacgaagcatcgctgcttgcctatggctcaagaacatcatcactcggccttggagtcctgaagaggaatccagagatcgtgaggtcctacaggccagattcaattttcatatgctctccggtcaacccgacgggagatctcgttgacgccgggctcctccgtaagttatccatggagatgagcaggatgggcggaatactgtttgtggatcaggcattcggtgacttcgttccagaacatgcagaggagacagtaaggatagctgaagaaatgggaaacgtgataataggccgatctctgacgaaaatactgtcaattccgtctttaaggcttggatacatactggtcagcgatcaggtgttcggcatgataagggacagagaggaaccgtgggctgtctgcgaacctgcacttgaattcgtgaggaaggccgatctcaaggctttgagggataccagtttaaagaggatcggcgaagagcgatcttacctgatggaagctttagagaacatgggtttcgagatacttggagatccgcatgccaatttcatagccttcagatccccatttgagatcgatctgaagaagcagctgctgaaatctggaatactgataagggatctttcagactatgcggatttcggcaagaactgctacagggttgccgtcagggggcgatctgaaaatgccctcctgattcaggctctgagaaacgccatcctgtga

SEQ ID NO: 41773 - DNA, 855 bp, Thermoplasma acidophilum
atgaatgggatgcagacagcggaattcgatggtacgggaagaaaggtatcggtcatcggtgtaggaacatggtcacttgaaggatcaagatccgagaacgtaagatcgataagatacgctctcgaccacggtgtcaacttcatagacactgcggaaatgtacggcactgaggatatagtcggcgaggccataaagggctatcgcagggaggatctattcatagcgacaaaggtatggccgacacacttcgcctaccatgacgtgctgaagtcctgcgaagagagcctcaaaaagctcggtaccgattacgttgacctgtaccagctgcactggcccaacccttccgtaagcataaaggagaccatgagcgcgatggagaaactcgttgatgaaggcaggataaggtacataggcataagcaatttctccgtcaaggagatgaaggaggccatgagcgctctggcaaagtacaggatagtttcaaatcagttggaatacaatgttgccacaagagagatagaggatgagggcatttacgatttctgcaggaagaacggcatggcgataatagcttacagcccgctctcccatggaaagatcttcggaaacgaaatgatactggaaacgctaacggatataggcaagaaatacggaaagagacccgcccaggttgcacttaactggatcataaggaagggtgcgtttcccattccaaaggcaagcaagccgatccacatggcagagaatatagaatcgacggatttcacactctctgatgaggatatgaagaccctggattcgctgtaccaaaggcatcctatcaggtccatagccagcaggtacaagggtcactga

SEQ ID NO: 41774 - DNA, 1176 bp, Thermoplasma acidophilum
atgatgaacagagtagcaatcatcgggtacggcatcagcaaatttggcaaacgcacggatgcatcgatgtacgacctcatatgggaagccgggtcagaagccataagatcaagcggtgttgataaaaaggacattgactacatggttgtatcgaacatgggcatgtggagctccgaggagttgcctgcggtcgttgctggcgaagttcttggaataagaaatgcagggcttcacagggtggaggctgcatgcgcaagtggcagctctgccatagcctccgcatacgatgccataaggtccggcagatccaagatagccattgcacttggcatagagaagatgaacgaggtggagagcgaaaccgcgatagagctcataggaagggctggaaactttctctgggagtatgagttcttcggactgacatttccaggatactatgctctgtacgcgacggcatacctgaacagatattcgggcaaggaagaagacctggcgcttgtatcggtaaagaatcatcactacgcccacctgaatccaatagcacacttcagcaacgagataacggtggatgacgttatgaagagcagatacatagcgtctccgctgaaactgtacgattcatcgcccataaccgacggatcagcagcggtcatactggcatcagaggatgtggcgaagcagtacacggatactcccgtttggattgatgccataggttcaaaccttggaactgcaaatctcagcaagagggacgattttgttcacatagaagctgcacgggaagctgctgccaaggcataccggatggcgaaaatagacgcagctaaaccttacagataccttgacggtgcagatgtgcatgactgcttttcgatagccgaggttctggcatatgaggatctgggcttcgccgagaggggaaagggccttgacatgctgagggacggtgaaacatacataggcggaaagatacctgtaaacgttgacggcggcctgatatccaagggccatccaataggggcaactggagttgccatggccgtggaggcctcgaagcagctcctgagaaaggccgaaccaggccggcagatagacgttaaaaatggaaaattcctgacccataacgtgggcggtacagggcactatgcctatgttaccatttactctgtgtga

SEQ ID NO: 41775 - DNA, 2109 bp, Thermoplasma acidophilum
atgaagataggttatcagttgataatcaatacgtattacgcagcatcttctgtctgtttcaggagaaatatatttaaatcaagacagaatagtaagatcatgacgctaactgtctgcccctactgcgggacaggctgccagattgaagtagattattccggcgatcattacacggtgcatggttatacaagatctgcagtgaacgagggaaagctctgcataaagggataccaggggctttcctatgcgagctcgcatgacaggataacctcgcccatgctgagaagcggtgacacatgggtgaaggtgagctgggatgaggcgatagattacgttgtgaaaaggctgaaggagataagggacaggtacggtccggacgcaatagcattccaggcgtcagccaagtgcacgaacgaggaaaactacctccttcagaagatagcacgaatgatcggaacgaacaatgtggatcactgtgccagaagctgccacagctccacggttgccggcctgataaggacactgggaactgcggctgcaaccggatccattaaaagcctgaagtcaacccagaccttttttgtcataggatcgaacacaacggaacagcacccaataataggcacaacgataataaagcagaaaaaggcgggcaaaaagctcatagttgctgatccaaggagaacaaagctagcatccatagctgacgtctttctccagttcaaacctggttctgatgtcgctctcctgaactccatgatgttcgttatcctgaaaaggggcctgatagattcagagttcataaagagtaggacagagggatttgaagcatttgcagaggaaatagaaaaatacccgcctgaactgacagaacagatcaccggtgtgccgccggatctggttgaaaaggcagcggagatctacgcttcaaacaggccttcagccatactctacggcatgggcataacgcagcacatccatggaacggagaacgttatgagcgtttccaaccttgcgctgatgaccggcaaccttggcagatacggttcgggcatatttcctctcaggggccagaacaacgtccagggttccagcgatatgggtgcgctctccgaattctatccaggttatgtcccgccagattcaccaggcgtggagaaattcgagcggatctgggaggcgaagctcccgaggaaggttggcctcatgctctcagagatgttcgatgcagccatagatgggcgcgtcaaggcaatatacctgatgggtgagaatccggtgataacggaggcaaacctttcagatgtggaaaggggcctgaagaatcttgagctgttcgttgtacaggatattttcatgacggacacggccagatacgcacacgttatacttccagccacatcagctctggagaaggagggcacattcaccaacaccgaacgccggatacagcgcgtcgttcctgtcaaagatccgcccggggatgccaggccggactggtggatactcagccagatctattcaaagatcttcgacagggaagcgtacagatcgcctgaggatatattcaatgagatacgcctggcaatcccgaactattctggggtcagatacagcgatctgtatccggatgggaaacagtggcccatcaacgatcagcatcctgaaggggcagagatactccatgtcgataaattcgccagggggctcggtaggttcatggccataccgtacaaatcgccatccgaatcgccggatgaagagtaccccttcatactgaccacgggcaggaactattaccactggcattcaggcaccatgacgcgccgcagcgaaatactggagagggaatcccccaatccgtatgttgaaataagtgtcaacgacgcaaagaaactctcgataagaaatggccagacgataaccatcgaatcaaggcacggatccataaaactcccggccatggtgacatcgaagattccggatggcatagtgttcgtgccattccatttcaaggaagccagggtgaacctgcttgtgggcgaaaaccttgatccgtactcaaagatacctgaattcaaggtggtggccgtgaaggtgaaagcatga

SEQ ID NO: 41776 - DNA, 1431 bp, Thermoplasma acidophilum
atggcacaaggactgctccagcagcttgataatgcaaaggttggaaagttccatctgagggcatgggtcatatctggaatgggctttttcacggatgcatatgatcttttcataataggcacagtagtatcactgctaccgcttgctggctggaactccctaacaacagcggatatttcgctgatatcttcagtcgcccttcttgcatcggtcataggggcatttacctttggcaggttgctggatctgctcggaaggagcagagtttacggtttcgaactcatgcttctcataataggtgctgttggcagtgcatttcttgttcctgtcaacggtgtcctgtatctgctcatttggaggttcatacttggtctcggcataggcggagattacgcaggcagctccaccataatggctgagttttcaaatgcaaagaacaggggccagctcatcggcatggtcttctccatgcagggcttcggcctcgtcttcgggccggtgatagcgcttgtgatgcttagatacatacccagcatagaccttgtatggaggctgttgctgtttctgggtgcaatacctgccgcgatcgttctctatggaaggaggacgataggtgagacgccgaggtattcaataaatgtgtcaggagacatctcttcagcaaaaaaagcgatccaggagatatccggaaaatccacagtgcaggcaaatccggatgagctgattggtgagcacataagctggaagaagatgttcacggacaggtacttccttatgacgctcataggcacggccggcgcatggtttgcccttgactgggcattttatggcaactcgataatgagccaccagatgctatctgccatagttcctgcgtctctcggaggggtggcgaaggtaaagatgaccactttctatgccctcataatatttgccgtatccgcccttcctggatactggattgcgacgtttactgtggacagaataggaagaaagccccttcagatactcgggttcttcatgatggcgttatcctacatcatactgggcgtattcagattcatatctgcgccttcttacataatctggttcatgatcatatacggccttagctacttcttcacggaattcgggccaaacgttaccactttcatatacgggccagaaatgttcccgacgtctctgaggggcatgggctcaggtctgtcatctgcaggtggcaaactgggagcgttcatagggactgcacttaacgttgtgatatacgcgatcttcggtgaaagtgtgttgttcatcattctcgcattcatatccattgccggcgcacttctgaccatgttcttcctcccggagacgtccggcaggagtcttgaggatatctccggcgagagaaactacaaaagggcactgagcagtggatccaagaagtga

SEQ ID NO: 41777 - DNA, 516 bp, Thermoplasma acidophilum
atgggtggtctggaagaggatcttcttagagttggagcaataaagttcggtgattttgttctcacatccggcaagagatccacatactatgtggacatcaaggaagctgcaacagatccttctgttttgagaaaaatagcctcggaattctcaggaatgataagatccagcaagatagccggcatggagctgggcgctgtgccactcattgtggcaaccgcactgcagatgtccataccgtacataatagtgagaaaggagagatcccatggaactatgagccttcttgtggggaagttcgaaaaaggagaggagatcgatgtgatagaggatgtggtaacgactggcaactctgttctgaaggcggtaaatacgctcagagagaatggggcggtggtgaaacgcgcttactgcgttgttgacagggaggagggcggatcggatctcctcaaggagaatggcatagatcttcacccgataataaggatttcacaggttaaaggcttcagaaaatag

SEQ ID NO: 41778 - DNA, 1809 bp, Thermoplasma acidophilum
ttgcagaaaagctacggcgtggcacttgaatctccaaccggttccggcaagaccatcatggcattgaaatctgccctgcagtattcaagtgaaaggaagctcaaggttctgtaccttgtccgcaccaattcgcaggaggaacaggttataaaggaattgagatctctttcatccacgatgaagatccgcgcaataccaatgcagggcagggtcaatatgtgcatactctacaggatggttgacgatctgcacgagataaatgcagaatctcttgcaaaattctgcaacatgaagaagcgtgaggtcatggccggaaatgaggctgcatgcccgtacttcaacttcaagataagatccgatgaaacgaagaggtttcttttcgacgagctgccgactgcggaggaattttacgattatggggaaaggaacaacgtgtgcccttatgaaagcatgaaggcagcactgccagatgcagacattgttatagcaccttatgcatattttctcaacaggtccgtggcagagaagtttctcagccactggggcgtctcaagaaaccagatagtgataatactggatgaagcgcacaacctgccggatataggcagatccataggatccttcaggatatctgtggaatcgctgaacagagcagacagggaggctcaggcatacggtgatccagagctgtcgcagaagatccatgtttccgatctgatagagatgatcagaagtgctttgcagagcatggtcagcgagagatgcgggaagggcgacgtcaggataaggttccaggaattcatggaatatatgaggataatgaacaagaggagcgagagagaaataagatcgctgctgaactatctctatctcttcggcgaatacgtggaaaacgagaaggaaaaggtgggcaaggtacctttcagttattgctcgtccgttgccagcaggatcatcgcattctctgaccaggatgaggagaagtacgcggccatactttcgccggaagacggcggatatatgcaggcggcctgccttgatccgtctggaatactggaggtgctgaaggaatccaagacgatacacatgtccggaacgcttgatcctttcgatttctattccgacatcaccggtttcgagattcctttcaagaagataggcgaaatatttcctcctgagaacagatacattgcgtattacgatggggtgtcatcaaaatacgacacgctggatgaaaaggaactggacagaatggcgacggtgatagaggatataatactgaaggtgaagaagaacaccatagtgtactttccatcatattcgctcatggacagggttgagaacagggtatcattcgaacacatgaaggagtacaggggcatagaccagaaggaactgtactccatgcttaagaaattcaggagggatcatggtacaattttcgcagtatctggcggaaggctttctgaaggcataaattttccgggaaacgaactggagatgataatactcgcgggcctgcctttcccgaggccggacgccatcaacagatcgctgtttgactactatgagaggaaatacggcaagggctgggaatacagcgtcgtgtatccaacggccataaagataaggcaggagatagggaggctcataaggagtgcggaagatacaggcgcctgcgtgatcctggacaagagggccggccagttcaggaaattcatacctgatatgaagaagacgtcggatccggcatcggatatatacaattttttcatatctgcgcaggcacgcgaaaaatatggggcctga

SEQ ID NO: 41779 - DNA, 756 bp, Thermoplasma acidophilum
ttgacagaagagaaatatagggagatagttgtgaaggacgaggatggtgttagggtgatagagataaggagagaaaacccactaaacccgttgacaatcgatttgcttcaagagatcgatcatgcagtgaggggatctggaaaggtaatagtcctcaggggaagcgatcgagctttctctgcaggtgcagacataaacaatttcctgacaatggatgaccgtgcagcctttcgtttctcagatcttggccagaatgtcatgaacagtattgcaacctatgaaaaacccgtgatagccgctatccatgggtatgcactgggtggtggcttcgagcttgcattagcttgtgatttcaggatatcagatgtcaacacaaagtacggattcccagaggtggggcttggcataatgcctggattcggcggtacgcagagaataatggaacttgccggcccgtcttacggaaagtacctcgccatgactgggaagatcatagatgagaaggaggcccttgcccatggcatagttaacatggtttctgagaattacatcgatgaggcgatgaagcttgcaagggaactcgccgagaagcctgcggtatcaatcagatacataaaagaagtcatgaccagcatcggtagagaaggctatgaactcgaaaaggaaaagtttgcgctgacattcagaacaaaggatgcaaaggagggactaacggccttcaaggagaagagaaaaccgaaattcaccggagagtga

SEQ ID NO: 41780 - DNA, 2313 bp, Thermoplasma acidophilum
ttggatggtttcaggataataatcgctgagaaagctgatgcgggaaggaggatagcgtattttctttccggtgggcaggtcaaatcacatagggcaaagggtacgtcgtatcttgagtttgaatacaatggttccaagacctatctaattccactgtcaggacacatagtcgaagctgacttcgaaagcgggtacagcgactggaataagatagacctatcggacctaatagatgcaaggatagtaaagaatataaagaacaaggttgcgtaccagacgctgcaagcctttcgcgggaaggttgaggagatagtcatcgcaacagactacgacagggaaggcgaactcataggcgtcgaggcgctggatataataaaggagggcaaagaggagatcaggcgcgctaaattcagcgcactcacaaagaatgagatactggattctttcaaaaatctgataggcgtaaactacagccttgccgatgctgcagatgccagggaatccatagacctgatatggggatcggtgctcaccaggttcttctcggtcaccacgggacgccttggcaaatcatttctctctgctggaagagtgcagaccccaaccctggcaatagtcgtagacagagaaagggaaatacaaagtttccggccggagcgttactggacgatatccatcacgttcgacaaggatgggcagttcaaggcacggtatcctgagaatataaaagatcaggataccgcagaaaagatatatgaagccataaagggaaagaatggaagggtttcctcatatacatcgaaggaagatcacataagaagaccagccccattcagcacgacggaattcctcagggaagcttccagaataggaatcatgcccaccaaggccatgagcatagctgaaaatctttacatgagggggctgataagttatccgagaacagataacaccgtttacccaagatccataaacctgaaatcagttctgaaaaaacttgaaaatactgcttactccaaatacgttaaggagatcgaaaccttcgatagaatattaccctccagggggaggattgagacaaccgatcatccgccaatatatcctgttgattcgccaaaagaacagctcaaaggtgattacggccgcgtttatgatctgatactcaggcattttctgtccacactttacagagacggtaagaaaaccgttgccgaagctgaaatttatgtcaatggctacacctttaaggccgcaggacagcacacaaccgaccgtggctggacggagatatacggatatgacccaaaggacgtctatctcccagaactcacagaaggagaggatctaaaggccatagactggaacatccagagagaagagacgaagccaccgccaaggtacgatatgtcatccctgcttaagaagatggaggaactcaaccttggaacaaagagcacgaggcacgacataataggaaagttgatagagaggggcttcatcgaaggaaacccagtgaagcctaccccccttggcatggcatttatagatgctgtgagatccgtgaactcgcacatagcagatcctgagatgacggccaaacttgaagaggacatggacaggatcgagaagaatgaaatgagcaagaatgatgtcgtggaagaatccaagaaaatgctccatgaggtcctgagccacttcctgaccaagacagcggatgtgaaagacataataacaaagggcataaatgcaggccaggagataggcgattgcccgttccatgagggaaagaagataatggtcatcagggatcgctttacatacactgtaagatgcgaagatccatcttgcaagataaacttcaggataaaaaggaatggatctataacactgtctgaccagaaatgccctgtgtgtggccttccaatgataaagataataaggaaaggacagtctccggagatcaaatgcatagatccagactgcagctataaccgagaaaacgaagattatggagaatgccctgcggatcacgggaggctggtcctcaggcagtcaaaatacggaaagcgcttccttggatgcagcaattaccccaagtgcacggtcacatatcctctacctcaaatggggaggataacaaaaacaggcgaagtgtgcccatactgcggtgctcccatactggctttatcaagaaatggaaggaagtggaagttctgccccaacatgcagtgcgagtacaacaagaaaaggaagccggaggctgcggtggagaagagtgtaaggaaaaaggggagaaatgcgagcaaaagctga

SEQ ID NO: 41781 - DNA, 783 bp, Thermoplasma acidophilum
atgatgaactgttccatcaagatcgataacgtctccatgagatacggcgaaaaactggctcttgatggagttacactggatattcctgagggaactatatacgggatacttgggccaaacggatctggaaagaccacccttatgcgcataatactcggccttctcaagcaaacagccggaagcgcaatcgtgtgcggttatgacagcacacgtgatcagatgaagataaaagaaatatctggttatgttccagagaccccaatactgtatgaatccatgacaccctcggaactgttcagtttcatagcctccataaggcggatggatgagggtaccttcaggagaagggtagatgcgcttatagatgccttcggtatagctgaatatattaacgaatttataggatccctctcattcggcaacaggcagaaggttgccataatctcggccatactccacgatccaaagatactcatagtagatgaaggcataaatggcctcgatccacgttctgcaaagcttttcaagagcatccttactgatatgagggatcacggtaagataatagtgttctcaacgcatatactggagatcgcagaatccctctgcgatcatgttgcaatactttacaacgggcatatagttgcaaacggaacaattgccgatctcagaaatgaagcgaatgcgccatcccagaatctggaggagatatttctgaagctcacgaatgcggatgacataccggaggttgcaaggtacctgagggatgaaattgaacactaa

SEQ ID NO: 41782 - DNA, 1350 bp, Thermoplasma acidophilum
atgatgcaggaagagctcaacggaattaagataaaagtaacaccgccaggcccagaagcaaagaagataatagacatgaacgaccgatatctggcaagaagcacacagtcgctgcccgttgtgggcaagatcggccgtggcgtatacgttgaagatgttgacgggaacgtgtatctggacttttcaagtggtataagcgttacaaacctcggacatgtcgatccatatgtcaccgcaaaggttgaagatcagctccacaagatgtggcactttccaggcacagatttctatacggagatgcaggttcttgcagctaaatcactaatagaagtcactccaggaaagtttgaaaagagggtattcttcacaaacagcggaaccgaaagcgtggaagcggccatcaaggtggcaaaatcgtacaccgggagaggaatgttcataggcttcatcggcgccttccacggaaggactcagggttcgctcagcttcaccgcttccaagccaatacaccacagaggtttcttcccgtccatgcctggagtggagcatgtaccttacccgaacccgtacaggaatccattcggaatagacggttatgagaatccagacgagcttgtgaacagggttatagattacatagaaacataccttctcaagacatacgttccgccggaggatgttgccggcatactggccgagcccgtacagggtgagggtggatacatagtaccaccaatgaacttcttccgcgaattgcgcaagcttgcggacagctacaacattccactgatgatggatgaggttcagagcggtttcggaagaactggaaagttctttgcctctgagcacttcggtgttgaacctgacgttataacgctggcgaaggctatagcatcgggtatacccatgggcgcagtggttatgcgaaaggagatgaactttaaggaaagcggcctccattcaaacacgttcggcggaaacctgatagcgtcagccgcctgcgttgccaccatcgaggagatgaagaaacttaatgttgttgaaaattcagcaaagcagggcgcttacctgaggaaacgccttgaggagctacagtcaaagtacgatgcgatcggtgatgtgagaggtctcggcctaatgcaggcaatagactttgtcaaggacaggagaacaaaggaaccgaacagcaagctaaggaatgcggtgatagacaacgctttcaggctgggattaatactgctttcaacaggatccagcgctataaggatcatcccgccgctgataataacgcaggatcagatcgatgagggcatagaggtgcttgacaaggcaataaagcagtctctgtga

SEQ ID NO: 41783 - DNA, 1155 bp, Thermoplasma acidophilum
atggtatcacacaggtataagggcttcaacaccaaggctgttcagtctggagagctcagggatccaagattcggaaacgtcaccacacctatattcgagacttctacattcgtatatccgaatcctgaaaaggaagcttacaccgatcacacaagagaccagccttacatatacaccagatggggaaacccaacggtacaggcatttgaggagaagtatgcagcagttgagggcgccgaatatgcactttctttctcctccggtatgggtgcaataacctctgcgatcactgggcttctccatccgggttcaagaatgctttctttgtcggatctctacgggcagacgttttatttttttaacaaggtactcggtgatcttggcataaaggtcgattacatcgataccgagaggatcaacagcctagattttgatccatcaaaatacgatgctatctacatggagtcgataacgaatccgacactcaaggtaccggacataagatccgtgtcagactatgcgaagaaatcccttgttatagttgatgcaacgtttgcatccccgtacaaccagcaccctcttgatctgggggctgacgtagtgatacacagtgccacaaaatacattggaggtcacagcgacatcgttatgggcgttgtgggtacgaacagcaaggagatattcaacagcctcgtcatccgtaggaagacctatggatcgaacccagatcccatacaggcctatcttgcgcttcgcggcttgaagactctcggcttgaggatggagaagcataacagaaatggtatggagattgcaaccttcctgaggaaaaacgattccatatcccgggtttattatccggacaccgaaatgggaaaaaaggtgctcagcgggtttggaggcatggtatcctttgagataaggcgcgatagggatgtccactcatttctgaggaaactcagcataccgatggtggccgcaagccttggcggtgttgaaagcctcataacactaccggcggagacttcgcattcctcgctgtccagagaagaaagggaacgaatgggcataagcgacaaccttgtaaggttctcaataggcatagaggatgcagaggatctgatcgcagatatccagaatgcccttggagcttga

SEQ ID NO: 41784 - DNA, 582 bp, Thermoplasma acidophilum
atgttcatagctattgagggcatagatggcgctggcaaaacaacacttgcaagaggcataggaaatatgctattgggcgaaggctatcgtgtctacatgacgaaggagcctacagatggcatggaaaactatgctggcgatggagtagaactttttctcaagttcacgataaacaggtatgcgcatcaaagagagatagatcgtcacattaagaatggtgaaattgtcatatgcgaccgctacataaggtcatcatacgcatatcagtttgaaggcatagctgagttctttggaaattccgaaaaggcgtgggagtggatggacagcgtatctgaaattataaagatcaggccggatgtgcagatatacgtggacgtggatgaggaaacagccatggaacgcatatccaggaggggccttagaaatccacattttgagaacgagcagaagcttaggagtgtacgccagatatacaaaggatttcagtgggatctgatcgttgatggtggcagggacaaggaagcaattatatctgaaacctttgaaaaaataattgcgaggttacgtcaggaaaagacatga

SEQ ID NO: 41785 - DNA, 2610 bp, Thermoplasma acidophilum
gtgaacggaaagaaggtttactattatccactgaggaagatcttcggtgaaaaggtgaacagcctcccaagatccctgaggataatactagagtcgatggtcaggaatctggatggaagatcaatttcagatagcgacataaatgccattctcaactggaatgcggagaatgttgccgataccgagataaggttcaaggtctcacgtgtggtcatgcaggatttcacaggtgtgcctgcagttgttgatcttgcctcgatgagggataccgtcaagaatcttggaaaggacccagagctcataaatcctcaggtgagggtggatcttgtaatagatcattcggttcaggttgattattacggggaaacgttcgccctggagaagaatgaggaattagaatttgacaggaatatggagaggtacaggttcctcaagtgggcacagaaggctttcaagaacttcaaagtcataccgccaggtaccggtataatacaccaggtcaatcttgaatatctggcagaggtcgttttcgaaggaaaaaaggatggtaaagattacgcttacttcgattcgcttgtgggcacggactcacacacaaccatgataaacggcataggcgtactgggctggggtgtcggcggaatagaggcagaagctgcattgctcggccagccaataacgatatccctgcctgaggtcatcggcgttcggatcaagggaaagatgcaaccgggcgtaacagctacggatgttgtcttaacagtcaccgagatgctcagaaaggtcaacgttgtggacaagttcgttgagttcttcgggccatccgtgaaatatttatccgtgcctgagagggcaacgatatcaaacatgtgccctgagttcggtgcaacgtgcgcactgttcccgatagacgatcagacgctgcagtatctggagacgactggaaggccaaaggatcacatagatctgataaagaaatatctggaggcgcaggggcttttcggagagggcgcagaaccgaagtacacaagggtgatagaactagacctgtccaccgtcaagcccagtgtggccggcccaaagctccctcagcagaggctggatctcgatcaggttccggcaagcttcctctccacgctcgaacagaacggaggcgaccgcctggttacgctgcgtaaagtcccactcaagatgaagggccaaaacctagaactgtcggatggagatatagttatagcagccataaccagctgcaccaacacaagcaatccatacgtgatgatagctgctgggctgcttgccaagaaggctgtggaagctggcctgaaggtgaatccaaaagtcaagacaagcctggccccaggatcgcgcgtcgttacggattacctgactgaatccggactcctatcataccttgagaagcttggcttctatatagtcggatatggatgcacaacctgcataggaaacagcggtccgctggatcaggatctgggtaacgcaatagtcaacaacaatctcagcgtggtatctgtgctttctgggaaccgcaacttcgaggccagaatacacaaggacgtaaaggcaaactacctaatgtcacctccgcttgtggtcgcatacgcactggccggaaacataaccgttaacctcaacaaggatccgatagcgacggtaggtggaaagaaggtctacctgaaggatatatggcccactaacgaagagatcaatgaggctgtaaacaaatacgtcaggaaggacatgttcgagaagaggtatggaaacataaccaatgagagatgggaaaagatagatgcaccttcatccccaacctatgcctgggatccaaagagcacatacataaggaacccgccgttcttcgagaatttcaggctggatcaggagttcacagatttccgcatcaagggtgcctatccactgctcgtcctcggagattcgattacaacggatcacatatcccctgcaggatccatagcaaaggacagccccgccgccaaatacctgattgagaacggcgtcaagccagaggatttcaactcgtatggatccaggcgcggaaaccatgaggtcatgatgaggggtacgttcgcaaacgtcaggataaaaaacctcatggtgaagagagagggaggatacacattattcgtaccagagaacaaggagatgtccgtttacgatgctgccatgcagtacaagaagatgggcataccggttgtcgtcatagctggcaaggaatacggtaccggaagctccagagactgggcagcgaagggcacataccttctgggagtgaaggccgtcatagcaaagagctacgagaggatacatcgcagcaacctcgttggaatgggtgtgatacccatcgagtacgaaggcttcaatccgcaggatatcgattatacaaagacaatagacgttgacatagggagcatcgatccgggatcgaaggcaaagattacctatacggacaagaagggtgagaaacacaccatcgatgtgaggctcagggtagatacgccagctgaatcggattacataaaaagtggcggtatactgcaatattcgctcaaaaagatactggcctcatga

SEQ ID NO: 41786 - DNA, 1218 bp, Thermoplasma acidophilum
atggcatatattcaagtgaaggaggatggaacccttcaggttccagatagagtaactataggatatatagagggcgatggaataggacctgatatatcaaagacaacgataaacgtactcaacgcagctcttgacatcgcctatggtggaaagcgttcaatagaatggaagaagatacttgcaggagatgaggcctacgataagaccggtgacaggcttccccagtcatcgctagatgaactgaaaaagtgtgtagtttcgctgaagggacctctgacaaccccaataggagaaggcttcaggagccttaacgtcactttgaggcagtacctcgatctttatgcgaacatcaggcctgtaagatacttcccaggcgtgccttcccctgtagttcatccagaatatatgaacatggtcgtcttcagggagaacaccgaggacctgtatgccggcatagaatggaggtacgattcagatggagccaagaaggtcagggaattcttggcgtcaacattcaacataaacctaacaagcgataccggcatagggataaagcccataagcaagttcaagtccacgaggcttgtcaggaaggctatacagtatgctatagctaacaagaggaagagcgtaacgcttgtgcataagggaaacataatgaagtacactgagggggcattcaaggaatggggttatgaggttgctaagacggagttcggcaactacaccgtgacggaaacggaataccttcaggatcctgaaaaatactcgaacaagatcgtcataaaggatcgaataacggacaacatgttccagcaggtcctgaccaggacgcaggagtacgatgtcattgcgacgcccaatctgaatggcgactacctttcagatgccctggcggcccaggtcggcggcataggcctggcacctggagcgaatataggcgaccactatgccgtatttgaggccgtgcatggaacagcaccgaagtacgctggcatggatgttgcaaacccaacatcgctgatactctccggagagatgatgctgcaacacattggctggaacgaggctgcgaacatactcgatgaggcaataatgcagacgtacagggatcagaagctgacgcaggacattgcaaggcttcttaacgtaaaagcacttaaatgctctgaattcggtgaggagataatcaacaggatgaaaaaacctgttcactga

SEQ ID NO: 41787 - DNA, 729 bp, Thermoplasma acidophilum
ttgaaaaacatggttggatctgcgatctacgtctatctagacaggcccgataagaagaatgcacttgacattgaatccataaagggattggagaaagcgctggatgaagcatgctctgatgaaaagatacgtgcagtggccatatcaggtaagggaaaggacttctcggcaggcgccgatatagatatgctgtcctcgttcgacagctcttcagcctatgaattcaggatggccatgaaccgtttatccaggaagatgagggatcttccgaaacccgtgatagcgatactgaagggatactcactgggaggaggccttgagcttgcagaatctgctgacataaggatagcattgaaggacgccatcatagggcagccagaggtctccataggaataaacgcaggggctggtggaaacgtcatactgccaaggatcgtgggcagcggaatagccatgtacatggcgatgagcgggcgcaggatgaacgccagcgaggcaaaggccattggccttgtggacgaagttgtggacgatgaggatcaggcgaggaagatagttgaggatatctcgtcaaaaccggcggtgacccttcagtacataaagaagctcgtcaatgcatcactggacctgccagtcgaccgcgctatggaggaagaggcattatatttctccatgctattcacacggaaagaggtaacggatctgctgaacagatggaggaagagatga

SEQ ID NO: 41788 - DNA, 1845 bp, Thermoplasma acidophilum
atggtacatctgcctaatgtatacactgcattccatggatcagatatttatatataccatctttcagctgaaacaactatgctcgcgatcgacgaatcagaactcaatcagcatgcaatgaaatggatagagggaataaagaaattcacagaggcagaggatgttgtggtatgtgatgggacgcctgaggagttcaaacagatatccaatgaattaatcaaatctggtgagttcataaagctcaatgagaatcgttatccaaactcgttcctatacaggagcgataggacggatgttgcgagaagtgaggaacggacattcatagcagcgcccgatgccagcatggccggatctctgaacaaccacatgacgctgcaacaggtcagcgaagtttggaacaaatttttcagaggtgcttacagaggaaaaaccatgttcgtaataccttatgcactgggcccgcttaattcaagattcacagactatggcattgagatcaccgacagcagatacgttgtgcttaatctccactacatcacgaggatgggcaaacaggttattggaagcatgcctgaaaagttcgttaagggcgtgcatgcgacgggcacgcttgatcctggaaacaagttcataatacatatcccgtgggacaagcctgaaggggtggatgctgacatactcagcgttaatacaaactacggtggaaatgcactactgagcaagaaatgccatgcactcaggatagcttcggtgagggcaagaaaagaggggtggctggcagagcacatgctgctgcttgaggtggaagacccgcatggaagaaaggtttacataacaggtgcattccccagcgccagcggaaagacaaacctggcaatgataaaccctccaaagcagtatgcagaggctggatggaagaccaggctcttaagcgacgatatagcttggatgaagatgaaggacggtatgctgtacgctacaaaccctgaaaacggtttctttgccgttgtacctggtacgaactacagaacaaacaaaaatgccatgatcacgctgagcagaaataccatattcaccaacacaggcatgacgaagacaggcgaaccatggtgggagggcctcgatccgctgcaggaggaactgtacgattggaaaggtgttctcaggaaacccgatggtgaaccaatagcgcatcccaactccaggtttacgtctccgctttcaaattatccgtttttatcggacagatcggaagatccggaaggtgttccagtctctgccatactgttcggtggcaggcgcgcatcactggtgcctctcgtttacgaggcattcaactggaaccacggcgtcttcatgggcgcgacgatgggcgtggagaagactgcggcatctgagggaaaggtaggcgaactccggagggatccgatggccatgcgtcctttctgcggctacaatatatctgattacttcaggcactggatagagatgggacggaagctaagccgcaggccgaagatattctacgtcaactggttcagaagaagacaggatgggtctttcatatggccgggcttctccgagaacttcagggtcatagaatggatactgtataggctggaccacaatgacaatgccatagagaccccaattggatacatccctgagaatataaacacagatggcctgaaccttaccaaacaggatatggaggaactcttcaggatcgacagagatggatggagggaggaaatgaagagtatcggagattacttcagccagataggaaatataccggaggatctcctgatcgaattcgagatggaaaagagaaggatatcttag

SEQ ID NO: 41789 - DNA, 1851 bp, Thermoplasma acidophilum
atgattgatattgaaatcggcggagatgcgccatttttcaggaagatcaaggtgcatctaggcaaaatagatgcaagtaccgcttatgtcgaaggtacgttcaactgtcagggcgagggcagcatagtcctggaggggaacagcgaatcgacagatgaagtggatggcctcgttccagataaatacgaatttaggatagctctcgatcagtaccggtttctgaggaatagccagtcaagatctaacatgttccaggtatcattatggcttgatgctgtgtatcacgatcctgatctttctcaattttcctgcatacttgacgataggttgatggatattaggatagctgtgcccaagcaggtggtctcggttcgtattttaactgaatcggaggttaaggtggtctattccagaagatcatcccaggcgacctacgacattgttgaatttgttatttcaggagtatctgggtatgcctttgaggtggatcaggtgagatatccggatcatggatactacagatcaaccaaaaggataaactcagagggtaactcgaagataatgtaccatatattcccagatcgtttccatcgttatggtgaagatcgtccgggcctcataaaatggggcgagaagccgtctcgcgactcattcttcggcggtaatctggaaggtataaggcagaagatccagtatatcaaggatctcagggtggatcacatatacctgaatcctctattcaaaagcaaatccaatcacaggtacgatgttgatgattattacagcatcgatgagttgttgggtacggatcaggatctgaagaatctcgtatcagatgcccatgcaagcggtataaaaatagttcttgatatggtcttcaatcacacttcaaccgacttcccggccttcagagatgtaatagagaagggcaggaattcaccttattacagatggtacatattccacagggatgaattcacagtattcaggggaagaggaaagagaggtagttatccgtcctatgagacgttcatggggtacggaggcatgccgaagcttgatcacagaaatcctgaggtgaggcgatactgcataaatgtcctgaaatattatgtgcagaagttcgatgtagatggattccgctacgatgtggcgcattccatatacagcaaattcttcgaggaggtcttcagtgagatcggtaccggaattttgcacataggggaggcgtggtgcctgcccacctaccttgtgaacggatcagcatggcagagctatacaaattatttcctaggcggatccatcatcgattttttgaagggatcgataacgctgggagaattctacgatagggtgcagagaatgctgatcgtcaatggtatagagaaacagcaggccatgatgaatgttttggattctcatgataccccaaggatcttaaggatcctgaatggagacaggaagaaggttaagctggcctactcgatactctatctgttcgatggtatagcaacaatctactatggcgatgaggttggtctggatggcggaaaggatccggacgacaggagatgcttcccgtgggattctatggatgaagatatgcacagcttcttcatgaacttgggtgatctgagagaaaaatacagtcttggatcagctggcgtgataacggtctttgaggacgaagcatcattcgtcatagagaaggtcaaggctggcagatccatatccgtacatatggcaaagaatgggcgcatgaaatttccgaaagactcattaatcgctgtgagggagaatcagaaagaagtcaagccatgggatttctatatatatctccgtacagtctaa

SEQ ID NO: 41790 - DNA, 840 bp, Thermoplasma acidophilum
atgataaaaattcctcaggcgggtagagacttggaaaccatagctgtgataggcgcaggaacaattggatcggccatatccatatcgcttgcaaaggcgggttatcatgttatttccacaagaagaaggccggatctgaatgcaggtctcaaggcatatggcattacggtaacatcggataatgttcaggccgtaacctcggccgatatggttatactgacgctgaagcctgctgatctggtttcagagatgaagaagctatcccagatcctcgagggaaagatcgtagtttccatggccgctgcagtccccattagggtgatacgtcacatccttcccagatccttcatagtgagatcgatgacgaacatagccgctgaggtcaatgcaggctacacacctttctgcaccctggaagaggatgaaggtaagatctccttcgtcagccgtgtactgggggtgttcggggaaacggagcgtgtagatgaaaaatacatggatgcgctgaccgcactgagcggcagcgggccagcctacatactgaccataatagaggccatgatgtatggcggcctgaaggttggtcttccgagaagcattgcactgaaggcatcataccagacggtaatgggatctgcaaagctgcttgccatgagcggcgaccatccatcagcaataaaggagaaggtcataacgcctggcggagtcaccattgatggcatatacgagcttgaaaatggcaagataaggacatcgataatgaaggccatagaatcgtcaacgcttaaggcaagaaagatatcgaaggatctttttccagaagaatctgataagaattga

SEQ ID NO: 41791 - DNA, 1581 bp, Thermoplasma acidophilum
atgaattcagcagaattgcagattcacacggatacagaacgagttgaggaaaaatatatacgcgaggatagaaaactgagaaaggatctcggcattgtcgatttattcctcataggcataaccggcgtgataggatcaggatggctatttgcgccactttacgctgccagagttgccggcccagcctcaatcatatcttgggcaattggtggtgtcctcgtccttcttgtgggattaaccttttcgcatttaatgggtttcagaaccgaagcaggagggatggtaaggtatccaatatatacgcatggtaaactggcgggttcgatcaccggatgggcattatggcttgcctataccatgaatccaccgagtgaggccagtgcgcttgtggaatacatgtcttcatacgtacccggagtgttccatagtggtacgttgacgcctgaaggtatgggcatcgccttaggtttcatgtttctatttgtgcttgtgaattattatggtgtcaagatatttgctagaataataaatgggctaacggccttgaaactggttgtgccaacagtgaccatgctgaccctcatcctcctatcattcagattcaggaattttacggtttcgggattttatccgtatggactttcatcggtgcttgcagcgattgtctccgcagggatcgtatattcataccttgggtttcaagccgtaattaaccttgcaggcgaatccaaaaggccagctagagacgggccaacagcgctcattcttgtcatcatcttttcgcttgtattctatatagcactggaaataaccttcataggttccgttccttcttcctttctgcgacatggatggtctggattgtttctggcctctccctttgcagatatagctctgtatttcaacctgacgtggctctattcgctgatcatagctgattcgatatattcgccaagcggatcctctatggcggccgtagcttcgaactccagggcaacgtatgcactcgcgaaggatggtttcttcccatcattctttgttcgcattgatggcaaaactggtataccacgaattgcgctgatatttaacttcgtgatctcagcgatcgtacttttgacgctgaagagctggcattccataattgaggcactaggtgtgcttctgctgatatcattcattggccctgctgcgtcgtccggcgttataaggcgaacatcgccagagaatcagatactgaaggggctttatggagtagtacagcctgcaatcttcgttatggctgggatcataattttcattactccgttcaccaagatcgacatagtcatagctttgttctctattccggcggtgctgctgatattgaaagaaaagaatttcagaaatgttgacctaggatacgggatttggctaccggtctatctgataattattctttcgttctcctttctgcacacctactatgaatcgttaaacatacttgttcctatcacagctttcgtatttctatcattatttgtatatattatcgccgttagagctggaatctctttcatgaagtccggaaaacaaaaagaataa

SEQ ID NO: 41792 - DNA, 525 bp, Thermoplasma acidophilum
atgtctcttgtaaacaaagcggcacccgatttcgaggctaatgcctttgtaaacgggcagataaagaaagttagactaagtagctacagaggaaaatgggtagttctattcttctaccctgcagatttcaccttcgtgtgcccaaccgaggtcgaaggcttcgcagaagactacgagaagttcaagaagaagaacacagaggtaatatcggtcagcgctgacacggtgtacgttcaccaggcttgggttcagcacgacgagagggtcgcaaaggcaaagttccccatggtagaggacaggaagggtaccatagcaagggcatacgatgtgtacaatgaggagactggcaatgctcagagaggcctgttcataataaacccggacggaatcgtcaagtatgttgtcataacggacgacaacgttggcaggagcacagacgagaccctgagggttctcgaggctctgcagtcaggcggcctatgcccggtcaactggcatgagggcgaaccaaccataaaggtctga

SEQ ID NO: 41793 - DNA, 2691 bp, Thermoplasma acidophilum
gtgataatagacaggattcgcctgattaacttcctatcgcatgaggacagcgagatattcttcgacacaggtgtcaacataatagtagggcacaatggggcaggaaaatcaagcataatcgatgcaatacgctttgctctgttcggagataagaggacaaagaagatcgaggatatgataaggaagggcgcaaagagtctggaagttgaaatggagttcaggcatggagggcacacctacataataagaagatcgataaccagaagatccaagaatcctgagagcaacgccatgataatggtcgatggaagtgcactttcccagtcggtgaaggacgctaacgattacatcgaaaagaacataataacaaagagcaaggacgtgtttctcaactcggtattttccaagcagggtgagatggacgatctcatctcaggtgatcctgcaaggagaaagaagctgctggatgagatacttgagatagaaaagctggaagaaacgtacgatgttctcaaggacgttatcgattccctgcaggccggtatatcgaacctggattaccttatatcggagaacgaaagagatagagacgatcttcgcaggtatcaggatgatgtggctgaattatccaagcaaatagatcaggaagaggccatagaatcagatctattaagaaaaaaggaggaggcgagcgcagagtacaacgctgtcagcaaggaactcattatgcttgatgcgacgcttaaaaacatgatgtcgcttagtgatgaagccaataggtacgaagaagaaatcagaaagatcgatggcaaactacaggaaatatcaggatcgacggagagatacaatgagataacgtcatccaaggtgtatgcaagcagggagaggatcaggggctactggaccgacaaggggcagatcatcgactaccgaaagatgctcaagaacatcgacggccaggtacagagctacgaggataacatgaagaaggccgcagaactccaggctgatcatgatcagtatgagataatgcagagaaggatggacgagataaagcatgagctggatgatctgcgcacctatgaaagcaagtacgtttctctcattaacgaaatagaacagaaaaagaagaagagggaagaatacaggaagaagcagaaggatctcggagatgagatatcgcggactctgggaagggcgttcgcaaatgcgagcgaactggtagccatatacgaagaaatacgcagggatatcgatgaaataaacacggatctgggcaatcttcaggtaaagataggggcgcttcgccagaaggaggaagagatccgcaggaacatgaatatgcttgaagggcacaataagtgcccggtctgcggcacggatcttggcgatgaaggatcgaggaggatacgcgaacactattcggaagatctgaacaggctgaacgaagagatagatcatcttgaacgtgaggcgtctgcaatcgatgagaagaagcggcagctcatatccatggagtcgtatctagcgaaaggcaaaattagggaatacgagacgtatgataggcaaatgaaggatctcgaagcacagataactgatgacgaaaattccctttctacaattgcatataagcacacgaagtatgaacagcttgatgaagagtatagatcgatgcatctcgaggatctaaggcagaagtatactgattggaacaatgcgatggccgtaatatccaacattggagatatagaggccttgagaaagcagaaggatgaagtttccaaaaagctcaaggatgcagaggataggacgcatgagatcgaaagcgaatttcctgatatcaattcgtatacgccctcctatatcggcaagatcgaggatgaggtcaggctgcttgaaccacagatcaagctggccgaagacctgaaaaggcagagggaaacgctcagagaaaaggtcaaggatctcagatctagatccgcaggcatggatgagattcagaaacgcaaaaatgaattgtcagttaaggcgagtgagtcagaaacgcgcctcaagtatgtagaagggcagatccaggccacgttgtcctcactatctggtaaaagatcaaaggttgaaacgctgagatcacacgtgtctgaaatcgaacaaaggatcagtgatagagaacgcgatattgaaaggatgaagaaaatcgagaaagccataaatgatgtgaaaagaataagagaggctttcggaaagaacggtgttcctgccatgataaggcagagcgtttccgattacctgactgcgaaaacacgtgactacctgtctagcttcgatcttgattttgacgacatatccgtggaccaagacttcaacgtgacggtatacaggggcggtgttccagagggcatagattcgctcagcggaggcgaaaagacagctgtagcatttgccataagggtggcggttgcgcagtttcttaatgcagatcttagcctgctcattctcgatgaaccaacggcgtttcttgacgaggagaggaggaacagcctttcggatataatagagtacacgctcaaggacagctcggtgataccgcaggttataatcatttcgcaccacagggaactgcttgccagtgcaaatgtggcgatagaggtgaagaagataggtggaagatccgttgtttcaaacgccgattag

SEQ ID NO: 41794 - DNA, 1158 bp, Thermoplasma acidophilum
atgccagaaactgaagaaattagcaaagggcttgaggatgtcaatataaagtggacaaggctcacgaccatcgacggaaataagggaatcctgcgatacgggggctattctgtcgaagatataattgcctctggggcacaggatgaggagatccagtatctgttcctgtatgggaaccttccaactgaacaggagctcagaaaatacaaggaaaccgtccagaagggttataagataccagattttgtcataaacgccataaggcagctgccaagggaatcggatgctgtggcaatgcagatggccgcggttgcagccatggcagcatcggagacaaagttcaagtggaacaaggatacggacagagacgttgcagcagaaatgatcggcaggatgtcagcgataaccgtgaacgtgtacaggcacataatgaacatgccggccgagcttccgaaaccatcagacagctacgctgagagcttcctgaacgctgcgtttggaaggaaggcaacaaaggaagagatagacgccatgaatacggcactgattctctacacagaccatgaggtgcctgcatctaccacggcaggcttggtcgcggtatcaaccctctcagacatgtactccggcataactgcagctcttgcggccctcaagggtccgctgcatggcggtgcagctgaggcagcaatagcgcagttcgatgagataaaggatcccgccatggtggagaagtggttcaacgacaacataataaacggaaagaagagactcatgggcttcggccacagggtatacaagacctacgatccaagggcaaagatattcaagggcatcgctgagaaactctccagcaagaagccagaggtgcacaaggtatatgagatcgccacgaagcttgaagactttggcatcaaggcattcggttcaaagggcatatatccgaacacggattacttctccggaatagtatacatgtccataggattcccgctgaggaacaacatatacacggcgctcttcgcgctatccagggttacagggtggcaggcacacttcatagagtacgtggaggaacagcagagactgattaggccgagagccgtttacgtcggtcctgcagagagaaagtacgtacccatcgctgaaagaaagtga

SEQ ID NO: 41795 - DNA, 807 bp, Thermoplasma acidophilum
atggacgagaatagaggaagcagaatagccataaacctgacaggaaaaatagcacttgttacaggttcaagttccggtctcggagctgccattgcgaagtatatggccagagccggcgccaaggttgcagtgcattaccgcagcggaaaggatcgtgcggacgcgatcgttgatgagataaaaaatgatggtggcttcgccatggcgttctatggcgatgtatcaaagaaggaagatgtccagaagctattctcagaaatagacagtaaactcggcactgttgatatacttgtcaacaacgctggtatagacggtaagcgagaactggttggcgaagatgatcctgatgactgggagaaggtaatagaggtcaacctcatgggcccttattactgcgcaagggaagcagttaagcgcatgaaaccgaaaaaaagcggtgtgatcataaacataacgtcagtccacgaatacgtaccatggtccggatacacagcatacagcagtgcaaaggcgggtctttctatgttcacgaaggcactggcacaggagctgtctgattacaacatccgcgtggttgcaatagcgccaggtgccataaagacacccataaacaaggacgtatggggcaatcccgaatcgctaaaggatctgctcaacaagatagcgatgccgaggcttggtgaagttgatgatataggccaagcagctgtctttcttgccagcgatcttgcctcatacataaccggaacaacactgcttgtcgatgggggcatggctctctatccggatttcaagcatggcggatga

SEQ ID NO: 41796 - DNA, 627 bp, Thermoplasma acidophilum
atgcaattcagcgtgggaaacatttatcagccttcagaatgtcatacctgcatggatgatcagacattcatcagcaccataaaaactggcgacaaaaagaagatagaggaaatggcggatgatctatggaattacagggatctgtatcagaggaatgcgctgatgatctcggccatgtacgggaggactgatctgatagaattcttcgccgcaaggtacgaccacatcgatgatagggacatagaaggaaatacggcattgatgtgggctgtgcgtaacaacaggatggaatcagcgaaaagcctcatcgcactgaaatgcagcattgatatacctgacagcgccggcaatacgccgatctgctgggcagtaatattcggatacacagatatggtcaagctgctcatatcctccggagccaatataaatatatcaaatgatgagggagatacccctgcgatacttgcctctaagtacggaagatccgaatgtctcaagatgttaatagaggctggttgcgacctgaacgcaaaaaaccacaatgctcagaacgtgtggaaggctgcggaggcctttggcagaaaagaaatattagaagttctcgcatcgttatccaacggtaggtga

SEQ ID NO: 41797 - DNA, 555 bp, Thermoplasma acidophilum
atgagtgagagagaaaagatcaccatagagaatatagtggcatcaacatcacttgcggagcatctggatctcagcaggatcgcactcgccctcgatggatcagaatacgaacccgagcaatttccaggcctcatatacaggcttcaggaaccgaagacagctgtgcttatattcaggagcggaaaggtgaactgcactggtgccaagaatatcgaagatgtcaagaggacaataaagatcatcatagacaagctcaaagcagcggatatagaagtctacgacgatccccagataatagtacagaacatcgtggcagtctacgatctagaatcagagctcaatctgacagatatagccatgtcccttggacttgaaaacgttgaatacgaacctgagcagtttccaggtctggtatacagggttgaggagccaagagtggttctccttctattcggttcaggaaaggttgtctgcaccggagcaaaggaggagagcgagatagaacaggccgtaataaaggtcaagaaagaactacagaaggtaggcttgatctga

SEQ ID NO: 41798 - DNA, 849 bp, Thermoplasma acidophilum
atgtttgaaagaaatttgctcgagggaaagatcgcactcgtaactggaggaggcacaggaataggtttcagcataggaaagcggtatggtgagctaggtgcatccatagccatatgcgggcgcagggaaaatgtactggctgatgctgtattcaaattcaaggaggctgggatcgacgcagattctcatcgctgtgacgtaagagatcctacccaggtttctgaaaccgtcgatcacttcatggatcgtttcggtaaaattgacgtcctggttaacaatgcggccggaaatttcgtctcaccaactgagaagctatccccgcatgctttcgacgccgtcataggcattgtacttcatggtacagtgtatatgacgcttgaacttggcaagcggtggatcaggaatggccagcatggtgtggtccttgacatcgtaacgacctatgcatggaccggatccggctacgttgttccgtctgcagctgcgaaggccggagttctcgcactggtaagatcccttgccgtggaatgggctaagtatggaatcaggcatgtggccatagcacctggcccgtttccaacggaagcaacgagaaagaatctcttccctatccccgaaatagaggatcgcatagtgcaaagggtcccgctgaagaggcctgggaggatggatgaaatagcaaacctcgccgcctacctagtttccgatggggccgaatacatcaacggttcggtagtgaccattgatggtggtgaatggctcaagggagctggccagttcaaccatcttgaaaatctgacggaggatcagtggaagatgatctacaagatatcgagaaaaaaagaatga

SEQ ID NO: 41799 - DNA, 1356 bp, Thermoplasma acidophilum
atggaagaatatgacgtcatcacgataggtgcaggaggcgctgcttatccagccgcgttcaggcttaagagatcaggtttcagcgttctcatgatagataagaagggcgtgatgtcgggaaattgccttgcagaaggttgtgttccatctaaagctgtgatcgaaacggtgcataatctggcgaagatgaggcatttcggtgattattccatagattacagtaaaatcgtcgatcacaaagacagtgtccagaatataagatatgaacagcatgaccaagagctcaaggaagcgggtctgaagataattaagggtacagcaaggataatagatgacaataccgttgaagtttcatcggataccggaacatcaagatacagatcatcatcagcaataataatagcttcaggttcagaaacctttgtgcccaagataccgggcgcagaacttgcctggacaagcgcagatctttattcgctgaagccaaaggtgaagaaacttccaaagagcatcgcgataataggcggtggatacattggtatggaaacggcttcattcatgtccatacttggtgtaaaggtaacggtcatagagatgctggacagggttatgagcaccatggatgaagccatggtggataaacttttaccgctgctgcccaaaatggatataaggacggcttcacctgttcagtcgatagaaaggaacggaagcatgtaccatgttaatttcggcaaagaaggtgagaaagaatccatagaagttgaagctgttctgatggcagttggaagggttcctgtatttccggaaggcatcgacgatctcggtattgagcacgacagacacggaatcaaggttaatatggcgatgcagaccaacataaagaatatttatgcgaccggtgatgtcaacggaataacgccgctcttccatgcggccaagaggcagtctttggttgctgcgaataacataatggcaaacaacgtaccgattgactacttcgatccgctttcagtaccattcacagtgtacacaataccgcagatggcctacgttggaatactgccgtctcaggcacggaagatgggcatagaataccttgagacagattatcagattgagaaggatgcgttggcgcagatcaacaacgagatgttcggggagatcaggatcttcacggataaaaggatgaaggttatagggggctacgtgatagggaacgacgcagggaacgttataaatgagattgcactggctgtttctaaggggctcagcttgagagatctagctgagatggcacatcagcacccaatgaccttcgagggaatagattctgctgcaagaaaactctactga

SEQ ID NO: 41800 - DNA, 1458 bp, Thermoplasma acidophilum
atgtatagagagaagttcacgaagataacagaaggcttcacttttgatgatgttctgctcataccaatgcgtacggctgttgaaccaaagaatgttgttgtttcgtcacgcataagccggcacatacaggtcaaggttccaatagtaagctcgcccatggacactgtgacggaagatgcaatggcaatcgccatggccagatatggcgccataggcgtaatccacaggaaccagccacgggaaaaggaagttgagatggtaaagcgcgtgaagagggaagagaccatcataatacgggacgtgtacacaataagccctgagacgccaatagaggtcgcaaggaccctcatggcaaccagaaacatagccggactccctgttgtgaaggatgataagctcgtcggcatagtcacgaagagggacctggagttcgtgaagaagggctcatcggtatccgacgtcatggtcagggatgtcatcaccgctccggagaacgtggatatagacgaggcaatagagatactgcataagaacaggatagagaaactgccgctcgttgacagttcaggccatctcgttggcctcataacagcaaaggacatcataacaaggcaaaagtttcctgatgcttcgagggacagcgagggccagcttatggtcggtgcagcggtcggccctttcgatctggacagggccgtggaggtcgagaaggcaggggcggacttcatagtcgttgacaccgcacatgcggacaacgagaacgtcctttcctccctcaagaagatgcggaagcagatatccgtggatatcgttgccgggaacatagccacggcgcaggctgccgaggatctgatttcctgcgacgtggatggcctcagggtgggcataggcccgggatccatatgcacgaccaggatagtggctggcgtgggcgtcccacagctcacagcgatatcggatgtggcagaggccgcgaaggacagcgggatacccgttatagcagacggaggcataaggtattctggggatatagtcaaggccatagccgcaggcgcagatgcggtgatgcttggatcgatgctggcaggcactgaggaaagcccaggccaggagatgataataaacggcaggaaatacaaggcatacaggggcatggggtccatcggtgctctcacaaccggcctatcggaccgatacagcaagcttggcaacggtttcatagctgagggcgtggaaggcgctgtcccatacaggggcagggttgatgaggtcctgttccagctggtcggtggcctgcgcacagggatggggtatgtcggggcagccaccatagaggatctgaagaggaacggcaaatttgtgaggataacaaataacggtctcagggagagccacccgcacgacataaggttgataagcgaaccgccaaattaccagatatcgaatataagcccgtag

SEQ ID NO: 41801 - DNA, 858 bp, Thermoplasma acidophilum
atgcagaaaaacggggaacctgttctcttcttcttcatggcattcttctggggcctgaactatataatggtaaaatacgcgtacgtatacgatgtttcctcttcgatcctgctgatgagggttctttacgcactggtattctcagctataatcttcgtccggcagataagatttccgagaacgccaatggagcacctgaaggtattcgtgctttctaatctaaatataacagcattcttcgcactttggttcttcggagagaccggagtaagtgcatcgctgacgtcgatcgtgatatattcgtacccgatcatgtcgctcgtcgcatcgtacgccctgctcaacgacaggtttggcaggggcaaggccatgggcatagcgcttggcttcgccgggctcataataatcttcttcagatccatcaacgtatcaaactacatcgatctgataatgctaattctcgcagcattgagctgggccatgggcacagtattctacaggaaattcctgacaggatacgattcagcaggcctgaacacccttcagctcctctacgcgatgccagccgtcatcctgatcgctttcatgacagggggaataaacagaaatctgatgataccgcagttcaaccttataatgctgtacatgggatcgctgggtactgcggtcgcgtatttcatattcctcacgctctacaggagatacagggtcagcgatatatcggcgtttttcttcattgttccggccataagcgtgatcctctcagtcatcctgctgcatgaggccgtatcaaggatcatgctgataggtttcgctgtgatgagcgtgggtatctacctgtctggacgcctcaggtga

SEQ ID NO: 41802 - DNA, 918 bp, Thermoplasma acidophilum
gtgcccgataaagtgatagaggtcgaacacctccggcagacctacgatggcaggacatttgtcgtagatgacgtttcattttatgtgcttaagggtgagatctatggcctccttggcaaaaacggtgccggaaagaccacaacgataaggacgatgacaacgatactcccggttcattacggaaaggtaaggatccttggcatggatgtatccgaaaacgcggagaagataaggagacgcataggcgtggttcttcagaacgagtccttcgacttcgccagcgtcgagcgaaacctgaaggtttacggcatgctctgggatgttcccagggaggtgctgaaggccaggatagaggaggtgcttgaggtcttcgatctgggccagctgaggaaggtgagggctatggagctctcgggagggcagaaaaagcgtttacaggttgccagggaattcctgcatgacatggacctgctgtttctcgacgaaccaacggtgggcctggatccgataatgcgccgttccgtcctgaattacataagggacaaggccagaaagggccttaccgttctttacacaacccagatcatggaggaggcagattacctgtgcgacaggatcgccatcatgaacaggggcaagatcgtggcagagggtacaagttcagatctaaagtcaaaatatggcgatctcaaaacaatacatgtcgtggtgtcaggcgaaatcgattacgaggatctaagggcgaagtttcctgaggacgtcctgtttgataatgaggagatacgcatcgtatcgaagaacgtggaggacatactgccagatctcataatatacctgaagacgaagggtataaggatagaaagaataagtgtagaggagagcagccttgacgatgtattcctgaaggtggtatcatga

SEQ ID NO: 41803 - DNA, 1860 bp, Thermoplasma acidophilum
atgttctattataagccgtccgatgaagccatcgcggaaaccaatcttgggcgattcgcctcatcccttgggatgaccgtaaaggatctctacgccagggccgacagggatcctgagtggttctggccaagggttatagatgatctcggcctggaattcttcaaaaaattcgaccatgtaatggatctatccgaaggcgtaccgtgggcgaaatggttcaccggcggcagaatcaacatcgagtataatgcggtggaacgctactccgattccgaaaatactgccatagtgtatgaatctgaggatggctataaatcaaaaatgtcatactcggaactcaacagaaaggtctcggccttatcttcggccatccatgacatgggcataggcaggggggacagggtcgccatatacatgccattcaatgctaacagcgcaatagcgttctatgccgtcctccgcatcggtgccatagctgtgccgatgttctctggctacggagttgatgctgtcaggaacaggatcgaagattcaggatcgagcctcatgataacgtctgcatcgtacaggaggaagggaaaggccatcgatatgtccgcggtcgcaaggagcatcaatatgaaaacgataatggatgccgatcgcacagatttctacagatttgaagatgctgtcagcggcggcaaaaatgtgccagtggagcgtacatcgagcgaagaccctgccataatgctctacacatcaggaactactggaaagccaaagggcacggtacatgtgcatggcggcgcgctagtcaacatagccaaggaagtcaagtattacatggatctgaaagagaacgatgtgctgcactggataactgaccttggctggatgatgggcccatgggcgcttattggcacgaatgcgcttcacggcacgatattcctctacgacggcgcaatagactatcccgatcctgacaggatattcgatattgtgcacgataacggcgtaacgctccttggcctctctcccacggtggtcaggatgataaagttcaggggcacgagcaggacgttcgataccgtgagggtattcggatcaactggggagccatgggacgaggagtcatgggtatacctgttcagcatactcggccgcggccgtgcatcgatttcaaacatatccggcggcacagacataatagggtgcttccttgcctcaaatccggccataccgcagaaacccagatgcctctacaggggacttggcatgaacgcatcgatattcaacgaggagggaagggaggtatacaacacggtggggtaccttgtggcaaagtttccaagcccatcaatgacacgcgggctttggaataacagggagaagtacctcgaaacttactggtcgaaattcaaagatatatggttccatggagacttcggtgagatggatgaagaaggctacttctacctttacggtagatccgatgacgtgataaagatcgccgggaaacgcgttggccccaatgaagttgaggatatggtgatgcgtgtcagcggcgtgacggaatgcgcggtggtatcgatacctgacagcgtcaaaggggaggttctcgccgtcttctacgtcggcgaaccgggcctgagcgggagaattgcaaagcagatagaggttggcatgggaaagccattcacgcccgcccatgtggtgcgcatatccagaataccgaagacaaggaacggcaagatcatgaggagggtgataagatccgccttctgcggccttcccgttggcgatgtgagcaacaccgacgacggcgacgtgataagggaaatagatgaccttgggaaggttgcccttcgccaggcttag

SEQ ID NO: 41804 - DNA, 1149 bp, Thermoplasma acidophilum
atgcagggttatacagatgcgtccgaaatgataagatcatccataagggaattcgtccggagggagatagaaccgctccgatcaaagattgacagggatgattattttccagttgataaattcagaatgatggggaaaatgggctatcttggggtgaccgtaccccctgaatacggaggcagtggggcaggttacattgcacaggcaataattgaggatgaacttgggtattcatcgccatctttggcgctgtcatatggagctcacagcaacctgtgccttgataacatatacaggaacgggtcgaaatacataagggagacctttgtcccgaaacttgcctccggcgactacataggatcgctgtgcctcaccgagccgggatccggttcagatgcccttgccatgtcaacccatatcgatgaagtcgatggggaactttacctttcaggaagcaaaatgtttatcaccaacgcgccgtacgcagaccttttcctggttcacagcagggacggtgacggatactcatcggtgatagtactggccagtgatggcggattcaacagggggagatcgcttgagaagatgggaatgcgcggttcgccaaccggagagatattcttcaacagggtcaggatcgaacctggcaggatagtagggggtagaggatcaggtaaaaaaataataatgtctggactgaactctgagcgtgtgatacttgcattcatattcataggcctggcaaggcgggccatagacgaggccgtgaactatgcctcacagaggaaacagttcgggcagcacatcgcggacttcgagctcatccaggagaagctttcgtacatgtatgtgaggtatgaggccagcaggatgcttgccttcagggctctggagaagctgcagttcgatatgatggatccaatagacgctgcatcagcgatcatgtatgcttccgaatcagcagaatacatagcaagagaggcgattcagatcttcggcgggtacggatacataaaggataccggcattgaaatgctgctgagagacgcgatcctggggcagataggtgcaggaacaactgagataaggaagcgcgtgatcgccagatccctggtgaagatgtacgaggagggcagaaggatcgagtga

SEQ ID NO: 41805 - DNA, 1491 bp, Thermoplasma acidophilum
atgatagagatagatggcagatcactgagggttgaggacgtctacgccgttgcggtggaatacgatcgggtaagtatcagcgatgataccctcaaggcggttgaagagaaacacgaggcctttctaaaactgataaattctggcaaaactgtttatggcgtcaacacaggcttcggaagccttctcaacgtccatatcgagagggatcaggagatcgaacttcagaagaatctcatcaggagccattcatccggggtgggggattaccttgaaaatagatacgtgagagccataatggcggtgcggttgaacagccttgccgccggttattccgcggtatcggctgatctcctgaacatgatggtcgagatgctcaacagggatgtgatcccagccgttccaaaatatggttctgtcggtgcaagcggtgatctggcacctctggcacacataggcctggcgatgatgggtgagggcaaggcgttctttgaagggcgccttatggattcggccagagcactggaaaaggcaggcctcaagccgtaccagttcaaggaaaaggagggtgtggccctgataaacggcacctcgttcatgtcaggcatactcagcatagcagtgatggatgcgcacgatattcttgaaaatgccataagatccgcgctcctctcattcgaggccctaggcggaacttcaaaggccttcaccccgtggattctgggggcaaggcctcatcttggtcaggtggcaataggtaaccggttcagggaatacctcacgggaagcgatatagttaagagagcagacagcgtgaaggttcaggatgcctatacgctcagatgcataccgcaggtatacggatcggttgcggatgtgatcgactatgttgagaacgtcctctccgtagagataaattccgcaacagacaatcccctgttcaacggcgaggaggttgtttctggcggtaacttccatggcgagccggtggcgctggcggctgactttctggcgatagcgctgacagacctgggcaatatggtggagaggcgcatagcccggctcgtggacacgaacctcagcggtctgccccccttcctgacgccggacagcggcctcaattcgggttacatgataccacagtatacggcagcagcattgtgcaacaggaataaggtgctggcatatccttcatctgcggacacaataccgacatcagctaaccaggaggatcacgtgagcatgggtgctactggatcgctcaagctgctggagatcatcgacaacgtccgatacattatagcgatagagtacctacttggatcacaggcgctggagtttacggataaagggatgtccccctccaccagaaagatctacgagaagataagggagaaagtggaaaagctggatcacgacagaccgccttccttcgatatagagacaataagaaagatgatggacaagaaagaattcatatcggcccttccatga

SEQ ID NO: 41806 - DNA, 858 bp, Thermoplasma acidophilum
atgataaaactgtacgataactacgtcttcatatcgcaggaaggcggagagagcggagaacggctctattccaagaaattccgtgaaaagagcgtggtggatgtttcaggactgcgcataggcgagggcctcgtggttgcagccgggccatgctcggtggagaatgaggccatgatacttgatattgccagatcggtaaaggccgccggtgcagatatgatacgtggcggtgcgttcaagccgaggacatcaccgtattctttccagggcctggcggagaagggcatagaatatctcgtggaggcgagggaagaaaccggcctgcccatagtcacggagataatgaatccggagtattacaggtacttcgacagggtggacatgctgcaggtcggttcaagaaacgcgcagaactttgatctccttcgctttctgggaaagcagaagaagcctgttctgctgaagaacggcatgggcaacacggccagggaatggctggaaaccgcagaatacatattgtctggagggaacggaaatgttgtgctgtgctacaggggcgtgcgtggcatagagaactcaacacgcttcacgatgaacgttgggagcataatatacgcaaaatccgaaacgcatctacccatatgcgccgatcccagccatgcttctggaaggcgcgatttcgtggaatcgatggcccttgcatcggttgcggccggtgcagacatgctcgaaatagaggtgcacaatgacccagacaacgcgctatctgattcagaacagcaaataaggcctgttgatctgaagaggatcatagaaaaggcaagagccctaaaagatctgctgtctcatgaaatataa

SEQ ID NO: 41807 - DNA, 768 bp, Thermoplasma acidophilum
atgagcggaaaacttgagggaaagatagcacttataaccggtgcaagtaagggcctgggccgcgctatagctgagaaattcgctgacgaaggcgccaaggttgccataaactacaacagcgatgagaagggcgcactcgaggtgaaaaggcgaactggtggagagatcttccaggccgatgtgtccaacagggatcagatccgcaggatggcaaacgagatacacagcaaactcggaaagatagacattcttgtgaacaattccggaatatggtacctcatgcccttcgaccagtacgatgaatctaaggttagaagaatgatcgatgtgaacctcatgggcgctatatacaccactctggaattcctccctgacctcaaggagaagagaggagttatcataaacatggcttcaaatgccgggatcggaacggcagccaggaatacgaccttctactcgataacaaaggccggtatcataatgctcacgaagaggctcgcatttgacctgtccgaatacggaataagggtcaacgcaatagcaccgggatggattgaaacggatctgacaattggcggaaagagcgaggaagagataaagcggctggaagacgacttcagatccaggacgacgctgaagatgataggcaaaccggagtacatcggaaatgccgctgtgttcctcgcgtccaaggactcggaatacatgaacggtcaggtcatggtgatagacggcgggaggatagacaaccttacccacagcatataa

SEQ ID NO: 41808 - DNA, 1458 bp, Thermoplasma acidophilum
atggaaaatggagtcagatattccgatctcatcgaaaggctagacatgagcagggtaaccaggttttactggttgctgaccattctggccacgataggtggttttctattcggatacgatacctctaacataggctctgcactgccattgcttgaaagaatatacccaggtataagtggttttgttgagggctacttggttgctggggcctcgcttggtgccgctgtaggcgcgataatagctgcgggactaacggacaggtacgggagaaagtacctgctcatagccgatgcggctatttacgcagccggtgcattgctctcagcattcaccgtggatctggtcatgctgctgctttccaggacgctaatagggattgctgtcggcgcagactccggcatagcgacagcttatatagcggaatatgctccaaaggccaggagaggaagcctcggcattctgcagcagtggatgatcaccatcggcattctggcagcttacctaatcggaatggcaaccctgttcttcgcacccggcttggcttatgcagttggttggaggataatgctgggcgttgccgccataccagctatcataggtctcgccttcaggttcatgatgccagaatcgcctaggtggctcctcgttaatggaaaatacaaggaagcatccgcttccctgaagaggctcggcctcaacatgagcgaggaagatctgaaatctgtaaagctatcacagccccacaagatcactcctggcgtaaagcgtgctctcctcatcgtgggcctgttctttgttttccagcagatcaccggaattaacataccgttttactacggcccggttgtgctggagaaccttcacatagttggaaaatcgacatcgctcgtttacagtatatactattcaatcgccgcatccgcaatactggcgatcataaacgtggctgcaacgtatataggcttccgctacatagactccgtcggaaggagaaaactggcgctgatgggatacgctggcatgacattcttcggaatacttggtggaatactgctgtacctcaagttagacataggcctgttcatagccttcgctggcttcataatattctttgccttcggtgttggcggcaccggctggatgatacagggagaatacttcccgaccagcatgagggggctgtatgcttcccttggtgcgttcatagactggatagccaacttcgcaataatagagcttttccctgtcatggactccgccataacgataaagaatgtggagtttgttttcggcgtcctctcgctgatagcgctgatactcttctactatataatgccggagacgaaagggctgtccgtcgagcagatagacacgctttttgaaaacaacagcctcgggcagatgaagcatgcctctatatccatgaagaaggagagcgttccagcagacccgaaatga

SEQ ID NO: 41809 - DNA, 1374 bp, Thermoplasma acidophilum
atgaggacagaaagggatgttatcggggaggtgcagctgcccgacaatgtattttatggcataaacacggcaagggcaagggagaacttcaggatcaccgggctgaccgctgattctgatcacatcgtatcaattgcgcaggtcaagaaggctgcagcgcttgcaaatgccgacggaggcgcactggataaggagaaggcagattacatttcaaaggcatgcgacgagataatcggcgggaagtaccatgaccagttcgtgatagacgtctaccaggctggcgcaggaacatcctacaacatgaacgcaaatgaggtcatagccaacgttgcgctgacactgatgggcaagaataagggagagtactcggtgatacatccaaacgaccacgtgaacatgagccagtctacgaacgatgtttatccgacgatgatgcgattaacagtctccaagaagatcaggaagctcaaggatgcactcaacgaactcatagagagcttagaggcaaagagcagggaattcagggggatcgcaaagcccgggaggacccatctccaggatgctgcgcctgtaacgcttgggcttgagttcggagcctacgcctacgccatgaagaaggaccgtgatgagataatagatgcctcggactacataatggagctgaacataggggggacagcggttggcacggggataaacactgcgaagaactatcaggaaaacgtggtgaagcacataaacgagataacgaaggagaacttcaggaaaagcacgaatctgctcggcataatgcagttcatgacggatttctccagggtcatgaatgcggtcacgaacctcgccctggatgttgagaagatagcaaacgacataaggctgctttactccggccctggcgcaggcatccatgagataataattccagctgtacagcagggatcatccataatgccgggcaagataaacccgtccatcgccgaggccatgaacatgatctgccactcagtcataggagcgcagcaggcggttaatatgagcgttcaggcagggcagcttgagctgaacgtgatgatgcccaacatcgactacgagctgacgagatccatagacataatgacaaacggcctgaagatgttcaagcagaaactcatagacggcatcaaagctaacgttcctgtatgcagagaacacctggcgaacagcttcggttcagcagcgctccttaacccctatctcggatacgataacgttgcaaagatagtgagagaggccgttgaaactgggaaatcaataaaaagcctagtactcgcaaccggaaaactgacagaagagcagtacatgaagataatggacagtggggttccaaaggactga

SEQ ID NO: 41810 - DNA, 945 bp, Thermoplasma acidophilum
atgagtgagatatactctcttaaaaatgtaaagaaatattatctggcccagaaacgtggtctgatagacgctcttgttaaggttccgaaaatatatgtcagggcgctagacgatgtgagcatatcaataatggatgggaacgtcataggtgttgttggggaaagcggttccggtaagtcgaccatgggcaaggttatggtaaccttggagactccgacagatggcgaactctacttcaagggcactagggtcactaagtcagagtacccaaagataaggaagcaggtggatatggtattccagaaccctgccacatcattgaaccctaaaatgaaggtgaaggacatagtttctgaacctcttgggcactttgacgaaggcgccataaaggaggtcattctgaaggtaggtctttcatacgacgaggtcaaggacaagcaatccagggaactttcgggagggcaggttcagagggttgcgatcgcacgtgcgttgatgaagaagccggaactgctagttctcgatgaaccaacatcagctctggatgaatcaatacaggcacaggtcttgaaccttctcgtcgacctgcagacagagtataagatgacatatatatttataactcataatatactggtagcaaaatacatatcagactatatagtggtattatacgctggcaaaatagtggagtatgggccgacttcagaggtcctttccaagcctttgcatccctatactcaattgcttctaagttccgttccgacggttgatgttaaggatgtgaaaccgcctgtcggcgatgtgccgagcctgataaatcttccacagggctgccgttttaaccccagatgcccatttgttatggaaaaatgcaggaaagaagaaccacctctgataagtcaggggcagaattatcaggtggcatgctggctgtatgaataa

SEQ ID NO: 41811 - DNA, 1233 bp, Thermoplasma acidophilum
atgacagttaagatatatggatctggcggcagcggtacggttgcacttccctcctcaaagagctttacacagcgttatatacttggatctgtgtttttgaacaagagcgttacactcaactacgtgacgatcacaggcgatgactccatagctctggatatagcacagagggccggcgcaaatataacgatgaatgacagcagcataaagatcaggacctcgttcacgtgccctagcgatatctatgtgggggagtccgccacgtcttatagaattgctcttggactgctcggatcagccggctgcatcactcacgtaaagggcgatccggaccttgcaaagagaccgatggatcctctggtgaaggcacttgaagcgaatgatgtgcatctgaagctcaacgaagatggcttctacgacgtcgatggatcggaatcaaagaagagatacattgaggtagacggcgtgagctcacagttcgtctcgtccatgatcttctactatgcaaggaagggtggaggcgagttcctggtaaagaatatgcggtcgccaggctatgtttacataaccaagcgtgttctgtacgatctcggttatttcgttaacattgagaagacaataacgatcaatccatccggcgtttggaagacggcaatagatgtagaaccggattactcaagtttggcatttttcctcgtcctcgggctgctctccgaaaacgttgatgtgaggttcaatataaagcgcatgtcgaggattcagccggattcggttctccttgacatgttcaaggacaacatagcgatagacagggatacgctgagagtgcttccaggaatcagggacaggatcacggttgacgccgatcacaatccagatctatgcccaccgatctccgtcataggcatattctctgaacacggtgttgagatcgataactatgcaaggctgaagaccaaggagagcaaccgctatgaaggcataatagatatggcctccaggttcggtgcgatcgtcgaggacaacggaaaggatctcttcatcaagagaggcgatctgaaggatccaggaacgctatcatacacagaccaccgcatgataatgagcgccgctgttgcagcagccgcatctggattcgaggtggaaatagagaacgaaaccaaggtctcgaagagctttccgggcttcttcaaggaactctcaaaatttgcaaacgtgagcgaatcaaattaa

SEQ ID NO: 41812 - DNA, 807 bp, Thermoplasma acidophilum
atgaacggaaatagcattatcgggctgatcgggcatcccgtatcgcattccataggccagatactttacaacaggatctttcaggacatgggcatagacgccttttacttggcgatggatgttcacatgaacgttcttccagcattcctgaagaattctttttttctaaaagcgttcaacgtgacgataccgcacaaggtatctataattccattccttgatgatctggatgaaatagcatcacaaacacgttctgttaacctcgtgataagggaacagagccgcatgaagggatacaacaccgattactacggtctggactacgcactatcttttaatcaagttgagattgaggaaaaaagaatcgtgatagccggttccggcggcattgcaagaacagtaatcagatacatgctggatcatggcgcgcatagagttgacgttctgacgaggaatgcacagaatgccagaagaaatctggatattccaggcataggcctgcatgaaaatatcgatgaggactacgacatctacgtgaactgcacacccctgggcacacttggagacggcgatcccttctcgactgtcgatttccgcagcgggcgtacgggcatagatctcgtctacaatccacctgacactcccttcctgaagagaatgcggaatgcgggcggccgaacggtctccggcctggatgtcttcatagggcagggactccggacgctggaacttgtgttcgggatcaggccagacagtatcttcagagaatatgcagtggaggctctgaatgaaatacgcaagggttag

SEQ ID NO: 41813 - DNA, 1083 bp, Thermoplasma acidophilum
gtggatgctcagagattcgtcctgccgatgaatggcgagaatatatccgtggttataggagaagatatcacaggccatatcagcgaggaggtcggccactatgacagcctcgtctttatgataagcagaaatgttgaggagatgttcggttccaagatacccccgcttgaaaattatggaagcagcacgatcaagatcacgcttaacgacggtgaatcgctaaagacccttaggaattaccagcgcataataaaggtacttgtggaaaaaaaggtcagcaggaactctctgcttgtatacgttggcggcggcacagtgggtgatcttgcaggcttcgttgcggcaacgtacaagaggggtttgcgtatgatagccgttcctaccacactgcttgcacaggtagacagctccattggaggcaagaacgggctggatttctccgacgtcaagaacgtcatagggacgttctataatccatacctgataatcgatgatctgcagttcctgaagagcactccggatctcataagggaaggcatgggggaggtcataaagtacagcataatagccggcggagacatgttccgcaaggtttcagaatgctcattatcgaacttccacgatcactcagcggatatcgtgaagatgagcataaagatcaaagcagacatagtcaacagagattactatgacagaaatggagtgcgatctatactgaacctgggccatacgatagcccacggcatagagggtgcttcaaaggggcagataagccacggacgtgctgtggccaccggcctcatggtggaagcgcacataggcgagaaatacggaaacacgaggccagaagtcatcgacgagataatgaagcttgcagataactacggtatagaaagggtacgcatatcggacataggcgtcaacagcatactgaggtatatatctaacgataagaagatgtcggagggttacatcaacatgcctgtccccgcggatatcgggaatataataaccatgaaggtcaccgagaggatgatcagcgacgggctgaacacattcatcagagagcatgaacggaaatag

SEQ ID NO: 41814 - DNA, 1977 bp, Thermoplasma acidophilum
atggagatcaacaaggtaactgtcataggatccggaataatggggcatgggatagcagaagtcatagctcttgctggcattgacgtcaacatcgaagatatttcaaacgaggttctggacaaggcgaaggcttccataaattccagtctggacaggttagtcagttctgggaaattgaaaaataaggatgaagttttatcgcgtattcactatttcacggatataccttcatctgtgaaagatgcggacctggtaatagaggccgttccggaagtattggatataaagaagagtgttttcgaccagctggacaagagcacaaaggacagcgccatacttgccacaaacacatccaacatcaggctcacagagatcgcggagggaataaagaaaaagggcaaggttgtcggcatgcacttcttcaacccaccggttgtgctaaagctggttgaggtcataagatctcagtacactgaagatgaagtattcgaaacggtttacgaattctcgaagaggattggaaagacacctataaaggtctacaaggacaccccgggttttgtggttaacaggataaacgctccggaatcactgtacttttgcctggtgatagataataatctggcgaagccggaggaggttgacagattcgcacgatcacagggactgcccatgggaccgtacgagcttatggactacgtcggcatagataccgtctatcattctctacagtactacgcaaaggagctatctccagattattctaagtgccaagtgtacacgaagctcttcaatgagaagaagcttgggctgaagaccggcgaaggtttctacaaatgggtgaatggtaaggcgcagatacctgaggcaaagcccacaaaggccgtggagcttatggacatcttcgctctggagataaacgaggcggtgaagataatagaggacggtgttgcctcgcccgatgatatagagacgggtgtaaagctcggaatgaacagaccattcggcccgataactgtggcaaagggcttaaccaatgctgaggtaaaggctaagctggaggcactctaccagaaattcagcgtggaggtcttcaaaccggcgaagtccatagctgaggggaagctcaagacggttatatcgatgcaggtagcgctctccaaggccgaagagaagaaggaggcagcatcagcatacatttcatccagcgatccagtaataatggagacgaagggcaggatcgccatacttcgtataaataatacgaagaataatctgataaatgcagcggtaatggatggtctcgagaaggcccttacggatctttggaacaaccgtgagatatctgttatcgtattgactggaaatggcccggtcttctcagctggagcacagctggactcgttcttcagcagcacctttgacttcatggagttctccaggcgtggagagcgtgtttttaaactgctaagtgagataccgaaggttacaatagccgagttgaagggctacacactcggcggaggattcgagatggcactcgcctgtgatataagggttgccaccgaggatgtgcagatagggttcccagaggttacacttggccttgttcccggatggggtggcacacagaggctctcacgtacagctggacagtccagagctgcttactatatactcacaggtgagaggttcacaggcaaagaggcttatgagatgggcatcgtcgcgaagatattcagcaaggacacaatcgactcggagacgctgaacctggctcagaacatagctgataaggttgcaccaatatctgctgcactggctaagaggcttgttctcaggagcacgaacacatccctggatgatgggctggagatggaagccatatcgatgggcctgctctacggtacagaggatctcaaggagggcatctcggcattcctgggtaagagaaaaccaaattatcagggtaaatga

SEQ ID NO: 41815 - DNA, 1593 bp, Thermoplasma acidophilum
atggaatacaaatatgagttgaccatagataagctgttgcagagtggagtgtcatccaaccctgatcagataataaactacaccggcaaaagggagttcaccttcaaagatttctccaaaagggtgaacacacttgccaaagctctgatatcaatcggcgtaaagaagggcgatagagttgccgttatagactgggacacttacgtatatctagaggcctacttcgccgttccaatggtcgatgcagttctccatacagtgaacgtccgttacccgcaggatctcatatactatacaatggatcatgctgaggataagtacgtgatagtgagggatgagtttgtaccgatactatcgaagaacagagaagctttctacttcataaagggatggatcgtctactccgagacagggcagattccggactccctgtcaccaaaatatgtgtacgatgatctgatgaaggaatcctattctgacatagaactaccccagctgtcagagaacgatctagcaaccacgttctatacatctggaacgacaggcataccaaaaggggtgcagttcacgcacaggcagatcgtactgcactccatatcatccggactggcgctcgccgacgatcctatcaaccttacgtctcgcgatgtgataatgccgcttgtgccgatgttccatgtgcatgcctggggtgtaccatacatgagcataatgtcaggtagacgctacgtgcttcctggcaggtacgactttgatcacataatcgatctcatcgataaatacaacgtaagcgtaatagctatggtcccttcgatactgtatctcatagttacaaatccgaatgtgaagaagatcgcaggacgcggaataaaggcgatagtcggaggcggagccctgccagaaggcttagcaaacgcggctgagaagctcggaataactgccatatcgggatacggattgtctgagaccgctccgatactcacgcttgcgacgtacaacgagagggtaaaagcgatgccagaatccgagaagaaaaaattcaggctcaaaaccgggattccgatacccctggtgcagctcagggtcgtagatgacaagatgaacgatgtgcccaaggatgagaagactataggcgagatcgttgttcgggctccatggctcaccagcgtttacgtgaagaacaaagaagggacagaggctctgtggcgtggcgactggatgcacaccggtgatctcgcggtgatggatgagtacggctacatacgcatcgttgacagggagaaggatgcagtaaaatcgggcggagagttcataccatcgctggtccttgaggatgccataagctcatgctcaggcgttgtcgagaacgccgtagtgggaaggcctgacgaaaagtggggagagaggccagtggcgttctacaccggcacggccaagccagatgagataagaaagcatctcatcgagatggtaaacgccggaaggatagcaaagttctggataccggacgatttcataaatataaaagaattcgcaaaaacaagcacaggaaagatagataaaaaggttctgagggaaatgatcaagaaatga

SEQ ID NO: 41816 - DNA, 981 bp, Thermoplasma acidophilum
gtgaaagaattcgctgcaaaggagatcgaacctgtatcgaaggacatagagatcaacggaattcagcgttcgctaaaggaaaagatcgccgggcagggtttcataggggcaacgcttccagcagagaagggaggcgccgggctggatgagaacggatacatgataattctggaggaaacagcaaaggcctcaccatcagtttcaatgtggatatttctaacgaacctctatcttaagctgaatcctgacagcgataagaaggccaacatcttgtccggaagtatcgatgtcacagttgatctatccccatactatctgagaggcaaatctgcggcgctcacggtcaccggcggcaagctcacagggaagatcacgaatgtcataaacggaacggcatcctccatcattgccagcgatggaagcagtatctatgccatagattcgggaatgcatgccgtaagcaaaagccatctcgggctgcggggcatggatctctcggatgttgattttgattcctccacatacgaaaaggtcggttctgaggagaaactgaggatggagctgaagaactcagacggagaggtagcagcaatatttctaggtatagcggatggcacaatgataaaggccgcagactattcaaaagtgagaaatgcctttgatcgcccgctgaaggactacacgccaatatttgatgagatagtgagtgccaagactgagatagatcttattcgcttctacctatatggaaatcagagtgaatacgcaaaggctttgtgcaagatcaaggcaagggagatagcgctgacagccagcaggagttcgctgcagatacatggcggttatggatacatccatgacttcgggatagagaagtattacagggatgccatggccatggctgtgtatttcggagaagattcctgggagaacagcgtcatatctcaggctgtgctgggtgagaagggcggaataatttaa

SEQ ID NO: 41817 - DNA, 1194 bp, Thermoplasma acidophilum
atgagaagaagaaggattacggtgtggccacgctctgtgtgggaggaggccagggctattccgttgtgtttgagaggtattgatatgaatttcgaatttgatgaggctcagaaggagttcaggaagaaggtagaggagtttgcgcggagggaattcacggaagaggctgcatccaagtacgatctccaggagaaataccctgaagaggtcgtaaggaggatgatcagcgagggcgtcttcgattactcgaatccctggaacatacttgttgcaacggagacgttctgcaaatacgatgctggaatgggcatatcaatgctcgtacctttttttggaaacgaagttatagccctcttcggaaacgatgaccagaagaagaagtatctgagcaaggttttttcagggcaagccaagatggggcttgccgtgacggagccaggtggtgggagtgatgttgcaaacataaagacaacagcagtcaaggaaggggatcactacgtactgaacggatcgaagatgttcataacaaacggagatatagcagacttcttcgtgcttctggcaagaacatccgtggaaaagaagaaacaccagggcatgagcgtattcatagtggagaggaacttcgatggtttcaaatctaacaagatacatgggaagctgggcgtaagggcaacggacaccgcagaactgacgcttgaaaatgttaaggtacctgctgaaaatttagtcggcgagccaggcaggggcttctattacataatgactttcttcgatataagcagggcctacgttgcggcacaggccctaggcatagcggagggcatccttgaaagagccgttggcatactccagaaagatggcccgataacgtcccagccagaacgtgtccagttcgctattgctgacatggcgacacgcatagaagctgcgaagctgctgacctatgaggcggcgtccttcatattcaacttcaatccaaacccagccgtgaccagcatggcaaaggcatacgcagctgaaactgcagtttacgtatcaagaaaggcaatggagataacgggtatagatggcctctcgtccaacatagaaagatcgttcagggacgcaaagatcatggagatatgggaaggtaccagcgagattgaaaaacttgtcatcgcgaggatgttgaaggtgggtgatagccaatga

SEQ ID NO: 41818 - DNA, 1191 bp, Thermoplasma acidophilum
atgaacagcgaaaaagtatatctcgttgacttcaaaaggacggcgttttccagatctaggccgaacgatccagagagggacgtgttcaactctatccggatggatgaagccatggcaaagctgataaacgtcgttatagatgagacaggaataaagccagaggagataaatgatgtgataacaggctgtgccctgcagatggacgagaactggacttatggtggaaggcaccctatactcctggcaaatcttccagaaaacgtccctggaatggcacttgacagggcatgctcttcctctcttaacgcaataaccatcggtgccatggagataatgacgggcaactccgatatagttatggcaggtggctacgaacacatgacgcacgttccaatgggaaacagcccattcttaaagcccaatataaagcttatggtgagaccggaatacatgcactgggacatgaatacgggatactccatgggtttgacggcggaaaaactggctgcactgagaggcatcactagagatgaaatggacagatactccctgagaagccatcagcttgcttcaaaggctttggacgatggatacttcaagggagagatcgtaccagttgaggttgagataaacggcgaggaaaaggttattgatactgaccagagcataaggaagaacacatcgctggaagacatgaagaagctgaaacctgcgttcaaggatgatggcgtaatcactgcgggaaattcctcgccactgaatgctggtgcatcgcttacgcttctgatgtcggagaagaaggtcaaggaatacggattgaaaccaatggcacgcatcgtttcctttggctgggcaggcgtcgatccttcaataatgggtgaaggcccagtacctgctacgaagaatgcactggcgaaggcaaagatggatgtgtcggatatagacctgtgggagataaacgaagctttcgccgttgtggtcctcaacgccatgaaggagcttggcattgaggaggatcgtgtcaacgttcatggcggggccattgcaataggccatcctcttggagccacaggtgcaaggatagctggtacgcttgcacgcataatgaatgagaagaagaaggattacggtgtggccacgctctgtgtgggaggaggccagggctattccgttgtgtttgagaggtattga

SEQ ID NO: 41819 - DNA, 1167 bp, Thermoplasma acidophilum
ttggtgttgctttttatgaatttatcattcgcgggctttagtcgaatggttggaataagtatgtcgaaattcgaagaatgcaatataaaggaagatctgaaatcggatctcaagaggatgggttttgttgatatgacggctgtgcaggaaagaacaattgaacctgcactcgcaggcagggatcttataataagatccaagacgggatctggaaaaacggcagcctatcttgtgcctataataaataatatatccctgggaaggaaacccagtgcactgatcgtgcttccaacgagggagctggcattgcaggtccatggagttgcagaaaagcttggacatagctctagaataagatccactgtcatatacggtggcgcctcaatgtcaaggcagattgaactgctggatcgtgggacagatataatagttggcaccccaggcaggatactggatctgcatgaaagaggctttttgaatctttctgcggtaaagtacttcgttctggatgaagccgatgtcatgcttgacatgggttttatcgatgatataaagagaatgatgtccctgctgagagaggacaagcagacgttcatcctctcggcaaccatgccggaggagatcatagatatggcaaacgacttcatgcgagatccggagactataatagtgggatcggatgaggtcacggtcaaggaaatataccactactatgcaatatcaaagagaaacaggaaacttcatgtgctgcagacgtaccttaaaacctacggcccgcagaagaccatcatattctccaggacaaaggtcggcacgaagatggtctgtgattttctcctgaacatgggatacaacgccgtcatgataaacggagatatgagccagagccagagggaaagggcaatgtaccttttcaggaacagagcggactatctggttgccacgaacgttgcggcccgtggcatagatataagggatgttacggacataatcaacttcgatctgcctgacgatccaaaggtgtatgtgcacagggtcggaaggacagcacgtctcggatctgagggaagggccttcagcatagtggaggagggccagagagacgcagtgtaccagattgaacatatggcccgcgttagcctgaagcagataaagctccaggaataa

SEQ ID NO: 41820 - DNA, 2250 bp, Thermoplasma acidophilum
ttgcttgacgatatccgaggttttatgaatacattcagcgaaactatgttcatggacgttataaattattcactcacaagggacaggtatgattctgtgtttcttcaaaggcaaaattatagggatcttggccagctgaaagaaatactcacgaacgatgatgggataaaaataaaattcgatggctatgatttgaagatacagggcacagcagatggcacgataaaattcacgtggactgatggtccagaaattccggtaactgaccctgagttcgtaaaaccacgattggataatggagtatacgaatttggggattacagactgctgatcgaaaaggacggtttttcaataagagatgttgagggaacgatactgcatcgtgagttctttccatcattcggagaaaacataacacatgcattcgagctgaatcagggagatataatagccggcttgggagaaaaggctgcacccatcaacatgattgggcatgtgttcagactatggaatcatgatgcaaacggatcttatgggccagacagcgatccgctctatgtcaacgtgccaattatgcttcacggtcatgccggtaggtttatcctgatattatacgttaacgctggcgatgctacagtggatgttggatattcggacgaacatagggtatcttcatctttcaaatcgaaacctcttgcttactatgtaatcacaggaaatcttgacactatatacgagaagctttcactgataactggaaagccacaaaagcctccctactgggctttcgagtttcaacagtcaagatacagctatatggatacaaaggaggtgagggatctggtagacggatttgcatctagaggaataccactgggtgcggtttatctagatatagattacatggacagattcaagatgttcacgttcgaccctcagagattcggtgacgttaaacagctcacagagtatatggaacagaagggggtaaagctcataacaataatggaaccaagcataaaaatggagcatggtttcgatctctatgaggaaggcctgaagggcggatattttgtcaaatatcctgatggaaacgtcatgtatgcaccggtctggccggagatggctgcttttcccgatttcaccgatgagaaagcgagggagtggtatgcctctaaatacgattttatgcgatccatgggcgtctccggattctggcatgatatgaatgaaccggccatattcgtgggatggggcgataacaccatgcccagatccgccgtgcatcggattggccgccatgaggaggtgcacaacctttacggatactacatggacaaggctgcctacgatcatctgtccaaagttgagaggcccttcatactctcacgatcaggatgggctggtataagcagatacggatggatatggacaggggatacggaaacctcgtggaaggaactgaagcagaacatcatcacaataatgcacatgtcaatgtcgggaataacgctgacaggatgtgatataggcggtttcaccggttctccaacacctgaacttttcataaggtggctgcaggcgtcactgtttttccctctctacagggttcattcagataagaaatcaaagaggagggagccatgggcctttgggagtcatgaaaaggagataatagagataataaggttgaggcattcctttgtgccacacatttacagcgaagcgatatcatcatccataacgggtcttccacttgtaaggcctgtcttctgggcagatccaagtaggaacgatctaatgtccgtggatgatgaatatacgttcggtggcagcatcctgattgcgccaatagtggaggaacacgccgtcatcaggaggataatacttccatctggccgctggtacaatatcagtgatgacaggattgttgaaggaagcctcagcataaacgttgatctttcgacagttccgatattcgtcagagaaggatcggcgatactcagggagaatgatggcattgaactgcatttatatcttgctaatgaaaggagaaaaagcatactgtacatcagtgacggaaatgatgacataaaggttgaggttgaattcgacagtaaaagcgttgatatcaatcctcagaaagtgccgaaaataaaggccatcgtgatgcacggtttcagggaagatgaattgatcctcaatggagaaccgataaaaacaagcgatggcataataaggttgaagtga

SEQ ID NO: 41821 - DNA, 2352 bp, Thermoplasma acidophilum
atgaatccaggtattgaaaaatatgagattcgattcgacttcgacctgaaggatttcacatatacctcccacgagaggatacatctggctggagactggaaggatataaagctggatgcggtcaggctctctgtggacaaagtaacctgcaacggccagcccatgaggttcgaaactggacaagatacggtcacagtaaagggcagctttcacgataaggatgtcatagacatagattttcatgcaaaggtcagtgacacactcatgggactctatctttctaggacaaaggagggtaccatgatcacgacgcaattcgagtcaaacggtgcaaggatggcatttccctgcgtcgatcatccagcctacaaggctgtcttcgccataacagtagtgatcgacaaggattacgatgccatatcgaacatgcctccaaagcgcatcgaggtgtccgagaggaagatcgttgaattccaggacacaccgaagatgtctacgtaccttctgtacattggtgtgggcaaattcaagtatgccaccgacaaataccgcgatatagatctcatactcgtttcgcttaaggacataaaatcgaagtatccccttgagatcgcaaggaaatccattgaattctacgagagctacttcggcattccatacgctctcccgaagatgcaccttatctcagttccagagttcggtgcaggggcgatggagaactggggcgcgataacgttcagggaagttgcgctcatggcaacagagaactccggatccataatgaagcagaacgctgccataacgatagcgcatgagatagcgcaccagtggttcggcgatctcgtaacgatgaaatggtggaacgacctttggctgaacgagagtttcgccaccttcatgtcgtacaagacggttgattcgttcagcaaacagtgggacgtattcgccgacttcataagaagcgagacaggcggtgcgctaagatccgattcgctgaagaatacgcatcccatagaggttgatgtcaaggatcccgatgagatctcgcagatattcgatgagatcagctacggcaagggtgcatcgatactccgcatgatagaggattatgcaggttacgaggagttcaggaagggcatatcgaagtatctcaacgatcatagatacggaaatgcggaaggatccgatctctggactgcaatagaggatgtttccgggaagcctgtgaaacgcgtcatggagtactggataaagaatccgggatatcctgtagtctcagtggtgaaaagtggaaacaaattcaggctgacgcaggaacagttcttccttgacggaacaagaggacaaggaaaatggccaataccgttgactgttatgaccaagtctggaaagaaagccatgctcatggaggaaagcgctgaaatagaggacatggtgaaggtcaatgtcaacagcagcggcttctacagggtatcctacgatggagaatcgttcgaaactgtgatgaagaattattccaagctcagcaaccttgacagatggggcttgataagtgatctctatgctttcctgatctctggaagggtgtccgtggatgattaccttgcaagaatcaagggcttcttcgaggattccgatcatttgatcgtcgaggaaatagcctcacagctcaccggcctctatctgcttaagcctgattcgaacaggatcagagaaacagcagcttcttacctcagcaggcaggtggttgcgcttggcgacaagcagaagggcgaggatgataagatctcgaagataaggggcatcgttacgcaggatctggcgatggtcgatgatcactttgcttctgatttggcacgcaaattctcaacactcgcagaggatcctgatcttgcattggcaaagtctatagcggcggccaaggcatacggcatctccgagcttgccagcgctgcggacaagtacacagacgatgaaatacgcgtcaggatcatagctgccatgggctggtgcagcccatctgacctgaaaagcgtcttcgaactgatcgataaaggaactataagaaaacaggacatgctgtatgtgttcagcaacatgcctgcaaatccgaagggaagagatttcttcttctccaacatagacagaatagttgcactgatggagcatgcgtttgagggcacaggatacaccagcagaatacttgaaacagccataccatacctcggcctggccagatatgaagatgtcaagaaaaaggctgaacagataagaaaaccgagctacaacgttggaataaataagggccttgaaacgctggaaatagtaagaaaattgtataataaattataa

SEQ ID NO: 41822 - DNA, 1002 bp, Thermoplasma acidophilum
atggatcccttcaggaaggccatcaagggttatgatcacgatcggataccagtctggtttatgaggcaggctggaaggtatcttccgtcctatatgaagtataggcagaggatgggcatagaggagatgatgtcatcgccggacgtcatagtggacgtaacgcatgatccggttgataggataggtgtagatgctgcgataattttcgcggatataacgacgccgctcagtggtatggggctcagggtcaggttcctagattctgtggggccagtggttgagaataacattgagaaatcaggtatttctgcggtagaggaatttgatccatcttctttcagccaccctgtcctgaaagcaatatcgaaatacagggagaggtatgcggatcctctgataggtttcgccggcggccctgtaactctcctttcttatataatatcagatggtgtggaccgggatcttttcagggtcaagagaatgatgattacggaggaaaaggcatatcaggctgtgatgacaagactcacagatatgatcattgaattcgccaggatgcagataagcgctggtgttgatgcattccagatcttcgacagctgggcaggttatctctcacctggcgaatacgaacatttcgtgaagccctacgtatatgacatcttgcaggaattgtcaggaagcattccgaccatatacttcagcacgatgacctcatcctacgttgccgatatggatctaccggcagatttctattcaatagactggcgcatagacatgaaaagattttcggctgaaatcccagatgaaaagggaatccagggcaatctcgatccagcgattgtcaactacgattacgcgctgcatgaggcatcgaaaatagtggaagccgcttctggaagagatcgctacatattcaataccgggcatggcctgctgccaagtacagatccagaaaagctaaaacggttggttgaatacgtgcatagcgtgaatctatga

SEQ ID NO: 41823 - DNA, 927 bp, Thermoplasma acidophilum
atgaaatctgctcttcttctgctttcctatggcagccccgagaggatcgaggatcttgacgagtatctcaaaaacatattcaacggaaaaccagtacctgaaagtgtcagggaagagaatctcagaaagtacgagatgttcggtggtagatccccgtccaaccgtataatcgaaagcatcgcgcggaagcttcatgaaaagatcggcgatgatatggacgttatcctggcctacaagcactggaatccatccattgaggaggccgtcaaaggcctcggatcatacgataacatagtagcgataccactcttctcgttctattctcagaacgtgaaggattcgtatctgaatcctctcgaatcggccctcaggaggtacggtttttcgccgcgccttgagtttgtgaacggtcttgcaaatagcgatctctttctgcccatgtgggcgaacatcatatcggaagatgcatccgaagattccttctacctgttcgatgcgcatagccttcctgcacctgacagggaagaggattacctgttctggctccgctattcaacatacaagatatcgcagatactgggcctatcgagatcagactttgggtttcagggtggccatctgggatggcttggcccgagcatatacgatgtcctcaacaggatcgatgcgagcaaaatcacagtcatcccgatatcattcctatacgatcacctggaaatactgtacgatctggattatgagttcagaaaggccgttgaggcaaagggcatgcactatcgtagggtgcgtatgccgaacgattctgccatgatggtcaatatgatagaacgcgcagccaggtctgcaataacgcatctcagtggagagaagattaacggcagcatcatcggccagccccgtattgcggataccgataacggcaggtga

SEQ ID NO: 41824 - DNA, 1236 bp, Thermoplasma acidophilum
atgatcagcaagcttaagatgcctcagccttcggtcaatatagggatggtcggccacgttgaccacggaaagagtacgctaacgctggctctgacaggcacgaagaccgatacccattcggaggagataaagagaggcatctcgataaagcttggttatgcagatacgcccatatacaggtgctacgattcctctggtaacgtgcattacacgcgggaaaaaggggaaaattgcgatctagaaagagtcatatcgatcgtggatgcgccgggtcacgaaacactgatggcaaccatgctgtcaggatccgcgcttatgaacggtgcccttctagtcatagctgcaaatgagcactgcccacaaccacagacaagggaacatcttaccgcacttgagatcatgggcataaaaaatataataatagtgcagaacaagatagatcttgtaacaagggagcgagcaatcgaaagttacagggaaataaagaattttgtcaagggcagcattgcagagaatgccccaataattccagtgagcgcgtaccacagcaccaacatagatgcgctgtttgaagccatagaaaagtacattccatcgcctaagttcaatgaaaatgacgatcccataatgtatattgcaagatcatttgacataaacaggccgggcacgcccgtaagtgaactgaaaggcggagtcattggcggatccttgacgcagggagaatttgccctgggcgatgagatcgagatagtaccgggaatacagacaacgaagggaaacaagactgtatggaacaacgtcaccactgaggttgtgagcctgatggccggcaagtactcatatgacaggataaggccaggtggattggcagccattggcacgaagctcgatccgtttctcacaaagggagatgccttcacaggaaggatcgcagggcacgtgggcaaggttcctccagttgcgttctccatgaggctggaatcgcacctgctcaagagagttgtcggatccgatcaggaactgaacgttgaacccataaggccaaaggaaactttgatgttcaccgttgcaacagcaaacaccgtcggtgttgttaacgccatgaagggcagcgaaatagaggtttcgctgaagtatccagtggcagcattcaacggcatgcgcgtagcaataggtaggcgtgttatgaacagatggcgcctgatcggctatggtataattcagtctctggaataa

SEQ ID NO: 41825 - DNA, 1338 bp, Thermoplasma acidophilum
atgggtttcttcgatgaaatggataacatgaggatgagaccgttccacaggaagatggagatcctggcatcaatgggcatgttcctggatggttatgacctttcagtgatagctatggcaatactgctgatgccaatacagctcaagttcagcaagcctgaatacatacttgtcaacgtgtccgcattagccggcatgattgtaggcgctccgctgcttggtaggctatcggatcgcataggcagaaagaagatatttgacatagatctaatactgttcgttgttttcgctataaccgcaggccttgcgactaacttctggatgatgttcataagcaggttcatgctcggcgtcggcataggcggtgattatccgataagttctacaatagtatcagaatttgcaccggtgaagaggcgcggaacgctgctctacgccatggtaggtatgtactggctcggatcgctgttctccggcattatgaattacacatttgccttcacatattacttctggagatacacgttcatcatcggcggaatagtcgcaataccgataatatctttgaggatgcagatccctgaatcgccaagatggctcgtaagccagggaagggctgatgaggcaagcaaggtcatagagaacataaccggaaaggagccggatctgaacgaaggtgtgatagagggcaaggaggaaagatctgtcaggttcagagacctcttttcatcaggttttctttccaagacggtatttgtgctttcggtatggttcctcttcgatgtggcctcatacggtataggcttctactacccgacgatgatgagggagatcggactgtccgcttcggcactcaacactgcaggcctacgcgtgatcgctgagatcggaatgatcgtggctgtgggcgcaattgtgggctatgccgtcgcgatgatgctggctgatcgtgtgggaaggcgcgtcctcacattggttggcgtcttcgtgatgtttgcacttctgttcctaggttcaatggtaaaaattgtctcgctgattccgctggtatcattcttcttctcattcgtcctgtttgagcagtgggttggcgctgccacactcttctacccaacagagctgtatccgacaaactacagatcgactatacagggaatagccacatcggtttcaagggtcggtgcgataatgggcgtcgtggtgtttcccctgtacccaatattccactcgatgttcctgtttgctaccctcatgttcgtggcctttgtgataacggttctgttcgcaccagagacaaagaagaaaccacttgaaaagatatggaatgcaaaagcctga

SEQ ID NO: 41826 - DNA, 1494 bp, Thermoplasma acidophilum
atgatggcctcggtgacggggatgataggatctggttggcttttttctgccttctatgcatcatccatggctgggccatactcgatcttctcatggctggtgggaactggcatagttgccattctggctctcatttacgctgatctaagtggtagggtgcccatggctggcgcagccgcaggttatccgtttctcaccaacgggacggtggccggatcgctcaacgcatggtctctctttcttggctatgcctcaacgccgccacttgaagtcatcgcttccataagctacctcagctttctggtgcctggacttctcaacaacaacggccttctcaccaccacaggaatattgctcgctgtagctctgctcgtagcgttcttcattctaaatgccactggaattcgaaatacgtccagattcaataacataatatcgtacatgaagatcgcaatacccatcataaccagcttcttcttcatattcaccatattctcaatcaggaacttcaccctggtaggaaccgtaaagcctgagggtatattcacggctgtacctggagctgggatagcgttctcgtttttgggcttcaggcaagccgttgaactctcgggggaggcgaagaaccctcagaagaccgttcccatagccataatgctcagcgtggcggttgcctctgcgatatacatgattgtccagatcgcattcataggttcactgcagtggggcagcatcaagcctggagactgggcagcactggcagacagtggatactcaagcgggccaatgctggtgcttgcgtcaacgctcggccttggagcgctagcaacagttctgctctttgacggcataatatcgccactgggaacaagcagcatttaccagaccacaacctcgaggatctcctacaggataagcgaaatgggcttcttccccaagaagatctcgacgacaaattccaggagtgtgcccatattcgcccttatacttgacctcgtggtgatgatactcttcgttcttccattcccgtcctggcagtctcttgtatctgtcaactcggatctgactatcatcgcatacatgagcggcccaatttcactcgcaatatttgaaaaatacgggatcgaggcgaaaggcttcaggctcccagcatcgaagatactggcaccacttggtttcgcactatccgcccttatagtttactggtccggatatcccacaacgctttacatgagcgcaatagccattgcaggccttgtgctgtttgtttttgctaggaagaacccgatcagagacatttcgcagggatcatacatgatagccatactggcgatactccccgtggtatcatacctcggaagctatgggatagggataataccgtttccgcttgatctgatcgtgattagcgctgttgccctggcaatattctacgctggaactcgggccgcgcctcagtctgtggctctgatggagaacttcatttcttcgtaa

SEQ ID NO: 41827 - DNA, 1314 bp, Thermoplasma acidophilum
ttgtccatcatattcgcaaaacttttattaattattttaagttatacgcatatgaaggaaaaagccagaaatgtttatatggtggctggaggcgtaacaaaattcgccaaggcgtcaccagagatggattttcggttgcgggtgaagaaggcttttgactatgctatgaatgatgcaggtctcacacttgcagacatagatggttcggttgcgtcatatttctctgaccacttccagaggcagctgatgtccggaataatggttcaggattaccttggtctcgtgccaaagcccagcaagagaatcgagggtggcggtgcgactggaggcctggcttttcaagccggatacgaggagatcgcctccggcagaatggacacggttgcagtctatggattcgagacgatgtcccatgtcaacacatggaagggaaatgaattcatagcgctcgctagcgataccaactttgattaccccattggcggcttttacacgggatactatgccatgatggctgtgcgccacatgtatgagttcgggacgactgtggagcagctggcgaaggtatcggtaaaaaaccatggtaatgctcttcacaatccctatgcacagagccccatgaagctgacagtagaggacgtacgcaacgcaccaatggtttcatacccacttacaaggctggacgtctgtgccatgtctgatggagccgcagttgcgatacttgcctccgaagacaaggcctttgagataacggatcatcccgtactcataaagggcataggcacgggcacggattccatgaggcttgctgataggccgtttggagatgtcccgctccttccaaatgagaagccatccgattataaagatctaaagtatccaggtgttcattccttcagggcagggcgaatggccgcgaaggaagcgtacgagatggcaggaataacggatcctctgaacgagcttgatctcatcgagctgcacgacgcctacacatcatcggagatacagacatacgaggatcttggcctatgcaagtacggcgaaggcggacagttcatagatgagggtaagccagagctgcacggaaagattcctgtgaatccgtccggtgggcttctcgcagcaggccatcctgtaggtgcgactggcataatgcaggcagtcttcatgttctggcagctgcagcacaccataaagaagcatttccatgatgactatctgcaggtgccgaatgcaaagaggggactcatacacagccatgccggaaccgggacttatgttaccgtaacgattatggaggcggcaaaatga

SEQ ID NO: 41828 - DNA, 462 bp, Thermoplasma acidophilum
atggaacttttaaacgtaggtgatattgctcccgattttgaaaccgttgatcagtacggaaagactgtaaagctgagttcatacagagggaagccagtggtgctctatttttaccccaaggataatacgcctgggtgcacgacagaggcctgcaacttcagggataatttcaattcattcaaagattccggcgtagaggttataggggttagtgttgattctccggaatcgcacaagaagtttgctgagaagtacaacctgaacttcacgctggcctcggacaaatccaaggacatcgtaaaaaaatacggggtattagggcttgcaaccgccaagagggtaacatatataatagacccggatggcaagatagcctatgtgtatccgaaagtcacgccaaaggatcatgcgcttgaagtcatgaacaagctaaaagatttaggcctagtaaaaaacaattga

SEQ ID NO: 41829 - DNA, 1017 bp, Thermoplasma acidophilum
atggataaattgagggtaggtctccttggatcaacgggcgttgttgggtctctgctatcgaagatgatagccatccatccatactttgatcttgcgaacgtctatgcctctgatagaagcgctggacaaagatatggcaacgttgtctatggtggtgcaagcgatctttataggaatctagaagtgaaggagagcaaccctgaccggataatcagcgaccacaatgatataatttttagtgctgttagtgatgaaaaagctggtttgatagagagacgtttggcagaggctgggttgcctatttttaccaacgcatcagcaaaccgtctcgaagatgatgttttcttgatagttccagagataaatggcgatctggttggcagcatcaagaggaagggtttcataatagcaaatggaaattgcagcacgattggccttgcccttggtattgatccggtcatccgcgggagatccgcagtgaaaatcatagttacgaccatgcaggctgtcagcggggcaggttatcctggggtttcatcgctggatataatcgacaatatgatcccgtacatacagaaggaggagacaaagatagaaagagaaacgaaaaagatattctccggaaaactggacacagaaatattcgctactactacgcgcgtgcctgttaaaattgggcatatggaatctgttcatatagaattcgatcaggtattggacccatcagagataagggcagaatttcgcagttatggcaatgggctgttgaaaactgtctatccatccctaccagatagatcggtgattttactggaaaaagatgacagaccccagcccgcgctggacgccacaaacggtggatcagcgctgaaagcagggatggccgtttcagttggaagattaagagtcagaagtcgtagtctggatcttgttcttctggttaataaccttgttaggggtgcagccggttcgaccctgctaaatgctgagatagcctacaaggagggtataatttga

SEQ ID NO: 41830 - DNA, 3588 bp, Thermoplasma acidophilum
gtgaaggaaattgttgatgcgtattttaaaaaatatggaatagtaaaccatcagctggattctatgaattctttttatgcgacgcctgataatccaaacagcgtaatgcagcagatcgtggatgaaacgaaggtatctgacgatgccgatccaggatattttgttctggatcctgcgaaaaccggtggtcatgatataagaatatactacggccgtgtcagggaaaacggccattacgtaggtgaacagaccatattcataggaaaaccggagataaaggaggcttccggtgcgtcgaatcagatcactccaaacgaggcaaggctgagggatctgaactacctggcaccggttacgctcaagctgagaattgttgaggatgggatagagaaagggtcagagataatcaaggtcggtgatctgcccgtcatggtcagatcaaagatatgcacactttccgaggaaaatcttgatcagtacatagagaagaacaatggccccatcggattatcgaggagagagaagctgcagtacgtcggcgaggacccggatgatccaggaggttacttcatcatagggggatcagagagggtcatagtatcgctggaggatctcgcaccaaacaagatcatggtggagtgggaagaccggtacgaatcaaaggtcgaggtatccaaggtcttctcgcagcggggaggtttccgtgcgctcaccagcatggagaagggaacggacggaaccataaacgtatcaataccgagcgttgcgggcaccgttccgctggtaatactcatgaaggcgcttggccttgagagagatgtggacgtacacgatgcgatagcctcggtaccggagatggaaccgataatatactcaaacattgaagattcaaagaatccgaaggttctcccaccaaacggtgtcaacacaaccgaggatgcaatatcgtacctcgagaaaaggtttgcagccggccaggccaaggagttcagggacaagaagatatcgcagatgctggatcattctctgcttccgcatctcggcgattcgccttccgaccgcataaggaaggcgatatacttgggaaggatggccagatcgcttctggaactgagcctgggaataaggaaggaagacgataaggatcacctcgcaaacaagaggataaagcttgccggtgatctgatggacgagctctttagaagcgcgttccagagcgtgatgaaggatctcaagtaccagttggagaagacgtacaacaggaagcgcggtataaagataaggccggccgtgaggcaggatctgctgacgcagagggttctccatgccatgtccacgggcaactggataggcggcagaacgggcgtatcgcagctactggacagggtttccaacctcagcacgatcagccatctgaggaggataatttcgcctcttacaaggacgcagccccacttcgaggcaagggaccttcatccgacccagtggggaaggatatgccccaacgaaactccagagggacagaactgcggtctggtcaagaacgccgccctcctcataaacgtgacgcagggcatcgatcctgacagcgtcatggagatactgaaggggatggacgtccgcgaggtcctggaggagagcccgaagaaagggcgtgtttatctgaatggagatttcataggatatcacgatgatccgagataccttgtttcgaggatacgcgaggagcgcaggtcaggccgcatgtcggatgaggtaaacgtcaggtatgatgacaacacgaacgaggttatagtgaacagcgaccgcggaaggctgcggaggccgctgctcatactcaaggacggaaagaccgtactggacaggacgatgatcgagaggctgaagcacggtgaaatatcgtttgaagatcttgtgaagcagggtgcgattgaatggctcgatgcagaggaagaggaggatacatacgtggcagtttacgcttacgacataccggagaaatgcccgcactgcaactcatacctctacagatccatggtggactgggtcaatccgggagaatccgagataaccctggaatgcggtttctgccaccagaggttcaacgtgccttcaaaactttcaaaggagaacacgcaccttgaaatcgatccagcgatgatactcggtgttgtcgcctcaataatcccgtatccggagcacaactcgtctccgaggattacgatagcgtctgcaatggccaagcagtctcttggctttgcccagtcaaacgtgaggataaggccggataccaggggccatctgctccattacccgcaggttccgctcgttcggacacgcgtcatggattacatccactacgaccgcaggccggccgggcagaacttcgttgttgcggttctttcatatgaaggatacaacatacaggatgcactggttataaataaggcagccatagaaaggggccttggcaggagcactttcttcaggacgtactctgcagaggagaggagataccccggaggccaggaggacaagtttgagattcctacgcacgatataataggggcaagggcagaggagtactacaagaacctggatgacagcggtataatattccccgaggcctatgtcgaaggatcagacgttctcatagggaagacatcacctccaagattcctggaggagggtgaagagcgccttggtccgcagaggaggcgcgaatcatccgttaccatgaggccaaacgaaagcggttacgtcgacaacgtattcctcaccgtatcggagagcaacagccgcgtagtgaagataaaggtcaggagcgagaggatacccgagctcggcgacaagtttgcgtcccggcacgggcagaagggggttgttggccttgtagttccgcaagaggatatgcccttcacggaggacgggataataccggatcttatattcaatccacattccattccgtccagaatgacggtcggccacatactggagatgataggcggcaagatcgcatccaggacaggaaggttcatcgatggtactatattcagcggagagccggaaaagagcctgagagacgccctggtgaagtacggcttcagaaagtcctcaaccgaggtcatgtatgatggtattactggcagaaggttcaaggccgatatctttgttggcgtgatatactaccagaagctgcatcacatggtcgcaggtaaattccatgcaaggtccagagggccggtgcagatactgacgaggcagccaacagaaggaaggtcgaggcagggaggtctcaggttcggtgagatggagagggataccctaatagcgcatggggcggcgatggtcataaaggatcgtctgctagaccagagtgatggtacagtactgtacgtgtgcggaaacccctcatgcggtcacatcgcaatatacgaccgcaggaagggcacgctgagatgccctgtgtgcggaaatacaggaaatatttatccgattgagacaagctatgccttcaagctgatgagggatgagctgatctctctcggtgttgttatgaggttaatgctcggtgatatgaaatga

SEQ ID NO: 41831 - DNA, 1188 bp, Thermoplasma acidophilum
atggatttcgaatttaccgaggatcagaaacttctgatggagacggcaaggaaattttcagaatccgtcatagcgccatccattggaaagatgaggagccagcgtaggatacaggacgaagtgtacagccagatggcaaagatgggctaccttgggatgaccgtgccagagaagtacgggggcatgggcgcagatgccgtatcgaccggaatagtcgcagagcagatagcaaggaacgatccgaccgcatccataccggtgctctttctggttgacaacgcgtggtcgtatctcatggcgaagtacggaaatgagaaggtcttcggagatatccttaggaaggttgcaaagggcgaatggataacggccatagcctccacggaatccggacacggttcagacgttgcgggcatagacaccgttgcgaagaggtccggtgatgaatacatagtcaacggcgagaaatcattcataagccttgttcgcgatgtcaaggagcatggcggtggctttgttactgtcgtgaaaaccagggaaaatgccggttcacgtggtatatcacttctctacataccctattccgacgatatcgagatatcctatctggaggagatgggcagggagggttcgtcatggggtgtgctgaggttcaacgatctccatgttccggcaaagtacctcatcggggaggagaacaggggcttcaacatagttcatgaaggttttgaattcgcaaggggcctcatatcggtcatatccgctggaacagcgctgaaatccatagaaaatggaataaactacatgaagcagaggaaggcctttggccgcgagatcgccacgtttgagggccttcagttccaggtcgctgacgacgtggccaagatggaggctgccctcagcttcgcgtacagggcgctgtggatatacgatcaggagcagaggcacgggaaatacagcagattctatgtcagcaagaacattgccatggcaaagctaatatctactacatggggattcgacgcaataaacgacgcgatgcagtggcagggtgcatatggatattccaaggactgccccgaagaatgggcactgcgcggtatacgatcgttcatgcttgccgagggttcgcgtgagataatgaagctcataatagccagagaatccataggcaaggaatacatgcggtga

SEQ ID NO: 41832 - DNA, 903 bp, Thermoplasma acidophilum
atggctgatctctcaacatctgtggccggaatcaggctggagaacccactgatgctggcttctggaattcttgatgaaaatggatacaccatgcttgatgttatgaataacggcgctgcagccgtggtcacgaaatccataggcatggaagagagaaatggttattctgcaccggtaatagttgaatatggtgacagccttatcaacgcggtgggcctttccaatccaggcatagacaatttcgcggaggagataaggatagcaaaaagatccgggaagcccgtcataggaagtgtctttgcctcggacgcggaatcctttgtcaatctcggcaggaaaatgcaggaatatggttgtgatgccgttgaactcaacctgagctgcccgcatgttaagggctttggccttgaggtgggctccgatccggatcttgttgaggatattgtgaatgagatgaaatccaagatcagcgtgcctgtcttcgcgaagctcagcccaaacgtatccgacataatagagatagcgaaggctgcggaaaaggccgatgcgtatgtcctcataaacacggttaaggccatgaagatcgacataagggcgaggatgcccgtccttaccaacgcctatggcggcctgtccgggcctgcaataaagcctgtcggcgttagatatgtatacgaggtgaaaaaggagacgggaaaggatatcataggggtgggcggcataacgacatatgaggacgccgttgaatacataatggccggagcctccgcagttcagataggtactgcgctctataccgtgggaaaatctgtttttcgtaatataatatcccagatgaacacctttatggatgatgagaaattccacagcattcaggatatggtaggggtggcgataagatga

SEQ ID NO: 41833 - DNA, 1314 bp, Thermoplasma acidophilum
atgtgcagttccggatcgccaacattcttttataacgtttccatatcaacatcaatgaaaacatcggatgtatcaggcttttacaagctatctgttgatgatcgtattcagttcgtgaaggaattttcagatcttaccgatgatgaagtatccatcctcaagaagaatggttcattgccaattgaaaaagccgacaagatcatcgagaacgtaataacaactattgaaatgccgatgggcatagccgtgaacttcaggatcaatgacagggactatctcatacccatggccatcgaagagccatcagtcgttgccgcagcatccaatgcggcaaaggtggcaaggaagaggggaggtttcagggcctttgccacagaaccgataatgataggcgaaatacaggtcctggacgttccggcaccatacagtgcaaagatagccctgcttgagtcaaagcagaagatactggatatggcaaatacaaggagcaagaccctatcatccatgaacgcgggcgcaagggatctggaagttgagatatttgaatacccgtacaggatgatgatagtgcatctgatagtggacgtgcgggacgccatgggcgcaaacgttatcaacagcatgtgcgaatacgtggcgccggagatagctagaataaccggcggccgcgtaaacctcaggatactgagcaaccttacgaagaacaggatcgcctatgcctcagcagttttcccgaaggaaataataggtgaggaggctgtggacagcataatagaggcctaccatatggctgccatagatatatacagggccgcgacgaacaataagggcataatgaatggtgtggacgcagttctcatagcaacgatgaatgactggagatccgcagaagccaatgcgcattcctacgcagccatgtatggttatggcccgctggcaaggtacgagaaggacgcgaatggagatcttgtgggcagcattgagataccgatggcggtcggtacaataggcggaacaacgaggagcatagaaaaggccaggatcgccatgaagattcttggcgtgaaggatgccaaagaattttctggcgttctggctgccgttggcctggcccagaactttgcggccctgcgtgcactggcaacggagggaattcagcgtgggcatatggagctccattcgagaaacattgccatgtctgtcggtgcagtcggtgatgagatcgataaggttgtttccaggatgatagaggagaaaaatatatcgatggcaaacgcacagaagatacttcaggagataaggaataagaactga

SEQ ID NO: 41834 - DNA, 888 bp, Thermoplasma acidophilum
atgaagattaaaatgcaggattcagttagcttcaggatggagttcagagaattcgggaagacaggtgaaaagatttcaaagatcggcgtggggacatactacgacgttggctggatgttcctggcaaggttcggtaggaagtccggttcggagatgaagatcagggccatacgtactgcggtggagaacggcgtcacacttatcgatacggcggaggtctacggaagcgaagatctggttgccagggccatagaaggcgttgacagggagagtctgttcatagccacaaaggtgtggataactcacctctcatacgattctgccataaaggcatgcaaaaggagcctgaagaggctcaacatgaaatacatcgatctttaccagattcactttccatccccaataggagacatcgagggtacgctgagggcaatggaaaagctggtggatgatggcctcatccggtacatcggtgtgagcaacttcaatctcgatcagctgaagcatgccatggaggccatgaaaaagtatgagatagttagcaaccaggttcattacagcctgaggcacagagatcctgaaactgatatgattccctttgcagagaagaacggtatggcaatactggcatggtatccgctcgaacacggcgatcttgtgcgggacgaagcgtatcccactgcatttctctcagatctgaggaaaaggtatccggaaatgagggcgtcacagatagcactgagctatctcatggaggcgaacagcaacgtatttccgatacccagggcatcgaatcccgatcatgtcctcgaaaacataaacagcgtgaagtatcatctctcggagggagaaataaaaattctgaaggatagtttcagatctctctga

SEQ ID NO: 41835 - DNA, 1944 bp, Thermoplasma acidophilum
atggaaagcgaaaagggaacattacccatgaacgaggtctacaaccccggcatgaacgtgtacagcgagatatacaggaaatccctggaagatcctgagaatttctgggcaaaacaggccgagatactgacatggtattccaaatggaacaagatcctcgacgattcaaagaagccgttttacagatggtttgtgggcggaaagctcaacgtgtcgtacaacgcagttgacaggcacctggagcagcacaggaggaataaggccgcatacatatgggttggcgaaaatggtgaagaaaagatagtgacgtacgatggactttacaggaggataaacaacctggccaaagccctcctgaacctcggaataaagaagggagacaggatagtactgtacctgcccatgataatcgaagcgcccgttgccatgctggccgcggccaggataggtgcagtattctctttcgtcttcgcaggcttcggtgcaggtgcactggcagagaggataaacgattcaaaggccgtactgctgataactgcagatggaggtttcagaaacggcaaggtggtggagctaaagaagatagcggatgaggcccttgagatgacctccacggtcagaaacgtgatcgtcataaagcatgccaggaatgacgtgaacatggttgaggatcgggatatctggtatcatgagatcgttggtgattcgcatacgtacgttgagccggaacatatggacgcgaacgatccgctcttcatcctttacacctctggaaccactggaaaacccaaaggagctgtgcacagcaccgggggctattccgtatgggttgccagcacgctgaagtgggctttcaatcctgatgaggatgacagatggtggtgcgctgcagacataggctggataaccgggcacagctacatagtattcgctcccttgatccttggcctgacgagcatcatgtacgagggatcgataacctatcccgaacctgacaggctatgggagatcatagaaaaataccgcgtgaacatcctttacacctcccccacggctataaggacgctgatgaagttcggagagaagtacccgcagaggcatgatctgagcaccctgaaagttctcggaacggttggagaacccataaatccggctgcctggaaatggtactacgagatcatcggcaactccaggtgcccgataatcgatacgtactggcagacggagaccggaggtttcatgatcgcaccgcagaggggactcggcctgccaccattgaagcctggttctgcgacttttccgcttcctggcgtagatcctgcaatacttgatgacgcgggaaaggaggtgcgtaccggcgagaagggttacatagtcttcaggagaccgtggccaggtatgctgatgaccgtcaacaacgacgacgagagatacgtaaaaacatacttctccaagttccccggctactattactgcggcgactatgcggtgaaggacgaagatggctactactggctcctgggcagatccgacgaggtcatgaacgtatcagggcacaggcttggtacgatcgagatcgaggatgccatagtagccacaggccttgccgttgaagctgccgtcttcggaaagcccgatccggtaaagggcgaggcaatatcggcattcgttgtacccaaggacgcaaacgccgacaggcacgaactcatctcggagatacgcaagaggataagggctgatcttggcccgatatacgttccggacgagatcaggatcgtgaaactgttgccgaagacgaggagcggcaagataatgaggagggtcgtgaaagctgtggcgctgaaccagatacctggcgatctaacgactctggaggattccacctctgtggacgagatcaagagcgcaattgaagccttcaagggagaggccggaggtgagtga

SEQ ID NO: 41836 - DNA, 2991 bp, Thermoplasma acidophilum
gtgataatcagaaatgattatatagtgataatcagtttagatcattgcatgtcagaaaaagcattttccatatcaattgatggcagaagttatgatgccaatgatggcgaaacagtactgcaggtgatgatgagaaaccgtctggacataagccacatctgttatcatccaagccttgggccaatccagacatgcgacacctgccttgtggaggcggacggcaagatcgtccgatcatgcgccacccaagtgcacgagaacatgaatgttgtatactcagaggatcgagttaaggatctcagaaaggaggccgtacagcgcatactggcgaatcacaacctttactgcactgtgtgcgacaacaacaacggtgattgcgagctccacaatgccgttcttgatctgaagatcgataagcagaagtatccgttcagcaggaaaccatacgatgttgatgattcgaacccgttttacgtgtacgacccttcgcagtgcattctttgcggacgctgcgtggaagcctgccaggatgttcaggtaaatgaaacgctgcacatagactggtcgctcgaaaggccaagggttgtctgggacgacggatcaaagatcaatgaatcttcatgcgtttcatgcggtcactgtgtaaccgtatgcccggtcaacgccctgatggagaagaccatgatcggaaatgcagggtatctgacagacctcgatactgagaccaagaatacgatgatcgatctggtgaaggcattcgaaccgatcataaccatgcggccggtgatggcaattagcaacatcgagtcaaagatgagggagacgaggatcaggaagacaaagaccgtatgcacatactgcggtgtcggctgttcctttgagatgtggacggtcggaaggaagatacttaaggttcagccaaagccggaatcacctgcaaacggcatatccacatgcgttaagggaaagttcggatgggactttgtcaacagcccagacaggttaacggaaccgctcataagagatggcgacagattcaggatggcctcatgggacgaagcccttgatctgattgcgtcaaggttaagggagataaaggagaagtatgggccggacgccatagaattcatagcatcttccaagggaacgaacgaggaggcatacctggtgcagaagcttgccaggcaggtattcggaacaaacaacgttgacaacagctcaaggttctgccaggcccctgcaaccaccggcctgtggcggacggtcggttacggcggtgatgcaggatcaataagtgatctctacgtatccgatctcatactggccgtgggaacaaataccgcagagtcgcaccccgttattgcaaccaggataaaacgtgcgcacaagctcaatggccagaagatcatagttgctgatctccgcatgcatgagatggcaagaagggcggatgttttcatacacccgcggccgggaacggacctcgtatggataaatgcggtggcgaagtacatcgtggatcagggatggcaggcaagggaattcattgaaaaacgggtgaacttctacgatgaatacgtgaagagccttgaaccatttacccttgaatttgctgagaaggtgtctggcgtaagcgccgatgatataaggaaaattgcgacgatgatacacgaggcaaagagcatggcggtgatatgggccatgggcgtcacgcagcatcaggctggcagcgatacctcgacagccctgtccaatcttctcctcctgacgggcaactatggcaggcctggaacaggcggctatccacttcgcgggcataacaacgtacagggtgccagcgacttcggtgcaatgtccgcataccttccaggataccagagcgtcagtgatgaaaaggcgagaaaaaagatcgaggagtactggaaatgccagataccggataagccaggttacgacaataacacctgccttgaggccataaacagtgacaggatcagggcaatgtacgttgttggtgaggaactggttgaaaccggatcagattcagaatacatcaggaagcagctggaaaagctggatttcctggtagttgaggacatgtttctgtcagagacggctaaatatgccgatgttgtcctgcccgcggcagcaagcgtggagaaggagggtacattcgtgaacactgagcgcaggatccagaggatataccgggtgatggaacccctggggaactccaggccagactggcagataatacaggatgttgcgaacagacttggtgcaggctggaattacaggcatccatctgagataatgcaggaggtatcaaagatcgcacctatattcgcgggcgtttcatatgagaggctagagggctttggaagccttcagtggcctgtgtccgatggtggaaaggatacaccactgctgtacactgatcgattcaatttccctgacggaaaggcccggttctaccccctgaagtacagtccgcccttgactgtggaccaggaattcgatctgcatctgaacaatggcagaatacttgagcacttccatgagggcaatgaaacctatcggtctcccggcctcaaggaaaaggttcctggcaccttcgtggaggtttcgccagaactcgctgcggaacgcggactgaaggatggagaccttgtcaggatcacctcgaaatggggaagcataaaggttcgcgttctggttacggacagagtctcgggaaaggaactctacatgcccatgaactcaggcggggactctgctgtcaacaaccttaccagcaggctgatggatccgaccgcgcatacgccagcctataaggagcttccggtgaagatggaaaagatagagggcggtcatggggaaagccccatgccaagaaccaatccaagatacggaaagccccacccgcagaggggagtaatggtggaagagaagtggaagcgcagcgattacataaaattgaccggtgattga

SEQ ID NO: 41837 - DNA, 969 bp, Thermoplasma acidophilum
ttggattgggaattggagcttcacagcaaggttgaggaggtgaatgccaggctcctcgaaacggtaaagagcgaagagcctgatctagaccggatggcaagatacaccatagaagcaggtgggaagaggttcaggccccttctaactatactagcgtatgaatcgagcaccgatgaaccctacttcaaaatactggatcttgcaacgggatacgaactcatacacactgccagcctcatacatgacgatataatcgataactcccccatgcgccgggggcgtccaacgctcagctacaaggaaggtgtgaacaacgcaatagttgttgcagattatcttttcgcaaaggcctatgaactcggctcaaggtatggtccgatcgtctcgaaggtcatggccgatgcatccagcaggcttgcggaaggacagatcctagaagctgtgaatctgggcaatctcaacataagtgaggatacttactacagaataatagaaaacaaaaccgcgcatttctttgaagcatgtgccagaggagccacgattgcggcgaatgctgatcttaacaccagaaatatgctatctggatttgcattcaatcttgggatggcttttcaggtgaccgatgacatacttgacataacaggcgatgacaagtacacaggaaagccaacctttgtagacataaaacacgacgcactgacattgcccataatatacgcacttcataattccgatgagaatgacagggataagatcgtcggcatgatcaatggaagcattgagatcgataaggatctgttaaagaggatattcctaagaagcggagcgatagactactccttcggtatagcaaagagattcataacctcggccatggactatctgaagaatgtcacaagatctccagacatcgatctgctgatggaacttgcgctgatggtcatcgaccgtattgaaatttatggatga

SEQ ID NO: 41838 - DNA, 1539 bp, Thermoplasma acidophilum
atgaaggcacttgtagaagatgatcttttttcaaagataggtctcgatgacgtgaactccggtgtttatgatggtgaatgggtcaaaccatcgggaaagatgctaacagtgaagagcccgatagatggcagtgaggttgccaagatctccctcgcaacgagggctgattacgacaggcttgtatccagggcgattgaggaattcaagaagtggaggatgataccggcaccgaagaggggccttatcataagggaaataggggacgagctcaggaaggagaagaagaacctaggaaagatcgtgaccatagaggctggcaaaactccatcggagggtgagggcgagatacaggagatgatagacatatcggatctggccctcgggctttcaaggcagctttacggtcttactatagccagcgaacgcccgtatcaccgcatgtatgagcagtgggttcccctcgggccagttgcggtcataacatcattcaattttccggcatctgtctggtcatggaacgccttcatagctgccgttgacggtgacgttgtaatatggaagccatcgtccaaggctgcgctcacagcagtggctgtcatgaaggttatagagcgcgtcctgaagagaaacaatgctccaaacattttcttcctcatggtcagctccggttcagagggcggagactggataacgaacgatccgagaataccgctcgtatcgttcaccggatccgtacctgtgggcaagaaaatatctgaaaacgttgcaaagcgcctgggaaagagcatactcgaacttggcggcaacaacggcgcgatcgtttcagacaaggcagatatagacctcgcactgaggggcgttgtctttggagcccttgcgaccgcgggccagcgctgcacaaccacgaggcgcgtgatcgtacaggagaagatatatgaccagttcctcgaaaaactaaagaatgcgtattccacgataaaagtcggcgatccaagggagaagggggttctcgttggtccgctgatagacgaggatgcggttaaggactatgagcatgccatagacctggccataaaacagggcggcaaattgatattcggaggaaagagaattacaataaagggcctggagggagggcattacgtaatgcccaccataattgaggcaaaaccggacatgccgatagtgaaggaggagacattcgcctctatactgtacgtgatgaaatacaggaccatcgaggaagcgatagagatacacaactcagttccacagggtctgtcctcatccatattcaccacagacctgcgtgaggaggaggccttcctgtctccatatggttcagactgcggtcttgcgaacgtgaataccagtacggccggtgcggagattggcggcgccttcggcggcgagaaggacacaggtggcggaagggagagcggaagcgacgcctggaaatactatatgagaaggcagaccgtcacgaagaactggggccagacactgccgctggcacaggacgtggtattcgagttctga

SEQ ID NO: 41839 - DNA, 753 bp, Thermoplasma acidophilum
atgaaaggcaaggtggccgtggtgacaggatccggtcgcggcataggtagggaaatagctgtatatcttgcaaagcagggtgcgaacgtggtagttaacgtaaaaaagagggttgaggatgggaacgagaccctggcggaggtgcggaaatacagcaatggcatcatggtccaagctgatgtatccacccgtgccggtgcaaggcatatagcggaagaaacacagaaggaatatgggcaatgcgatatactggttaacaatgccggtctgggcataggcatgccatttctggacagcgatgacaggttaattgaaaagatggtgtcaacgaactacctttcagctatatactgcactcaggagttgacgaaaataatgcctgaaggaggttccatcataatgatggcttcccttgctggcataaggccaatggtgtcgctttcgctctatggcagccttaaagccgcgataataaagctgacggaataccttgcccttgagttcaagcagaaaaaaataagggtgaactccattgcaccctccatcgtcaagacgaagatgggcgaaagcctcatcgactatatgcatatgacggaggatgagtatacgtcaaagcacacgctaaccggcagtatcatctatccggaggaaatagcgaagacggtcgattttctggtatcatcgccaaatataaccggacagacaatagttatagattcagggcagtcattaattggagatcttacaatatga

SEQ ID NO: 41840 - DNA, 1284 bp, Thermoplasma acidophilum
gtgaaaataatggcaagtcagaaaccacacctgaatctgataacgataggtcatgtagatcatggaaaatctacattggtaggacggctgctgtacgagcacggcgagattccagcacatattatagaagagtatagaaaggaagcagagcagaagggtaaggcgaccttcgaatttgcctgggtcatggataggttcaaggaagagagggagagaggagttaccattgatctggcccacaggaaattcgagaccgataagtattacttcacgcttatcgatgcgcctggccacagagacttcgtcaagaacatgataacaggtacaagtcaggccgatgcggccatcctagtcatatctgcaagggaaggagaaggtgtgatggagcagaccagagagcatgccttccttgcgaggactcttggtgtaccacagatggttgtggccataaacaagatggatgcgacaagcccaccgtacagtgagaagaggtacaacgaggtcaaggccgatgctgagaaactcctcaggtccataggtttcaaggatatatcattcgtgcccataagcggctacaagggagacaacgtaacaaagcccagcccgaatatgccatggtacaagggcccaacacttctgcaggcactggatgccttcaaggtacctgagaagcccataaacaagccgctcaggatcccagttgaagatgtgtattccataaccggtatcggaacggttcctgtcggcagagtagagacgggtgtccttaagcccggtgacaaggtcatattcctcccggcagacaagcagggtgatgtcaaatccatcgaaatgcatcacgaaccactgcagcaggcagagcctggcgataacataggcttcaacgtcagaggcattgcaaagaacgatatcaagaggggagatgtctgcggtcacctcgatacacccccgaccgttgtgaaggcgttcaccgctcagataatcgtgctcaaccatccgagcgtcatagctcctggatacaagccggtattccacgtgcacacagcccaggtggcatgcaggatagatgagatagtcaagacccttaacccgaaggatggaacaactctgaaggagaaaccagacttcataaagaacggagacgttgcgatagtgaaggtcatacctgacaagccactggtcatcgaaaaggtttcagaaataccccagcttggcaggtttgccgtccgtgacatggggcaaacagttgcggctggccagtgcatagatctcgaaaagaggtaa

SEQ ID NO: 41841 - DNA, 1461 bp, Thermoplasma acidophilum
ttggcatggccatttatgaaccgtttgatatgcaggcatcgttattaccgctttcagatacgctgcatctggcatatcatattttgtattttaaaaaagtatatttcttggtcatgcattatcggtattatggttgaattcaaaagcagccacgccgcatttgaccagatgagaataacgcccacgttcatcgagataaccatactctcctccatgggcgttttcatggatggtttcagcctttccatattctccgcggctctcacataccttaagtcctacatacttgtaagggcaattttcgtttcactagccgcctcggccatttacataggaatgttcctcggaagcttcacgatggggcatctctccgacaggataggcaggaagaggatgtacacgtacgatcttgcgataacaagcgtattcctcgtgctgacggcactttctaccagtttttacgagttcttcatattcgaactgctggcgggcataggaataggcgctgattatcctctcagctcatccatagaagctgagttttccccgagaagatccaggggtcgttttctggttttcaacatcttcatgtggacgatcgggtccatcgtcttctacgtcatatccataccccttatcttcaggttcggatcggaatcgtggcgctggatgtacggtgtaggggccatcgtaccggtggtagttatactggccagacgcgcattgccggagagcccatactggctggtcaaggccggaaaggacagcgaggccaagactgtcgctgacagcatgggaagggaggccggatatacggacgtcgatctcccgaatgtggagaagggttcaagttcattcagatcggtcttctccggttcgtacctcccgctcataatatttgcgagcctggcctggttctcatacgacgtttcaagctatggcgtctggaactacacgccttcaatattcgtatctgttggcgtctctgccgtcagcagcatactgtcaacactgctggaggatctgccggtcatagtgggattcatcatatgcctgctgctgatagagcgcgtcgggcgcaaaattctgcagtcggtgggctttggcctggcaggcgtatcgctgctgtcctttgcgctctacgcagatcacagaacgctcccgttcataatgctgttcacagcatttgcaatgatgcacctgtttcacaacatcgggccgacaaatctcacctatgtttatcctgttgagatcttcccgaccagaataaggggtacggccatgggcatagccactgcggcatccaggataggcgccatacttggagtgttcgcatttcctctcataacagccagcatgggcatgtcggccagcctcatgttcttcgccatcttcgagttcgtcggcttcatcgttaccgttgtacttgcgccggagaccaagtctaggcccataacataa

SEQ ID NO: 41842 - DNA, 1404 bp, Thermoplasma acidophilum
ttgctatacggtgtttgtcgtagaaagcatttaataattgacggttatcttttttcgatgataatggaagatcaggagagaaccgagcgatacaatgaagacgcactcaggtactctgagtactttaagggaaaaatacagaccatatcaaaggttcctgtccgaagtctggatgacttttcaatatggtatacacctggagtggccgcagtttccagaaagatagcatccgatccggatctgtccttcgaactgaccggtagatggaattcaattgcgatactgactgatggtacaagggttctcggcctcggaaacataggcccggaggccgcaatgcccgtgatggaaggcaaggcgttgatattcaactatttagggggagtgaacgcgatacctatacccataagggtccagtcaaaggaggagtttgtgaaggttgccaaggctctcgaaccttcattcggcggaataaacctggaggacatagagagcccaaagtgcttcttcctcctggaaacgctgcagaatgagatgaacatcccagtgtggcatgatgaccagctgggcacggcatcgataacgctggcaggggtgataaactccctgaggatcgtgggaaagaagatcgatcaggtcaaggttgtcttcaacggtgcaggcgcagcgaatatagcggcggcatatcttttcaaggctgcgggattcaagatgaagaatatgatcctggtggattccaagggcatacttcatcctgaacgcgaggatatagacgctctgatgataaacaacccgtggaagtatcagctggcaattgagacgaacggagagagggtaaagggcgatctgtcaaatgcgatagagggtgcggatctgctgatatccgcagcaaagtcagggcctgatacgatagacagcaggatcgtgaagaagatgaacaatgacgccatagtctttgtcctggcaaacccaataccagagatgtggccgcaagaagccaaggaaaatggcgcgaggatagtggccactggaaggggcgactttccgaaccagatcaacaacagccttgtgtttcccggagtatttcgcggtgtgctcgatgccagggcaaagggcgttaacttcgatgtaatggtcgcagcatcgtatgagatagccaactttgttgaagatccgacggaggaaaagatcgttcccacgatggaggagtgggagctctatccgcgcctggcctctgcggtggcatcaaagaccgtagagcttggactggcgaggaagagcgacagcaaggagggtttctacaggcgtgcaagagagatcatagagagcaacaggaatatctattccaagcttatggatctaggtttgataaagaggatgccaaatggtgaacacaaaaattag

SEQ ID NO: 41843 - DNA, 1233 bp, Thermoplasma acidophilum
atgacagaaagcaagggttttctcagactggcatgggcaagagaccacatgcccgtcatagcggaaataaggaagaggtttcaggctgaaaaaccattcaagggcataaaagtggccatggccctgcatgttgaggcaaaaacgggcatattcgctctattgctgaaagagggcggtgcagaagtaaagatggcctcctgcaacccgctcagctccgacgattccgttgtacagagcctcaaggaggattatgggatgccggtcttcgccagaaagggcgagaccagcgaggagtattatgaatacctccatagaacgctggatgtccagccggacataataatagacgacggaggcgatctcacgaagattgtgcatactgagaggaaggatctggcgaagaacatattgggtggaaacgaggaaacgaccacaggagtgcagaggctcagggccatggagagatccggcgtcctgctcttccctatgttcgatgttaacgatgcaaacatgaagcacctgtttgacaacaggtatggtacaggacagagcacgctggacggaattatgaatgcaactaacctgcttatagccggaaggactgtggttgtggcagggtacggatactgcggccgcggaatagcgatgaggctcaagggcatgggggctaacgtcatagttaccgaaatagatcccatcaaggcaaacgaagccataatggatggttttcaggtcaggaggatgaacaatgcgatccgggacgcggacatggtaataaccgcgacgggcatgaaggatgttgtcaagtatgaggacgcgctggttgcaaagaagaacatcgttctggccaatgccggccatttcaataacgaggtggccgtgtccgaaatagaaaaaagatcgcttgaagtgaatgaagtccgtgaattcgtgaagagatacaggctcgaaaatgggaacacggtggacataatagcagatggaaggctggtcaatctggccgctggacaggggcatccagttgagatcatggatctgagcttcgcgctgcaggcccttaccgctgaatacctggtcaaaaaccatgataagcttgagagaaaggtttaccctgttccggcagatatagacaggtacgtcgcagagataaggctgaagcagttcggaggcgaactggatcagctgaatgaagaacagataaaatacctgaactcatgggacgaggggacttaa

SEQ ID NO: 41844 - DNA, 717 bp, Thermoplasma acidophilum
ttgtcaggtgaaaatatgccagatgagaataaatttccgctgataggagagaaatttcctgagatgaccgtggagacaacgcatggaagcatgaagcttcccgatcagtacaagggtaggtggttcatgctcttcagccatcccggtgatttcacaccagtatgcacgactgagttctactcctttgcacgaaggtttgaggatttccagaagatcaataccgatctcattgggctttcggttgacagcacgataagccacatagagtgggtcaactggatcagggataatctgaagatagaggtgccgttccccataattggggattccatgggacgtgttgcgacacgactcgggatgatacaggcagagtcatccacatccacagtgcgcgcggttttcatagtggatccgaattctacggtcaggctcataatgtattacccacttgaaattggcaggaatgttgacgaacttctcagggcaataaaggcgctgcagatgtctgataagtacagaggtgcaatgccggcaaactggccatacaatgaacttatcggcgagaaaatgctcaacccggctccgaagaacgttaaggatgcaacgggcaggctgaaggagttcaagggatacgcctggtggctcacatataaagacgttccagacaatgaggtgcaggagaccaagaagatagttaagatgcgcgaagagaaatga

SEQ ID NO: 41845 - DNA, 876 bp, Thermoplasma acidophilum
atggatatcaggactacggctgttgtgggtagtggtgttatggggcaggggatagcccaggttttcgccagatctggttaccccgtgactataatagatgtgagggatgatatactggcaaacgctgttcgcagcataaaggaggggcgttatggcctcatgaaccttgtcaagaaaggcacaatgaccgaatcagaagtcgataagataatgggaaaaatacgcacatcaacaagttatggttcactttcagacgccgatattgtagtggaagccgttccggagaacctggatctgaaaagaaaggtcttcatcgatatagagaaaaatgtgagtgagaatgccataatagcatcaaacacatccggtataaccatagccgagattgcccaggatctgaagaagaaggacagggcaatcggaatgcactggttcaatccagcaggcatcatgaagcttatagaggttgttagggcgaagatgacctctgaagacacgatcagcactgtcgttgatttttcacgcaggatcgggaaaacgccagttgtcgttgcagacgttcctggcttcttcacaactagattcatagaggggtggttgctggccgccataaggtcatacgaggcgaacattgcaacgaaggcggacatagataccatggcgaagctcgccttcggttttcccatgggtccgttcgagctgatgaacataataggcatagatacggtgtatcacatagcggagtacctcagggaagagaccggagatccgcagttcataccgcccgtatcgctcaagcagatggtcataaacggctatctcggcgatccgaaggtcaaatacggaagcaagggcggctggttcgacatgcagtga

SEQ ID NO: 41846 - DNA, 1170 bp, Thermoplasma acidophilum
gtggttggaggcggccctggcggaagtacggctgccagatatgctgccaagtatggcctgaaaacactgatgatagagaagagacctgagataggatctcctgtgagatgcggagagggcctttcaaaggggatactcaacgaagcagatataaaagctgacagatccttcatagccaacgaagtgaaaggtgcaaggatttacggaccatcggagaagaggccaataattctgcagagcgagaaggccggaaatgaagttggctatgttcttgagagggacaagttcgacaagcatcttgctgcccttgctgccaaggcgggcgcagatgtgtgggtaaagtcgccggcccttggcgtgataaaagagaacggcaaggtcgctggggcaaagataaggcacaataacgagatagtggatgtcagggcaaagatggtcatagccgcagacggtttcgagagcgaattcggaaggtgggccggcctgaagagcgtgatactggcaaggaatgacataatatccgcgcttcagtacaggatgatcaatgtcgatgtggaccctgactacaccgacttctacctcggttcgatagcgccggccggttatatatgggtattcccgaagggggaaggcatggccaacgtgggcatagggtcctccataaactggatacacaacaggttcgagctgaagaactaccttgacaggttcatagagaaccatcctggtttgaagaagggccaggatatacagcttgttacaggcggcgtttcggtttctaaggtcaagatgcctatcactatgccgggcctaatgctcgtaggagacgctgcaaggctcatcgatccaatcacgggtggtggaatagcaaacgccattgtctctggtatgtacgctgcgcaggttaccaaggaagcaattgagagcaatgattactcgccgcagatgatgcagaaatacgaaaaactgataaaggaacgcttcgagagaaagcacctcaggaactgggtggcgaaggagaaacttgccatgctatcggatgatacgcttgacaagctcgtcgatatagtatctgagcaggtgcttacaaccatatctgtcgaggcgatactgaaggcgatcgctgaaaaataccctgaggtcgtcaaggagctggaagacctcatctga

SEQ ID NO: 41847 - DNA, 1368 bp, Thermoplasma acidophilum
atggtagtctcgcccatagaatacaggtatggcagaagacaagtcaagaaaatattcgatgatgaaacacgcctaaattacatgcttaaggttgaagccgcaatagcgaaggcagaatccgagcttggtataataccgcaagatgcctacaatgagatccagagagcggtagattccggatcaataactctggacgaggtcaggcaggttgaggatgagataaaacatgacgttatggccgttgtccgggttctttcaaaatattccggatcagggtctaagtatgtacacttcggtgtcacatcaaacgatataaacgataccgcaactgcacttcagctgcatgatttctcttctatctacagatcgaaccttgtatcattcatggaaacacttgtaggcctcgcatctaaatatcgcgatcttccaatgatgggtaggactcatggccagcatgcctcgccgataacccttggcctgaagtttgcggtctatcttgcggagatgataaggcatctcgaccggtgggatgagatggctggcagagcatttgccgggaaggtgctgggtcctgtcggtactggagcagctctgggagaaatggcactggatgttcagaagagggtcatggacatactgggtatatatccggaggacggcgcaacgcagatcgtcaacagggatcgttacatagagtatctctccgtcataaatggtatatcggtgacgctggaaaagatagctaccgagataaggaatcttcaaagaccagagatagatgaactctccgaatactttgactttgaaaagcaggtcggctcaagctccatgccaagcaaggtaaatccaataaattccgaaaacgtggtgagcctctcacgcttcataagatccttgataatatctgagtacgaggccggtgttacatggcatgaacgggatctcaccaatagtgcatctgaacgctttgttataccgtacgcgagcatactgatagattatgctactgatcgattaaacggtgttctgaaaaccctcatcgtcaaggaggacaatatacgcaggaatctggaaaacgatgacagcatctactctgaaagtatagtaacgatactgactgagcgcggtatggcaaggcaggacgcacatgaatttgtccgaagatcggccatgaatgcaaggagcaagggtatgagcttcaggcagggcctgctagagaatggcattgaaagatatctcagcaaagccgatcttgacagggcgatggatccggccaacttcataggattggcaccgatcatatgtgatacgatagtaaagaaggcgaaagagaggatcgggatgaaagatggagagcaagcttcctga

SEQ ID NO: 41848 - DNA, 1134 bp, Thermoplasma acidophilum
atgcagtacataaacgagtcagctacggtatcggcatcaaacaacgttgaaaagctcagaaaacagggcctgaagatatataattttggcattggtgaacctgatttcacaacgccggaagggatcatagattacgcctttgagatggcgaaacagggaaagacccattatactccctctgctggaattatggaactccgcgagaaaattgcatctaagctgaagacaagaaatcgcatagatgcaaatgcggaaaacgtgctcgtcacgccgacgaagttcggcataaacctcgcaatgatggtcatactgaatcctggtgatgaggtcatcataccggatccatactacgtatcatatcccgatatagttaaacttgcaggaggtaagcctgtacctgtgcgaaccaccgacgattacgatattgatctggatgagatgagaaaattcgtgacaccaaggacaagggccataattctcaataatccaaataacccaaccggtaaggttctatcggagaaagagataagagacctcgtagatttcgcattggaaaatgatatttacatagtatcagatgaaatatatgaggatctaatatacgagggaagcctgtattcgccagcttctatgggaaaggaggcatttgaacacaccataacgctgaatggcttttcaaaaggatatgccatgaccggatggcgcatagggtatttcgtggctactgaggagatcgttgaagccgcaaacatcatacagcagcagacaataacatgtgcttcatctatatcgcagtatgcggctctcagagcgcttgatgacaatgaaagtccagctaggatgagatccgaattcaggaaacgcagagaccttgcatacggcatactttctgagagcacggatatgaaggtgcacaagccagaaggcgcattctacatgtttcctgggtacagcaaggatataccctccgaaaagatcgctgagatgctgctgaaccaggagcatgttgtcgttaccccaggaagcgcctttggcgatcgtggccgacaccatttcaggatatcatttgcgacctcggaagacattatcaaagagggacttgaaaggctggtcaaatttatgcacacattatga

SEQ ID NO: 41849 - DNA, 1143 bp, Thermoplasma acidophilum
gtggtgcgtttgtcgaaggatctccagtttccgattagggatagtttcgatagaaatgcgttttctgttaactttccaatatatgcgactacggcctacaggtctccagagggtgatcatttccgctattccagggagaataatcccactgtggaggagctggcaaggcagatatctctgcttgaaggttcacagttagccgcatgcttctcatccggcatgggatctatatcaaccgtttttctctccctgctgaaaccaggagacggcctggtgttgcctatggatgtttttggaagaacgtatctttttgcaaaggactttctatcaagattcggaataaatgtttccataacagaccctggaacagataaagttatcgaggccataggcgataaaacgcggatgatcttcgtggaaagcctctccaatcctgtacttcgagtttatgacataaaaaggctttctgattctgcgaaacagaacaatgcgcttctggttgtagatgatacaataataactcccgttggccagcgcgcgatcgatcatggagctgatatcgtcgtcaatagcctctcaaaattcattgggggacacaatgctgctattggtgggtcgtcatccggatcatctgaatttataaaaaatatagattctgacaggagaagccttggatcttccatggatcctttttctgcgttcttatttctgcaggggatgaaaacactgaagatacgcatagaaagatcatcaagatcggcgcagatcatagcagagcatttgtcgacattggatcatgtggagagagtctactatccagggctgaccgaaaatgattatcacgatctggctctccggacattaaaaaattatggatctgtagtttcctttgttctagatgatggtgtagacgcatctaaattcatgtcatccctcgaaaggataattcctgcaaacaccatgggcagtgtagaaacgctcatatctaatccatacagtatgtcgcataggaacctaagcgataaggaacgcgcaagaataggcgtcgttcccggattaatgagactatccgtagggatagaggaaatatcagatataatggatgatatagagaacgctatcaaaaaaagtttgaaaagttag

SEQ ID NO: 41850 - DNA, 1230 bp, Thermoplasma acidophilum
atgcaaatacttactctcatttcgtgggatttcaaaagaaataataacttcttcaatcaagctgttctcaatccttacgaatattgggccgatattttggagaagaacggcatttccagatacgtcatactattgacctgtaacagggtagagatatatctccgtgccggatttccagaggatcttgaagcaatgaagcccaacgtattacatgatgaggaagcaattaagcacttgatggaggtttcttccggccttgattcgatgtcccttggagaaaacgagatactaaagcaggtgaaggaggcctacgagctatctgtcagaaatgggaaggtcgacaaggttctgtccctgatctttcagaaggccatattcgttggcaagaaggtgcgttcagaaacagagatatcaagggggaaggtgtcggttccatcgatcgtatacgacatactctcaagcagggtggtgcaaaaggtactgatcatagggaacggcatgatcgcaggtgagatagcgccatatctcagcggcaaattcgaggtgaccatagcaggccgcaacatagatcacgtgaaggatcttgcatcaaagtacaactacagctacactactataaatgatctgcacgagttgatcatgagaaacgatgcaataatatcagctacgtcttctaagacacccatcatcagaagggaagagatggtcgagggcaaactctacatcgatctcgggaatccgagaaacatagaggataagccaggcgcggacataattacaatcgatgacatttactcagtatccaatagaaatggatcagccaggatggaaagcgtcgatgaggcccgcaggataatagagatcgagatggcttcgctcatgaacaagataaaggacgtcatgattgacgaaattttcgcggatttctacaaattcgccgtcgtcgttcagaagatggagatagaaaaattcagccgaatgcatcctgagatcccagcatctgacgttgaggcatttgcccattccatgataaacaaggtcatgaacataccggtcatgacgctgaagagtgttgccagatcccagagcaaccaggatttcagccggatattttcaaaattctacgacaacttcagcgatctcgtatctgctgctctccagagctatgaaggtcgtcaagatacccaaagtctacgagaccgaactcgtcggttattgcaaagatcctga

SEQ ID NO: 41851 - DNA, 1401 bp, Thermoplasma acidophilum
atgggttttattgaggaagttagaaccttccttgggaattatgccatcacaaggaaggaggatctcatcccttacatgaacgatgcttcttacttcaccggagaaatgcctgaagccgtccttctgcctggatcaccggaagatgttcagagaataatgaagcttgcttataaatatgaggttcctgttgtcgtcaggggcggcggatcttcgctcactggatcatcgatcctgaagaatgagggtatcgtaatttcaatgctcagaatgaaccacataatcgatctgaacctgaacgataagtgcgttgttgcagaacctggtgttaggttggacgatctggaacgattccttgacaaatacgggcacttctatcctcctgatccagccagttccagatctgccacggtaggaggatccatatccaccaacgccggaggcctcaggggtgtggcctacggtgtgacgaaggactgggtgctcgggctcgaggtagtattggcagatggcacgctcgtaaaatttggaaacaaggcgctgaagagatccatgggctacgacatgactgcactgatgatcggttccgaggggactctgggtataataaccaaggcgtacctcaagatatggccaaagcctgaacgcatagccagaatacttgctttcttcagaacgatagatgatgcggggaatgccatatcagaggtgaaggaacgcataataccggagatggccgaattcatggacaagatctcgctggattcagttccagacgccataaagtaccccgaaggtacgaattatgcactgatcgttgatgcctccgggcctccggagacgctgcagaggcgcagggaacagattgagggtatcctgaaaaaatacgccatagagacacggagcacaacagacaaggcggagatgaacaggatttacctcgcaaggaaggggctgtatgcttcaatactcaggctaaggaagagtgaaaaggaatacatagtcatcggggatatcgttgttcccgtatcagaattgccatctgccctgaaggagattgagaaagcacgtgatgtggatggtgttagatgcgctctcttcggtcacataggcgatggaaacatacatgcaaacatattcgcggatctttcgaacgaggaggccatggccaaggtaaacaagttcatgatggacatggcgatgatctctgttagacacggcggtagtgtatcagcagaacatggaataggcctcgagaagaagaaactgttcgttgaggagatgcgcttccacgataacatgcgcacgctggatctcatgagatcgataaagcgcatcttcgatccgaagaacattctaaacaggggtaatatatttgaccaggatgcaggatctgatagctga

SEQ ID NO: 41852 - DNA, 1362 bp, Thermoplasma acidophilum
atgacgctattcttgatcatggcagatcagaggctattcggtaccaatggaataaggggtataccaaacgatgatctcaccgttgattttgcgatccgggttgggaagagcataggcatgttcgtatctggcgacgttgccgtcggaagggatacacggatcagcggcgatatgatagcctcttccgttctggctggcctcatggccacaggccacaatataatagatcttggcatacttcccacgcctgcacttcagtactactgcaagaaccatgcactgtacggagttatgataaccgcgtcgcacaatccgccgcagtacaatgggataaaggtaatagatagggatggcactgagatagaacgcccctctgaggaaaagatagaaaacatatacagcaccggatcgttcaacatggtcaggtgggaggacgtaggcaggataagatacgtgagcgatgccatcgatcagtacatagatggcgttttatcaaaggttgatgtcaggagaataaaagaaagaagattcagagtgcttgttgatacagggaatggcgcggcctatgcctccactcctaagctcctggaaaagttaggatgcagcgtcgttacgctcaatgccaaccctgatggcagattcacttcgaggaatgcagagccgaagcccgaaaacctcaaagaactcatggcgctcatggcgaatggaaattttgatcttggaatagcccacgatggcgatgctgacagggttgtgttcatagatgaaaggggaaacttcatagacggtgataagagcctggccctcctggtaaaaaacttcgcctctgccagcgatatagttgttacaccagtcagctcatcggacaccatatcagatgtgtgttcggcaataggcgccacgatcatacggacgaaggtcggtgcgccgatagttgcaaggacgatgatacagaacggtgctgttataggaggcgaggaaaacggaggcgtcatctacggaaaacatcagtactgcagggacggcgcgatgacactctcactgatgctggatcttatggccaggagcaacaggaagatatcagaactgatacgtgaacttccaccgtatttcttggagaagagacagatagaacggactgtggactggggcttgctggagagagagcttcgaaagggggagaaggtggatactacagatggcataaagatcataaaggatgatgggtggatactcataaggccatctggtacagaaaaaatactaagggtgtatgcagaatccacggatatggccatggcaaaaaaatatgccgatcagtacgtggcgaagataagggatctgcaggaaaaattgggatga

SEQ ID NO: 41853 - DNA, 1281 bp, Thermoplasma acidophilum
ttgcaatggcaggctatgggttcaaaggatctttttcagagaggatcttccctcttcccgatgggtgtgaattcacctgtaagatactttaaggattatccattctacgttgataatgcgtccggatcaaggatatacgatgtggacggaaatgaatacatagattactgcctggcctacggcccatccatacttgggcacgccgatccggatgtcgtccgcgcagtcagggatcaggccgaaaaaggcctcatctacggtgcgccgtccgaggccgagatcaggcttggggatatcataagaagatcgtcaaagaacatagagatgatgagatttacaaattctggaaccgaggcgaccatgcacgcgatacgccttgccagggcctatacagggagaagcataatagtgaagatggaaggtggatttcatggcgcccatgattattctttaataagatcaggaagcgggacgctgacgtttggatctccatcatcacctggcgtcccagaggaggttgccagaacggtcgtcgttggaaggtacaacgacgaggcgaatataagaaacatattcagccagtacggcagcaggatcgctgctgtgataacggagcctatcatgggcaacgccggggtcataaccccggaacctggattccttgaatttttaagggatataacacagaagaacggatccctgctcatattcgacgaggtcataaccggttaccgcttcgccttttcaccatatcaggatataataggaataagaccggatctgaccaccatggggaagataataggcggcggcatgcccatagggctctttggcggatcggcggatataatgaagaaagtatcgccgtctggcgatgtctaccagagcggtaccttttctgggaatccagttaccatggcggcgggcttcgccgcattgaaaaagcttcagggcatggactacgcttccctggtcaggaggacggagaagctgatgaacggcatcgatgatatactagcaaaacgcaaaatcaggcacgtggtgaatggatacagaagcatgttccagttcttcttcgcagagagtgccaagaactacgatgaggtgatgaaagccgacagggatctctacttcaggatattcaagaggctgatgaatcacggcgtatacgttccgccatcacagtttgagacaaactttgtcagctttgcgcactcggatgatgatatatcgaagaccatagaggccttcgatctctccgtaggcgaggctgccaaatga

SEQ ID NO: 41854 - DNA, 888 bp, Thermoplasma acidophilum
atgatcaccataaggataggcacgaggccaagcaggcttgccgtgagacaggccgagatcgtggcctccgcgatccggcatgcaggatatgaagtagaaatagtgaaatacagatccgaaggagattctgacctgaaatcgcccctgtattccattggaaagaccggtgtgttcgtggaaaggctcaattctctgatactctctggcgatattgatgcagccgtgcacagtgcgaaggacataccgtatgaaattgacaggaggctcaggatctccgctgttatgcctcgtggaaggttcgaggatgcgcttgtctctgaaaatccactgtcaaagctgcctcctggatcggttatcggaacatcgagcctgaggcgcaggtaccagatcctttaccagagaaaggatgtcaaggtatcgaacataaggggaaatgtagatacaaggatcgagaagatgcggtctgaggggatggccggcatagttatggcgcttgcggccatagatcgtcttgaactgaacctgaggtactggcccttcgatcctgagaagtttgtcccggcaccgaatcagggaataatcgccgtagtgtccgaagacggatctaaggcatcagaggtgctttccagcataaacgatgcggatacgtacgatgatatgatggctgagcgatcgataacgcagggcctcaaacttggatgttccacacctgtgggaatcctcagcagacataccggaaagggtatgcgtattctggcacagttcttcgccatggatggctcggacatgatgatgtttgaccagcatgtggacgggttggatgacgtggacggcatagtctcctacatcagggagaatcttcctgaagagtacgggtataaactatga

SEQ ID NO: 41855 - DNA, 456 bp, Thermoplasma acidophilum
atggagaagacattaaggatatccaagataagggatggaacggtcatagaccatgttccgtcaggaaagggcatacgtgttataggtgtgctgggcgtgcacgaggacgtcaattacacggtgagccttgcaatacacgtaccgagcaacaagatgggattcaaagatgtcataaagatagaaaaccgattcctggacaggaacgaacttgacatgatatcgctgatagcacccaacgccacgatcagcataatcaagaactatgagataagcgaaaaattccaggtggagcttccttcgaggctcatcggcgtgctgaaatgcaagaaccagaactgcatcaccaacacccgcgagcctgtagaatctgagttcgagatagtctcgaagcaccctcttgtgatcaggtgcgtctactgcgagagaacgatgggtgaaaaggacattttcacttaa

SEQ ID NO: 41856 - DNA, 918 bp, Thermoplasma acidophilum
atgttaaagaacagaagcgttgtatcaatcgaggatgtggacatcgatgacctcaacgatctcttcgatctttcggattcaatgctcaagacaatcgaaaagggcggaagcaccgaccttctaaggaacaggataatggccacgcttttctacgagccgagtacacggacaaggctgtcgtttgagagcgctatgcaccggctagggggatctgttataacagtatcggacgttaaaaccagctcagtggccaagggtgagactcttgccgataccatccgaatggcctcatcgtattcagatatcatagttataaggcatccgctggagggggctgcaaggcttgcatctaaatttgcaaacaaaccggtgatcaacgctggggacggatcgggtcagcacccaacacagacaatactcgacctctacacaataaagagagaaaccggttcgatcgatgggaagaccataaccatggtcggagatcttcgctatggaaggaccattcactcgcttataatagcgctgtcgaggttcgatgtgagaataaaccttgttagcccgcagatactcaagctcccggaatacgtgttgacaaagataggcgatcgcagccgtataatggaatacgacgatctgtcaaaggtgattgaggatacggatgtactgtacgtgacaaggatacagaaggagagattcagcgatcagaatgaataccagagcgttataggatcgtattccgtggacagggatctcgtttcgagaatgaagaaagatgccataataatgcatccgctccctaggattgatgagataaagcccgaggtcgatgaacttccgcaggccagatatttcaagcaggcctattacggtgttcccgtacgtatggcgctgatataccgtattctgggtgattga

SEQ ID NO: 41857 - DNA, 1167 bp, Thermoplasma acidophilum
atgagagacgtattcatagtggctgcaaagagaactgccattggaaaatttggtcgttctttctcaaagctaaaggctccgcaacttggtggggcagcaatcaaggcagttatggatgaagcccacgtagatcccgcatcggttgaggaggtcataatgggaaatgtcatacaggcaggaaatggccagaatcctgcgggccaggccgctttccatggtgggcttcctaactccgttttgaaatatacggtcaatgttgtgtgtgcatctggcatgctcgcggtggagagcgctgccagggagatcgcactcggagaaagggatcttgtcatagcaggtggaatggaaagcatgagcaatgcaccatttcttctgccagcggacctcaggtggggcccgaagcaccttttacacaagaattataagatagatgacgccatgctcaccgatggccttcttgacgcgttctacttcgaacacatgggagtgtccgcagagcgaacatccagaaaattcggaattacaagggaaatggcggatgaatactctgtgcagagctatgaaagggccataagggcaactgaatctggagaattcgccgatgagatcgtgcagttcgaaggccttgaccatgatgagggcataaggaagacaactatggaggaccttgccaggctaccgcctgccttcgacaagaatggcatccttacagcaggaaattcagcacagctttcggatggtgggtcagcgcttatgattgcttctgaaaaggccataaatgagtatggtctcaaaccaatagcaagaatcacggggtatgaacaggcttccctagatcccctagattttgtggaggcacctatacccgcaacaagaaagctgcttgagaaacagcacaagagcatagattactacgatctggttgaacacaatgaagccttctccatcgcatctgttatagttagaaacgaactgaagatcgataatgaaaggttcaacgtaaatggcggagcagttgccattgggcatccgattggaaacagtggtgccaggatcatcgttacgctgatgaatgctctcaagcacagacatctgaagactggactcgcaacactatgccatggaggcggaggcgcgcacactctcacactcgaaatggtggaatga

SEQ ID NO: 41858 - DNA, 1548 bp, Thermoplasma acidophilum
atgccattcgaaaatgaaaacacatatgtcaggatggtagaagccggcaaagaggatgaattccacagaaagtatgaggaagcgctcaaagaggtggaatcctatttccacaaggaatatccgaatataataaaggaagacattgttgagagcaaaaagataaaggatataagcccaatagatggcagtgagatagcgactttccaattggcatcggatgaatccgttaacaaagccgtggacatgctctatcggtcatacaagaactggtacaatataggatacatgaagcgcgccctaactttcctgaaagcagcaggcatgctcagcgatcagaagttcaagttcgctgccatacttacgtacgaaaacggaaagaatagatatgaagccattggtgatgtggatgaagccatagacttcatgcgttattacgcaatcaacctcatagaaaatcagggcttcataaaattaacgggcaaagcctacaagaatgaggaatcgatgagtgtgatgaaaccctatggcgtgtttggcgtcatatctccattcaacttcttctcgatcggcgtcggcatgagttcaggcccactcgtcacgggcaatgcagtcatattgaagccgagcagcgatataccgctttcgctgtacctatgggttcgcctgatgcacgatgcgggcgttccgaaagaggtactggcctacgtttcaggttcaggtagcgttgtaggaaagcacatagtcgagaacaagaaggttgcgggaatagtattcacaggatctagggaagtcggtctagacatccagagaaggtctatcgacaatggaccaaaggtcgtcataacagagatgggaggcaaggatgccataatcgtgtccaacaaggctgatctgaacaaagctgtggaaggagttgcaagagcagcctttggattcgctggccagaaatgcagcgcatgctcattgctctatgttcacaaggacgtgtatgatgagttcatgaagcgcctcaaggaaagaaccgaccagataaagccagatgacccaaggaagaaggagacatttctcaacccggtcataaacaaggaggcatacgagaaattcatcaagctgaagcctgaatacaacaagggtaagatactcactggaggacatgaactgaagaggcctggattctacgttgaaccaacaatagtgacggatctgcccaaagatgcctatattgcacggaatgagatcttcctgccggtgctgagtgtgttcaaatgcaacagcatacaggaagccatagaagatataaacagcatggattatgggctcacaggaggcatattcactgaagacccgaatgagatacagtactatttcgacaacgtagaggtaggcgttctctacgcaaacaggaagagcggaggttccaccggttcaatggttggttcgcagcccttcgttggctggaaactcagcggtgtttcaggaaagggaaccggttcgttctactacctgatgcagttcctgagagaacagtcacagacaatagcacattga

SEQ ID NO: 41859 - DNA, 636 bp, Thermoplasma acidophilum
atgaatcagactttagaaactggtacaaccacggttggtattacactgaaagacgccgtaataatggcaactgaaaggcgtgtcacaatggagaatttcatcatgcacaagaatggtaaaaagctgttccagatcgacacttatacggggatgacaatagccggccttgtgggagatgcccaagtactggtaaggtatatgaaggcagagcttgaactttacaggctccagagaagagtaaacatgccaatagaggctgttgccactctgctttcaaacatgctcaaccaggtaaaatacatgccttacatggtccagctgcttgtgggtggaattgatacagctccccacgtattttccatagatgcggctggaggttccgttgaggatatctatgccagcacaggatcaggctcaccattcgtatacggcgttctcgaatcgcagtatagcgaaaagatgaccgtcgatgaaggtgtcgatcttgtgataagggccataagcgcggcaaagcagagggattcagcatctggaggtatgatagatgttgcggttattactaggaaagacggatatgtccagcttcctaccgatcagatagaatcaaggatcaggaagctcggattaattctgtaa

SEQ ID NO: 41860 - DNA, 951 bp, Thermoplasma acidophilum
atgaaatctgagagcctaagagatgtatacggcaaggagcttgtcaaactcggttccttcgacagagacatagttgttctggatgcagatctttcctcatccactaagacaggatattttgcaaatgcgtttccggataggttcttcaacatgggcatatctgaacagtccatggtcacaaccgcggccggccttgccctgtcagggaagaagccttttgtgtccacctttgccatattccttacgaggacgtacgaacagatcaggcagtccgtatgctataacaatgcgcctgtgcggttcgtcgttacccacggaggaataaccgtaggagaggacggtgctacgcatcagatagttgaggatgttggcataatggctgggcttcccaatatgaatgtgatcgtgccagcagattctgtggagaccaggagcgttgtagattatcttgccggcgttgataagccccactatgtcaggctgagcagggagaagtttccggttataaacgatgaggactatgaattcaagattggaaaatcaaagaccatcagagacggtgcggatttaaccataatagcggatggtgtcatggtgtcaaaatcgcttgaggcggccgagtccttgaaaaaaaatggtgtggatgctagagttataaacatgtcttcaatcaaaccaacagacagagacgccataataaaggccgcaaaagagacagggcatatagtaaccgcagaggagcattcaatatacaacggccttggaagccgcgtggctgagataacttcagaatcctatcctgtaccagtcaggcgtattggcatgcgtgatacctttggaaaatctggaaaagcgtgggaactcttctcatacttccacatggatgttaaagatataattaacgaagctatgacctgcttggaggagaaaaactatgaaaatattccttga

SEQ ID NO: 41861 - DNA, 870 bp, Thermoplasma acidophilum
atgccattcaagatcgtgcctatactgacaccattccggggaaacgagatagatggagaaaaattcaaggatcactgcctgaagcttttgagagacggaatcgatatgatattcgttgcgggtacgaatggtatgggaccagcactttctttccaggagaagaaaatgctcgcagagtactgttctgatattactgatagagtgatattccaggttggatcactgaatcttgaggaaagcatagaacttgccaggatcgccagatccatgaatttttatgcagtagcggccctgcctccattttactttggtggcatacctgaggaatggatcatacgctattatacgcagatatccgaggtgatggagacattcatctacaactatcccaagttcacgggctacgatatcaatgcagaccttgcgagaaagataaagaaaaaaggcgggaacatcttgggggtcaaggacaccgtcagcgatatagatcacatgatgaggtacaaatacctgatcgatgatttcatggttttttctggtccgagcaactacatcttgcatgccgcagtcaatggattagatggcgctgttgcagcggctggaaattatgccacagagatgttcgtacagatactggacgataccgcaaggtatggaagagcgaatcagatcatcatagatgaaatattcgatgccgcttcgcgttatgggcagtgggcctcaaactacagccttgtgcgcatactaaggggatatgatgccggagatccaagaccgccattctatccgcttgacgatcatacggaggagaagctccgttcagaggtaagatccataatgcaaaaatacgggagagaaagtaaattataa

SEQ ID NO: 41862 - DNA, 1269 bp, Thermoplasma acidophilum
gtgatgtcaatgtctgagaaaatagccgtaatcggagcaggaatcaatggaatattcgcagcatattaccttgcgtatgctggatacgatgttacagttttcgaaaggggagacatagattccggtacatccggaaggtttcatggtatgctgcacagcggtgcgcggtacgcaacaaacgatgaggtatctgcccgtgaatgcatagttgaaaacaggagaataagcaatatagggcacagatacgttgagaataccggtggatatttcttggcggcaaacgatgacgaagctgagtttggagacgtgctatttgatgcctgcaggagggctggcatagacatatctgagattccgatagaggaattcgccagggacaacccacagctgaagaacgccagaagggccatgcgtgttccagacaaggtgataagatcctacgagttcgtggtatcagtggccgcagctgcgcatctgatgggcaccaagatcaggacatactctgatgtgaagaaaatcgacatcgagggtaattccgtgaccgggatagagtatgaaagatccggcaaggagatcagcgaaaaattcgacgcggttgtcaatgcgacaggccctttttccggaaagatacttgaaagatctgggctcaagcagaccccagttatgccatctgccggcatcatggttgttcttgaaggacgcgtttccacagctatactgaacaggatgcgcgaaccatcagatgcagacatactcctcccatactggagcaattcaatactgggaacctctgccgtggttgttgaggacccggacagcttcaggcctgaaccagaggatatgcagatgatgatcgatgacatgtctgaactcgtaccggccgttaagatcatgccgatcaagcgttactactattcagttagaccactcatagaggacgcgggcgaagacgcaaggaccgccagcaggagcttcaggatagttggcgaggaggatcttgatgatactctgctgagcgttgtcggtggaaagtttaccaccgggcgtttggttggcgaggagatagcgaagagagtcatgcatcacttcggaacggtgatcgatctaaaggatccggatctggatgcgacgctggaagccttcgagaaacgttatgcatcggatccgatcatctcacgggcacttgaaaggaggggcacaatagatgaggagtacgccggcatagccgaggcatatgcgatatcatccataataggtggtaaacaatga

SEQ ID NO: 41863 - DNA, 1311 bp, Thermoplasma acidophilum
atgtcaggaaaagctgatccacttgagatcgcgaaggaagcaaagccttcgcaggcaaacaacgaagtggaagaggatccgtttgagatcgcgctaaaacagctgaggaaggctgcaaaggttttgaatctagatgagcaggccctggagatactgagctcgccgcagaagatcctgcaggtgagcttgcccgtcaagatggatgacggcaaggtgaaggtattcaccggtttcagggtcaggcacaatatagccaggggcccggcgaagggaggcataaggttccacccgcaggagaccctttctacggttaaggctctgtctatgtggatgacttggaaatgcgccatagcagacataccctatggtggagcgaagggtggtatcatatgcgacccatcaacgatgagccagggcgagcttgagaggctcagcagggcatacataagggctatagctgacttcatcggccctgatgtggatgtacctgcacctgatgtaaacacgaacccacagataatggcatggatgctggacgaatacgagaacatagtcaggcacaatgcaccgaacgtcataaccggaaagcccctcgaggttggaggatcacttggaaggttcgattcaaccggtaagggaggcatgttcgtactccgcgaaggtgcaaagaagatcggtctagatctttccaaagcgcgcgtggctgtgcagggattcggaaacgtaggtcaattcgcagtcaaattcgttgaggagatgttcggagcaaaggttgtcgcagtttcggatataaagggaggcatatacagcgagaatggcttcaaattcgatgatctgctggcctggagcaagaagataggcagtgtcgttggattcccaggttcgaagcccataacgaacgaggaactgcttgaatccgatgtagacgtcctcataccggcagcaatagaggagcagataactgcaaggaatgcggataagatcaaggcaaagatcatacttgaacttgccaacggcccgacaacgccagaggccgatgagatactgtacaagaagggcaagctcgtgcttcctgacgtgctgtccaactccggtggtgtcatagtgtcctacttcgagtgggtccagaacaactacggcgagtactggagcaccgaggaagtgacgaacaagctcgatgtcaagatcacgaaggccgcaaggcaggtccttgagactatggacaagtaccatgtagatcccaggactgcagcttatgtcattgcggtgaaaaaggtcgcagatgctatgaaggtaaggggttggtactga

SEQ ID NO: 41864 - DNA, 1275 bp, Thermoplasma acidophilum
gtgctctcaaatcttgattatctttatggattgaagagggaaggcattaaatttgacctcgatgtgatgagaggttttgctgacatgatcgggcatcctgagaacaggttcaaaagtttccatataacaggttcaaatggaaaaggatctacatcggaattcatatactcaatattaaggcaaaaattcagcgcagggatctatacatctccacacctgataaaattcaacgaacgcataatggtaaacgacagtatgatacctgatgattacatagattccttcataggaaaataccggccaatgatagaggatcttgccaagatcaacagaaacccaacattttttgaagtcacgaccatgatggcctttcagtacttcgccgatatgaaggttgactatgcctcagtggaggttgggctcggcggaaggcttgacgccaccaacataattatgcctctagtgagcgtgataacgcaggtgggctacgaacacgcagacaagcttggctgctcgcttacctctattgcatacgaaaaaggcggcataataaaggagggaaggccaatagtgcttcaggatcagaagcctgaagttgtgaagacgataaagagcatatctcaggtgcgcggatcgccactgatcatgctcgatccccaaaaaatacggggcctgaatctatccgaagctggcacatcgttcgatttcgaaggcatgaacgggacatatcaccttgaaaccgacctgataggtgaataccaggctctgaatgcagcgaccgccgtgcttgccatagaagcctctggaataggcctagaaaaaaatgacattgagagggggataaaaagcgcaaggtggcctggccgccttgaaataataagcagagatccgctgataatcatagatgcggcacacaatccacctgccgtgaacaagatggccaatacattccgcaaggtattcaccaagaagcccctcatagttgccggtatactatcagataaggattcatatgcatacttccacgtcatacgccagatctcagacaggataatattcacaaccccggaggagaaggaaagggcggtagatccaaagaaactctacgatctttacggccatctattttcagaggccagagtgatccctgatccaatagatgccgtgaacgaggccgcaaaaagatccgacttcgtcctggtcactggatcgatatacctcataggtgccgtgaaggagtactacgaaaagaagagagaaaaggtggttgcctga

SEQ ID NO: 41865 - DNA, 984 bp, Thermoplasma acidophilum
ttgaacctcagaaaaaaagttatgaataaatttgcaattaagtttacgaataaagtatctgattttatggcctcatattttgaatgcattgatgtgtctaagacctatgcgaaggggcagaccgctcttagaagcgtttccttcgagataccgatgcatggcgtcttctcgctgataggaagaaatggtgctggcaagaccacacttgtgcgcatacttgcaaccgagctcatgccaacctccggtaaggttttcatcgacgacatcgatataataagagaacctgatagcattcgaaggaggatagccataatcccacaggaggctagagccatatcatggctgactccgatgcagacggtcaccacctttcttctatacaggggcataaggtattccgaggcgaaggccagggcaaaagaggtgcttgcggatctgggattagcttccgttgctgatagaatgaacaggatgctatcaggcgggcagaagaggaaggttctggtcgcagcgctggtggcatcggatgccgatatactgttcatggatgagccaacgacagggcttgatcccatatctagatcagaactgtgggatattctatcggatctgaagaaggagaagttcatattcctgactacgcactatcttgaagaggccgagagattatcggatcgcataggcatactcgatcagggcgaaatgaaggccataggaaccatgtccgacctaagatccatggtaccgaagaagtacagcataagcctcgtagataaagagaacggaaacatcgagattgaaaataatggttcagttataaaggtgggaagcaggattttcgtcgatgaaaatgaggcatacgtcatagcgagggatctgataaataggaacatcaggttttcaataaatcccgtatcccttgaggatatatactatagcatagctaagaaggaaatagctggtggggaaagtgtacaggactag

SEQ ID NO: 41866 - DNA, 1617 bp, Thermoplasma acidophilum
gtgaattatttctcggacgacatcgtactgcaggacgtgctaaactatctcggctatgatattgatgataaacttcaggaaatgggaaggtacgtcagcgaagagatgatcgaggattcgatcttcatagatcattatggagaaccggtcctccagatgtggggcattctggacaatcgcacggacggaatatggatatcgaggacgcatcagaacatgatcgacaggcttctggacatgggtgtggtctcgaagatagccagcgaaaatgatctgatgtatcatttcatctccggatatcttatatcggatgcgggcctcttctgcactctgacgctaactgggcagacagcctatggcctcaggaagtatggcgatgccaggctgcagcaatttctaaatcattacgcgaacagcgaccactggctcggtgcaacctattacacagagatacagggagggagcgatcttggtgccaaccagacaacagcagtcagatccggtgataagtacatactcaacggtgagaacaagtatttcgccagcaacgctggccttgcggatggggctatcgtcacggcaaggatggagggtgcaaggccaggtgcaaagggaatatcggttttcttcgttcccacgctgagatcggatggtaccaggaactatgagataaggaggatcaaggacaagctcggcaccatcatggtaccaacaggagaggtcgtgctcaaggattcggagggttatctgcttggagatgagaaaaatggcatatacatcgcacttgagattcttgaggtctccaggatcgacgatgcgatagcggcgatgggcatagctagaaaagcactctgggaggcttatttctatgcaaacaagcgaacagcctttggaaagccgatcatagaccatcccctgatgctgagggatctcgcggagatggaatcggaggttgaggcgtcgacggtgctttcgatgatcgccgctgacatgttcaacaaagcgtctcacctcaaacctccctacgatgaccagtaccacatggccagggcatttacccacatggcaaagaacatagcgtcatggtccagcgactacgtgaccaggtataccatggaggttttcgggggcaagggattccttaaggagttcccggtggaaaagttccatagggattcgatagtcacatccctctgggaggggacgagcaacatacaagcgcttgatttcctggagatcgtccagaaaagaggcatagacgaaaagatcctcgcgctagtatggaacatcatggacaacctttcatcggaaaatgccgccatgcttaaagcggcctttgactctgtgcgtgagaggatggtttcatacaagaattctgaaaacatggaatacttcgctaaggacatactgaacatgttcggatacctgtctgcactggcctacatgttttcagtatcggaaaagacaggaaacccagggatgcagatggctgcccgcatatactactacaggcatttcgccaattcgcttgcgacagacatcaagttcagcgatttccgcagggtcatagattggatgaacaccactggcagcgaaaaggtcatcgagatgaaatga

SEQ ID NO: 41867 - DNA, 849 bp, Thermoplasma acidophilum
atggagccagagattcttttcaggaagatcgacgatcttggtgaaggcccgacctatgacgagagaagaaagcgtgtctactgggtagatataagaggaaagaaattccactacctaagcctcgagaattctgagatgaagacgttccaatccatagggatgatttcatccatcgttccaaccgaccgcgacctgatggccgcaacggtcgatcatggcctgtacctcatagatgacgctggaaagcatacgctcctgaccgaagttgagaaggatcagaagtccacgaggttcaacgacggcaaggccgatcccttcggaaattatgtggcaggaacgatggatcttgaggagaagaggcccataggttccctgtacgtgctcacgggaaagactataaggcgcattctcgagaacctcaccatatcaaacggaatagcatggaatacaaaaaagaaggtattctaccacatagatacgcccaagaggagggtggacgcttactcatacgatggcaagatgaacatagagcgactgggcacggcggtggacttcaggaacgaggttgggaatccagacggcatgaccatagatgcggatggaaatctgtgggttgcacactggggtggcaacaggataaccatccatgatccggaaaggcagaagaagatcgatgagataattttcccggcccagaacataacgtcatgcgtctttgcgggcaacggcctgcgcgatctgtatgtctcgtctgcatccaacggaaatccggatgacatggggggaagcctcttcgtagtgcataccgattacgctggttcaaagacgttcacgttcagcgtgccatga

SEQ ID NO: 41868 - DNA, 1302 bp, Thermoplasma acidophilum
ttgaagctttggtcgggagggatccagagggatcagaatgcggattccaccgtggcattcgtaaagcgggacattgaggctgaaatatacctgatgaagtacgagatcctatcgttgatagcctatcatcttgatctggcacagaggcgactcatcacggaggcggaatcaaaatgcatcatcaattcgcttatatcgcttctccaggacagcccgaaaatagatcctgaacaggaggatgcccacaccgctgtcgaaaacgcagtcattgagaggtgcggggatatgggccgcaatgttcgcctcttcctctccaggaacgaacaggttcatgccaacgtccttatgttcaccatcgaaaggtgccacagcataatatcgatcctgctggattccatcaaggtactgaaaggcgcggacttgaagggcctgctgccaggtacaacgcacttcatgcctgccatgcctgttacagcggcaacgtattcaaactacatagaaaattcgctggctttggccatcagatccatcgacagatcgcttgctgatgcatcggtccttccgtatggttatggatctggatacggcagccccaattctggaaaattgaaagtcatgtccgagatgcttgggatcggcccagttttgaaaaatccgatgattgcttcatccctctaccagttcaccatcatgcagatctcgaattccatcgccggcctatcgataacactctctaggatagccatggatctgatcgaatactacagggatggctatgtatcgttatcggatgaattcaccacgggcagctcactcatgccaaacaaaagaaatccggattaccttgaacttctgcagggtatggcagctgtgtcctcctcggtcgcggttatgtcggccatggcgacgatgaacaagacttctggctaccatcgcgacttccagatgctcaaggattcatacatcgacatgctgaattacattgaggaggccctgttgcggcttcctgatctatttaaaggcttgagatttgaaataaccgatccgatgatgctgccgggttcaatatttgccacgggcaacgcctgggaagacttcgctaacacccatgactggaagcagagctatgctaacatcggaagaaagatcagggaaaaacaagatctgaaacgctacatgccggaggattacgtcgatattgtggaaatgcactatctggaggagatagagaaaaaatacggcgaaatcctgaaaaaatgggattatctcattgaaaaagcggaggcgtatatcagcgaatga

SEQ ID NO: 41869 - DNA, 1218 bp, Thermoplasma acidophilum
ttgttcgccatggacaaggcgcttcttctgtattcaggtggacttgatacatcggtcatgatcaaatggatccaggaaaatctgtcgatggatgttgctacgctcacgctcaacgtgggcaacagcgatctggttgccatagaggaaaaggcaaggatgctcggggctgatcctgtcttcgtccacgatgcaaaggatgagtttgctgaaaaattcatagcgaagtcaataatggcaaacgggagctatgaaggctacccgctttcaacagctctcgcaaggccgcttatggctgaaaaggcggtgaaatatgcacagaagatcggtgcaaaatacatcgttcatggatccacgggaaggggcaacgatcaggtcaggtttgaggtatccatcagggcccttgacccgtcaatgcaggttcttgtacccgtacgcgaatggaacatgatgcgaaaggatgaggttgagtatgcaaaaacgcacggaataccggtaaagctcgatggcaagtactcaatagatgagaatatatggggaaggtctgttgaaggcccggatcttgaagatatcggcaagggcgtacctgaggatgtctatgaatgggttgtgcctccatggaaggctaatgcggaacatacactaaaaattgcattcgatggtggcataccgagtgaaattgatggtgaaaaaatgaaactcgcggatctcatagtttttcttaacaccttggcaggatcgagcggcataggcctcatcgatcacatggagaacagggttgttggcctcaagagccatgaggtttacgaatgcccggcagcaacggtgatcacccatgcgcacaggtatctcgaatcgctgatacttaacaggaacgaggccgaggtcaagatgaacatggactggcagttcgcgaagtttgtctacggtgggctatggcatgatcctgttatgaacgctgtgaatgcggctgaggccgaattcaacagggacatcagcggcgagatcaagatcaggatgtcccacggcataatgtacatagaaggtgcatgggggaacagcttcctttacagcaaggatctgatcaactacagttcaatggcctttgatcagagggcgtccaagggcttcatagatatatacggaaatgccacggtgcattctcacaacaggaatccgaagatggtaaaggaggtgcagggttcttcggtcgaattctga

SEQ ID NO: 41870 - DNA, 1437 bp, Thermoplasma acidophilum
atggcgtatcgggaggattctgaagcaagaaaattgggcacgtgggatctggtctttcagggcctgggtcagatcacgcctataacgatattgtcgggcctcatagtgagcatcgttgggctctcaggaatcaatgcaccccttgcaatgctcatttctttcgttgctgtggtactggctgcgaacacgatatatcagttctcaggcataatcagccatgctggaggatactatgcttacgttgaacatggccttggcaggcatgtgggcaaattcacaggcttgcagtacctgctgtaccaggcgtcaaatcttgctcttgagtatctaatcgtaatatggggattttcaaaatctctgaactacgcgttcggtacatcccttccggtttggtctggtatggtgtggatgggatcgatgatggccctttcctacgtgctcatgaggagaggcgcaaaaccatccctcaggctcgcactgatactcggatcgatacagattgcatttgttgccatattgtcgatgataatcataccgtccgctgatgataacacggtgcaggcattcattccgtcctccggttctggatggactggcgtcttcctaggattcatagttggcggatatcttgcattcgccggctatggatctgttgtgccgatgggggaggaggcgagatctccaaggaaaaccataaagaaggccataatagcaattgtggtgatggctggagcgatctttgtcctgggatcctatgctatggtagtgggcttcggactaagcaatctaggaaacttctcctcttcgatcatacctggcctgatagtggcgaggcgcttcaccggccttgcaggtgccgttatattcatcgttgtgagcacttttctctcaacttacggtacagtcatcggcatgggaacgccaatgacgcgagtcatgtacgcgcttggaagggacagagtgcttcctggatggctgggcaggatcgatggacgtggagtgccggcaagaagcatcgacatgacgtatgcaatatctgcagtttcagctgcgatgctcggtacctacttttacctcgcagatggcttttacgcaggccttttctatgcatgggcaatattcggaaccatagcaacgctgtccacgctgctgatacacatactgacgaatacatcgctatcagtatcctctgtgaaaaggcgatctggaaacttcatcttctggatcgctttgccatcgctgaccaccatcctgatgatcacggcgtattattattcgttgatcggcatgaccatgccgtatctcatcgcacccattgtttttgcagcctggatagtgatatcagcgcttatactcatggccaggaaagatgaatatgccagtatcgatttctctccttcaatggaacacatgggtgcaggtacgggtgatgagtga

SEQ ID NO: 41871 - DNA, 1548 bp, Thermoplasma acidophilum
atggaacacacaaggctgcacaacaaaggtctgactctagataagatctttctgaaaacactgcgaaccacccataacggttttctgacggatggaaaggatcgcatcggatatggagaattctatgacagagtcatagccatagcggaagagcttcacagggatcttggagaaaacagaaccgtatcagtgatggactggaatactctaaatttcgccacgctgctctatgcggtaccgctatcaggaaacgtacttcatccagtggatgtcaggcaaccgcctgaacaggtgatgtcctccatgaaggaagctcaaagcagctatcttctgtattcggcagatttcggcaggcttgctgacgccgtgaaaacttccggcatcgtcaaggaagacaatatcaggagcaccaaggaagtgtttgatgagagcaccgatcataagcctgggaatgctggtctgccggaactggaagaggacaggatagcgtcggtactcttttccagcggcaccactggcaagcccaagggcgtgaggtacaggcacagagatatagtgctgaccatatgggccatggagaccaatctgtctgcttttccaggcccggcaaggttggcttcttcggataccgtattctcgctgattccgttctttcacctctggtcctggggaacgctctacatatcaacgctcataggggccagctacgtggtaggaggaagattcgacccaggatccacatcggatctcataaagagaaacggcgtaacctggatgagcatggttccgacgatgttcaatgcccttatctcttgggacaggaactctctggacggtatgaagatactcataggcggatcagcaataccgtcgggcatactcaacttcgcctccgatcatcagattgagctgaccgggatctacggattcaccgatggactagcagcaggaataggaacttcgaacataaacggaagcctatcggaaagaaatgctgatgcggtgaacgccataactccattggtattcacggatttcgaggtggagggagaaaacaacgaaatcaaattcagatctccatggataccagagggctacttcaatgttcaggaggaaagggcatacagggacggctggttctatccgggcgattccgcagaattcacgcaggacggcaagataaggataagggacaggataaaggatctgatcaagagcggcggagaattcattccaagcgcacttctcgaatactatatctccgaaataggcgatataggcgatgtcgctgtaataggtgttcatgacgataaatggatagaaaggcctgttgcgatctaccggacaagaagcggtgccaccgtaaatgacgaaatcatcaggtcgtacctgaaggatctttccaacaaaggcttaatcagagactggtggattcctgatcgctttattcctgtggacagcatgcccatgaccggcacgggaaagatcgacaaaaagacgctcagggccatgctggagaagggggatctcagaacggatcgaaagtaa

SEQ ID NO: 41872 - DNA, 777 bp, Thermoplasma acidophilum
ttgacgagtgcaaaatacatcttcgatttttctggatctacggcggtggttaccggcgcattccaaggcataggaaaggcaatagccgatgcactgttggatgctggtgccgaagtttatggaatagacaaggcatttccagatcatggtgttgatgaaggcagattccatggcctgcatggcagcgttgattccctggatgacatcgcaagtctaagagatcgtgtagctgaaacttccggacggcttgattttcttgtgaacaatgcgggtatctacttctataagaaaatagaggactctacggaggatgattatgaaaggataaccagtgtcaacctgaagggttatttccttatgaccagggagttcctccagcttctcagaaaatcagattacccatccatcgtgaacatagcatcggtgtccggacagcggcctgaggcaggtcatcccctctactctatgaccaagggaggaatacttgcactgacaagagcgctatctgccgacctaggcatgctaggtatcagggtaaacagtgtaagccctggaaatattaagacgcctatgaacgacgaggacatactcgatcaggctaggaagcgtggcttggatccagacgaggtggagaggcagtatgctgctgaaagcgtacttggaagacgcggtgaagccgctgaagtggcctcggtagtgctattccttctgtcaaagggtgcgagctatataaatggggccgatatagttgtggatggaggtctgcttctggtatga

SEQ ID NO: 41873 - DNA, 1413 bp, Thermoplasma acidophilum
gtggaagaaggaaaggttgttcaggttcataaaagtgaaacgaagaaaagccaggtcagatgggtcatcgtatctcttctctttcttgcaatactgttcaattacgcggacagggagatatggatagtctcggagccggcttttgcatacagctttggctggtctcattctgctacggcgctcaccgcaacagctgttcacaacatttcgctgatactgttcttttggtctctgtcctatgcgatcttcaacttcccgggtggctggatcgttgacaagctcggcctgaggaagtcgatggcgaccatgttcgccatctggtccgtattcacggcgttgacagcggccacgttcaatttcatcagcatggttatcgtacgagtgattatgggcgctggagaagggccagtttggcccataaattccaaggtcgtaaaaggatgggcaaacagatacgatgagtccaaatcgtttacgctggccggtgctgggcaggctgtcggccctgttatcggcctgatcgccggtggaattctggttacaatgttcggatggccggcagcattcattctgttcggagtacttggactgatatttgctgccatatggtatttctatgtcagggacaggcccgctgacgattcgaaggttaacagtgaggagctggcgtacatcagggaaggaaagaccgaagaagagaaagaggaaaaggttcttccgtcaggtgttagctggaagatggctgcgaagatgatcttcggcacgcaggccggctggggcacgtttcttgtatttctctcattcggatacgttctcttcacgttcctgtactggcttccgccgctgatgttttcaaccttcgcccataccgtggagaagagcggtctctattctgctgccatagatgtggcgctgatagcaggttttctcggttccgggcctttcaacgatggcttgctcagaaagtttcctgataacaagccgcttgcaaggaggctaggcgccatcataccgatggttctgatgataatcatggtcggtctctcttacttcacggggaaggcgcacaaccttcttggaactgccatattcctcggcataggcagcgggctgatgaacctgacggtcggatcgtgggcagtaaatgctgtggatcttgcacctgccggcacatctgcgacggtgtacggcatatacaacggttcgctgaaccttgtcggtgctttcaattccattatcgagggtgcgctgttcataaaatatgggccggttcttgcctttacgagttcaataatattcatgctaatgttccttggaggataccttggcctcataaggaagaagacctgggaaagggccatggcgtacaaggagcaactttcaaaggaagcatatgcatatatgaaggagtga

SEQ ID NO: 41874 - DNA, 1338 bp, Thermoplasma acidophilum
ttgttagataatgccaatcttacaggcacacacgtatcttggacattgatagcgtcgcttggggatttcttggatgccggtatgtttgcaggtaccggtataacattatccgcaatactcgcctatttgcatataacatcgactctactggcaggatttccagccctgatcacgcttctcgggacagcgttcggcgcattagtcttcgggcccttaggagataagtacggaagaaaattcatctatcaggtagatatgattgtgtatgcagttgctgccatccttctggctttctcattcaactttatctgggctatggtattttatgccataataggtatatcagtgggtgcagatgttccaacgtcttggtctttgatatctgagtttgctcctaaaagtggtaggggtaaattgatgacgtatacaaacataatgtggtacgtgggggttctagttgaacttgcgatagctatagcgatatacaacaccggaatcacgctgttcagaaccatttggataatgcttggcatcatagccataattgcctgggctttaaggcgcagattgacagaatctccaagatttgatgtattaaagggtcgttatgaggatcttcacagtgccacaaaaattctcggaagcgcacaggaggctacaatttcagcctctacagcacctaaatacaaagaatatcgctatggagaactcttcaccaaatatggggggccattactattcgcctggttcctatacctgatgtggggtatacctgcctcaacttacggggagttcttcccatacatcttcagttcactacatctggtatcgacgagggttgtcttcgcttttgaagcaatatattttggcagtgcgatcgttccaggcctgcttatatactatttcctcaccgacaaggttggtgtgggcaggtatccgctgtatctcacaagtgcagctatgtcagccgtatcattcctgctgcttgtctataaacctttcctctataatgtaccggtgctcctcatttcattcctgctattcggtataggtcagggtctaggtgtgtggccaataactaggctatattcgctggagcattttccgaccagtataagaaattcagggcagggtttcatctggttcactatgagattcgaaggtgctatatttggactcttcactcctcttatcgtaaaggcaagtgtcacctacatcggatggatagcgggaatattcttccttgttgcattcatagtcgtcggtgtaatgggcgtagttgcaccgggttacgtgaggacagaatcaaaatccctggaacaaactgctggcgaatag

SEQ ID NO: 41875 - DNA, 738 bp, Thermoplasma acidophilum
gtgataaccggtggatctcggggcataggtagagcgatcgcgttgggacttgctaagcaaggagcgaacatacttataagctacgcctctcacgattccgaagcagacgaggttctggaaactgccagcaaatatggcgtgaaagcgcataaggtaaaggtcgatcagagcgatccatatgagagcataagatttgctgagaaagctatagaaacatttggcaaggtgcatatattggttgataacgccggcatatgcccatttgaggatttcttcagaatcagcgttgatttgttcgaaaaagtatggaaagtcaatgttgaaagtcattatttcatcacacaacgcattgcgaaaaatatgatcgagaacaaaataaacggaaggatactccttataagttccatcagtgcgcacgttggtggcgaatttcaaacgcattataccacaacaaaatctgcgcttaacggcttcatgcactcgattgcaatcgtgcttggaaaatatggaatacttgttaatagccttgaacccggaacaatactcacagacataaacaaggaggatctttcaaaccaggaaaaaagagcgtatatggaacgccgtacagtcgtggggaggctgggattgccagaggacatggtcgcacctgctctgtttctcctctcagatgataatacatacgtaaccggtacagaactgctggcagatggcggaatgcttataaatcttcaataa

SEQ ID NO: 41876 - DNA, 768 bp, Thermoplasma acidophilum
atgttcagcgatctaagggataaggtcgttatcgtgaccggagcgagcatgggcattggaagggccatagcggaaaggtttgtggacgagggttcaaaggtcatagacctttccatacacgatccaggtgaagcaaaatacgaccatatcgaatgtgacgttacgaacccagatcaggtcaaagcttcgattgaccatatcttcaaggaatacgggagcatttcggtgctggtcaacaacgctggcatcgagagctacgggaagatcgaaagcatgagcatgggggagtggcgcaggataatcgacgtgaatctgttcggctattactatgcatcaaagttcgccattccgtacatgatcaggtccagagatcccagcatagtgaacatatcgtcggtgcaggcatcgatcataacaaagaacgcctcagcctacgtcacgtctaagcatgccgtcatcggtctgacgaagagcatcgcgctggactacgcccccttactcagatgcaatgccgtatgccctgccacgatcgatacgccgctcgtcaggaaagctgctgaactagaagtcggcagcgacccgatgaggatagagaaaaagatctccgaatgggggcacgaacaccccatgcagcgcatcggaaaaccgcaggaagttgcctcagccgtcgcgtttcttgcctcaagggaagcctcgttcattaccggcacatgcctctacgtagatggcggcctcagcatacgtgcacccataagcacgccagaatga

SEQ ID NO: 41877 - DNA, 1800 bp, Thermoplasma acidophilum
gtggcatctgaattggacgggttcaagaaatgggataaagatcttgaaggtgatcttggaaaattcgaatttttcgtcaatggatacagcaatgtcagttttaactgtattgacaggcatgcaatgaaaacacctcagaagactgctataatatggctgagtgaggacggtttacggcaatcgataacctacagagatctcatgctgcagaccgcgaaatttgcgaaaggattggcagatgaaggcgtaaaaatgggagatgtcgtgacgatctttctccccaatagaatagaggcattcatagctgcccatgcctgcttcagaattggggcgatatataacataatattttctgggttttctgctaaagcccttctggataggatgaaggaaactaacccaaaggtggtaataaccacagacagcagtctacgccggggaagaaaaatcaacctgaaggagaccctagactcaataatcagtgaagtgccgtccgtgaagaaagtcatcataatcaagagagacggcaagcacgatctgaatctgggtgaaagggaagtatactacgatgactttatgtcaggaataacgggatatgccgaaccggtgcctatcgaggctaatgcacctggttttgtcatatacacttctgggacaacggccaagcccaagggcgtggtccattccggcataggttttcttgttggatcctatcacaatgtaaaatatgcgcttgatcttgggcctgaagatatcttctggtgtaccgccgacgtgggatggctgacgttcccgatcttcgaactcgtgggcggcctggcacacggtgcaacggtcattgcatacgagggggcgctggattaccctgacataaggcatttctacagcattatacaggatttcaaggttacgaaattgttcacggcgccaacctttttgagaatgcttgccaggaatggatcggacgtggcttctggatatgacctgagcagcctgaggctgatatcgctggttggggaaccgctagacgtgaagacatggaaatgggtgtacaacgacctcgggcacgggaggatagagataaacaacacctacggccagacggaaacagggagcgcatggacttcctctcttgtgggcgttaccggtgcaaggcccggttcatgcgggcttccactcccaggtcactcatttgatatacttgacgaaggtggtcaaccagttgaaaatggaaggatagggacgctcgtattgagaaagccattcccttcacttgcaagaggaatatggaaagacccacagagatatttcaaggaatatctttctgttttcccggggaattattgtacctatgattctgccgtccgtgacaggtatggccatatatgggtactcggaagaactgacgatgtgataaatgtttccgggcacaggatctccacaatggagatggaagatgcaataatgtctataccggaggtttctgaggctgccgttgttggtgtcgatcatgctataaaaggcatgtcaactgcggtatttgtcaccctcggcaacggaattgatttgccagcagatctaggaaaaaggatacaggacgaaattgctagaaggataggtaattatgccaagcctgaaagtgtatacgtgatcccagagatgccaaagacgcgtagcggaaagataatgcgaagactgttgcgagagatcgtaatcagcaataaagtgagcggtgatctgacaggcctcgaggatcccggtgtgatttcgcgcatactgcaggagatgaagcaggcttaa

SEQ ID NO: 41878 - DNA, 1425 bp, Thermoplasma acidophilum
atggaatcaaacgcatacgctaaaccggttaaggtgcccggtaggtcgatcataacatcgctgtccgcgatggggtatttcctggatggctacgatctgagcgtgatctctgtgttcacgctggtcctggtcacgtaccacatattcaggtacacggccttcacggagtcgttcgtcacaggatcggccctgctcggcgccttcgttggagcagtgctctttggccactacgccgacaggatcggcagaagatacctgtacatattcgatctcattttcttcgcggtttttgcggtgctcaccgcactcgcgacgaacatatatgagatgatagccttcaggttcttcgtcggccttggagtcggcgcggactattcgctgagccctgtgtacaccaccgagatgtatcccaatgcgaagaggggaggcggctacggatgggtctggaccttctggagcctgggtgctgcagctgcattcatcataggctacggcttctatctcatcgatccgctgacgggctggcgctggacgctcggtcttggagccataccggccatagtcgtggtcgtcatgaggatgaggatgccggaatccataaggtggaaggccgccgacaagaatgtatcggagcaggagatcagggatgtcgctgacagcatcggcatcaaaaaggaggaaatggacagcataatggcggagagaaacagggaatcgaggataagatcaggatcgctctcctccctctttaaaggagagtacggcaagagaacgctcatagtctggatacagtggatcctgtacgatatagcaggatacggtatcggcctctattccccgcttatcctcaaggaactcggcgtcagcggatcgtacaccctgctctactccttcatgttctacatgcccataggcttcatgggcgccttcggtgcagtaatgctcaacgaccgcgtgggaagaaggccgcttcagatactcggcttcggatcgatggccctggctatacttctcttcttcttcgcagcaagcggaaagggacaggtcttcctggccataggaatacttgcattcatcatcgattacgcacttggcaaccttgggccaggaaatacaatggggctgtacgccatagaactgctgcccacgaagttgaggagctcttccatgggaagcgccaccggcataacaaggatagtctcgttcctctccgccttcctgttcccatatctgtcgaagccgacagtgctcggaaaggagggtttcttcttcgtcctcttcgttgtgatgatcctcgcgctgatcttcacaatattcttcacacctgagacgaagggattgagccttgaggagataacggtggcaaaatacaggcacgagggctggaaaccagtcctcgccctggacgatacgagtaaaaaataa

SEQ ID NO: 41879 - DNA, 1260 bp, Thermoplasma acidophilum
gtgacctatatgccggagaatatggatccttttgagatggccctccagcagcttgaaaaagccgccgcggttctgaagctggatgagcaggcccttgagatactgaagcagccggagaagatcctgcaggtgagcattcccgttcggatggacaacggcaggataaaggttttcaccggattcagggtgaggtacaacaccgccagggggccagggaagggcggtatcaggtatcacacagaggaaacgctgtccacggtgaaggcccttgccgcctggatgacatggaaatgcgcgatcgttgacattccattcggcggtgccaagggaggggtgatatgcgatccaaagtccatgagccagggtgagcttgagaggctaagcaggggatacatacgggccatcgctgatttcatcggcccggaggtggatgtgccggccccggatgtatatacgaacccgcagataatggcctggatgatggacgaatatgagaacgttgtgaggcacagcgcaccgaatgtcataaccggaaagccacttgaagtgggcggatccgagggccgcggagacgcaacagcaaaaggtggaatgtacgttcttagggaaggtgcgaagaggatcggtcttgatctttctaaggctcgcgtggccgtgcagggattcggaaatgcagggcagtttgcagtgaaattcgttcatgagatgttcggatcaaaggtcgtcgcggtatcggacacgaagggaggcatatatgtgaaggatggaattgactatgcagcgcttctcgaacacaagaaaaagacgggatcggtcgtgggattcccgggatcggaaccgataaccaacgaggagcttctcgaatcggacgtagacgttctgataccggcggcaatagaggagcagatcaccggaaagaacgcggacaggatcagggcgaagatagtgctggaacttgcaaacggccctacaacgccggaggcggatgagatactgtacaagcgcggcatactggatcttccagatttcctctcaaactccggtggagtaacggtctcttacttcgagtgggtccagaacaactacggcgagtactggacggccgatgatgtgtacaaaaagctcgaccagaagatgaccaaggcagcgcatgacgtgttcgatgctatggataaatacaaggtcaatccaaggacagcggcctacgttgtctcagtcaagaaagtggcggacgccatgaaggccagaggcatgtattaa

SEQ ID NO: 41880 - DNA, 1494 bp, Thermoplasma acidophilum
ttgctccccatgtttggaaatcccgggacgacagagatcccgatgatcagagacgttaccgattatgttctggccctccacgatggcgtagcggctgccatcgctgaaggatacgcgatttcatccggaaggccgtcaatcgtgaatcttcacacggatctgggtgtgggcaacgccatggcctacctcataaccgctttgaaaaacaggacaccggtaatagtcaccgcgggccagcaggatcagaggcatcttgcatacagcccactgctttccggtaacctgtatgacctcgccggaaacttcgcgaagtacagatccgaagtgagaagggcttcggacatagcatacgagatgaggaaggcataccagattgcggcggaaccgcctaggggccccgtgttcctctcatttcccatggatgtgatggaacaggatggcctgtactcaggggagggggtcgcagtttctgaatacggaatcgcagacgatgacgatgttaacaggatagcccaggccataaacgaatccgagaatcccgccatcatcttcgggtctgaaatagacgaattcaacgcgttcagtgaagccgtggaattcgcaaggaaggtcggatgtcccgtatactcagagccgcttggaaacaggtcgagctacatttcggatgacccacagtacgccggtgagctgtttccagccgcaatactgatcaatcttcagctcatgcagcacgatctcctggtcttcataggatctgatataacgctttatccgtacacaaccgatacagttcttcccgaaaagcgcaagatattcgtgggcctgaacaacacgcggagaatgggtgagacgtacatagccaatccaaagaccttcctcaggaagataacgcccctggtgaagaagaagaatagttacagcgctcagaaggattacagaaagttcacggacgccatgcgagagaggaagaggatgggctacaattacgtgtcatacaggatatcgaagtatttcagcgattacacgctggtcgatgaggccatatccatgtcagagccgctgcgccattacttcggttacaggccccacggctatttcacggccaggagtggccagatagggtgggcgctgcccgcatccattggcatggcgatggacagccccaaggtggtatcggtgatcggggatggatcgctgatgtattcggtgcaggcgctatggactgcaaggcactacggcataccgctgaaaatgatcgtgctcagaaatggtggttacagcatactgcgcagctatgcaaaatcgtattatccggaaatcaaggatgccgattttctgaggccggacccggacgttgagagcatattatcgtcatacggcatcgatgtaaataccgctgacacagatctcagaaacctggagtggctgagatccggatcggatcagaaagcgattgtcgtcgatgtggacagatccataccgaacatgttctga

SEQ ID NO: 41881 - DNA, 3423 bp, Thermoplasma acidophilum
ttgtcgtcgtacatcgagaggatcgaggcgcacaattttaagtcattccgcaggaagaaggtcataaatttcacgaagggcctcaacgtcataagcggcccgaacggcagcggcaagagcaacataggcgatatgcttctcttcgtcctcggaacaaagtccatacacgctgtccgggcggacaggctatcggaccttgtgagcaagggatccggaaacgaatgcagcgtctccgtcacgttcaggagcgacgacggcagatcgctggtcatagagaggaggctcgtcatagaggatgaaccgaagtcgtactattacgtcaacggggtcagatccaggctctcggagattgatgagaccctggcctccatgggcataaacttcgggacatacagcttcgtgcttcagggggatataaacgatttcatctcttacagcggccaggagcgcaggaagctcatagagagaatatccggcgtggatcagttcgacagcgagattgaaagggtcaaagctgacatcgaagccgtcagcaggaacatggagataaaccagacgataatagacgagaagaggcagaacctggaaaggctgcgaacggaaaaggagaagaaggagaggtacgatgcgctgctgaagagaaagcgggacgtggaatacacggagatactgaacaggaaaaacgctatggaaaggcagaagcgcaccatagaggggcagatctccgatctcacgaaagaaatagcacagcttgaagaacgcagatcggatcttgaaaagcgttccgaggctatcaggatcaggagggaagatgttgcgaaaaggatagacgacctgacaagcggcgagatgaacagggtgaagacggaccttcattccgtcgaggtggatatagcgaagatacgcggtatcatcgatgaaaagaacaggaatatggagaagctggaggagaccatagcgaagtatgaaagcgaaagggacagcacggaccgcgagatcgaggatctggacaggcagatagaggaaaaggcgaagaggaagagggcactggaggatcgctacgccgatctcaagaagagatacgatgaccttttcagcagggctcaggccgaggccgtggatgcggcggagaccaggagaaaatcgaaggaataccaggagaagatcgacgggctgggcagggagatagaggaactgaaagcggcaggatcgcagatgaacgccgatcttgctgttttgctgcagaagaaggccgcactggaggagaggaaggaggaccttgatctgaagatcaggacatcagagtggaaggcaaaggaaacgtctgaggatatgggcaagtacagcaggaagtactacgatctcaaggccaagtacgatcagataaacgaccgcatatccgatctgaagagcgagatcagcgaaaaagaggcatcggccaagatcgcatcaagcagggtgccggagtacgtcaggaacgtaaagatgcttgaggagagcgtcgaaggcgtgatcggcctcgtccgcgatctgatatcgtacggcgaaaagtacgttaaggccgtggaaagcgctggcggaggcaggcttaatgcagtggtcgtgaaggacgatgctgtcgctaaggaatgcatacagatcctgaaggaccggaagatatcgcctatgacgtttcttccgctgaacaagatgcgggatccaccggcacagagggatgtgggcaagatctcaaaggacccgggatacctcggcatcctcatggacttcgtcgacttcgaggatcagtacagatcggccgtgtattatgcaatacgtgacacgatactggtccaggacatcgatgccggcaggaggctgatgggaatattccgccttgtgacgcttgacggcgatatattcgatcccggcggatccataaccggcggttacaggaattacgcctcggactacgcatcagccctgagaatgcagcatgatctcgagggcatgaagatccagctctcctcgctgatggatgatcgatccaggataaagagggagatggaccaggcattcagcgagatgagcgaggcttccaggagaaccggagagatcatgaaggagcaggagatgctgaagaaggaggcggagaggtcaagggaagaactcaagcaggtcatggacgatatctcaagcacagacagggcgatagcagacaaaaaaaggatgatagacgaaaatgaaaaggtgatcgaacagaagacgctggatctgcacaagtatcaggaggctctgaacgatctgtacgacaggatcgacccggagttcttcaagaacatcggagacctctcaaacgagatcaacgaggtgcgttccgagatcgatgccgttgccagcgaactgaatcagatcaccagcaggagggacatactctccagcgaaagaaagcatctggaggatcagatgatcgatacgaagctccaggagaattcaatcgcagctgagatcgatgacctcaatggaaagaagagggaactcgaggagaaggcgaagaagtatcagtacgcactgaacgatcttgagggccgctacggcaatctttcggcacaggtcagggaggccgataagcagatcagggagatggagaacggcataaacgatgccaaggcatccatcgatctgaagaacgatctcatgaacgatctgaaggtcaaggcgggcatactggaagggaacctgtcatcgatcgagagggaactgtcatcgtacagcggctgcgaagccgtgatcggagatctgcaggccatgaggcaggagatcgaaagggccataatggatctcggcgagataaacaatgctgcaccgcagcagtatgaggatgcgctgaaggatctcgatgattacgagaagaaacatgagaagctcatggaggagaagaaggccctggaggagaccacagccatgctcaacgagaagaagcgcgaggtgttcgtgaagacgttcaccgacataagcgagaagatgaactatgtgtacggcataataaacgggggcaccgcaaagctgatcatgatcggttccgacccgctgacatcatcggtggaggtgagcgtaactccaaaggacaaggcaacggtgaagatacaggcactgagcggaggcgagaagagcgttgccgcactttcattcataacagcggtgcagatacttatgcccagctcgatatacttcctggacgaggtggatatgtacctggatgcctacaatgccgagaacatgatcaagatgataagccagaacgcgggtgaggcacagacgatagtgatatcgctgaaatcactggttttcagctatgcgtccaacgccataggcgtgaccagcgtcaacggcgagtcgttcgtgttcaacggccacttcgacggttctccggaggctgcaccatga

SEQ ID NO: 41882 - DNA, 1311 bp, Thermoplasma acidophilum
atgtgcgttttgatgccgcattttttgtacctccgatcactgatctccggacgaaggtatataaataaggatcatcgctatccatgcaggaggttgggattcatgggtatttacgacatttttgatgatgaatcggccaggagcatatccggaatgtccatagatgagatggcgaagaagtacggcactccggtgatcatctattcacgggcaaggatcgtctcaaatatcagacgtatcagggaggcctatgagaaccgtgtaaggatgctctactccgtcaaggccaacgacaaccctaggatcatagagatcatgcatcaggaaagcatcggatcagattcagcgagcccgatggagatcatgatgtccattttctctggaataccgccggaggacatactctactccccgaacaatgcctccgagtacgatctcaacttcgcgcttgatcgcgggatagccataaacttcaacactttcacacagtacaggaagatgagggaaaagcccgagaggatatccttcaggatcaacccgggttttggcatgggcgaattcgcaggtaccaccaccgggggtgccaggacaaagttcgggatagacccggatgccgccatcctggcctacagaaaggccagggaggacgggatcagggagttcggtatacacatgatgatcggatcgaacaacagggatcatgtcaagatcgctgaagcgtattcgaatttcttccgcattgcagacaggatcgggagggaagcgggcgtgagttttcaattcgcggatgttgggggtggcctgggcattccgtatgtccagggcgaaaacgaactggacattgcggcactggggtcagccgtgttgaaagaatttgatcgataccatttcggcgatctcgtcctcgaaccgggacgctatctggttggcgatgccggcatcatcgtcggcacagtcaacgatgtgcacaacggcttcgcgggcacagacatcggcatgaacctcaacataaggccggccctgtacggcgccaggcacacgataatcccggtcggagagagggttgagggcgagaagatcaccgtcaccgggcagatatgcgagaacacggacaggatcggcgatacggcatggaggttgagtgagggcgatcgcataatggtgctcgatgccggcgcctacgtttactcgatgagctccaggtacaacggcaggccgaggccgcccgagatcatgatcatggaggacgggaaggacgtgatgatcaggcggagggaggatttctcggatttcatcgcaaccgtcgtctga

SEQ ID NO: 41883 - DNA, 3144 bp, Thermoplasma acidophilum
atgccgcgaagggatgacatacacaggatactcgttatcggatcagggccggtcgtgataggccaggccgccgagttcgattattccgggtcgcaggcatgtctatcgttacgcgaggaagggtactatgtggtgctccttaactcaaatcctgccacgatacagacggatcacaggatagcggaccgcgtatatatcgaaccgataacagtggaggctgtggaacgcataattgagaaggagaagatagatgccatagaaccgcacatgggcgggcagactgcccttaaccttgccgtgaagctcaagaacagcggaatattgcagcgatacggaataaagataataggtacgccggtggaatccatcgagctggccgaagaccgtgaaaaattttacgaattcttgaaggcaatgggcgagccgcagcccgcgaggtacaggataaggagggatcatatcgatgaggacgtcgcttcaattccggatattccggtgatagtccggacttcgttttccctcggtggaaccggcggcagcatcgtgcagaacaggcaggacctgctggcaatggcggagaacctcttccgggcatcggacatagattacctggaggtgaatgaatcgctggagggcatgaaggagatcgagtacgaggtcatacgggattcctttgggaactgcataacagtgtgcaacatggagaacctcgatcccatgggcgtgcacacgggcgagagcatcgtcgtcactccgtcccagacgctgagcgacatcgagtaccagatgctccgcgattcagccatacgcatcatatccggcctggggatagagggcgcctgcaacatacagttcgcgctgtcagagggcaggtactacgtgatagaggtaaatccgaggacctcgaggtcgtccgcgctggcctccaaggcaaccggttatccgatagcgaggatagcggcgaagatagcggcaggatacggcctgcacgagataaagaacccaataacgaagagcacgttcgcggcctacgagccgtcccttgattacgttactgtgaagataccgaggtggcccttcgacaagttttccgttgaccgcaccatcggcgtccagatgaaatccataggcgaggtcatgggcataggtcgcacgttcgaggaggcgctgatgaaggccatagccagccttgacaacgcgttctcttcgaacataaggttgcacgttcctgacgatgaactctggcggctcatagggaagcccaacgaccgcaggatcttcgccatctttgagggcctgttccgcaacttcgacgtgaagcgcatgtccaggctttccggttatgacgaatacttcatagagaagatgcgcaacatcgttgaggcccttcgaaacatggacatgggccgcattccggagaatctcctgaggatcaagaggatcgggatacctgacgagatcatttccgcgttctgcggtgtgcctgccgatacgatcacgaagtacaggatcgacaggaacatcatgccggtctacaagcgcatcgacacatgctccggggaattcgaggtcgccgtcccgtacatgtattcgacctatgaggatgaggacgaaacgccagacctgtccggttccataatgatcataggctctggcccgaacaggatagcgcagggcctggagttcgactacggttccgtgaaggcgattcttgccctcagggacatgggctacaggagcatcatgctgaattccaatccggagacggtttcgacggacttcgacatatccgatgcgctgttcttcgaaccggtgaccccggagtacgtcgtgaacgtcatacgcagatccggatgcgcgggactcatagtccagttctccgggcagaccgggcagaacatggccaggaggatagaggagatactgggcaaacatatcgtattgggaacgtcgacggagagcatagaccgcatcgaggatcgcacggtcttctcaagggtaatagagggcctcggcataaagcagccgcccttcgccatcgcggagaacgagaacgatacggtgaggaaggcgatgggccttggccttcccataatcctgcgttcaagccacgtgataggcggacgttccatggagatcatatacgatgtggattacctggcagacagggccagggagatcttcgccatatcgaagaacgtgcttgtgagcaagtacctggaaaatgccgtcgagatggacgtggacttcgtatcagacggcacctcgtatagcatatgcgggatcatcgtgcatatagaggaggccggcgtgcactctggtgacgcaaccatggtctacggccccggcatagtgcccgtggatatagagaagaagatcgagggcatcgtcggcagcatggtcagggagttcaggctcatcggactatcgaatctccagatcgccgtgcgcgacggggacgtctacgttatcgaactaaacgccaggtccagcagatccgtgcccttcatatccaaggcgactggcattgactgggtccgccttgccgtcgagtgcatgatcggttcacgcatcgaaaataagcgtatggaggcgaagagctacttcctgaaggtatccgtctttccgttctcaaagttctccgacatggacgtggtatatggcccggagatgaagtcgaccggagaggcaatgtatccgggccgaacgctggccgaagcgctgagaaagagccttcagcgcagcatatcatccgtgctcataacggtaagggacgaggacaagcccaggattgtggacatagcgaggatcctgctggagaagggcgtaaagctgtatgccacggccggaacctctaagtttctcgcggatcacggcatacccactgagacgctctaccgggtcagggacaggagggaaccgcgcatcctggacatgatctcgtcaggatctatagacatggtgataaacacgacagagatgaccgccggtgccgtcagggacggtttcaagataagacggatctgcataatgcggggcataccgctaataatgaacataaatttggcaagggcctacgcggaggcgcttggacaggttgaggtggattaccgcgagatcggcgattacctgcaggtgtcatga

SEQ ID NO: 41884 - DNA, 1062 bp, Thermoplasma acidophilum
gtggaaaaggttgaaatgaagcgatacttgatcaccagcgacgggaccgtgatagcaggttatggttacggttcccccgtcacagggtatggagagcttgttttcaccacctcgatgaccggttatctcgagagtatgacggatccgtcatacgtgggccagatcctcgtgtttgcgtcgcctacgatagcgaattacgaactgcgcaagggcgtgatggagagcgacagggtgaaggtatctggcatcgtgaccagggacgctcacataaacatgccggccgggacccttggcctggacttcgaccgttttctgagggacgaggggataccggccatagacggggttgacaccaggcttcttgtgcggaagataaggcagggcggcgtcctcagggcatacatagcggacgatcctcagggccattctgatttccccgatcccatgtccgagaatcttgttgccagggccgttgacgccaggggcgtgaagaacatcaggggtaaaggcgaaaggaggatacttttcatcgatcttggttcgaagaaaacgctgagagatatgatgctggaacacttctccctgataatggcttctgcggattccgatcttgatgccatcgataaatacgatgccatattcgtgtccaacgggcccggcgatcccgatcatccgtcgctgaggccggtggtgaattttctgaagaggaacataggcgtgaagccaatcttcggaatatgcttcgggctgcagataatagcgctggcatacggatcgaagacgtacaagatgaagttcggccacaggggatcgaaccatgcggtcacggatgggaaccgcatatacgtaacgacgcacaaccacgggtacgccgtggacccggataccgtgagggacttccatgtcagggagcgcgacataaacgacggcacaatcgagatgatcgaggacgggatgatgatggccgtgcagtaccatccggaagcttcgcccggtccgcacgacaccaggtggttcttttctgagatgaggaggaggacggaggatgccgcgaagggatga

SEQ ID NO: 41885 - DNA, 2097 bp, Thermoplasma acidophilum
atgatatcatctgaggtttctgaagacaggatcaaggatctctggagggatttcttcaggctctacgggtactcggacgagataaacagaatacaccaggagtatccggaggtgaggaccctttacgtatcattcagggatctcgaggactacaactggcagttcgccggttccatactggtctctccggaaatatacataagggccggagaggaggtgatacttcaggattatctcctggacagggtaacgcagaggttcaacatattcaatctcaggataaaggaccttgaggagaagaacgtagcgtacaggatacgcgatataaggagcgcaaacataggcacactcatcagcgtatctggcatagtcaggaagaacaccgaggtgtttcccaagctgaagaacgctgccttcgaatgcagcagctgccacggcctcacgtacgtggaacagacggagaacaggctcagcgagccgcaggtctgcgaccactgcggactctccagaggcaaggacaagatattcttcaaactcaggcccaacctatccgaattcatagacgtgcagaaggtggagatacaggaggacccggaaacgcttgaagggggatcgcagcctcagcgcataaccatcataaccgaggacgatcttgcaggcttactctacccgggaaacagggtgatcgtggacggcatactgaggacggagcagcgcaggcagggaaacataccgctgaccgagttcttcacctacctgtacgcaataaacgtcaggaaggacgtcaaggagctcgagagcgtgaagataaccgaagaggataagaagaggatcatcgagatatcgaagaaacccgacataatagatgtcatatccagatcgatagcgccgacgatacacggcctggatatggtgaagaaggcgcttgcgctgcagatgttcggcggtgtacggaaggtgatgaaggacggcacgaccatgcgcggcgatatacacatacttatggtcggtgatcccggtaccgccaaatcgcagctcctgaaatacatggcggaggtctcgccgaggggcatcttcaccttcggcagggggtcaagcgctgccggcctcacggccgccgccgtacgggatgagttcggagagggaagatggacgctggaagcgggcgcactggtcctcgcggacaacggcttcgtggccatcgacgaactggacaagatggacgaacacgataccgctgcgatgcacgaggccatggagcagcagaccgtaaccatatccaaggcgggcataatggcaacgctgaaggcccgcgcatccgtgcttgcagctgccaacccgaagttcggcaggtacgacctgaacaggaacctcgccgagcagatcaactttccccttccgctgctctcaaggttcgatgtcatattcaagatggtcgatcatccgaacaaggacagcgacagcaggcttgcagagcacgtgctgaaggcgcacaggatcggcgagatctacaggagcatagagcacagcgatgccgacatcgaaattgacgagcagggcttcgaaccggagatcgacaaggacacgctcaggaagtacgtggcatacgcaaggaacaatgtctttccaaggctcagcgacgaggcaatagccatactccaggatcagtacgtcaagaccaggagcacgtcgcacgatgcaatacccataaccgtgaggcagcttgaatccaccataaggctcgctgaagccgcggcccgtgccaggctgtccacgatcgtaacggtagaggacgccctgctggcgaagaagatcgtcgattactacctgatggatgtgtccatggacaatggaaagatggatatcgacatcatatatacgggagcaagttcgaagcagaggaatgatatggaaactgtccttgatataataaagcagctgaagtcggaaaagggcatggccgaggtcgctgacgtcataaacgtggccatgagcaggggcatgactcagaagaaggctgaggaagctttgcttaagctgaagaacgcgggccagatattcgagaaatcctacggaaagatcgacgtgataagttga

SEQ ID NO: 41886 - DNA, 1482 bp, Thermoplasma acidophilum
atggatacgaagttatacatagatggacagtgggttaattcttcttccggaaagactgtcgacaagtacagcccggtgactggacaggtcatcggaaggtttgaggcggcgaccagagatgatgttgacagggccatagatgctgcggaggatgcattctgggcctggaacgatcttggttcggtggagagatcgaagataatttacagggcaaaggaactgatagagaagaacagggcggaacttgagaacataataatggaggagaacggaaagccggtaaaggaggccaaggaggaggtcgacggcgtcatagaccagatacagtactacgcggaatgggcgaggaagctcaacggcgaggtcgtcgaaggaacgtcgtcccacaggaaaatattccagtacaaggttccttacggcatagtcgttgcgctgacgccctggaatttcccggccggtatggttgcgaggaagctggctcctgcgctgttgacaggaaacaccgttgttctgaagccgagcagcgatacgcccggaagcgcagagtggatcgtgcgcaagttcgtcgaagccggcgtaccgaagggcgttttgaacttcatcaccggaaggggatcagagattggcgattacatagtcgaacacaaaaaggtaaacctaataacgatgaccggttcaaccgcaaccggccagaggataatgcagaaagcatcagccaacatggcaaagctcatactcgagctgggcggaaaggcgccgtttatggtgtggaaggacgcagacatggacaatgcactgaagaccctgctgtgggcgaagtactggaacgcgggccagtcttgcatagcggctgagcgcctctacgtgcacgaagacatctacgacacattcatgagcaggttcgtggaactgagcaggaagctcgcactgggcgatccgaagaacgctgacatgggcccgcttataaacaaaggcgcgctccaggccacatccgagatcgttgaagaggcaaaggagagcggtgcaaagatactgttcggcggaagccagccaagcctcagcggaccgtacaggaacggctacttcttcctgccgaccataataggcaacgcagaccagaaatcgaagatattccaggaggaaatattcgcaccagtcataggcgccaggaagatatccagcgttgaggaaatgtacgatctggccaacgattcaaagtacggcctggcatcgtacctgttcacgaaggacccgaacataatattcgaggcttcagagaggataaggttcggcgaactttacgttaacatgcctggtccggaggcctcgcagggataccacacaggcttccgcatgaccggacaggcaggagaggggagcaagtacggaatatccgaatacctgaagctgaagaacatctacgttgattactccggaaagcccctgcacataaacaccgtgagggacgatctgtttcagtga

SEQ ID NO: 41887 - DNA, 2343 bp, Thermoplasma acidophilum
atggaagtcgagaagtacgatctcacgctggattttgatattcagaagaggacattcaatgggacggaaaccataacggctgacgctggagacatagtcctcgatgccgtaggattgcagataaactggatgaaggtcaacggcagggacacggcgttcacctacgatggccagacggtaagggcccccggtgattcacagccacagaagatcgagatatcctttgccggaaaggtttcagattcactgtcaggaatatactatgccggccgtgaaaacggcatgataaccacccacttcgaggccacggatgccaggcgcatgtttccctgcgtcgatcacccggcctacaaggcggtgtttgccataaccgtcgtgatcgacaaggactacgatgcaatatcgaacatgcctccaaagcgcatcgaggtctcggagaggaaggtcgttgagttccaggatacgccgaggatgtcaacgtaccttctctacgttggaatcggaaagttcaggtacgagtacgaaaaataccgcgatatcgatctcatactcgcatcgctgaaggacataagatcgaagtatccgctggacatggcgaggaagtccgtcgaattctatgagaactacttcggaattccatacgctctcccgaagatgcacctgatctccgttcctgagttcggagcaggggcgatggagaactggggcgcgataacgttcagggagatatacatggacatcgctgagaattcggcagtcacggtgaagaggaactcagcgaacgtcatcgcgcatgagatagctcaccagtggttcggcgatctcgtgacgatgaagtggtggaacgacctctggctgaacgagagcttcgcaacattcatgtcgtacaagacgatggacaccctatttcccgaatggtctttctggggagacttctttgtcagcaggacgtctggcgcactcagatccgattctctgaagaatacgcacccgatagaggtggatgtcagggatccggatgagatatcgcagatattcgatgagatcagctacggaaagggtgcatccatactgcgcatgatagaggattacgcaggttacgaggagttcaggaagggcatatcgaagtacctcaacgatcacaaattcggaaacgcagagggatcggatctctggactgcaatagaggatgtttccggaaagcctgtgaaacgtgtcatggagtactggattaagaacccggggtatcctgtcataaagctgaagagaaacggcaggaagatcacgatgtatcagacgcgcttcctgctgaacggtgaagaagagggcagatggccagtgcccgtaaacataaagaagaaggacggcgtggagaggatcctgctggaggatgaagcatcgatcgaagcggacggcctcataaagataaatgcggacagcgctggcttctaccgggtgctttacgatgatgcgacgttctccgacgttatgggccattacagggatctttccccgctggacaggatcggactcgtggacgacctctttgcattcctgctctccgggcatattgaccccgaaacgtacaggcagcggatcaggaacttcttcgatgacgaagaccacaatgtcataacggccatagttggacagatggagtacctgcgcatgcttacgcacgcgttcgacgacgatgcaagggcattctgcaggtcaaggatgcagtttcttaccggaaagcaggatgagaatctgaaaatagcccttggccgcgtatcgcgcctctacgtgatggtcgatgaatcctacgccgaggagatgtcaaagctgttcaaggactttgacagcgcggaacctgagatgaggagctcgatagcgacagcctacgcactggtcaccggtgatctcaagggcctgcttgaaaagttcagatctgttgacagggacgaggacagggtccgcatcatatctgccttcggcaagctcaagtcaaacaccgatctatccaccgtttacggaatggtggagaagaccgagataaagaaacaggacatgatatcgttcttcagctctgcgctggagacgcttcccggccgcgaattcatctttgcaaaccttgacaggatcatcaggctagtgatcaggtacttcacaggaaacaggacggcgtcaaggaccgttgagatgatgatccccgtcatcggattggatcatccggacgccgaggacatcgtccggaacatcggatcgaagaacataagcatgggcctcgcaaagggcatcgagatgctcgccgtgaacagaaagcttgtggaaaggatcaggcagacagcagtgaaatga

SEQ ID NO: 41888 - DNA, 810 bp, Thermoplasma acidophilum
atgcgaatgcaatgcgcaaaattaataatacactggcatgttagcataagcatgccaaacgccattgtatctgcagcctcaagcggtataggtaaaggaatagcttccgttctttcacgatctggataccggctcaccctgtttgcacgggatgagaaacgaatcgatgaggccagaaaggaactgaagttaaaattcggcttggaacctctggccattcctgcggatctgtcaaaaccagaagacatagatagagttgtcaaaaagcacagggagacctatggaagcattgaaaacctcgtaatcaactatggcgatccacgtgtggccggctttactgatctgagcgatgaggactggcaatacgccatagatatgatattcatgtccacagtcaggatcaccagggaagcactcaaggacatgatcagggcaaggcacggatcgatagtgtacgtgacatccatgacggtccgtgaacctatggaagggttctccctatcatcttccctgagatcggctgtagttgcactggcaaagaacatatcgctagaggtctctaaattcgggataaggataaacacaatatctcagggatacatcaatacggaaaggctaagagacgtcataaaaactggggttgaccgcaccgagggcatgaggagactcagcggagatgttccactgcgcagagtaggagatccggaggagataggtgaagttgtagaattcctgttatcaagccgggcctcctatgtcaacggtgctaacatacccgttgacggaggaataactaaatttccgctgtga

SEQ ID NO: 41889 - DNA, 1083 bp, Thermoplasma acidophilum
atgttcactcttggcagctcaatgaagatgacggtattcggttcatcgcatggcgaagccgtaggatcgatcatagacggctttccgattggtttcaaaatcccgttggactatgtgcagaaatacatggagtacaggaggcctggatcaagcatactgacctcacagaggaaggaagatgatgaggtcgagatcatttccggccttcatgagggttacacagatggaagccctctgacgcttatcataagaaacaagaacgtgatatcatcgtattacagcgagatcagggagaatcccaggccaggccacagcgactacacgatgtttctcaaatacggagaattcagaaactatgagggcggaggtttcctgtccggcaggatgaccgcaccgcttgttgcagcaggttccattgccaaggcatatctcgaaggcatgggcataaaagtgaagagctatatgaggtcgataggcgacgttgaatgcagcagggtttcaggagaagcttacagctttgaaaccaggatgccagatccagagtgtgatgcgagggcgcgtgaactcataatgagagttatgaaggcgggcgacagcattggcggaagaatagacacggtcgtcgagaactttccgggcggtgtcggcgaaccgttctttgattccgttgagagctccatcgcgcatgccatcttttcgataccagctgtaaaagccatagagttcggcgatggcttcaggctcgcttcgatgcttggctcagaggcaaacgatcctttcgatcttgccgacggaaagattgtgacgaagacaaaccacaacggcggcatcctcggtggaataacaaacggcatgccaatacgattctcaattgcggtgaagccgacgccgtccatacacatccctcagcagaccgttaatctatccacatctgagaaaacgacaataacggtaaagggcaggcacgatccctgtgtggccataagggcagttccggtcgtcgaatgcctcacatccttcgtactgctcgatctgctcatccagtccggcaacgtaaaccgctacgccaggaagacaagatga

SEQ ID NO: 41890 - DNA, 2238 bp, Thermoplasma acidophilum
atggaatccaacaacggtatcatactcagggttgcagaagcaaactcaacagatccaggcatgtcaagagttcggctcgatgaatcatcgcgaaggttgcttgatgccgagatcggagatgtcgttgagatcgagaaggtcaggaaaacagtgggcagggtctacagggcaaggcctgaggacgaaaataaaggcatagtcaggatagacagcgtcatgcgaaataattgcggggcatccataggggacaaggtaaaggtcaggaaggttagaaccgagatcgccaagaaggtcacgcttgcaccgataataagaaaggatcagaggctgaaatttggtgaaggcattgaagaatatgtgcagcgcgcactcatcagaaggccaatgctggagcaggacaacataagtgtacccggcctaactctagccggccagacaggtctgctcttcaaggtcgtcaagacgctccccagcaaggttccggttgagataggcgaggagacaaagatcgagataagggaggaaccggcctctgaggttctcgaggaagtctctagaataagctatgaggatataggaggcctttcagagcagctaggaaagataagggagatgatcgagctgcctctcaagcatccagaactcttcgaaaggctagggataacgccacccaaaggtgtcatactgtatgggcctccaggaaccggtaagacgctgatagccagggcagtggccaatgaatccggtgcaaacttcctctcgataaatggcccagagataatgagcaaatactacggtcagagcgagcagaagctaagggaaatattctcaaaggcagaggagaccgcgccttcgataatattcatcgatgagatagattctatagcgccaaagagggaggaagttcagggtgaggtggagcgcagggtagtcgcgcagctgctcaccttgatggatggaatgaaggagaggggccatgtcatagtcataggcgccacaaaccgcatagatgccatagatcctgcgctcaggaggccgggccgctttgacagggagatagagataggcgttccggacaggaatggaagaaaggagatcctgatgatacacaccaggaacatgcctctagggatgagcgaagaggagaagaacaaattcctggaggagatggcagattacacctatggattcgtaggagccgatctggcggcgttggtcagggagagtgcaatgaatgcactgagaaggtacctcccggagatagatctggacaaacccattcctacggagatcctcgagaagatggtagtaacggaagacgacttcaagaatgccctgaaatccatcgaacccagcagcctcagagaggtcatggtggaggtgccaaacgttcactgggatgatataggagggcttgaggacgtcaagagggagataaaggagacggtggagcttccactgctcaagccagatgtgttcaagaggctcggaataaggccctcaaagggatttctactctacggaccgcctggtgttggaaaaaccctgctggcaaaggcagtggccacagagagcaacgccaacttcatatccattaagggcccggaggtactgagtaaatgggttggagagagtgaaaaagccataagagagattttcaagaaggcgaagcaggttgcgccagccatagttttccttgatgagatagattccatagctcccaggcgtgggacgactagcgattccggggtcacggagaggatcgtgaaccagctgttgacatcccttgatggcatagaggtcatgaacggtgttgtcgttattggcgcaacgaacaggccggatataatggatcctgcccttctcagggctggtagattcgacaagctcatctacataccaccacctgacaaagaggccaggctgagcatactgaaggtccacacaaagaatatgccgcttgcccctgacgtcgatctcaacgatatagcacagcggacagaggggtacgtcggcgcggatcttgaaaacctctgcagggaagctggaatgaatgcgtacagggagaatccagatgctacctccgtatcgcagaagaacttcctcgacgcactcaagaccataaggccatcagtggacgaagaggtcataaagttctacaggactctgtcggagaccatgagcaagtctgtgtccgagaggagaaagcagcttcaggatcaggggctttatctctga

SEQ ID NO: 41891 - DNA, 1011 bp, Thermoplasma acidophilum
atgaaggcagccctactagaaaaattgaatcagcccttgtccattgttgatcgtgagattccggaacctggcgaaaacgaagtggttataaagcaggactatgccggcctctgttatcgtgatattctcagcgccaccggcttttttccgaggatacagttgccgataatacctggccatgagataggaggcactgtggtgaaaaccggcagcgaggtacgcaatttccatgtaggcgatcatgttgccagcctcatatacattccgtgcggaaaatgcgaatactgcagatctgggaatgaaaatctttgcccgtataagaaatcgatcggagaggaagtccagggcggtttccgggaatacgtcaacgtgccggagataagcctgataagcgcacctaaggaagttgacaccaggtaccttccaatagcgtcatgtgtgacgggtatgatatatcatgcacttttcaagctggcaaaggtcaaggagggccagagggttctgataacaggtgcaggcggaggtgttggatctaacgctgtgcagatggcaaaggcgttcggcgcaactgtcatagcggaaaccacctcagaatcaaagaaggagatgctggagaagattggcgcagattacatagttgacggaaatggaaaattcaatgaggatgtgaagaagatcggcggcgcggatatagtcttagaatgcgtgggaatacatacatttgagagatcgctgaggagcctgaacaacggcggaaagatgatcgttataggaaatataaagccagatcctgtaaatctcccattgggcctgataatcctgaagggcaataccataaggggaagcataagctccaccagaaaggatgtttcagatgccctgaagatggttgcagaaaacaggataaagcccgtcataggatctgaagtgagcattgacaggataaatgaagccatggagatgatgaaaaacaaacagactgaagggcgtgttctgattaaatttagttga

SEQ ID NO: 41892 - DNA, 627 bp, Thermoplasma acidophilum
atggcaatgcagataaaaggcgtgatcttcgacttcgacggtacgctcctggattctgttgaactcaggataaccgcatggaagaaggcatttcagaatttcggagtgaatgtcccggaggatctcatcagaccgatgataggttatccagggatcgatctagcgaaaaagtttgtgaagaatcctcttgacgttgagatgctccaggaggattactttctcaagaatatagaatccgcgaaattctttcaggatgtgattccaactctcgctgaacttaggaaacgcggaattaaaactgcagttgttacctcgaccagaaggatcgttatgcagaagttcagtctccaagttgatcatgtcgttacgatagatgatgtgtcaaagggaaagcctgatccagaaccctatctgaaggcgctgaagatgatgggcataccagccgaagaatgcatcgtcgtcggagacatagaaaatgatctcatacctgctaagaagcttagatgtatctcagtactcgtaaagcatgggcgtgatatcagttccaactatgccgattatgagatagaaaatatagcggatatactgaacgtcatagatcatctagctgagaaaaataataggtga

SEQ ID NO: 41893 - DNA, 894 bp, Thermoplasma acidophilum
gtgatgggcatatccgttagcaatgtatcgaagaggtacggagatctcatggctcttaatcgcgtttcattcaacgtcaatggcacgggatgccttgtccttctcgggccaaatggagccggcaagacaacgctgatgaagattatgacaaacataataaggccgtcagagggtaacgtgagcataaatggcttcaacgtcagggaaaatccaggcaaagccctggaaactgtaggatcgctgatagagcagccagaattctatccctacataacgggctatgaggctctgatgtttacatgcaggataaggggcatttccaaagaaaaatgcatatcagaagttcagcgtgtctcaacgctaacgcactgccgcgattatcttaataggaagaccaaagaatactcgcggggaatgaagcagagggttgggctcgccacagcactgataggcgacccttcgattataatactggatgaaccaactttcggtcttgatcccaatggaatgatggagatccgcgatataataatgaagatgaagaaggaaaagctcattgtgctcagcacccacctgatatctgaagctgaattgctagcggattatataggaataatagatcacgggcgcctgatgcatttcggccccgttgaaaaacagcgttatcttgaggtgaaaggccaaataaacgaagcgcacgtcaacgtgcctggagtagaaatagtgaaaaaagacgatgtccggatgatattgaggaagagcgatggcgttgacaattgggccataataaaggcacttgaaacctccggatccatcatagaaacattcgattattacagtataatcgaagacctttacagaaataacgtttcgcagacggatgcagaaatgtga

SEQ ID NO: 41894 - DNA, 1515 bp, Thermoplasma acidophilum
atgaaatacgggtttttagaaaaactctatcctgtattcaggcgctacctaaaggaccgtaagcatgagagagaggatcatgagtgggattatgagattgagaggcacggcgaaatagctgtaaggaggttcatcgagctcggcccaacattcataaagctgggccagatactttctgctcggccggacctgcttccaaaggaatacctgaaatcgttcaggctccttcaggatagggtggatccggatccctttccgctggctagggagatcatcgaacgcaatgtgggaaagatcgaagacgtatttgaatacttcaacgagaacgccatatccggagcttcgcttggccaggtgtatgaagcggtatatcacggaaaaaaggtggctgtgaaggtaaaccggtataacatagaggagagggtaagaaacgatctcattgtcataaaacacctcctgaggcttgccaagggcagaatagacaattttctctatcttagcatcgagaatgttgtatctgatttcaatcggcggatctttgacgagatcgattacaggaaggaagcctccaacatgcgtgccatagctgccaatttaaaggaggaggatcgcgtcatagtgcctggaataatagaggagctttctggaaaggaagttctggtgatggagtacattgaaggaataaagatagatgatgtccagaggcttaaggatgctggccttgatacaaaggagatcgcactaagatacgacacaatattcatgcgtatgctcctgaagaacgaaatattccacgcagatccacatccgggcaacgtttccgtacgcgaggatggatcaataatcctgtacgactttgggatgatagggcatatcaatgacgatatgcggttcaggcttctttctctttacgatggtctccttaacagagatccggatgagataatagatgcgctcatagccctgaatgcactttcgccaggcgcaaacagaggcgttatcaggaagggcatcgagctggccatctcgaatttttatggcagatctgcggaagatcttgaaatcagggagcttctggacgtggccaacgacgtcatatttcagtttccattccgccttcccagggcactcgttttatacatgaggatgtcttctctccttgaaggcgtatgccagcagctggatccagacttcaaattcataagggtgctccagaagctactctacgatgaaggcctaatacagaccctctacaagcagcagctgaaaaattttctatccgatacgctgagatcggtggagaaagctgtgcagatcgttccacttatgaaaagaaggctggagagcgaagatgaaaccgtgagaccgcagagagactacaggataccggcatcaatattccttggcttcatcctcctctctcttttcatagaggagaaaaccaggcctcttgtgtttatccctcttatcgcaattgatatcgtggcttttctttacataatgattagaaaatga

SEQ ID NO: 41895 - DNA, 1005 bp, Thermoplasma acidophilum
ttggaggcgattcgattgccaataataaagactgagaatctaaccaagatatatcctggaggtataaaggccgtagatggactaaacatagagatagaggaagctgagatctacgggctgctcggaaagaatggcgcaggaaagacaacaaccataaagatgctcacaacagccatcgatccgacgtctggaaatgccattattggtggttatgatctgagaaaggataaggagaagataaggaggataataggcgtcgtgccgcaggatctgacaacggatgctgatctgaaaggcgttgagaatttgaggatgatagcatcattctacaatatccccaagcaggaagcagaacagagaataaaggatcttctggaaatagtggatctctctgattggggaaacaagtatgtatcccagtattcaggcggaatgaggaagaggctggaactcatatgcgggcttgtaaactcgccaaagatactgtttctggatgaaccaacgcttggactcgacgtgaacacgagatcaaagatgtggaaatacatcagagatatacagaaagaacttggcgtaacgataatactcacctcccattatttagaggaggtggatcaactagccgatcgcatctcaataatagaccatggaaagatactgataactggaacaccagacagcctcaaggccagccttaaaggcgacgtgataaccatggaattcaactcaatggaagatgcagaattagctagatcctatccaggatcgctggaagcttctgtgatgggggacgcaaaggtaaggatgaaggttgaaaattcagacacagagcttccaaagatactcgagtaccttttggaaaagaatgtgtcgcctattacaataaatgtgaaaaaaccctcgcttgatgaggttttccttgaatatactggatcgtcaatagaagaggatattgatccagaacagttcagaaggatgatgcagaacgtcaggaggttgagatag

SEQ ID NO: 41896 - DNA, 1206 bp, Thermoplasma acidophilum
atggaactacctatagaagaaataaaagtaagaaaggtccttgattcaaggggaaattttaccgtggaggccgacgtcacggttccgaatggttttggaaggacctctgcgccagctggagcgagtacaggggaaacagaagttatagccttttccaaatccggaatcgacgcatcgatacagttcttcgaatctaaggtgaagagatcacttataggattcaacgcactggatcagagcggcttcgacaagcttctcaccgatatagacggatcgggcaacttctccaatctcggaggaaatctagcaaccgccttatccatgtcagtagccaaggcagcagcacagagccttggaataccactttacagatacgtcggaggaatcagatcaaccatacccaggccgatgggcaacgtcataggcggcggaaagcatgcaagaaatggcacatcgatacaggaatttctcgtatccgctcagggcagcacattccttgagtcagcgtacataaacgtgctagtgcacaggcgcatcggcgacatgctttccgacaaattcaaagacataagcataggcgtcggcgacgagaggacatggagcgttaacctcagcgatgaggaggctttcgagatactgaacgaggcggtcaaggagatttcgtccgagaagaaggttaagatatacacaggtgttgactttgcagcagattccctgtacgagaatggaaaatacgtgtacaaacacacaacgaagagcagggatgaacagatagattatgccatatcgatatcgaaagacttcggtgtctactatatcgaggatcccatgtacgatactgatttcgacggcttcgcggagataacggcaagaataggggataggagcctcatcgtgggcgacgatctgtatacaacaaatccggacaggataagaaagggtgtggagaagaaatccaccaacgctgtgctcataaaggtgaaccagatcggtactctaagcgcagccagggaagccgtggccgttgccacatttgccggaatgaaaaatatagtgagccacagatctggagaaaccaccgatgatttcctcgcgcacctttcagtggccttcggatccacgttcgtcaagactggagtgataggcggagaacgtgttgcaaagctgaacgagatagcgaggatagaagaatgcttaacatcatag

SEQ ID NO: 41897 - DNA, 2661 bp, Thermoplasma acidophilum
gtggcacaaatagagaagtttgtctatagatttgatgaaggaggaaaagaaatggttgacctcctcggtgggaagggagccggcctagctgagatgacaaagataggtctgaatgtacctccaggatttaccataacgacgaaggcatgcatcgccttcttgaaacatggcggtttccccgaaggcatgatggatcaggtcatgcaggcactgcacgatctcgaaaataaagtaggcagggtattcggcgacgaaaagaatccgctgctggtttcggtaagatcaggggcaccggtcagtatgcctggcatgatggacacggtactgaacgtgggcctgaacgacagcactgttgaaggattggcattcatgaccgataacaggcgctttgccatggatgcctacaggagactcatacagatgtttggagagatagtctatgggcttccgcatgaggagttcagggagaagatagaagaagtcaagaggatgaggggctatgatgaggatcgctttactgtacaggaccttcagggcctcatcgatcagtacaccgtaatataccgcaagcatggaaagatctttcctcaggatccagaaacgcagctggttgaatccataaaatcggttttcaactcgtggaacagcaagcgcgctgttgcctacagaaagatgaatggaataccggatgatatgggcacggctgtgagcatagtcgcaatggtctttgggaacatgggcgacgattcagctactggtgtggcctttacaagagatccaaacacgggagagaagaaggtatttgccgagtaccttaccaacgcccagggcgaggatgtcgttgcaggcataaggacgccgaagtacatcgatgacatgcagaacgagatgccgcaggtctatgcggatctgatgaagacgtgcgacatcctggaacaccactacagggatatgcaggatatagagttcacagtggagcgaggaaaactctacctgctgcagacaaggactgggaaaaggagtgcaaaggcagccatcaggatcgccattgatatggtggatgaagggatcatatcggaagaggaagccctgatgcggattacgccggcgacgttcgacaggactatgcatccgcaggtaaagaccacgggtagggaaattccgctcggaaaggggcttgcagcatctccaggtgcagcctctggcatgatcgtattctcttccgagcgtgcccttgagattgggaaatcgaagaagatgatcctcgtcagacctgaaaccacggccgacgatgtgcgtgggatggctgtgtgtgagggattcctgacgcagaagggcggcatgacatcgcatgctgcggttgtggccagagcaatgggaaagccagccgtggtgggcgtggaatccatgtcggtgaatgccaatgagaagacgctgaccattggcggaaagaagctcagagaaggcgatgtggtgaccatagacggcacatctggctatttctacgagggcgagttgcccgtagagaaacccacagttgacgattattcgaagaggcttctggagatcgctgataagtacaggaggctgggtgtgagggcaaatgcaaacacgccggaagaggccaagatcgcgcgcgagaatggtgcagagggcataggcctcgcaaggacggagagaatgttccttggcaacgacaggatagggattatgcgatcgatgataatgagcgagacgcctgaagatcgaaagaaataccttgatcagttgttaccgatgcagatacacgatttcgtcgaattcttccgcaccatggagggttatcctgttataataaggcttctggatccaccacttcacgaattccttcccaacaaggaggacatcataaggcagatatacgacgtaaataacggaaagggaaaaatcgaggatctgccataccttgaaaagcttctcaaaacggtcagggatctggaggagttcaatcccatgctgggctttagaggatgccgtgttggacttgtttatccagaaatatacgatatgcaggtcagggctataatcgaagcagctgcaaaggtcatagaggaaggccgtgaaatatatcccgagataatgatacctcttgtcgggcaccacaacgaactcaggaagatcagggcaaggctcgaggagaccgcaaagtccgtgaggaatcacgagaaggtcaagtacaagtttgggacaatgatagagataccgagggcatgtgttactgcagataagatagcacagtatgccgacttcttctcattcggaacgaacgatctcactcagatgacgtttggatacagcagggacgacgctgaaggcaagttcatgttcttctaccttgaaaacggcattctggaaagtgatccgttctcatccgttgacagggatggagttggcgaactaatgaagatggccgtagagaggggcaagagggcaaagcctgatctcgaggtcggaatctgcggcgaacagggcggagatcccgatacgatagagttctgcgacgagatcggtctggattatgtgtctgcctcgccccacaggataccggtggctaggctggctgcagccagatccagcatagctaggaacaggccggagatgacacagatctcaaaatattga

SEQ ID NO: 41898 - DNA, 1635 bp, Thermoplasma acidophilum
atgaagaccaagatagttgcgacaataggcccggctagcagttcgcccgagataatgaaacagatgatagacaacggtctttcgctggtaagaataaattctgcacatgcagatataaaggatgtatcgaagataacgcagatggttcgttctatcaacagggacgttggtataatgatagacctgaagggcccagagctcagaacgggcgaattcgcgggtggtacattgaaaatatcatccggtaaggactacgtcatgggcaaagacatagtcctgaacaacatgaacgtgctttcggctgttcaggttggcgacaggatactgatgagcgatggtgaagtatcattcgaggttgaatcaacagatccgttcacaatccgggctctaaacgatggcgttctaagggacaggagccgtgtgaatatccccggccgtttcatagagctcggaaccataacggacagggatcgtgccttcataagggagggcatagcggatggcgtggacttcttcgccctttcatttgtgcagaaatctgagaacgttgacagcctgcgcgacttcgttatagacagcggtggcgatcagtacataatatcgaagatagagacgaagagcggcctggataacatagaggagatagtgaagtcatccgatggcatcatggtggcgcgtggcgatctcggtgtggaacttcccttgaaagaggtcgtgctggctcagaagcacataataaagacagcgcatgaggatggcgatttcactatcgtagcgacccaggtgctggaatccatggtaaacaacagttcacccacaagggcagagatttcagacattacaaatgcgatcatagacaatgcagatgccttaatgctctccgaggagagtgcgataggaaagtatccggttcaggccgtccgtacgctcaaggaggtttcggattacgtggaggacaaggtgtcgttcgattcttcatattactttaagggaaacaccatagcatactcagtagcaagggcagcgaagatactctctgatgatatcaagagcgatgggatagtggcacttacgcatactggatcaaccgttaggatgatatcgtcgctgaggccaaaggccatggtctacgctgccactgtaagcgagagtcttgccagaaagctgaacatatacttcggcgtattgccattgcatatggagggcaacgcagaagatcttagtttttcagagattatggaatacatagtgcgttctggtaggttcgctgatggaagtaagctcgtgatgaccagcggcgatccgtacttcacgtttggagggacgaacgacgtcaaggtggccgttgtaggcaaattcataggaagaggctattcatttggagatagcttatccggtacggcaacttacggtacgaagggagacatactcatgtctgaggatggaagaattcctggaactgatttcagggcattcatattcacatctgatatcaagccatctcttatgtcttctttaaagggaaaaacggttgtaaccaaggcaagattggttcgtcagataaaggaaggcgagcgcatatacatcgatggaaatacgggaataatactcatggcttcgccggatcaaaaataa

SEQ ID NO: 41899 - DNA, 1086 bp, Thermoplasma acidophilum
atgactgaacagaaagccattgtgacagatgcgcccaaaggtggcgtgaaatacacaacaatagacatgcctgaaccggaacattacgacgccaagctttcacctgtatacataggaatatgcggaacggatcgtggagaggtggctggtgccctgtcattcacgtacaatccagagggggagaattttcttgttctcgggcacgaggcgcttctgcgtgttgacgatgcccgtgataatggctacataaagaagggcgatcttgtagtacccctcgtgagaaggcctggaaaatgcatcaactgcagaataggcaggcaggataactgttccataggtgatccggacaaacatgaggctggaataactgggcttcatggtttcatgcgcgatgtcatatacgacgatatagagtatctcgttaaggttgaagatccagaactgggaaggatcgcagtgcttacggagcctctgaaaaatgtcatgaaggcttttgaggtcttcgacgttgtgtcaaaaagatccatattcttcggggacgattccacgctcataggtaagaggatggtcataataggcagcgggagcgaggctttcctctactcgtttgcaggcgtagatcgcggtttcgacgtcacaatggtgaacaggcacgatgagacggaaaacaagctgaagatcatggacgagttcggcgtcaagttcgcaaactaccttaaggacatgccggaaaagatagatctcctggttgacaccagtggtgatccaacgacgacattcaagttcctcaggaaggtaaacaacaacggcgtcgtcatattgttcggcacgaacggcaaggcgcccggctatccagtggatggcgaggacatagattacatcgtggagaggaacataacaatagccggatcggttgatgccgcgaagatacactacgtgcaggcccttcagtccctcagcaactggaacagaagacacccagatgccatgaagagcatcataacatacgaggcgaagccgtccgaaaccaacatattcttccagaaaccacacggagagataaagacggtgataaagtggcagtga

SEQ ID NO: 41900 - DNA, 831 bp, Thermoplasma acidophilum
gtgaagatcctcaggggagaggagatcgccgaaaagaaagccgaaaacctgcatgggataattgaaagatccgggctcgaaccatcgctgaaacttatacagattggagataatgaggctgcctcaatatatgccagggcaaagatcagaaggggaaagaagatcggtatagccgtggacctggaaaagtatgatgacatttcgatgaaagaccttctgaagaggatagacgatctagcgaaggatccacagataaatggaatcatgatagaaaatccgctgccaaagggctttgattattatgagatagtcaggaatattccctactataaggacgtggatgcgctctccccatacaaccagggactcatagcccttaaccgtgaattcctcgtgcctgcaacaccccgtgccgtgatagatatcatggattactatggatatcatgaaaatacggtgaccatagtgaatagatctcccgttgttggccggccactgtcgatgatgcttctcaacaggaattacacagtatcggtatgccacagcaaaacaaaggatataggctcgatgacaagatcttcgaagatcgtggttgtggccgtgggaaggcctggatttctcaatagggaaatggttacaccagggtccgttgtcatagatgtcggcataaactacgtaaacgacaaggtggttggggatgcaaattttgaggatctttcagaatatgtagaggccataacccctgtgccgggaggggttggcccgataacggcaacaaacatactcgaaaacgttgtgaaggcggcagaattccaaaaaaacaacctgtaa

SEQ ID NO: 41901 - DNA, 2391 bp, Thermoplasma acidophilum
atggaggtagagataaggatcgtctctgcatcttataggcagagcgatgtggccgttgaactcttcggcagaactcgggagggggaatccgtagcagcactatattttggattcaggccttattatgatgttgttgagccggatgaggcgtacctgaaagtgatccagaatgatcccgaatttgtaaagatggaagataaaaggctctggattaggggcaaatacgaaaacgtcaagaggatatacataagatctccttggaaggttccagaataccgggagaaatgtccctttgaagttctcgccgcagatataccattccaccatcgcttcatctacgatctggatcttggatcctgcgtaaagataatcggagaaaacatatccgacagagaaacatccttcaccacagatatagtcattcgggcagaccggatagagaacgtaaacgatttcaatccaaatctgaaggttctcagctttgatgtcgagaatgagatcaaccgggagaatgtggaagattacggaaagatactggtgataggatattccgtcagctttcaggggaagaccgtgaccggatcattatccggtgaagagcaggatatactccgcagttttgtcgatctgataagggcggaggatccggatgttatcactggctacaacatagatggatacgatatacctgtgataaagaagaggatggacaggtatgggataaagctagagataggcagagatggttccattccaaggagaataatgaaccagttctggcgtgtccacggacgcctgataagcgatacatggtggagcgtcaagaggatactccatccgaagcatgaatccctagattacgtggcgaacatgcttcttggcgagggcaaggataacatagacaggcttcacatagaggatgaatggaagaaaagacgtgaagaggtcatagcttactgtataaaggatgccgatcttacactacgtatttttgaaaagctgatggtaatgaacaggctgatgtacatgtcttcggtcacaaagctgccccttgacgatgttgcaaacgtcggcaccagcaattacgttgattcaatacttatcagagctgctgacagagaaaatataggcgttccaatgaaccagcacgagatcaaaaccgaggagatacagggcggatatgtgcatagcataggtgcagggctctactcaaacgtgatagtcctggacttcaagagcatgtatccatccatgataataaagtacaatgtctgcttcacaacgcttgatcctaacggtgagatactgtccccaaacggggtgcgtttcctatctcctgaaaagaagaagggcctgataccaagaatactgcaggagctgatggccgacagggatgaagtcaagaggcggatgaaggccgcaaagacgaaggatgaacgcgaattttatgacggaattcagaacgcaataaaggtgcttatgaacacattctacggtgtgctagcatcttcgttctacagattcacagatcacaagatcggaagtgcgatcacggcatttgccagggaaacaataaaaggcataatttcaactcttgaatccgcacattacagggtcatatatggagatacggatagtgttttcgttgaatctggagctggatcggccgaggatgctataaagaggggaaaagatctgagtgaaaggctttctagggaacagggtctcacgctggattttcagatggtgctggatccgttcttctcccacggggcaaagaagcgatacgctggaagatgcgtttatccggatgacatgaagggtgaaatagtcataaagggatacgaagttcgcagaaccgattcattcgatctgcagagccaagcattgtcaaaggtcatagacttcatcctcaacagagatatagatggagcgataaaatacgcagatgacctgataaagaaggtcagggccggcgatccttcgatagatatcgatagcctcgtgatatccagaactgtaaaggatttccaaagctacagggccaatcaggaatcgctcgccaatatcagggctgcaaagaagctgatagatatgggtgaaaccttcgtcccaggtatgaaagtttcgtggatcgtcaccaatggcaagcgtacccctcaggaggtagaaccatatatatatggtagggatctgaacgtcaagccggactgggattactatgctaggagattatccgaaacgcttggcagggttatagatgtgttccgcaccgatctggggcagggtcagaagactgcaagcttggaaagctttggatcgtcttcggatgaagctaagccagtgaacaaggaaccgcgcaagaacagcacattggatagcttcttctga

SEQ ID NO: 41902 - DNA, 816 bp, Thermoplasma acidophilum
atggaggctggatctacagatcctccgaagaacctgataaaagtgaatgaaaaacagattgaatggtgttgtgatatgatcagactgaacctttcggttaagaatctcaaggagattacggatttactgagcacgatagtatcagaggcgaagttcagagttgacgaaaacggcatgagcgtaaccgccgttgacccagcgcatgttgccatgataaggctggaagtcccaaaggaagcatttgttgagttccacacggatgggcaggaggagatcgccctggatattgacaggctcaagtctgtgatcaggctagcgagctcctcagagaacgtcggcataacaaaggatggtgaaaagctgaaatttgagctgggcacaataaacaagagcatatcgcttcttgatccgtcaaccatagttaccccaaagatacccaacataacgtcggagtactatgcagtcttgaagaagtctgatttcgagaggggcttgagggcagcagaggatatatcggattcaataagattcaccctctcccaagacggtttcaaggcctattcgcattcggaatcggaagaatcagagatgatacttcccaaggatctgataacggacatgtcttgcaacacaaccatcaagagctcttatcctctcgaatacctgctgaaatttataaaggcaatatcctcaacggatagcttgaaactcagcttcagggatgattatcctctatcggttgaattttatctggatcagaatccaggcgcaaagataaaaggacttttccttctggctccgagaatggagcagtaa

SEQ ID NO: 41903 - DNA, 939 bp, Thermoplasma acidophilum
atggttgaaaatacgaaaaagaaaaaggttgaggagatagaaagatgccctgaatgcggttccaccaatcttataagggattacgagcatggagaacttgtctgcggagaatgcggggcggtcattgaggatgcctatatcgatcaggggccagagtggagggcattcgactctgagcagaatgaaagcagggccagagctggatccccaatgacctacaccattcacgataagggtctttctacagacatatcatggaagaataaggattcgtatggaagatccataccgacaaggaacagggcccagctgtacaggctcagaaagtggcagaagaggataaaggtatcaaatgcagccgaaagaaacctttcacaggcactccaggagcttgagaggatggcctcaaacctgagcataccggacgatgtgaaggaaaccgcagcggttatttaccgcaaggctgtaaaacagaacatgatacgcggccgaagcatagagggcgttgtagcaggagcactctatgcggcctgcaggataactaacgtacccagaacgctcggtgagatagcctcggtcacaagggtgaagaagaaggagataggtcgaacctataggataatgagcaggtatctaaagctgaacataatgccttccaaggccgaagactatatcagcaggttctgttcaaagctgaagttatcgatggataccaggaataaggccctcgagatactgagatctgccgagaatgcgggtctgacttcgggcaaggggccaacaggagttgcggctgcggcgatatacatagcatcgctgatgaccggtgaacggagaacgcagagagctgttgccgaggttgctggtgtaaccgaggttacgataagaaacagatacaaggaactcactgagaaactgcagctcaacgtagagcagtga

SEQ ID NO: 41904 - DNA, 1653 bp, Thermoplasma acidophilum
atgatgatgtacgaagatgatatcagaaggatagcactaataaatgcatatcagcacgagggaaaagccgatctcaagtctgtcatgggaaaggtcatggcggagattccggatctcaggcgcgatccccgatcagctagggagatggtctctcgcattgtagacgaggtcaattcaatgagtgcctatgagataagggaaaccgtagagaccagatacacctcatcgataagaaaggagaaaaaagtagaggaacatcgtcttccagatctcgagggagtaaacgggccggtagtaatgaggatggccccatctccgtccggaccactgcatattggccacaccaggatggcaatactcaacgacgagtatgtcaaaaggtatggcggcgaactgattctcaggatagaggatacaaatccgaaaaacatagatccagatgcatatcatatgataccggaggatcttgaatggcttggcgtgaacgtgacgaagatcgttatacagagtgacaggttcgatctgtactatgcagaagcaaagaagctgatggaaaacggccatatgtatgtctgcacctgccccagggaggagttcaagaagaggaagctagaatcaataccatgcaaagatcgcgataaccctcctgaaaccaatcttgaactcttcgataagatgatcgatggcaccataaaggaaggagacgccgttgcagtggtgaagactgatctaaaacatcctaacccttcggtgagggactggatagcattcaggatcatagaagcaaggcatccgagggtcgatgacaaataccgcgtctatcctatgatgagcttcagcgttgccgtggacgaccattatcttggcctgactcatgtccttagaggaaaggatcagctcacaaacaccgacaaacagaggtacattttcgattacaatggctggaaaaagccatactattaccattatgggatgataaaattcccgggaatcaagctgaaaacatctctgatgaaaaaggggatactcagcggacagtacgagggatggtctgatatcaggctcggaactgtgagggcttttgcaaagagaggctacagaccggagaccttcaggcgatactggataaactccggactgcgcgaaatagatgcgatcttctcgatagaaatatttgactccataaaccgtgagatcgtggatcctagagcgtaccgcttctcgtttgtaaaggatcctgtaccagttcgcatagagggcatgccaaacatcagcgcgaaactaccattgcatccaacgcacccagagtacggcttcagagaatatgaagttaagggctcagtttacatagccagtcgggattttgccgctatttcagagggcgagagaataaggctgaaggatctatgttacattagaaaaaaggggaacggcataatctatgacggtgttgaaatgacagagaaaaccaagataatcaactggtgcccagaggggtctagggacttctccgtactgaaacctgatggatcgaaggacagtggccttatagaaccaaaatcctcaggatatcgtggaatcgcacaacttgaaagatacgggtacgtcaactttgctgatggagatgatctggcctatttcactcacccctga

SEQ ID NO: 41905 - DNA, 924 bp, Thermoplasma acidophilum
atgactgttgaaggggaaacaccgaagcgttgtcctgaatgcaattctgaacacctaataagggattatgaacacggcgagctcatctgtgcagactgtggagctgttattgaggatgcctacatcgatcaggggccagagtggagggcattcgactcagaccaggacgaacggagagcgagaaccggatcacccatgacctacctgagccatgataagggcctcgccacggagatatcctggtcgaataaggattattatggaaagaggatcccgcacaaaaatagggcacagatataccgtgttagaaaatggcatcagagaatacgtgtttccaatgctgcggagaggaatctgtcccttgcacttcagctcttgaacgatatcggtgcgaaattgggcattccgaaggacatcaaggaaacggcagctttgatatacagaaaggcggtagagaagaacctcatcagaggaaggagcattgagagcatagtatgtgcatccatatatgctgcttgcaggaaggttaacatacctcgtactcttgatgagatttcgaaggcatctgaggtaaacaagaaaaagatcggaaaagcgtataggcatcttgctaaggaacttgatctgaacctgaagccaacaaccccgttctcttacatttcccagttctgcaacaagctcgatcttgacaagcaggcaatagtgataagtgaggatatagtaaggcaggccatgtccatgggcatttcctccggaaaaggtccaacaggcatagctgcggccgcgatttacatagcttctgtgaaggtcggaaaacccaggacacagaaggaaatagcaaggatttcaggtgttaccgaagtgacaataaggaacagatacaaggagataagcaaggcgcttaacatctctatatcggaatag

SEQ ID NO: 41906 - DNA, 945 bp, Thermoplasma acidophilum
atggaaattaaaacagtaggggttataggtgctggaacaatgggatctgcaatagctgagcttttcgccttcaacggtttcaatgtagttatgaaagatcagaacatggatcttgcgagatccggctattccgggatagagaaaatactgaatgatatgaagaggataaatgacgagaaaccggaaaaggaaatagctaggatcgagaattatggaatcaagctatcagacgatcagaagaatgccatcaggaaaaagatcggagtacaggttgatgtaaacgccatgctgaagagaataagtctcacggataagtattcagatctgtcttcatgcgatctcgtcatcgaggctgccttcgaaaaccaggatgttaagaacaggatattttcggacatttctgatctatctgaacatgcaatcatagcctcaaacacatcctcgctgagcataacagagatgtcctcgcgcctgaaaaggcctgaaaatgcactcattctgcacttcttcaatcctccatacctccttccgctcgtggaggttgttccgtccctctacacatcagatgaggccaagaacactgcagtatctctgatatccagaatgaagaaccaccgtgagggcatggtgccggttatggcgaaagaacgcgagggcttcatagtcaacagactgcttataccgcttataaattcagcttcggatcttctcgatagtggcgtggcgtctgcagaagacatagatactgccatgaagaagggtgctggattcccaatggggccgctggagctagccgacatgataggcatagatgtagttgttgacgtcatggaagtactcgaaagggcttatggtgaaagatacaagacatctgtgatcctaagaagaatgcgggaggcgaatcgattgggaagaaaaacgagaattggattttataaatattaa

SEQ ID NO: 41907 - DNA, 978 bp, Thermoplasma acidophilum
atggcaagaaagaagatttctgtaataggcgccggaaatgtaggtgccacagtcgcacagttcttggccgcaaaacagctcggcgatgtttatctgtttgatgttgtagatggaattcctgagggaaaggctctggatattcaggagggagctccacactggagatacgatcttgatgtggtgggtttcagtacgagtgatgaaaccaagtacaagaacatggagggcagcgacgtcatagtcgttacggctggactggcaaggaagccagggatgagcagggacgatctctttgacaagaacgtggagataatatctgacgtttcgagaaacataaagaaatactcgccagattcaataatagtggtggtatcaaacccagccgatataatggcctatgcattgcagaagtttaccggcatagatccatcgaagataatgggtctcggcggatctcttgacagttcaaggttcagaacctttctcgcaaaggaattgaatgtgtctgttgaagacgttaacgcattcgtcattgggggacacggagatgatatggtgccgttcatacgatactccagcgttgccggcatacccatagagaacctgctttcaaaggagaagatcgatgagatagtgaagaggacgaggtttggcggcggagagatcgtgaactatctgaagacaggcagcgctttctacgcacctggcatatccataaccgcgatggtggaatctgtgatcatggacaagaaacgcgtcataccgtgcgcagcttacataaccggcaagcatgcggaccactacggaataagggacaagttcataggcgtgccgataaagatcggagagaagggtgtagaacagatatacgacatagacttcaagccggatgaacttgagctctggaagaagagtgtggcttcagttgaggccagctcaaagaaagtggacgagtggatcgcaaagcacgcccactga

SEQ ID NO: 41908 - DNA, 600 bp, Thermoplasma acidophilum
ttgggtcaaaaggctccggattttaccgtgaacacgtcaaagggtcctgtaaccctgtccagctacaggggaaagtgggttctgctgttttcgcatccaggtgatttcacaccggtgtgcacaacggagttcatagcatttacagagagatacaaggatttccaggctctgggcgttgaactcctcggcctcagcatcgacagcgtgtacagccatatagcgtggataagggacataaaggagcacttcggtattgaaataccattcccgataattgcggacatagacaaggaggttgccaggcagtacaacctgatcgatgagaagtccggcgcaaccgtcaggggagttttcatcatcgatccgaaccagatagtcaggtggatgatctactatccggccgagacaggaaggaacatagacgagataataagggtgataaaggccctgcagttcaactgggaacgcaagctagccacgccagccaactggcagcccgggcaggagggaatagagggcgcaccttcaacggttgatgcaagcctgaagagggatggagaaccgggtgtgaagacctggtatctgaagtttgtgaaataa

SEQ ID NO: 41909 - DNA, 963 bp, Thermoplasma acidophilum
atgttcccgatcattagaatgagaaggtacagaaaggatcagaatttcagggatcttttctccgaaacttcgatcaggccggagaagctggttatgccaatatttgttgaagagggcatttcgaagccggtagagatctcctccatgccgggaatactgagatatccgcttggagatctgaaggcctatgtgaaacaccttgaagacataggagtgaaatctgtcctactgttcggcgttccatcgcataaggatagtatgggaagtgctgcctacgacaagaatggcgtgatacagaaggccatatccgtaatcaaagataacacgaacataataacaattgcggatctttgtctatgtgaatacacagatacagggcaatgcggcctgttgaaggatggttatgtggacaacgactcaacgcttgaggtgtacaggaaaatagcgaaaagctatgcagaggccggtgtggatatagtcgcccctagcggtatgatggatgggcaggtatcggccataagggatgaactggataatgatggcttcgaaaacgtgatgatcatggcgtacagttccaagttctcatcaaatctctatggcccattcagggaagccgcggaatccgctccgaaggtcggagacagaaagagctaccagatggattacagaaaccagagggaagcgctcagggagatcgatctggacgtgtacgagggtgcagacataataatggtaaaaccggcgattttctacctggatatcatagctaaggccagagaaagattcgatctgccgttggctgcgtacagcgtgagcggcgagtacaatatgatatacaatgcggtgaagaacgggtacctgtccgaagatgccatacgagaatcattagtttccatattccgagccggtgcggatatagtgataacgtacttcacggaacagatactaacgaattcaaaatga

SEQ ID NO: 41910 - DNA, 1155 bp, Thermoplasma acidophilum
atgggaaactttggagttacacaggacgaagagctcgtactttcatttgtcaggaaatttgcagaggaagaactgaagcctcttgcaaaggaaatcgatgagaagatggaggttccacggaagataattgacagaatgaaggatcttggcctgtttgcaacttatatacccaaggagtatggcggctacggcatgagttttcccttcctcgtccgcgccatagaggagatctcgaaggcatgcccaagtactgcgcttgttctggatggtgcgctcacactatttgctgagccactgataatgttcggttccgaagatttaaagaagagataccttcccagggttgcggcgggatcggtgggcggtctggccataacagaacccggggcgggaagtgacgcagcgggaataagtgcaaccgccgtcaaaaaaggcgacagatatgtgataaacggggacaagatattcatctcgaatggaaggatatcagatttcttcgtgctagatgcggtgacagatccaggaaagagacacaggggaataacggcattcgttgctgacagggatactcccggcctgaagataagcagggacatccacaagatgggcataagaggttcgagcaccgtggagcttgcctttgaggacatggaaattccagcggaaaacatagtgggaaaggaaaatgaagggttcaaggtcatcatggagacccttgatgcaggcaggatcggcatagccgcccaggctcttggtatagcagagaacgcgctggccgaggcaatagattacgtgaagcagaggaagcagttcgggacggagatagccaacttcgagggcatacagttcatgatcgcagagatggcaactgaaatagaggcagcgcgctatctgacatacgttgcagctgagaaatggcagaacaaggagaacaccattgagatatcagccatggcaaagatgaaggccagcgatgttgcaatgcgagttacaacggatgctctgcagctgttcggcggatacggctacacgaccgatcttgatgcggagaggcatatgcgcgatgcaaagatcacgcagatatacgaaggtacgaatcagatacagaggctggtcattgcaaaggaaatacttaaaaaaacgcgttattactaa

SEQ ID NO: 41911 - DNA, 969 bp, Thermoplasma acidophilum
ttgatcgatctttttcgcagatactatagagaaaataacatagatccgccggaactcataagcaagcgggaagtaggctacatgacgttttccggtgaggtcataagacacctgaagataaacaacaggttcgaacttaacatgctgctgcgtgatgctgcgcccatgcatgtctacagttctgcggcgtattacagaaaacccgatgaaagaaagatgccagaaaaggaatgggggggtgcggatctgatcttcgatctggattccgatcatctccccgggtctgaaaaactatcacaaaaggagatgttaatacagattagggatcagactgagaggctggtaagtgatttcctcatcgcagatttcggtattcccaagtcatcaataaagatatatttttcaggcaacaggggttatcatgtgcacatatccgatgatcgtgtgtacaggctaggatccgacgcgaggcgtgaaataactgattatataacgggcaacagcctggatgaaacggttgtaagaagggctatcgatatgctcggcatcgcatcaggaggctggccagccgtggttagtaaggaactgggcgaggcctccccggcaaaccagagaagagaatccgatctcaggaaggcaataaagagggctagagagaatcattctgttctgatagattcacccgtaacctatgatattcataggataataaggatgccaaacacgctgcatgggaagagcggtctcatcgtaaaggaggtagaaatagatcaccttggagaatttgacccgttccaggaatgcatcccagatcagttcagggatggcgagtatgatgtttttctgccagagaagataaaaccagttgagattggagggattgaatcgccaaagatgcccggcaagcacagggttaaaacgttcatggcagtttacctggtggcatcagggcgtgccgtgtttccataa

SEQ ID NO: 41912 - DNA, 1650 bp, Thermoplasma acidophilum
gtgataagcaatatgatgacgggacaggttccaattctagttctgaaagaaggcacacagagagagcagggtaaaaacgcacagaggaataatatagaggcagcaaaggcgattgccgatgccgtcaggaccacacttggcccaaagggaatggacaagatgctggtcgattccattggcgatataataatttcaaatgatggtgcaacgatcctcaaggagatggatgtggagcatccaacggcgaagatgatcgtagaggtctccaaggcgcaggataccgccgtgggtgatggtacaacgactgctgttgtgctctctggcgagttgctcaagcaggctgagacactgctcgatcagggtgtgcatccaaccgtcatatccaacggatacaggctcgcggtaaatgaggcaagaaagatcatagacgaaatagctgagaaatcaacagacgacgcaaccttgaggaagatagctctcaccgcactgtcagggaagaacacaggtttgtcaaacgacttcctggctgatcttgtcgttaaggcggtcaatgcagttgctgaggtcagagatggaaagacgatagttgacacagccaacataaaggtggacaagaaaaacggcggaagtgtcaatgacactcagttcataagcggtatcgtcatagacaaggaaaaggttcattccaagatgcctgatgtggtcaagaacgcaaagatcgctctgatcgattccgcgcttgagataaagaagacggaaattgaagccaaggtccagatatcggatccaagcaagatacaggatttccttaaccaagagacgaacacgttcaagcagatggtcgagaagataaagaagagcggtgcgaatgtcgtcctctgccagaagggcatcgatgatgtggcgcagcactaccttgccaaggaaggcatatacgctgttcgcagagtcaagaagagcgatatggagaagttggccaaggccacaggtgctaagatagttacggatcttgacgatcttactccatccgtcctaggcgaggcggaaaccgttgaggagcgcaagatcggcgatgacagaatgaccttcgtcatgggatgcaagaatccaaaggcggtcagcatactgatcagaggaggaacagaccacgttgtctcggaggtcgagagggcgcttaacgatgctataagggtcgttgctataacaaaagaggatggaaaattcctctggggcggaggagcagttgaggccgaactggcaatgaggcttgccaaatacgcgaatagcgtcggtggtagggagcagctggctatagaagcctttgcgaaggccctggagataattccgaggacgctggctgaaaatgcgggaattgatccgatcaacaccctgataaagctcaaggcggagcatgaaaaaggacgcatatccgtcggagtggatctcgataacaacggtgtcggggacatgaaggcaaagggcgtcgtagatcctcttagggtcaaaacacacgcgctcgagagcgccgtcgaggtcgcaacaatgatactgagaatcgacgatgtaatcgcaagcaagaagtccacgccgccttccggacagggtggccagggacagggaatgccaggcggcggaatgcctgagtactga

SEQ ID NO: 41913 - DNA, 1704 bp, Thermoplasma acidophilum
ttggagaagattaaggaggatgtgatcatccttggtggcgggatggctggcctaagagcagccgtcgcagccgcagagtacaacaaaaacatctcagttggggtggtctccaaactgtaccccctccgatcccattctgtttctgcggagggcggaacaagtgcggttctaaatccgaaggacagtttcgacctacatgcctacgataccatcaagggatcagactaccttgcggaccaggatgccgtagaggagttcgtcaggctggttccagagcagatttacactaccgatcactggggatgcccatggagcaggaatccagatggcaccatctctcaaagggacttcggagcgctgagctttccaagagctacatttgcagccgataagactggtttccacgttatgcagaccctcttcagcagggcgctgaagtacgataatatccacttctacaatgagtatttcgcaacatccatgttcctggatggaggaagattcaactctttgacgactataaacctgagaacgggggaattcgtcgtatttcaaggaaagtcaataatatttgcggctggcggtgcgggaaggctgtaccagttcagcacctatgcccattctgtttccggagatggggatgccatagcctacagggccggtataccgctgaaggatatggagttcatacagttccatccaaccggtcttgtaccttcaggcattctaataacggagggtgccagagccgatggcggataccttctcaacggcgaaaagaagaggttcatgcaagcctatgcacctaacaagcttgagaaggcatcgagagatgtcgtctcaagggccataatgtgggagatagaggccggcaggggagcaaagggagaatacggcgacatggaatatgtttatctcgatctaaggcacatggccgatatcctagatgaaaggctaccgatgataacggagatagccaaaaaattcaacggcatagacgcccatactgagctcatacctgtgcatcctgcaactcactatacaatgggtggcatcgattctaacgtgaagacaaccactgatttctccggcatctttgcagcaggcgaaaatgcatgcgtcagcatacatggggcgaacaggctcggatcgaattcgaccaatgaatgtcttgcccttggaaacgtggctggtgtgtccgccgccaagtacgctatggagcatgatatcccggatcttgtagttgaaaacgtgaacaacgaagagaagaggatatgggacgacctgctaaagagagatggcggcgagaatgttgccaagataagggaggatctcaggatcaacatggacaaaaacgtgggcatattcagggacgcagatggcctgaacacatctctgaagaatataaagcaatacaaggagaggtatcagaagatctccatacaggacaagtcaagcacgttcaatatggagctagaatgggcgcttgaggttggtttcatgctggatctggccgagataataaccgttggcgcgataatgaggacagagagcagaggcgcccattacaggaaggattatccaaacagagatgacgaaaactttttgaaacatacaattgctacatacactaaggatggaccgaagataacgtacaaaccagtcgtgataaccaaatggcagccaacagtcaggacatactga

SEQ ID NO: 41914 - DNA, 723 bp, Thermoplasma acidophilum
atggccgatgaatatgaatttgagataaagaggaaggatcagagcggaaaggtctattacagcacctacaaggtacccaaagacaagatatccacggtgcttgagggccttctgtatattaaggagaatctcgatcagtcgctatcgttcaggtattcctgcaggatggagatctgcggaagttgcggcatggagatcgatgggaaaccaaggatggcatgctcaaccatagttgaggatctcaagaaggataagataaggatcgaacctctcagacattataaggtgataagggatcttgtagtggatatcgatccgttcttcgagaaatacagagaggtcaaaccatacataatcagggacgatgatggcaaatacgacaaggaacttccgcagaccccagagcagttccatgaatacgcgaatttcgccatgtgcataaaatgtggtctgtgcatggccgcatgcccgatagaaggatccgacccgcagtatctgggtcctgctccactggctgccgcctggagatacatagctgataaccgtgataagggggcaaaatatagggtcgagatcgtagacggcgaggagggtacatcgagatgccacttcgcaggcgaatgcacagaggtatgcccgaaaggagtagatccatcctttgcgatacagaagctcaggaggaccgctctgaagatcgaacttgcgagcatatttgggaggtag

SEQ ID NO: 41915 - DNA, 303 bp, Thermoplasma acidophilum
atgttttgcccaaagtgtggttccttgatgactcctgtaaatggtaaatatgtgtgcccatcatgtggatatgaaatatcgaagaacaaggaaaccataaaaatagtttcgaagagtgctgataaggagacaataatgataaaagaagaagtctcagccgaacctcttgattcagatgcagtctgccctcgctgccatcataagggggccagatacgtgttgaagcagacaagatctgcagatgaacctgaaacaaaattctacacgtgcgaagagtgcggctatagatggagagaatattga

SEQ ID NO: 41916 - DNA, 687 bp, Thermoplasma acidophilum
gtggagagaccagaaacagatttagatagagatgaacttgtatccagttttctgggcagactgaagagatacaagggattgaggattccagagaatatatcaaaggatgaaaacctgaacagaatagctccatacctgaagagatccggactgatggcagaccttccggagaatgttattgtggacgccttgaagctctaccttgagagctcttcaagaggtgtttcccgtggcaggggctgtgtcgctgttctcgcagcatgccttttgatagcatcaaggaggcaggcaaacccaatgacgctcaagtacatagccagaagcatgcacacggatccatcacgcgtatggagaacagagaatgccatagtcaagaatatgaagaccccgtctatatcggccaggccgatggattttgtcgaacggtactccgagcttctcaacgtggacaatgatgtgaggagcgaggccatagcgcttgttcagcagttctcgcgtgaaatgaggataatgagaaaggctccatcaaccatcgcaatatctgcaatataccttgcatcggaaaggctgtcgaaacatctcgttcagagatacgtcgtaaagaagactggcataaccgaggtgacattaataaagacgtacaaggagatggcagagtatctctccatgggaaccgcagacacgtga

SEQ ID NO: 41917 - DNA, 870 bp, Thermoplasma acidophilum
atggggtcgggatccgcggaaacgattgtttgcagaaatctaacaaaggcgttcaaaaagcgcaggattctggacaatgtgaatttcagcctcagcggcggcgtcaacattcttgttggggagaatggtgcaggaaaaagcacccttttctacctgataagtggcataatgaaaccggacggcggcatagccatgctcaacgggatagactcctggaaaagccataggcaggcaatgagaggagtttctttcatgcctgaaaaaccttctgtacttggggggacatcagtgagagaacacatctactggttctcggctttgaacggtaccggtatggaacgcataatcgattacctgcatttctttcgggtcgattacgtactacaggccacttttcagtccctgagcttgggtgaaatgcagcttgttatgattgcatgctatctcagcactgaatcttcaattttcattcttgatgagccaaattccaatgtggacgttcataagcgatcactggtatctgaagcgattagacaaaaggcggatagatccaacagcctgttcctgatttcaacacatgtgcttgacgaaatgctgacgatctatgataggatgctggtgctggataaaggtaccgtaagattttcagcggaatttggaaaggcatcctttgtgagcgtactccgtaccaataacaacaatcgaatgcttgattccatcagggaatgggatggcagtgcagtgctgatcaacggcgctattttcacgtcactggaaataaagagatgcgcagaaatagcatccgaaaatggggttgtcatcatgtcttattttcttatacctgctgaaatggtgaggatctatgggtag

SEQ ID NO: 41918 - DNA, 1011 bp, Thermoplasma acidophilum
atgggaacagatatatcggatatagttgtgagccacgagacttctctcaaggatcagggcaatcagacattctcgatagatacatacaacatactgtatcagttgctgagcaacgtaaggcagtatgatgggatgccactgatggattcccacggcaatgtgacttcgcacctctacggcatattctaccggacgatcaaccttctggaaaacaggataaggccggtatacgtgttcgacggaaagccaagcccactgaagaacaggactataagcgaacggcagatgatgaaggagaaggcaaaggcagaactggaggaggcaatagagagaggcgaagaagatctaaggcagtactactctcgcataaattacataaccccgcagatagtcgatgacacgaagaaactccttgattacatggggataccttacgtcgatgcaccatctgagggtgaggcccaggcctcctacatgacgaagaagaatgtcgatggggtcatatcccaggactacgactgcctgctcttcggagcaagaaagattctgcgaaacttcgcgatatacggccgcaggaaggttccaaggaagaatatatacaagaccgtatacccggagtacataatactggatgaagtgctctctgcaaatcagataaaccaggatcagctgataggcataggtatactggtcggcaccgatttcaacgaggggataaagggaataggggcaaagaaggcccttgccctgataaagaaggaaggcgacattaagtctgttttgaagcacataggcaagaacattgagaacctggacgagataatagacttcttcaagaatcctccggtagtggactatgatttcaagttcagaaagccagatacggatgcaatagagcattttttgtgcgatgagcatgatttctcaagggagaggataagggatcacctggaatcgctgagaaagaatgatcaggcgtcgacgcagttcaggctcgatagttttgattaa

SEQ ID NO: 41919 - DNA, 912 bp, Thermoplasma acidophilum
ttgggagaccatggggatgcgaaagatcatgcttcagaactgaaggatattttttcgctgaagaagatcgcggacgccaagtacagctatgaagacagcgactatgtgatatttggcgtcccatttgacaacacatcaagctacaggcggggctcgaaatacgcccccgattccataagatcggcatacgtgaatctggaatcgtttgaattctcctaccggtttgacctgctcagggccagaatatcggatcttggtgacatggaagaatccgaggacgtggagtacgttgtcgaccaggtcgatcgtgtaacgaagatggtattcagcgatggaaagatacctataatgctgggcggtgaacactccataaccgttggtgccgtcagaaactttcctgaagacgtgcacatggtaatagtggatgcgcattccgatttcagggattcgtacatgggaaacaaactgaaccatgcctgcgttacgaaacgcgcgctggagatactgggcccaaacaggataacctcaatagggacaagatcggtttctctggaggaataccaggatcctgactttgaaaaggtggaattcataccgtcattcagcgtccgggaatacggcatcgaacggttcataaatgacatagagaggaggcccggaagggtttacatatccatcgatatggacggaatagatccagcgtatgcgcccgctgtgggaacaccggagccattcggccttaccgattatgaggtcaggcggcttgtggagaggctttcctacaaggccataggcatggatataaacgaattttccccgctgtacgataacggcaacacgtccatgctggcgggcaaattaatacaggtcttcatagccagcagggaaaaatacaggatagagcatatataa

SEQ ID NO: 41920 - DNA, 1146 bp, Thermoplasma acidophilum
ttgagaatactttactttactgacacctattaccccactccggacggggtttctgtatacctcaaggaggtaaaacagaagcttgaggatgaggggcacgaggtgatgatcttctcggtcaccggagattccagggagcataatgtgtacgtaccgaagtacacggctccattcttgccatacccacagtacagggtgccggtgtcattcataccattccgggtattcaggagagcgctggagtttaatccagacatagtgcacctgcacaatgcattttacatgagctccgtggggtatctcgtcgcaaggaggatcggcgtcccgccagttgccacatttcacacggacgtatccaggatgaaggaaagcataaacatgccattcaagaaccttgccttcgacctgggagaacgctacagcctttttctttacagaaaatgcaggatggtaatggcaccaagcgcaacggttgaagagtacctgaagatcaggggggtgaagaatgtggtcactctcccgctcttcgtggacaccgataagtacaggtatgttccggcggattccggagagagatacatactctacctgggtagaatcactgttgacaagggcatttacagggtgctggatctcgctgaagcaatgaaaagcgaagatgtgaggttcaagatagcgggagttgggccggagctggataggataagaagaatcgtgaagtatcacggcatgaaaaatgttgagatactcgggtatgtagatgaccagaggaagatggacctcatggcaaatgcaagcctcttcgtctatccgtcttcggctgataccttcgggatatccgtcttcgaggcgctggcctccggagtacccgtcatggtttctgaagactttccggttaaggagaataccgaagccatatcatacgtcaagttcggcgatatcagatcagcggtggagaccgcagagagaattttgcatgaagatagaaggaaacttgcagccgaggccaggcatctcgtagagtcaaaatacagcctcgagaggcatatatcatcgttgcttgagatctacgattacatcagggctgagagaagaaaaatgggatcttcagagaagatgagagcggacaattccgcatacagatga

SEQ ID NO: 41921 - DNA, 885 bp, Thermoplasma acidophilum
gtgtatcagttggtgtattatgaggcattttcagcgcgcgaggcactgatagaaatacgcggattgaaaaaggtctattccagcgggaaggtggcacttggcggaattgatctggatataccgagtggcatctctgctatcatcggaaggaacggagcgggcaagaccacgctcatgaggatactctcgacgcagcttctgccgacatccggtagcatcaggataaatggcttccacgtggtcagagaggcttcgaaggtcaggaaaatagtgtgcagcattccgcaggaagcttcccccattggtgttctgactccgcttgaacaggtgaagatgtatcttgttgcaaggggattctcgtattcaacagcagatgcagaagcgaagagggctcttgaagaggtcggcctcgcggaaagcatgcgggtgcctgcggacacgctatcaggtgggatgaagaggaaaatattcgtggcaatggcgcttgcatcaggcagcgaaatcgtcttcatggatgagccgaccaccggtcttgatccgatatccagatacgaagtctgggctgccataaggaaactcggatccaacgtccttcttacgactcactacatggaggaggctgcttccctgtcatcctatatcgtgctcgtggaatcaggaaggatcatgaacaggggaatgctgagggaactgctatcggtcttttcaggaaaggtcagggtagaatgcaggcagtatcaggaagaatcaatagaaattggtgggatctacataaaatatgtggattctgacgaagctgaagcttatgtgaagatgggttgcgacgtgaagaacataacgcttgatgaccttttcataaaggagaggatacagcttgaaccttaa

SEQ ID NO: 41922 - DNA, 1170 bp, Thermoplasma acidophilum
atgaaaatattgataatgggtatagacggatatattggctttccgctggctatgaggctcctgaaccgggggcatcaggtgtacggccttgacaactatataacgagaaggcgtgtttcaaaggtcggttctgattctgcacttccgatactatcgttccatgaaagaaataggaggctgaaaaggcattttggacatcagataccgttcttctatggcgatgcgtccaatccggattttgtgtacaaggtgatcgaaaaaattaggccggatgcggttgtgcatctggctgaacagagatccgcaccgtactccatgataggcctcagagaggcaaacgagaccatggtgaagaacattacaagcacgatgaatctcatatatgccataaaggacattgtaccggaggcgcacatcctgaagcttggcaccatgggcgaatatggcactccgaacatagacattccagaggggtttttcgagatcgagtacaatggaagaagggatgtgctacctttccctaagaacgccggatcgtggtatcactggacaaaggttcacgattcaaacaatctcatgttcgcgaaccgtgtctggaacctggcggtgaccgatgtaatgcagggtgtcgtttacggaacgaagacgcaggagattgatgaaacaggcctgtacacaaggttcgatattgacgaggtttatggaactgccctcaacagattcaccgccgaggctataatcgatatgcctctcacagtgtacggaaagggcggccagacgcgcgggttcctgtctttgaacgacagcattcagtgcctgacgcttgcacttgagaaacctccaaaggctggagaatacagggttctaaatcagttcgacgagaaatacagtgtgggacagctggctgagatggttcagaggatattcgaaaatgagtacggaaagaggcccgaaattgcacacctggacaatccaagggtagaaaaggaggaacattactacaatccagagcaccggaagctcgaagaaatgggctacaggaggacgaagatcattgaagaagagatagtggatgccatatcagatctttcaaaatttagagacaggatatataacctcaggggcacgcttatgcctaagacattctggaagctgtcagcgtacaattga

SEQ ID NO: 41923 - DNA, 744 bp, Thermoplasma acidophilum
atggatggcctgataacggcggccggcctcggtacgcgctcaatggcttcaaaatattacagaaaagagatcttttccgtttacgatgaaagggacggtcaaatggtcataaggcccatgctcgatgccgtcatttaccgtatgaagtatgcgggtattgataacatatatgtggttctcgatcatgaggatggcgttaccaaaaaatttatagaagagagctatcccgacctccacataattgaacagcgggaacgaaggggttatggatatgcggtatacctcgcaagggatcacatggattctccattcgtgctgaatgcaggagatgggatgcttcttgatcctgatgttgagaacaccatagtgcacagctttaagggcggtaacctcctcgtggcatttcaggttgatgatccaagaaaatacggtgttctggaaatgtccggagataaagtggtcggggtaagggaaaagcctgaaaagcctccatcaaacctggcgctggccgccttctatgtcctcgatccttcaatattcgatcatatagatatagatcggaaggagtcggagctcacgcctgccatagatgcaacaataaaggctggagtgaaaacagaagccagaatgataaggaaggatgaatggataagcgtcggccaggtatccagctatgttgacgtggttaacaggacatacagttttgccagagaaagggcaaaaacaggggattttaagaaatag

SEQ ID NO: 41924 - DNA, 1227 bp, Thermoplasma acidophilum
atggatgagttcttcttgatgaattctttcgatcttgcgggaaaaacagtatacttgagggtggatataaatgcacccgtcaatccgctgaccggtgagataatgggtattgacaggttcagggcccacatagacacgataaggaatttgagaaattccaaggtcgtcatagttgcccatcagagcagacctggaaaggacgattttatctcactcagacagcatgcacagatactttcgcaccttctcaacaagagggtgcagttcgtggatcagctcttcggaagccaggtcaacagggcggtatccgaaatgtcagatggggacatagtgatgctggagaattcaaggttttattcggaggaggttgacctaaccacgatcgaaagcatggaatcatcaaacatagtgagaagcctgtctccgctgtttgactacttcatcatagatgcctttgctgcaatacacagggcacagacaactctagttggattccacaggataaaaccaaacatagccggcactctcatagaaagggaggtcagcatgatagaacgattcagaaagataagggaaaagccgaagattgcaatacttggcggggctaagatagaggattcaatagcagtctcggagaacttcctatctagagggttcgtggataaaattctaactggcggagtcgttgccaacgctttcctgtgggcatccggatttgatataggaaaaaagaacagggaattcataatgaagaataacggagattacgaaaagctgctcgacaaatgcagggcaatcctttcaaaatacggagataaactggttatgccgacggatttcgtgatgaatccatcgggtcagaggatatcgataaacgagaagatcccggacgaccagatactggctgacatagggctggataccattgtagaatattccgagataattgacggagcaagggccatattcatgaatggacctatgggtatgtacgaaatagaggattattcttccggtaccagggaagtgttcaccgctgttgcacattccaaggcattcaagcttgcaggaggcggacacacgctcagcgcccttgacaaactaggtctgaccaagatgatcgatcatgcatccaccggaggtggtgcgttgataagctatttaagtggtgaaacaatgcctgtccttgaggcattgaaggaaagcaaaaagctgtttgagggatga

SEQ ID NO: 41925 - DNA, 1065 bp, Thermoplasma acidophilum
atgttgcagtacagaagttcaaagatgatctccatggagattgtggaattcaaatggctgaagttcctcgatagataccgttctatggcgaagcacaacctttcgaacagtggaatgccggagccagacctccgaagcatgggcatagacacgagatatgagagctatctgaatgagatggtagatcttgatgcagccctgcgggataccgtggcaagaagatacggtgtcgatagggacaacgtcataataacgaacggtggtaccgaggcaatcttcctggcctccgctttcatcagcgccagttccgaagtgatcgcagtaccctctcctgaatacgagccgatattcatcgttccagaatcgctcgatagaagggtaagaagggtaaagcttgagaagataggccaggccgagaaaaacagcgaaagccttgccctcagcctcccaaataacccaacgggaaaatacggagacatcgcagatctggtcagggatgcaggaagaacgtaccgctacgtatacatagacgaaacgttccacgatttcacggatgataggggctcatcgctttacgatggttcaaagaaccttatagtatccaacacgatgacgaaattttacgggttgagcagtctcagagttggctggatagtttccgataaggagaacatagatgccatcaggagaataaaggatctcacaaccataaacaatgcgcggttttccctgtttctggccaggcaggcaattgaaaagtgggacaggttcagggaaaggacgcacagcatcgtcaggaaaaatgccgacattgccaggaaggaactatctgacttcggtttctattcagacgaatatgagggtgcaccgttcatgttcgtcggtgacggaaggttcgattcggagatgatggcttccaaagccatcagtggctatggcgtgctcgttgcgcctggatcctacttcggactggacgggtatctgcgcgtctgtttgactgcgctggacgcaagggaagatatagcggcattcagggaatttgctgagaaagagttagggaaatga

SEQ ID NO: 41926 - DNA, 1842 bp, Thermoplasma acidophilum
atgtcaaagataattggtattgatctgggtacaagcaattctgctgctgcagttgtgatatcggggaagccaaccgtgatcccaagctcggagggggtatcgataggaggcaaggctttccccagctatgtcgcatttacgaaggatgggcagatgcttgtgggcgaacctgcgaggagacaggctctactcaatccagaaggcaccatattcgcagcaaagagaaagatgggtacagattacaagttcaaggtttttgataaggagttcacgcctcagcagatctctgcattcatacttcagaagataaaaaaggatgctgaggccttcctcggcgaaccagtgaatgaagctgttataactgtgcccgcttatttcaatgataatcagaggcaggcaaccaaagatgccggtacaatagctggcttcgatgttaagaggataataaatgaaccaacagccgctgcactcgcctatggtgtagataagagcgggaaatccgaaaagatcctcgttttcgatctcggagggggaactctggatgttacgataatggatttcggtgatggcgttttccaggtgctttcaacatccggcgacacacggcttggaggtactgacatggacgaggccatcgtcaactatatagccgatgacttccagaagaaggagggcatagacctcagaaaggatcgatccgcctacataaggctgagggatgcggctgaaaaggccaagatagaactttcaactacgctctcaacagatatcgatctgccgtacataacggtaacaaacagcgggccaaaacacataaagatgacgctcacaagggcaaagctagaagagctcatatctccaatagttgagagggtgaaaggcccgatagacaaggctcttgaaggcgcaaagctcaagaaaaccgagatcacaaagctgctattcgtgggcgggccgaccaggataccatatgttaggaaatatgttgaggattaccttggcataaaggccgagggtggagtggacccgatggaagctgtggccatcggtgctgcaatacagggcgcagtcctaaagggagagataaaagacatcgttctgctggatgtgaccccgctcacgctcagcgttgaaacgcttggtggcatcgcaaccccgataattcctgcaaacaccaccataccggtgagaaagagccagatatttacgacagctgaggacatgcagacaacggtcaccatacacgtggtgcagggtgagaggccgctcgcgaaggataacgtttcgctgggtatgttcaatcttaccggaatagcgccggccccaaggggcgttccacagatagaggtgacgttcgatatcgactcaaacggcattctgaacgtgaccgcggtggacaaggctactggaaagaagcagggtataacgataacggcttccacgaagctctccaaagaggagatagagaggatgaagaaagaagccgagcaatacgctgagcaggacagaaaggcgaaggaacagatagaactgctaaacaatgcagagtctttagcttacagtgttgagaagacgctgaacgatgctggagacaaggtggacaaggagactaaggaaaggctgaccaacgaggtaaaggatctgagaaaggccatagaggagaagaacacggagaacgtaaagacgctgatggacaagctgtcaaaggacatacaggaagtcggggccaagatgtaccagcaggcttcagcgaacacccagcagagtgcacagtcaaacagccagaattcgggatcgtctgatggtaagaccgtggatgctgaatacaaggaaaaaagctga

SEQ ID NO: 41927 - DNA, 1098 bp, Thermoplasma acidophilum
atggcaaaggactactataagatactgggcgtggacaggaatgccacagacgaggagataaagaaggctttcagggagcttgccaaaaagtggcatcctgacctacatccagagaacaagcaggaggcagaggaaaaattcaaagagatcagtgaggcatacgaggtgctgtctgatccgcagaagaggaggatgtacgatcagacaggcaccgttgacttcggtgctggaggccagaacttcaactgggacaacttcacgcattacagcgatctgaatgatatattcaacgacatatttggaggcaacttcgcctccgatttcttctcaggttttggtaggggacagcgtgaggaacagtacgatctggatctctacacgaaccttgacataacactggaagatgcctattacggcactgaaaagaggataaagtacagacgcaatgccatgtgccctgactgcaatggaactggagccaagaatggcaaactgataacgtgcccaacatgcaatggaaccggacagcagaggatagtcagaggccagggatttttcaggatggtcacggttacaacatgccagacctgcggtggcaggggcaggataccggaagagaagtgcccgagatgcaatggtactggaacggtggtcgtcaatgaagacatatccgtgaagatcccaaagggagccaccgacaatctgaggctcagggttcagggcaagggacagtcatacaatggccggactggagatctgtacgttgttttacgtgtcaggaatgacaggaatgtgcagaggataaatgacgatcttatgattgaccagaaaataaatttcgctcaggctgcgcttggagatacaatagaggtaaatcttttcagggaaaaatacagcctcaagatacccgaagggacacaaccgggcgaagtcctcaggatcaagggtgcaggaatgccccatctaaacggtcatggcagtggcgatctccttgtccgcgtcaacgtggaggtaccgaagaggctcacgcaaaaacagaaggatctgataagggagatattcgatataaaggaaaaccacagatcatggtttcactga

SEQ ID NO: 41928 - DNA, 1467 bp, Thermoplasma acidophilum
gtggatgctaatgggcgtatcgtctcatttgcctacagattgaacagacagtattttcctgcgccgggatgggttgaacaggatcccgtgaatctctggcgcaatgtgaggatcacgctgaagaaggccatagaggaatccagaattgatttgactggcattgcttcggctggcgtgacgaaccagcgcgagactgtcctcgtatgggatcgtaagactggccggccgctctacaacgcgattgtatggcaggataaacgaacatccaggaggataaaggatctcgatgaggagacttcaaattcgataatgaaaaccaccgggttgagacctgattcatatttctcggcttcaaagatacagtggctgctggaaaatgtcgagggccttaggaaaaagatggccgatggtgatgtctcattcggaactgtagactcgtggatcatctggaatctgaacggttccgtaaatagaagcatcaccgttacggaccacagcaatgcatccagaaccatgttatatgatatagctaagctgaggtggaatccagatctgctcgacatatttggtggaatatctgaaacttcgctgcctgaggttatgtcgtcaggatctgctgagtacggctacatctcaaaggatacttcagcgatattcgatgggcgggaagtgcccattaccgccgatataggggatcagcagtcggctctctttgggcagggatgtttcaatccaggcgacgtgaaggcaacgtatggaactggaacctttatcctttccaatgcaggaaccgaggttccgcagacctccggaactctgctcagaaccatattctattccatatctggcagggagttgagttatgcgctcgaagggagcatacttgcatctggatcagtgctcagatggcttcagaacagtctccatctattccgatcagccaaggatatagaggatgccgcagaaaagctgaagagcaatgatggagtatactttgtcccggcattctccggccttggttctccatactgggatcaggacgcgagaggactgttcattgggcttactgagagcacgaccgccgatcatctggccagatccgtactggaatctgaagtttatatggccaccgacgtgattatggaaatagaaaaggagatcggaaggaatatagcgaagataaggtgcgatgggggcggatcaagaagcgattttctgatgcagtttcaggccgacattgctaatgcggaggtgctcgtacccgaatcatcggaaactacggccctgggatcagcttacctatccggccttgtatccggcttatggaagagcaaggatgaaatacgcgagctctggaggctcaagaaggtgtataggccagtgatgtcagaagaggaaaggaaaaggaactatgtgggatggaaggatgccgtaaagagatgcatgggatggcatcctaatatataa

SEQ ID NO: 41929 - DNA, 1017 bp, Thermoplasma acidophilum
atgatcagagtaggcattaacggttatggaaccataggaaggagggttgctcgggcagtatctcttcaggatgacatgatcgtaacgggcatagtgaagacaaaacccgactacgtcagcatggttgcatccagagacttcaaaatttttgttcccgataaatcctatgagaaggcatttcaggatgcaggaataaaggttgaaggtactgttgagaatctgatcgatgattcggagatcatagttgatgcgactccagagggacagggagagaagaacaaggatctgtacgtcaagagaaggataaaggccatatttgaggggggagaggagccagagatcgcgcaggccagcttcaatgcgtattcaaacttcgaagaggcccgatccaaggattacgtcagggtggtgtcatgcaacactaccgcgctggccagaacgctccatccactcagagaaagatttgggataaggtatgtggacgcaacgatagtcaggcgggcaaccgatcccaacgacagcaagaaggggccgataaacgctgtggagccaagtctctccataccgtcccatcatgcgcctgacctcaggacagtaatgagcggtctgaatgtgagcaccattgcgataaaggcgccgacgaccctgatgcacgttcatgctgtcagagttgagctggagaaggatgcctcaaagaacgatgtaattgaagcatggaggtcctacagaaggataatggagataggaaagaacagcggcataacgtccacggggcagatgatggatcttgccagggagttcggcagggatagatccgatctgtacgaaatagccgtatggagccagagcgtgtctgttcagggaaaccatgtctcttatattcaggcggtgcatcaggagagtgacgtggttccagagaatgtagatgccataagatccatgttcgatatagcggacagggacaggtccgtatcgatgacagacagcaaactgaagatagagaagagggtgttttga

SEQ ID NO: 41930 - DNA, 972 bp, Thermoplasma acidophilum
ttgatggaaagtaacgaggagaatagggagaagaaaaccattgaggatttaccgggtgtcggagaagcgactgcagagaagctgagggagaacggatacgatgacataatggccatcgccgtggcctctccgaaggatctttccgatgtaacgggcattggtgagggtgcagctgcaaagataatagcggcggcacgaaaattcgcggatataggtaatttcgaaactggtgaagagatacttgaaaggagaaagagcatacagaagctgacgaccgggagcaagaatctcgatgatctcctcggtggcggccttgaaacgcaggcaataacggaattcttcggtgagttcggttcagggaaaacgcagataatgcaccagcttgcagtcaactgcacgcttccaaaggagaagggtggtttcgacagcgatgtgatgatgatcgataccgagaacacattcaggccggaacgcataatacagatggcaaagagcaagggcgcggatccggacgaaacgctgaagaggatacacgttgcaagggcctacaattcccaccaccagatactgctggcggagaaggcccaggacaccgcaaaggagtataacattaagcttctgatagtcgattcgcttaccgctcacttcagatcagaatacgtgggccgtggatctcttgcggagagacagcagcttctgaacaagcatatgcacgacctgctcaggtttggaaccatatacaatgctgtcatcgcagtaacaaaccaggtttcggcaaggccggacgttttcttcggcgatcccatggcacccatcggaggaaacatagtggggcacactgcaaccttcaggatatacctgaggaagagcaagggtggaaagaggatagccagactcatcgactcaccttatctgccggaaggggaaacggtgatacagataagcgaggaaggcgtcagcgacggtacatga

SEQ ID NO: 41931 - DNA, 1770 bp, Thermoplasma acidophilum
atggcgacgaaatcatctactagccaggctgtctccaagctgaggcagcccatagtctgcgttttaggccatgtagatcatggcaagacaacactgctagatctaataaggggtacctctgttgccagtaaggaaccaggcggcattacgcagaggatagcggcaacgaccgttgatatttccagaatcctgaaggaaacggaaaaactgaacacgaaggggctgaagataccggggctgctgttcattgatacccctggccatgttgccttctcgaatatgagggcgaggggcggagccctagcggatctggccatccttgtcattgatataaatgaaggcataatgccacagaccgttgagtccatcgatatactcaagaaattcaagactccattcataatagctgcgaacaagatcgatctgatacctttcttcacagacgttaagaccaacctgttcaccgaattcatacggaaacagaggcaggaatatgtcaacgaactggacaacaggatctacagcataatgaacaagctgtatgaattcggcctcaactcggacaggttcgacaggatatcagatttcacaaagacgatagccatagtacccgtgagcgcaaagaaaaatataggcgtgccggagatactcatggttctggctggccttgcacagcgcttcctcgaaagggagatagagtacagggacataaacggccatgccacaataatagaggtgagaaaggaggagtctgcaggtatcacccttgatgcagtcctctatcagggaaccatttcagtcggggattcgatagctgtcaatacgaagaacggcccagcggtgaccaaggtcaaggccctcttcgttaacaccggaaaggggcagcgtgcactcaaggaggtaaagaaggtatccgcagctgaaggtataagggtgctcataagcgataagatcgatgttatatccggttcaccgatgatagttgtcagggacaacctggatcaggtcatgaaggagattgaggaggagagcaaggttgatatccccctgagtgaggagggcatatacgtaaaggctgaagcaatcggatcgctcgaggccataagctatgagctcaacaagcagggcataaagataaagcaggcccaggtcggtgacatcacgaagagggacataatggatgtatccaccctacccgatcctatcaacaggatcatcgtaggcttcaacgtatctgttctgccggaggcaagagatgcgatgtcttcatccgatgtgagcatcgtaaccggtgacatcatttacaagatcgtagaggacacacagaaggttatggacgaaaggaagaagatgctcctgcagggaaggaagatgtccatgccggttccatccaggatcaggatactcccgcagtatatattcagggcatcaaagcctgtcatcgttggtgtcagggtggaaaccgggcagatcaaggttggggataatctgataaggggcgacggaaagtatgccggtactattaagagcataaggaacgaagatgtcagcgttcgctaccaggacgcacctgctgaggttgccgtggccatagacaacgtaacgctcaaccgccagatattcccggacgacgttctgtatgtggatataaccgagaacgtcgtgaaggagcttcgcagggctccgatggaaaaggaaataatggacacgcttgaagaaattataaggataaagagaaaggataacccattctggggaacgagggtctga

SEQ ID NO: 41932 - DNA, 447 bp, Thermoplasma acidophilum
atgacggagcgtacgcttgtgcttctcaagcctgacgctgtgaagcgaaggctgatcgggcgcataatctccaggctggaggataagggcctgaaggttgtcgcactcaaattcatgcagatgacgaaggatcaggctgagaatcactattcggtgcacagatccaagccgttcttcaaggatctggtaacttacataacatcaggccccatagttgcgatggtgcttgaagggccaaaggccatagaggtcgtaaggatcttagccggatccacagacggttcaaaggctcagccagggactatacgtggagatttctcaatgggcatagagaagaacataatacatgcatccgattcccccgaagcctattcgcacgagatgcccatattcttcaacgagagtgaaatagtagaatggtcctatggcgacgaaatcatctactag

SEQ ID NO: 41933 - DNA, 1767 bp, Thermoplasma acidophilum
atgttattttccgtagttgcagatgcctttgaaaagatggaaagcaccactaagcggctggaattgaccgatcttcttgttaacctgctaaaggaggcagatgacgatcttccccttcttatttatctgctggaggggaagcttggcccggactacctgggcatcgagacgcagatgtcagataagctcattataaaggccctgtcagttgcctcaaatataagtgaggatgaaatagcgaaggaatacgcaaaagcaggcgatataggaacaatcgcgaaggagattgcggagaagaggagccttaggtcactcgtgcaggaagagatgacggtgaaatacattcatgatacgctcatgaagatggcacgaactacaggatcaggaagcacaaaggccagggtggatgcatacatggatctatttctcaacagcacgcccaaggagatcatgtacataactagaataatcaccggaaagctcaggatcggaatatcagatgcgacgatactggacgctattgtgaaggcctttgcagatgaaaaatattcagaggacattgaaaatgccttcaactttcatccagatctcggttatatcgcctcagagctccgcaagggcaatattgatgccatactaaaactgggcccaacaccgatgattccctttaaggtcatgcttgcggaacgccttagatccgtagaagaaatcctggaaaagatgggcggaaggtgtgcatttgaatacaagtacgatgggatgaggacggagacccatatcgaaaggggaaaggtgaggcttttctcaagaggaaacgaagaaaccacgaaccagtttccagatataacgaaggctgcatccgagaccttcaaggtcgattcggcaatactcgacggagaggctgtgccatatgatccggatactggggaactctatccattccaggtgatatcccataggagggggaggaagtatgatctcgataaggtatcatcagagatacccataacggtcttcctcttcgacatagtgtatctgaatggaagggatctatccaaaactccatataccgagaggagaaagatactggaatcaatatttacggagagcgatagcttcaggcttgcgaagaggatagaatccggagatcctgctgaggttcaccggttcttcaacagcgcgatcgaggatggatgtgaggggctggtggcaaagagtacatctcctgattcgttctacaaggccggagcccgtgggtggctctggataaagctgaagagggattatcaggcacagctctgggatactctcgatctaaccgtcgtgggcgccttttacggccatggaaggaggaagggaacctatggagctctgcttcttgccacttacaacgacaagaacgatacttttgaaacggtctgcaagctgggatcaggattctccgacgacgttctgttttcgcttccgaagaagtttgagcagtatgtatctaaagaaaagcctgcacgggttataagcaacctggaaccagacgtgtggttctatcctgctgttgtcatggaggtaataggggcagaaatcaccgtaagccccatacacacctgtgcctacggggaaatagaaaaggactctggactttcagtgaggtttccaaggttcacaggaaaatggcgcgaggacaagaaacctgaagattcaacaacatctagagaaatactcgaaatgtacaaggaacaaaaaaagactataacggaggagaagagttaa

SEQ ID NO: 41934 - DNA, 879 bp, Thermoplasma acidophilum
atgtacaagggtatcgtaacgcccatgataacacccatgggccaaaatggagaaatagattacagggccactgaaattttgatagataatctcgcagactttggcgttgatggattgttcccaatgggatctaccggactgtttccaatgttcagtaccgatgaaaagaaaaaattcctgggttttgtcagggatcattcgaagaagatcgaggtatacgccggtgttggatcctcttcaacgcaggaatctgtcgaactttcgaagtatacagaggatataggaataaaggtaagggttctcatgcccacatactacatcaagccggatgaagactggatgtacaggcatttttcaacggtaatatccgcggcgtcgaatgatctcttcatttacaatataccgcagctgtctggatcctggataagcgaaagcctgattgagaaactgaccagggagttctccaacgtcaagggcataaaggatagctccggcgatatgcgattcttcagcagaataataaggcacaagaacgaaaaattcgatatatttcaggggcaggacgatctactgtttctctcactatcaataggagcaagcggcggtgtctgcggcctctccaacatatcaccatacataacgaacctgtatcatgagttcagcgccggaaacctggaaaaggcaagaaaaatacagatcgatgaggtcaatcccctgatgtacgcgatcaacgaggcaaccttccctgcaggatattattatgccttctacaagatgaacggcataaaaggcggatacagggcaccaatggttgagcctaccaccgatcagaagaaaaagatcgatcaggaactcaccaaaatcccgaagaagcaataa

SEQ ID NO: 41935 - DNA, 1059 bp, Thermoplasma acidophilum
atggaattccagaagttcaggacgatgcacttccccagggatgtgtacatagggcatgatgtgcttgaacacatcgtagacgttgtgggggaaaacagcagaaacaaaaatgcgattatcgtatccggagatttaacttacgaacttgctggaaggaaggtgcacgacctgttatcaacgtatggttatgaagtgcacgtctttttagccggtaatgccaattacgacacacttgaaagaatagaatacgaatcgcttgacattcaggcggggatagtaataggcgttggaggtggagcgaagatagatctcgcaaagaaactcgctttcgacaggaagcttccgttcgtgagcgtacctactgcacccagccacgatggcatagcctctccaagggcatccctcagaaggaacggtatctcatattctgaagagggcgcaatgcccataggcgtcatagccgatactgccattatgataaaggctccttacaggtaccttgctgccggtgcagctgatgtcatatcgaatctcagcgccgttaaggactggaaactggcacacaggctaaagggtgaggagttcagctccagcgctgcagcgatgtccgaatactcggcgcaggaggtcctgtcacagataaatgagatcaaaaaatatgaagaatcatccgtgtggctggtcacaaagaacatactggcatccggaacggccatggccattgcaggaaactccaggccaggtagcggcagcgagcatctcttcgcccacgccctcgaggcagctggagtggagaacatgctgcatggagagatgtgcgcaatgggaactgtgatctcaatgtaccttcacgacgagaactggcagcagataaaggaggcgtttgacaaccttggcatatcgataagatcaagagattacggaatagaggacgagatcgtaattaatgcactgagaaccgcccacgccataagaccggaaagatatactatcctcggagagagcgatatgtcctatgatgcggccgtaaaagccctggaacttactggaataatatga

SEQ ID NO: 41936 - DNA, 1128 bp, Thermoplasma acidophilum
gtgagagtgttggatgacatcgacgagaagatagataaagcgactaagctgcttcagggaggaataaaggaagaatccctaggccacaaagacaaggcaaaggagtattacttcgccgcttacagactgatgctggaagccgccaacgcgtcccccccagatctcaaaaagaaaagactggatcagtgcaacatcattctaagtgcctaccagcgcgtcaatgaaaacagaaccgcaccagctgaagagaagaccagcgacaggatatctgagggagaggccctgcttgaagaaataggcctagagaagccagagataccgaaggtaacgtttgaggatgttgctgggcttgatgacgttaaaaacgagatcctcgggaagatcgtgtatccgatgaaattcaaggagctgtcccaggaatacaatattcaatttggaggaggcatgctgttgtacggccctccgggcacaggaaaaaccttcatagtaaaggccatagccaatgaggtcagggcgaggttcatcaatgtaaacccggccagcctctacagccagtggttcggtatgttcgagaaaaacatatcgaagcttttccgggctgcggctttgctctctccttcaataatattcttcgatgaaatagatgcccttgtgccgaaacgtgatacctcaaactcagatgcggcaaaacggggcgttgcgcaactgctgaatgaggtcggcggcataaattcacagaagaacaagaatctgttcatcatagccgcaacgaacaatccctgggagatagatgaagctatgctgaggcctggccgattcgatatcaaaatatacgtgccgcccccggacattatagccagaaagaagatctttgagctgaacatggccaaggttaagcaggctggcaatattgattacaatttgcttgcccagcagactgaggggtacagcggtgcagacatagaattcatatgcaagaaggccagccagaacgtattcatggaagccgttaaatccggaaaacagaggcaggtggagaccagggatctcctcgacgtgatcggtagcataaaaccgtcaatcgatgccgatctgctctcgaaatacagggaattcgctggattctaa

SEQ ID NO: 41937 - DNA, 975 bp, Thermoplasma acidophilum
atgaaggaaatcagaataatactgatgggaacaggaaacgtcggccttaacgttctcagaataatagatgcgagcaatcggagaagatctgcatttagtattaaggtggttggagtatcagattctcgaagctatgcttctgggagaaatctggatatctcgagcataatatccaataaagagaagactggcagaatatcggatcgagcattctccggtccggaagatctcatgggcgaagctgccgatttgctcgttgactgcacccctgcgtcgagagacggtgttcgtgaatattcactttacagaatggcgttcgaatccggcatgaacgttgtcacggcaaacaaatccgggttagctaataaatggcatgatatcatggattccgcaaaccagaattcgaagtatatacggtatgaagctacggttgctggtggtgtgccccttttcagtgtccttgattactcaatcctgccttcaaaggtaaagcggttcaggggcatcgtgagctctacgatcaactatgtaatcaggaacatggcaaatggaagatctctgagggatgttgttgatgatgcaataaaaaagggcatcgcagaaagcaatccgcaggatgacctgaatggtctggatgctgccagaaagagtgtgatacttgtgaaccatatatttggaacggaatacacactgaacgatgttgaatattccggtgttgatgagagatcatacaatgcgaacgatcgccttgtcacagaggtgtacgttgatgatcgcaggccagttgcagtatcgcgcatcatctccctgaataaggacgacttcctgatgagcatcgggatggatggtcttggctatcagattgaaaccgacagcaacggtactgtgaacgtaagtgatatatacgatggcccatatgaaacagccggcgcggtggtgaacgatatattacttttatcaaaggtgcagaaataa

SEQ ID NO: 41938 - DNA, 1182 bp, Thermoplasma acidophilum
atgcaaagattgagctgggtggaggaagagctctcagccctgaaggctgagggaagatacgtcccgataagaacgatagagagtgctcagggttcatgggtaacaatagggggcaagaaagtactgaacatgtgttcaaacaactacctcggttttgcaaatcatccggagacgaagaaggcagcaattgaggccattgagcagtacggtgttggggccggtgcggttagatccatagccggcacggatgagatacatgctaggctggaggagaagatagccaagttcaagcatatggaatcggcactggtgtatcagggcggtcttctggccaatgttggaaccataccggcactagtcggaaaggatgacgtcatattctcagaagagctgaatcatgcgagcattatcgacggcacaaggctgagctctgccaagaggatagtgtacaagcacctttccgtagaggacctggaaaagcagatcagggaaaaccgttccgccttcaagaaggcactggtgataacggatggtgtcttcagcatggacggagacattgcgccattgcccgagatcacggaggtcgcggagaaaaacgatgttatggtctatgtggacgatgcccacggagagggtgtgcttggcgatcatggcaggggaattgtcaactacttccatctggaggatcgtgttgatattgagatgggtacattctcgaaggcgctgggttcaatgggcggttttgttgcaggttctgcagatctaatagatcttctcaagcagaaggccaggcctttcttgttcagcagtgcgcttaatccgggcgatgcagccgccgttctcaaggcgatagagatactggagaaggacgattctctgataaagaaactgtggcacaattcggatatattgaaaaaatcgctctctgatgttggctataataccggacacagcaagaccccaataacgccggtcataataggcgatgaaaagaagactgtggagctgagcaagatgctgtacgatgagaaggatgtctttgcttcccccatagtgtatcctaccgtgccaaagggtactgccaggataaggctcatgccgtccgctgtacacacggacgctgacataaaggtagctgttgacgcattcacagatctcggcaaaaagttgcatataatatga

SEQ ID NO: 41939 - DNA, 1209 bp, Thermoplasma acidophilum
atggaatacagattttctgacatatttcggtacataaagccctccgagattagatcgttattgaaatacacctccgatccggaactcatttctttcggcggcggaatgccaaatccggaatcatttccgatcaaagaaatgaaggagatactgaacgatgtgatagataattacggtaaaaaggccctccagtacgggacgaccgagggcctagatccgctcagggacgaactggccaaatacgtggagaagaccgagggaatcagggcaaagagggaggagatcatactcaccaccggatcgcagcaggccctttacgcgattggaaagatattcacgaatccaggagaaacagtcataacggaggggccaacctatgtcggcgccatatcggccttcaattccaacaaggctgagatgatcgcgatagatctcgatgacaagggaatggacgtggatgctctggaggaaaggataaggaattttatggccaacggaacgaaaccaaagttcatctacgtcataccgacattccagaaccctgctggcaccacgatggtgcttgacaggagaaagcagctgctcgaaatttcaaaaaggtatgagataccaattgtggaagataatccgtacggacagttgagatacgatggggatcctgttccatccatcaagagcatggacgatgacggaaatgtgatctacctggggacattctcaaaggtcatggctccgggcctgaggcttggatacgtcatagcggacaggcagatagtggagaagataaatctggtgaagcagggcctggatcttgcatcggactccctgtctgagtacatcgcatatgaatacctgaagcgcggagacatatacaggcagatacccaagacggtcagcctgtacaggaagaagcgcgacctgatgctgaaatcgatagctgagtatttccctgaaggggttaaatacacaaagccaaacggcggcatgttcctctgggtctctctcgatgagaagatcgacacaaccaggatgctggagagggctttgaaggcaaaggtcgcgtacgttagcggagctgccttctatccgcatggcgaaaagcacaacagcatgagactgaacttcacgtattctgacgatgacaagatcgtcgagggaataaaacgcctagcatacgtgataaatgaggagatggaggtcgtcgagtaa

SEQ ID NO: 41940 - DNA, 765 bp, Thermoplasma acidophilum
atgaatattaaacccctaccggataatggagatcttgttgtcgtcaagataacagaagttaaaaacttcggagcaaacggtgttctggaggaataccctggcgtggaaggttacatacacatctcagaggtcgccactggctgggtcaagcatataaggagttatctccgtgaggggcagcgtgtcgtatgcaaggttataggcgtcaatcccgagcggaaggttgtcgatctttcgctgaagagggtaaaccagcaccagagcagggagaagatagctgagtggaagaacgaacagaaggcagataagttgttcgagatagtgtgcagcaggcttaatagaaatcctgaagaatgcaaggagcagttcggtaggaggcttgttgagctgtttggaacgcttttcgctgcctttgaaagtgcagcgcagtcaaatggagaatggcttccagagatgaatggcgactggaagaatgtgtttgtggagatcgccaaggagaacataacgatcccagaggtttccgtctccggatactttgaggtctattctttagcttcagatggtgttgagaggataaaggaagttctcacaatacctgaggatacgggaaaggttgaacttgagtatgttggcgctccgaggtacagaatagtggtgaaggacaaggactacaaaaaggccgaagaaattcttaaaaaggttgtgcagatagttaacgagaaggccaagaagctacaggtggaagtggagttcaacaagcaatga

SEQ ID NO: 41941 - DNA, 690 bp, Thermoplasma acidophilum
atgatattcctcgattatgacggcacgcttgtgccgataataatgaacccggaggagagctatgctgatgctggtctcctctcgctgatatccgatcttaaagaaagatttgatacctatatcgttacgggaagatctcccgaggaaataagcaggtttctgccacttgacataaatatgatctgctatcatggcgcatgttcgaagatcaatgggcagatcgtttacaacaatggatcagatcgcttccttggagtcttcgacagaatatacgaagatacaaggtcatgggtatctgatttcccggggctcaggatatataggaagaatcttgcagtgctgtatcatctcggacttatgggggcggatatgaagccaaaattaagatcgaggatcgaagagatagccagaatatttggagtggaaacatattacgggaagatgatcatagagctccgtgttcccggcgttaacaagggatctgcaataaggtctgtaagaggagaaaggccggccataatagcaggcgatgatgctaccgacgaggcggccttcgaagccaatgatgacgcgcttacaataaaagtcggagaaggagaaacgcacgcaaagtttcacgtggcagattacatagaaatgcgaaaaatacttaagttcatagaaatgttaggagttcagaaaaagcaataa

SEQ ID NO: 41942 - DNA, 1326 bp, Thermoplasma acidophilum
atgaagtacatagtcgtctccagcagatgcccattttcccatgataaggctgcaggaaaggagatcataaaggaaaatgttggcggggttgctacagccctgcggagagcgatggaaaaatacggtggcacttggatttgctggggagacggcaagctggatggcaaatatctggatgaggacgttgggaaatacagaatccgcagggtcatgctcagtgtgcctgaaaaacatggctattatgatctttactctaacagaacgctgtggccgctattccattacttcagggagagggtcaagtacacagacaatggctacgaaatctacaggcgtgtcaacgaaaaattcaccaacatgatcgttcagtcgttatctccggaggacgttatatggatacatgattaccagctttcccttgttcctaagatgctccgggatcgaggaataacaaaccggataatattcacctggcacataccatgggtttccaaggagatgttcgagacgctgcctgagagcagggatataatcgacagcctttcgagatctgacttcataacattccataccgaaacctacaggaagaactttacagatcttctggacgagaactcgagagcaaagagcctggttatacctctcggaatagattaccgctacttcagcaagacaaggggtacggacataaagagctatgcgctcatggacagaaagcttatattttccatagacagactggattacacgaagggcctggtgaatcgggttctttcaatcgaggagctgcttagaaggcaccccgatctcgtgggcaagttcgtttacgttatgatagtcacacccagcaggacaaccgtgtcagattatgtggccatgaagcgcgaactcgagatgcatataggcagaataaatggagagttcggatcgatcagctggatgccgatactatacatgtacaggaagatctccgataagatgctggtatcgtattacaagaatgcggatatagctctcataacaccactgatcgatggcctgaacctggtttcaaaggagtttgtagcatcatccgataagggtatcctgatactttcaagatttgccggtgcttcaaactgcctggacggagccgtggtcgtgaatccaaatagccttggcgaagttgcggaagcgatatacagcgccatgaatatgggcgaggatgagatccgggaaaggctcaggaagatgaaggaagaggtgtcaaggagagatactgactggtggatccgacgaatcaatgcgatagcaaagaggaagataaatgatagaacagtcacttga

SEQ ID NO: 41943 - DNA, 567 bp, Thermoplasma acidophilum
atgaggataacgatagccggaaagatcggcagtggcaagtcaactgtcagttcagaactgtcaaggataacaggatataccgtatactcctccggtacatttttcagggaaaccgccaggaagatgaatatgagtatagaggacttcaacgtatattccgaatcgcatccagaggcagattattatacggatgaaacgcagaaggcgtttatgcaggccaacgacaacataatagtagagggacggcttgccggctggatatcgtacctgaatggaataaacgcattcaggatctttctctatgcaacgtattacaccaggctcgtaaggttcgctggaagggaaaatattgatatcgatagtgcaagagatctcatggaaaagcgtgaaaaatcggagaaggaaaggtacaggaagctgtatgggatcgacgtagacgatctttccatatacgatattgtcgtaaatacagagttcatgaagccaccggagatagcggtgtatatcgccaacaggatcgatgaaatgtcaagaaaggatatttttacaccgagaatactgcggtga

SEQ ID NO: 41944 - DNA, 552 bp, Thermoplasma acidophilum
atgcggtcagtcataaccggggttgcaggtgtgggcaaaaccactgtattggacatagtgagcaaggagaccggcataaagatagtgaactatggcacgctgatgtttgatctggcaaaaaagcggggccttgtggaaaacagggatcagatgcgaaagctttcgagggatatacagatagatctgcagaagaacgctgctacggagataggtaggatggaagacgtcatcgtggacacgcatatgtccataaagacgccgttcggttacctccccggccttccggaatgggttctgcgcgagataaatgcgtctgcattcataataatcgaagcagatccggagctgatcctgaggcgtaggcagaacgacccgaccagggcaagggatgaggattcagtcgaaagcataagagagcaccaggaaatcaatagggcttttgcagcggcctattcaatcttcagcggcgcaacggtcaagatcataaccaacgaggagggaaaaccagataaggcagcacatgatatcataaaggtgattgcagttgactga

SEQ ID NO: 41945 - DNA, 1632 bp, Thermoplasma acidophilum
atgatagctggacaacctatattcattcttaaagaaggaacaaagagagagagcggaaaagacgcaatgaaggagaacattgaggctgccattgcaatttcaaattccgtgaggtcgagccttggcccaaggggcatggacaagatgctcgtggactcgctcggcgacatagtcataactaatgatggtgtgaccatcctgaaggagatggacgttgagcatcctgctgcaaagatgatggttgaggtctccaagacacaagactcattcgtgggagacggtacaactacggcagtgataatagctggcggtctgctccagcaggcacagggcctgataaaccagaatgtacatccgacagtgatatctgaaggatacaggatggcttcagaggaggcaaagagagtcattgatgaaatatcgaccaagataggtgctgatgagaaggcactactccttaagatggctcagacctctctcaacagcaagagcgcctctgttgctaaggacaagctggccgagatctcatatgaggcagtgaaatcggttgctgagctgagagacggcaagtattacgtcgattttgacaacatacaggtcgtgaagaaacagggcggtgccattgatgacacgcagctcataaatggtataatcgttgacaaggaaaaggtgcatccgggcatgccagatgtggtcaaggatgcaaagatagcattgcttgatgctccacttgagataaagaaacctgagttcgatacaaacctcaggatagaggatccatcaatgatacagaagttcctggcccaggaagagaacatgctcagggagatggtggacaagataaaatccgtgggtgcgaacgtggtcataacgcagaagggcatagatgacatggcacagcactatctctccagggctggaatatacgcagtacgcagggtcaaaaagagcgatatggacaagctcgcaaaggcaacaggggcttccattgtatcgaccatagatgagatatcatcatccgatctgggaaccgcagagagagtcgagcaggtgaaggtcggagaggactacatgacgttcgtgacgggctgcaagaatccaaaggcggtcagcatacttgtcaggggagagactgagcacgtggtagatgaaatggagagatcaataaccgattcgctgcacgtcgtggccagtgcccttgaagatggtgcatacgctgctggcggcggtgctacagcagccgagatagcgttcaggctcaggtcatatgcccagaagatcggtggcaggcagcagctggccatcgagaagtttgcggatgcgatcgaggaaatacccagggcactcgcggagaacgcaggtctagatccgatcgacatactgctaaagctcagggcagagcacgccaagggcaacaagacatatggtataaatgtcttcaccggcgaaatcgaggacatggtgaagaacggcgtgatagagcccataagggtgggcaagcaggccatagagtctgcaactgaggctgccataatgatactgcgcattgatgatgtcatagcaacgaagtcaagcagttcctctagcaacccaccaaagagcggaagcagcagcgagtcctctgaggactga

SEQ ID NO: 41946 - DNA, 1380 bp, Thermoplasma acidophilum
atgtttgagggcttagattcacgcagaataacgttctttcagataaagagcgtcatagtcagcggcataggtatattctcagattcttacaatctttacgctatatcgcttgtatactatctcgtatctgcttcactggatctttctccacttcaggattctttgatgacttcagcatcctttatgggcgcggcggccggagccttcctctttggcttcatcgcggacagaatagggcgaaagccaatgtatgggatagaccttgcattcatagccctcggttcgttccttcaattattcactgtaaacttctatgagcttgttatattcaggtcgattctgggattcggaataggtggggactacgttctttcgccggttataatggcagagaatgcagacaccagggacaggggtaaactgatgataatgacattcccaataatggctgcctttggagccatgctcgtagcattcgtggatcagatatctctcctatatttgccgtctagtgcagtttggcatgttgtcctcgcttttggaggcgtgccagctctgcttgttatatatctgaggagaaaaatacctgaaacgccgaggttcgaagccagggttaggggcaattctacggaactatccaagatagaaaccgagatcggatcagccgttaacgtggacatagatcgaaaaccgttcatatctaggctgcgtgcctcgattctcatgataaccgtatccgccgttctgtggatactctatgacatgtactccactacattcgccatctacggaccgataacgatagcatacaaccttggcctaaccccgataaccttcacatattatgcggaattatttgctggcatacccggcgcgataatatctgcacttctcatagaccgggttggaaggcgtaagctcatagtggttggatatgctggagttttcgtctggctcttaatgtattcgcttctccttgcaaaggcatccatatttgcaggccttgcttccgatatcacaccggcaggcctcataggaaaggctgcgatactgggattcttcttctacataatgaactacctgttttcagccacagggccggcatcgataataggcggggcgatggttacgccggagataacgccaacaaaagtcaggggcacctcacagggaataactgttggtattgatcgaacagccgatgctgtaggcctcacagcttttccgatattgctttcaaaatttggcttatctgccatggtactggcctacgccatgatagcggttctttccataataatgatcttcatgatacctgaagctgcaggcaagagcctcgaagaggtgtcaaaggattacgatacgacaacacaaatataa

SEQ ID NO: 41947 - DNA, 702 bp, Thermoplasma acidophilum
atgcaacagggccagatggcttacgatagagcgattacggttttttcaccagatggtagacttttccaggtagagtatgcaagggaagcagttaagaaaggttcaacggcgctcggtatgaaattcgcaaatggtgtgctcttgatatccgataagaaggtaagaagcagacttattgagcagaattcaattgaaaagatacagcttatagatgattatgttgccgcagtgacgtccgggctggtggcagacgcgagagtacttgtggactttgccaggataagcgcccagcaggaaaaggtaacgtacggatcgcttgtaaatattgagaatctagttaagagagttgctgaccagatgcagcagtacacacagtacggtggcgtaaggccatacggtgtatcgctgatcttcgctggcatagatcagatcggcccaaggctgttcgactgcgatcccgccggtactataaatgagtacaaggcaacggccatcggatcgggcaaagatgccgttgtgagcttccttgagcgcgaatacaaggaaaacctgcccgagaaggaagcagtgacgcttggaataaaggcgctgaaatcttcccttgaggagggcgaagagcttaaggctccggagatcgcatcaataacggtgggaaataagtacaggatatacgatcaggaggaagttaaaaaattcctctga

SEQ ID NO: 41948 - DNA, 1065 bp, Thermoplasma acidophilum
atgcagatagaaaccgaagacccgcatgaaacaataaacaattacaaattgcgaatagacgagaggatatcaaggtttttcgacaggaaagaagccgaaaccaaagatgatctctctagaagggtcataaggatgataagggagtacaccgagggagggggcaaaaggcttaggcccatattccttgtccttggctacaggctctttgccgatgaaaataatgcaatattcgatgcttcgatatccatagagcttgcgcagtcatatcttctcatacatgatgacgtcatagatgacagcgatctgaggcgcgggaaacccagcatgcatataaggctgtggagatcgttcttcccggaatcagagaaggggaagaagatgggggaaggcctcgcaatagttgcaggagatcttgccgaaacctatgcccatgaaagcctgatcaactccgacttcgatcccagcctacttctgctggccgatatggaacttacgaagactatagagatgacaggctacgggcagttcctagatgttgtttccggcacgctgaatgattttagagaaaacgatctcataaggctgcacctatggaaaaccgccagatacacgcttgagggtcctctggccatgggtgcattgctcagtggaaggcacgatcagatcatggatctgagactcttcggccgtacgcttggaatagcgttccagctcaaggatgacatactcggcctgtttggtgatgaagccacaactgggaaatccatatacagcgatgtgaacgagggaaagagaaccctgctcatgatcaaggccatggaattttctgacaggcaggatgccgagttcattgacagaatactacgcagaggcaacgtgacccaggaggaattcgagaggataaggaacatcgtgatgaaaagcggatcttacgactactccgtcaagctcatggacagcctggttgccaaatcaaaggagtacctaaacagaattagaggcaacagctgcgccaaaacttacctttcctggctttcggattaccttgtggccagagaccactag

SEQ ID NO: 41949 - DNA, 987 bp, Thermoplasma acidophilum
atgaaggctgctcttgtatatgaaccgctaggaaacgaaaatctgaggatcgaagatgtcgatgaccccaaggttttggatggccaggttctcatagaggtcaggaaagccgggctcaaccccgttgattacaacacgataaacggcaagatcgtgtacaagctgaatccgctcccacacattccagggacagaggtatacggggttgtggcacaggacagcggaaatttcaaaaagggcgaccgcgtggttgtgtataaccgagttttcgatggcacatgcgatcaatgtatatcgggaaatgagcatctgtgcaccgcaggtggcatatggggagttgtatccaatggtggctatgcacagaaggtcgccgttccagagaagaacgttttcaggctgcccaaaaatgtaagcgatgagatggcagcaagcatcggtgtggcagccctgacctcattcagggctcttcgactagctggctgtgctcctggcaaatccgtcctgatattcggtgcgtccggaaataccggcatgttctccgtacagatggcgtcaatgatgggctgtgatgtctacgcggtgtcaaggaaggactggatagaggaattcggtgcaacagaggtattcgaggcggatgagatccctgatagcatgaaattcgatattgttgtgaatccgctgggaacgttgttctggaaggaatcgctgaaacacctcggtatccgtggatctctggtcacattcggcatcttcactggaagagagggatccattgacatagcggatctttacacaggcgagagaaggatacttggatcaactggtggcacgagatcggatctgagggatctgctggagttcatgaagatgcacgatttacgcgtcaagatatcgagagagttcaaactgactgaaatgcaggatgccctgaaattttacaacgaggaccatgacgggaggatactcatatcgatgagagtatcctga

SEQ ID NO: 41950 - DNA, 1452 bp, Thermoplasma acidophilum
gtgtttcctaaaggctttaaatttgggttttcagaggcagggtttcagtttgagatgggaataagtgatcctgatcccaatacagactggtatgtatggacgcacgataagtataacattcagaaccatgtggtttctggagatctgcctgaaaacggtgcaggttactgggatctataccacagggatcatgatttcgctcagcatctgggaatgaatgcagctagaataggtatagaatggtcaagaatatttccaaaatcaactgaggaagttaaggtcagtgtacaaaatgacaggggcgacgtgctgaatgttgatatcacagacagggatcttgacaaacttgataagattgcaaataaagatgccgtgaatcactatagaagcatattctcggatttcaagaatcgcggaaattaccttatcatcaatttgtaccattggtccactccagtgtggataaacgacccgtcgaagagagatatcgaaaaggataatgcagttggaaattgctttacaacacgctcaattgtggaatttgccaagtttgcggcttatgttgccagggcgttcgatgatcttgctgatagatggagcacgatgaatgaaccaaatatacttttcaatggccagtgcagcaatgactggagaccggactctatggcaatacggaaaaagctgttcgcagaagcccatgcaagggcatatgacagcataaaaaaattttcagagaaacctgttggcatagtgtatgccaatggagatatgcagccattgactgatgaggacagagaggcaagggatcttgcagagtatgaaataagatactcgttcttcgacgccataaccaagggagatctatcgtggtatgcaaatgccgcgcagaatcgttctctggattatagctctgataagcgggaggatatggcgaatcatcttgactgggtgggtgttaactattacagcagggatgttgttaaaaaagacggtgacagatgggccatagtacctggatatgggtatgcaactggcgagaacaagaggtctcttgacggaagatcctccagcgacaccggctgggaagtgtatcctgaaggaatataccatctcgtcatgtcctatcagaagcatatcgggcttccgatgatgatatctgaaaatggagttgcggacgatagcgacagactgaggcccagatacgtggcatcccatctgaagaatctcgaaagtgcgataagagacggtgcaaaggttgagggctacctgcattgggcattgacagacaattatgaatgggcatcaggattttccaagaaattcgggcttctcaaggtagactttaaaacaaagaagagatacatcaggccaggtgcgcttgtttttaaagaaatagttgaaaataatggagtcgacgaagatctggaatggcttgccgcagataaattctaa

SEQ ID NO: 41951 - DNA, 894 bp, Thermoplasma acidophilum
gtgctggacatggaaaaggatctgagcgaaataatcgatctatccattgagttgaagaaaaacagatacagaagctatgaatcgctgagaaataaggttctgggcctcatattcgagaaaccgagcacgaggactaggacgtcgctggaagttgcgatagatcagctcggtgggcatgctgtttacctgaacccatcagagatgcagttgggcaggggcgaaaccatatcagataccgggcatgtactttcgagatttctggatgccatagcataccgtgcttacgaccacaggaacgtggtggaactagctagaagcaccagcataccggttataaatgcgcttgacgatgtggagcacccgttgcagatagttgccgatttcatgaccataaaggagaagaaggggcggttcacaaaccttaaattttcttacataggcgacggaaataacatggcaaattcgttgatgctgggggcagcaatacttggaaccgacatgtatgtagcatccccaaaggggtttgagccgaagcaggagttcgttgagaaggcaagaagcatagcgaagcagcatggatcgtccatcaccataacaaacgatccggtagaagcagccagggatgctgatgtcatatacacggatgtctggatatcgatgggcgaggaatcaaagaagggagaaaaggaaaaggccttcaaggatttccagataaatgagaagctcgtgtccaatgccaagagggattacatattcatgcactgccttcccgcacatcgcggcctagaggtcaccgatggcgttgctgacagcataaacagcgttatatttgatgaagctgaaaacaggttgcattcggagaagggcgttttatacaagcttctttcctactga

SEQ ID NO: 41952 - DNA, 885 bp, Thermoplasma acidophilum
ttgaaagggtcacgaaggtgttctaaaatggttctgataaataagaatactaaggtgatagttcagggcattaccggccatcagggttctttccacaccggtgaaatgctcaagtttggcacaaaagttgttgcaggaattgcacctggcaaaggcggaacgaagttcgccgataaggtgccgatagtgaattctgtttcagaggccatgcagtatgagccagatgccaccatgatatcggtaccggctccatacgtcaaggatgcggcctacgaagcaatagacaacgggctaaagatagtctacatactaaccgaacatgtcccataccaggacacgatggaaatagtcaaagaagcttccctgcgcggcataaccgttcttggccccaacgggcctggcataacggtgcctttcgagagcaagataggcataatgccaaaccacatattcaaggagggcgatgttgccatagcctcaaggagcggcacgctgacctacgaaatagtgtacgcggttacgaaagcaggaatgggagagagcaccgttataggccttggtggggaccgtgtggtcggcctgacgttcatagacgtgcttaagatgttcgagaaggatgaaaagacaaagcgcattgttcttgtaggagagatcggtggaaacaacgaggaactggccgccgattacataaagaagcacgtgaagaagaaggtcgttgcatacatagcgggcaggagtgcaccaccaggcaagaggatggggcatgcaggtgcaataatagagcgtggggtcggtactgccgaatcaaagctcaaggccttcgctgaggcaggcgtgaaggttgcagattatccacaggatataccgaagcttctggaggagtga

SEQ ID NO: 41953 - DNA, 1131 bp, Thermoplasma acidophilum
atgacattatgcaatcactggtacggtgatctattgaatctttatgaatacatggggaaggacatcttccgtcagtacggaatacctgtacccaacggatatgttgtttcaagcgtagatgaggtcagaaaacttacaaaccctgtggctgtgaaatcgcagattctcctaggaggcaggggaaaggcaggaggcataaagttcgctaagacggatcaagagctcaaagacgctgtgaaagcacttctgggagcaaaggtaaggaatctgaccgtgaccaaggtgctcatagaagatatgctgaacataaagcatgaatattacgtgagcataacgctaaacagatcagcaagagcaccaactgtaatcgcaagtgccatgggtggtgttgagattgaaacggttccggatgagaaaatattcaagaggataatcgatccatcgcttggatattcggacttcataggaagagaagcgtccacttttatggggctgagcccggatctgtcaaagcagtttctggatcttctgaagaagctgtacaatgtctacaaaggcgaggacgccgagcttgttgagattaacccgctggtggagacgaacgatggcaagctcatagctgcagatgccaaggttgtgatagactccgatgcaatgttcaggcacagggaattcaacatacaggatccggaaaaaacacctctggaactgaaggccgagggcaagggctatgcctttgtggagcttgacggggacattggtgtgatagcaaatggtgctgggctcaccatggccacactggatgcgcttctgctgcataagggcaagccgaggaactttctggatcttggcggaacagataacgttgacatagttgtgaatgcgttcgatcttgtgcttgaagccaagccaaaggccatactggtcaatatatttggaggagtcacgaaatgcgataccgtggctcagggcatagtcgatgcgaagaagaagttcgacataaagataccaatagtagtaaggttgagcgggatccatgaggaggaaggcaggcagatcctgaaggagaacgggattgaggcgttttccgagatgatgccagccattgaaagggtcacgaaggtgttctaa

SEQ ID NO: 41954 - DNA, 1410 bp, Thermoplasma acidophilum
ttgagtaaggagtacgatcttctcattttagggtacggcgctgcagcattctcagcagccataaaagcgtcggagataacgtctgggcaggccagcatagcgatggtcggcacagggccgcttggcggaacatgtgttaacgttggttgcgtcccttcgaagatgctcatctcagctgcgaagaacctgaagtacatagcgaagccgaggtatcccggtttaaaggccacatacgcagttgagactggcgaagtgatggatttcataaggatggctgttgacgaggaacggcacaacaagtatgaagcggtgatctctggatatgaaaacatagacctttacagatcacgcgcagtcttcacgggagatcgcagggttaaattggatgacggacaggaactgttcggatacaacgtgttaatagctacgggaagcaggccatccataccagcagtgcccgggcttgccaatgctggatacataacaagcaacgagttctgggccctggaaagaattccagagagtcttgtcataataggcagcgggcccattggatctgagataggccaggcagctgcaaggcttggaagcagggtgcacatagttgagatagcggatcagatacttcctggcatatctaaggacatggcgcagatggtaatggatgccatggccagtgacggtgttgaattctcactttcatccatggttaaagatgtctcagtcaggaacggtaagaagatcgttagattcgagaaaaatggtgttcagcatgagattgaggctgacgagatcctcgtagccacaggaagatcgccgaatgccgatctggatcttgagaagacaggcgtgaagtatgacaggtacggcattgaggttgacagcactctcaggacatccaacaggaagatatacgcggcaggcgatgtggtcaagcagagactgaagcttgaaacgcttgcatcgaaggaaggtgtcatagctgccgagaacatgttcgatcatgcgggcataagcgtcgatctgaatagttttccagttgcggtatttacgagtccggaatacgcgtcagttggttacacggaggatgaggcccttaaggccggcttgaattacgatgtcagatcgatatacaccaccgacgtgcccaaggagaggatactgaggaatgatcgagggatgataaagatagtagcagaacagggaacgggcagaataattgggatacagatcgttgcagagaacgcagcggacatgataaacgaggcatcagcgatcctccatgcaggcatgactgtgggcgatgtcatagatacgccacatgtgttcccgacggtcaatgaaggcataaagcttgcagcgcagtcatttctgagggatatctccatgatgagctgttgtatggaatga

SEQ ID NO: 41955 - DNA, 375 bp, Thermoplasma acidophilum
ttgatcatgacagaggtaccagagggtttgaactacacgaagacgcacgaatggtacagaaaggatggaaacacagcgaccataggaataactgattatgctcagtcccagatgacggatatagtctacgtcgatcttccaaaggttggggataagaagaaggccggagacgttcttctgacaatagaatccgtgaaatcagcagaggatgtttattccccaataacaggaacggtaaccgccgtaaacgaagaggtcgcaaagcatccggaatcaataaacaaggatccttacggcagctggctggtcaagatggccattgagagtgagggagaacacctgtctgcatcggagtacaggaagttaatacaatga

SEQ ID NO: 41956 - DNA, 1383 bp, Thermoplasma acidophilum
atggattgccctgaaccgcgatcctgccatgcaaagaaaccttttatctctccagatcatagtgtaaaggtctctatggttgtacctaatggagagggcgataagactgcggctgttgtgggtctgcagtttggtgatgagggaaagggcaagataaccgattatctcagcggatcttacgatgttgttgttagattcaacggtggaacaaacgctgggcataccgtggtgaccgatgaagggacgttcaagttccatcttctcccttcaggatccctgcgtacatcatatgttgtgctcggcagcggcatggttatcgatccggttgcgttgatccctgagatagagatagtgagaaagatcaatccggcactgaaaattataatcagcagaaacgcccatgttgtaacgaagatgcacaggcagatcgatgtggaagaggagaagataagatcgagcctgatgataggaaccactgcacagggcattggccccacatacgaagataagtacgcacggactgggataaggatggtcgacatctccgatattgacctgatcaaggagaagatagaaaccatgtacaggatgcactccaacctgttagccaacactgaattttccaatctggcaaagagagaggaaatggccaaggagatatacgaagctggcatcaagctcactggataccttgactatacggaggtagcgatagacaggctttattcccagggaaaaagaatactgttcgaaggcgctcagggcgtgttcctggatccagattttgggttctatcccttcgtcacatcatcgaacaccataagcgcttcagtttacacaggaaccggcttctctctcaggaaggtcaacaggataataggagttgcaaaggcgtacgtatctaaggttggggaggggccatttcccaccgaaataactggcgacctcgccaagcagctcagggatctcggtggcgaatacggaacgacaactggtaggccgagaagggtcggatggctcgatctgcccatgctgaaatacgcagtacgcatagatgacgtggatgagatagccataacaaaggttgatacattgggcatgcttgacacggttaaggtttgcagacagtatctcatagatgggaagcctatagattatgttcccagagacatgaataccataaagaagatcgaacccgtgtacgatgagttcgagggatggggtgccatctcagattcgatcagcggcaggaagatatcgatagatcagctgccatcaaagctggtgaaatacataaagtacattgaagatcaggttggaaagcccatcggcataatatccatggggaaggaaaggaacagaactgtgagaataataaaatga

SEQ ID NO: 41957 - DNA, 1431 bp, Thermoplasma acidophilum
atgacagaaaacaacggaggtctggacgctataaatgaggctatcaacacgtctcatggtagtttccatctgaagaccgttcttatatccggattgggcttctttacggatgcctacgatctattcataatcggtgtggtcgtttctctgctttcgctggcaggctggacgaccgtggacactttctacaagggtctcataagctcaactgcgctaatatctgcagtcataggagccataatcttcggcaggctcctcgattacctgggcaggaagagagtctacgggcttgagctggcgatccttatagtcggtgccttgggcagcgctttcctgacgccttacaacaacgttatagccttaatagcgtggaggttcatcctgggtataggtatcggcggcgattacgccactagctcaaccataatagcagagtattcgaataccaagagcaggggcaagctcataggcagtgtattctcaatgcagagctttggactggttgcaggcccattggtagcgcttgcgttcatgcttcacggtattccgccggcaataacctggaaggccctgctggccataggggccataccggcagcaatcgtgatatacttcaggctgaagatgcccgagccgcctagatacacggcagcagcaaagggagacgtacacaaggctgcaaaggatctcaaggagtacaccggaatacatgttgaagtatcatccaaggataaatacgttgtgaaggccaaatggaccgcacttttcaaggacaggacttttctccttacgctgatcggtaccatgggtgcctggttcatgatggactgggcgctgtacggcaactcgataatgtcatcgacgatactttccgcacttgtaccatccacgattaaaggccttccagctctgataagatccacagaatacaccctgttgatatttgctggtgcagcattccctggctactggatagcaacttcagtgctggataagataggcaggaagaccatacagctcattggattcgcagttatggcactttcgtatgcactaattgcgataggctaccactcgataataggcaacataagcatgttcctggcgctgtacgggctcagctatttcttcatagagttcgggccaaacgtcaccacgttcgtgtatccgcccgaggtgtttccggtcacaacaagggggcttggaacaggtatgtcggcggcaggaggcaagataggcgcattcatcggtacctttgccgatgcgataatactcggcacagatgcgtctgcgcatctaccattcctgttctcgctcctcgccgtattcgcagttataggtttcgcactgacgctggtattgcttcctgagacaaagggaaggaatcttgaggacacgtcaggtgagaagaggtatacggtaaaggcctga

SEQ ID NO: 41958 - DNA, 1380 bp, Thermoplasma acidophilum
atgatatcctcaatgactgaatcatgggaggaattaaaagaaagagcttatggcccaatggacaaacaaaaatcaaaatggttcaactataaaatgctattattgactggaggtggcatattcgttgatggatacaatatagtcatcatatccttcggtttagcaggaatagaaacactgttcggtctacaacacaatgcttttttagttgggctcataggaatatcggtgattatagggaatttagtaggagccttgctttcaggttattttgtcgacaaggtcggaaggcgaacgatatttataattgatcttatattatttgtattttttgcaataatatccgggctagtgacaaatgcatacgaactcgtagtagcgcgcctcttggtaggtttaggaataggattagattatccaatagccacttcatatctcagtgaatataccccaattaatccaaggggaaaattcttggtcatgaatataacattcttcaatattgcaggagttgttgcagctatagttggatactcactcttgccattgggtgcaacgattgcctggagatatatgttaatgtctgctgcagttccagccgccattacaatagctggaagaatacgaactccagaatctccaagatggttacttgagcatggaaggaaaaaagaagctatacaggccattgaaagagtaacagagagcaccttgccagatgatacccaaaaattcataatggattccaacgtaaaaccaccggtatcaggctattataaagagcttcttacgaaatatactaaaagtgcaattttcataggtcttttctatttcttcttcgcaattgcatttgtaaacgcctctttgtatgggccttcaatccttgcatcctttggagaagctggtcttatcggttcttcattatattggttgcttttcgtcgtaggagacatcatctgtatactagtaatcgattcatttggtcgaagaaattctacgctaacaggctgggctggtatgctgataactatgataatcttagccttcgctccatcaaatctaaaattactttctcttggtgcatttatactatttgcaatgttccagggtatagggcctggtagtcttcatatggtatattctccagagctctttccaaccagaatcagagccactgcggagggatggaaacaaggtataggtagattaggtggagtgcttacaggtctgttcttcccaagtctggtgataggagataagctgttaatattaattctaacctctatagctggacttgtattatcaatactgatggctccagaaactaagagaaaagggctggaagagatttcagaaaaagacataaaccttcagatataa

SEQ ID NO: 41959 - DNA, 1371 bp, Thermoplasma acidophilum
atggctgaaactaaacagctatctgatgaagatcaggtaaaagacataatagccagagccaacaggatacctgtgtggtcccttccgacggcctttcttgccataataggcataggctatttcttcacattctacgatatatctgatattggacttgcaatgcccgccatagccaagcagtttgatataggtacgtcattaagtcttttcatagccttatccgttggcctcattggctatgggattggatcatacataataggatcattggcagatatttatggtcgatacagatcgatgatccttacgatggggctaactgcgcttggctcttttggggacgccatatctgtgaacgttccagaactcaccatattcaggtttataactggtctaggtctaggggcagatcttaatctcgtttcaagttatgtgagcgagttcgctccaccttccataagagggaagatcacagtctatacgttcttgataggtatcttgggtcaagcgataactccttttgttggcctatcactggtgccggtatattacaatggctggcgctatctgttcggtatcggggccgtcatagccttcattgccctgatattgaggtttgaattgccggaatcgccaaggtggctggcagcaaaggcccataatctggaaaaggccaggaaagtactggaaatgatggaagctacagccgtcaagaagataggaaagctgccagacccgaaaccagaagaggtggttttagaggagccaaagtttccaactctctatcttttcaggagaccttattcgacaaggcttgggttgcttgtagtgatgtggttcttctggtatattggaaattatgctttccttggggattcggcggccattcttgcttcagcaggcttttccatctcttcgtcaatactatatctggctgtgggtgcaattggatatccagtgggtgcagccataatggttgtttctgctgacagattcgaacgtaagtacgtcatatttgcagatacggttgtatggtttatcggcctcatgcttttctctgctaagataagtgcattcatctttgctggatctttcctcgcttctatggcactgggcatgtacctccaggttgcatacacttacacggctgaaaattatccaacaagggcaagatcctccggttttgcattgacagatggcattggacatgtgggtggtgcgttcggggcactgttactgccggttcttgttgcttcttactccttcgctttcggtttcaggttcattgctatcacagggcttatcgccggcatactggctatgttagggccaaagacatccaacaggacactggaagctatttcggcctaa

SEQ ID NO: 41960 - DNA, 1311 bp, Thermoplasma acidophilum
atgtacgatgcaataataataggttccggcccgggaggctatgcagcggccatacgcctgggccagaggcagaagaaggtcgctctcatcgaaaaggacaagattggcggtgaatgccttaactacggctgcataccatcaaaagcactgatagaactcgcaaactcgataaactacctcagggagatgccaggcgtatccctgaactattccatagacatgaagaaatggcaggaatggaagtggtccatgatcaacaggctgaccggcggcgtggaaacgctctgcaagggttatggcgtcgacgtcataaggggcgaagcttacatcgttgacgcaacccatgttaaaataggggagaaggtgatcgagggaaagaacctggtcatagccaccggttccaagccggtcaggataaagggcatcgacgatgtgatgtacaacagggaagtgctcgatctcgatcacataccggagtcaacggccataataggcggcggctacataggggttgagattgggacggcgcttgcgaagctcggatccaaggtgacaataattgagatgatgcccagcatacttcccggcacggatcaggagcttgtaaggcatgttgagaggaggctgtcccagctcggcgtccgagttatgaccggcaagaaggttctgaacacgcagcacggcgataagataagggtgaacatggagggcggagagtacgtagaggccgagaaggtcctcatgaccgttggaagggtacccaatacggagggattcggcctcgagaacttgaagctggagatggacgggcgcttcataaagacggacgcgcacaagcgcacaagcgtgccgaacgtttacgccataggcgacgtgtccgggcagcccatgcttgcgcacaaggcatattacgacgcggatattgctgcggacaacatatgcggcatggacagcgtagtagaatacagggccatgccatacgtcatatactctgatcctgagatagcgtacaccggatcgaagtcagcgaagtcaaccagatttccggttgcagcaaacgggagatcgcttaccatgaacgagagcatcggaacattcaatatatactacgatgagaagggcatcgtaacaggtgccggccttgccgcacctcacgcaagcgagctgataagcgaactgtcccttgcggttgaatccgggctgatggcaatggacatagggctgaccatacacccgcatccgaccgtcagcgagggcgtcaaggagactgcagaagaagcctacggaaagcccctgcacttcaaaatttga

SEQ ID NO: 41961 - DNA, 1203 bp, Thermoplasma acidophilum
atgtacgaattcaaactgccagacataggtgagggggtaacagagggcgagatagtcagatgggatgtcaaggaaggcgacatggtggagaaggatcaggaccttgttgaggttatgacggacaaggtcacagtgaagataccgtcgcccgtcaggggaaagatagtgaagatactctacagggagggccaggttgtccctgtgggttctaccctcctgcagatcgataccggtgaagaggctccggtacagcagcctgccggccgtgccgaaagcacggttcaggttgcagaggtcaagcaggtgcccctgccggaggtatccgggcatgtgcttgcaagccctgcagttaggagaatagcgagggagaacggaatagacctctcgaaggtgggaggcaccggagagggtgggcgcgtgacgcttgacgatctggagaggtacatgaagtcgcctgcaccatcgccagccccatccgctggaaaagcggaggccgtgcacacggcgccgcagatcccggcccagaagcctgcacctgggagagaagagatcctggagatgcatggcctgaggcggataatattcgacaagatgacgaaggcaaagcagatcatgccccatttcacggtgatggaggaagtcgacgtcacatccatggtttcgattctggattccgcgaaggccaggaacaggaaggtcaccgtcacgggctttctggcaaggatcgtgccatctatcctgaagcagtatccatacctcaacgcaatttacgatgaaacgcgcagagtttacatactgaagaaatactacaacataggcatagcggttgacacgccggacggcctgaacgtcttcgtcataaaggatgctgatagaaagagcatggtggagatatctgcagagatatcggacaaggcaagcagggcacgcgagaacaagctgcagctggatgaagtccaggattcaacgttcaccataaccaacgttggcacaatagggggcataatgtccacgccaataatcaactatcctgaggtcgcaatactgggtgtgcaccggatcctggaaagagaggggcggaaatacatgtacctatcgctgtcctgtgaccacaggctcatagacggagcggttgcaaccaggttcatcgtggatctgaaaaaggttattgaggatccgaacgctataatctacgagatctga

SEQ ID NO: 41962 - DNA, 960 bp, Thermoplasma acidophilum
atgaacatggttcaggcactgaacagtgcaatggatctcaagatgtccgaggatgacagcgtaataatactcggagaggacgtaggcagggatggaggtgtcttcagggtcacggatggcctacaggcgaagtacgggccacagcgtgtgatagacactccgctttctgagctgggaatcgtcggaatggctattggaatggccgttaacggtctcaagccgattccggagatacagttccaggatttcatatacacttccatggaccagataataaaccagatggcgaagattcgctacaggtcaggaggcgattacaccgtcccgctggttctgcgcactccagtcggtggcggcataaagggtggcctctaccactcgcagagcggcgaagcctacttcgcacatacggcaggccttacagttgtaagcccgtcaaatccatatgatgcaaaggggctcctcatatcagcgatagaatctccagatccggtcatattcctggagccaaagaggctttacagggcgcagaaggttgaggttccggacgagaaatacaccatcccgctcaggaaggcaaacgtcctgaagcagggaaatgacgttacaatagtgacctacggttcgatggttccgaccgtcatgtccgttgcgtccaagtcaaagtacgatgttgaggtcatagatctgcgcactatagcgccgatggacagggatacgatcatatcttccgtcaagaagacgggcagagtggtcatagtccacgaggctccaaggacgctgggggttggcgcagagatatccgcaatgatatcggagcgcgcaatagagtacctttacgctccgatcgtcagggtaactggcccggacacgccattcccctacaggctcgaggagtactatctgcccaatgaagggaggataaatgcagctctagatagggttatgtcattcaggtga

SEQ ID NO: 41963 - DNA, 1014 bp, Thermoplasma acidophilum
atgacggaagttctggatcaggatgagaaaaacctcatcgtaagaggttttacatccatggtgcttgggaggtattttgacaagaagatcataacggcccagaggcagggcctggtcggtttctacacgcccatgatggggcaggaagccacgcaggccggagctgccatggcgctgtcaaaggaggacagtgtctacggctattaccgcgacgtgacgatgctcatttacctggggcatccaatagagaagatattcgatcagataatgggaaacgccgaggacagtgccaagggcaggcagatgcccagccactacagtgcgaaggagataaacttcatgtcagttcccagcccggtagccaccaacctgccgcttgccgttggcgcagcctatgccaagaaatacagaaagcaggaaggcatcgtgataacaacgttcggagatggcggtacttcgaccccggatttccatgcggccatgaactttgcagccgtcttcgaccttccggtggtattcctctgcgagaacaacggatgggccatatccctgcccgttgagaagcagaccaaggctgaaatatacaagaaggccgaagcatatggcatgaagggcgtctacgtggacggaaacgatttcataaagacctacaggacggtcaaggacgcggtcgagtacgccagatctggaaatccgattctggtggaggcgagaagctacaggatggggccgcattcaacatcggacgatcccagcaagtaccgcaagaacgaggtgcaggagaacagcgatcttgatccgcttgtcatagcggagaagctgatgatcagcggaggatacctcaaccaggcggagatcgacaagatcaaggacgaatcaaagaagatgatcgatgagaagttcgaggagcgcctcaagatacctgctccagatcctgagacgatgtttgatgacgtctattccgagatcacatgggcaattgaagaggagaggggtgagatactacgcagatga

SEQ ID NO: 41964 - DNA, 1056 bp, Thermoplasma acidophilum
atgtcaggtattgtaacctacggttcatacatacccaggtatcgcataaagccggatgagatagccagggtatggggagagaacccggatcatataaagaatggcatatacatactcagcaaatccgtgccagcaccggacgaggatgtcgccacgatatccgttgaggctgctcggaatgcactgaagagaaagaagatagatcccaaggagatcggagccatatacgtcggttctgaatcacacccttatgctgtaaagccaacggcgacaattgttggatcggccataggcgttgacttctcactgttcgctgcagattacgaatttgcgtgcaaggcaggcaccgctggaatgcagaacgtaaaggccatggttgactccggcatgataaaatacgggcttgccatcggtgcggatacctcacagggagctcccggcgatgccctcgagtattctgcatctgccggaggtacagctttcatcataggaaaggatgataccatagccgagataaattcgacactttccgtagcgtccgatacgccagacttctggaggagagagggccagccctatccgagccatggagagaggttcacgggcgagcctgcatacttcaggcacgtcatcacggcggcaaagatgatgatggaacgcatggaaacgcagcccaaggactatgattacgttgtgttccaccagccaaatgggaagttcccgaccagggccgcaaagatgctgggcttcgaggagaagcagtacaaggacggccttctcactccgtacataggcaatacctattcaggatcgatgatgaccggcctctcctccatactggatgtgtcaaagcccggtgaccacatactggcagtttcattcggatccggcgcaggatctgatgcattcgacataactgtgactgacaggatcgaggagatggacaggaacagggcgccgaccataaagaagatgcttgagaatgtgaagtgggttgattacgcaatctacgcgaagtacaagaagaagataatagtgggtgatggcattgagtga

SEQ ID NO: 41965 - DNA, 1164 bp, Thermoplasma acidophilum
atggcattgagtgatgtgtacatcattggggcaggagaaacaaaattcggtgagctctgggataagtcgctcagggatctggccgttgaggccggacttgaggcgattaaggatgcaaacatctattccagggatctgcagatgctctatgccagcaacagccttgcaggcactataaacgagcagagcaacatcgctgcccttgcggcggatttctccggaatagcggaaacgcacgtgccggcagtaagggtcgaggcatcgactgcgtccggaggcgcggcggtgcgtgaggcctatctggccataaagtccggcgaatacgacgtggtcatggttggcggtgtggagaagatgaccgacatatacggatctgagataatagacgtgcagtcctccatactcgacagggagtgggagagcttcaatggcgctaccccggctgcgttagcggcaataacggcacgcagatacatgcacgacttcaaggtgcccagggaggatattgcgatgatcgctgttaacgatcatgccaacgcctccatgaacccggatgcccagtacagaaacaagataactgtggaacaggttatcaacagcgatccggttgcagagccgctgaacgtcttcgactgctctccgatctctgatggggcctcagcaatcattcttgcatctgatgagtacagaaagaagaacaggctggacggaataaggatagttagctccgccatgtcggaggattaccttgcactgcacagcaggaaatcaatatacacgctggaatctgcgcggatcgcctcgaagcaggccctcgaaagggcagggatcaagaagaatgacatatccttccttgaactcaacgattcatacagcatatacgggctccttgaacttgaggatcttggctttgcggagaagggcaagggcagggaacttctcggagaaataaagataaacgggagcctgcctgtcaacccgtctggaggcctaaaggccaagggaaacccgctcggtgcaacgggagtatcgcaattctatgaggcatatctgcagttaaagggaaaggccgggcagaggcaggtcaagggtgccaggtatggaatgcttcacaacatggcaggaactggggcgacgtccgtcgtccatatagtgggtgagtga

SEQ ID NO: 41966 - DNA, 639 bp, Thermoplasma acidophilum
ttgacagaatcagaaaggcagtgtggaatagatgaggccggtcgtggcccagttataggaccaatggttatatcgctggtgtgttgtgatctttcatttcttaaggaaataagggtaaaggactccaaggccctgaccaggaagagaagatcagaactgtttgaaaagatcatgggaagatgctctgttaggtacaggatactccatccaaaggatctcaataggatgatggctgccgaatctctgaacaagatcgaggaggacgagatagtggatctgcttcgttacgccgatgacctggtatacatagattgctacgacgtgatagaggagcgggcacaggaaataatccagatgagatcaggcaggcaggttgtctgcaaacataaggcagatgccatatttcctgcagtttctgccgcttccatagtatcgaaggtcataagggatgcggagatagacaggcttcacgatagattcggtgacttcggatccggatacccatccgatccaaggacgatagatttcctgaaaaaatacctaaaggagaaccaggatccatccgaaattgtgaggattcactggtctacggttcagcgtttgctgcattcagaaaaaaatcagaaaaaattattttaa

SEQ ID NO: 41967 - DNA, 1095 bp, Thermoplasma acidophilum
atgatgtgcctttcagaagaacagcagattctgagaacaagcataaaggattttgtgaaaaggtatgtggtaccagggctgaatgaaatcaagaatgatagatttccaagggatatcctgagagaactgggaaagaatggcttcttcaacgttatgatacctggctttggagtccaggacagctactcgtattccctcatcgttgaagagcttgcatcggcatcaccgtccctggcgtggctatatgtgacgcatgtggctgcggcctatgccctttcaaggatgggcagcgaagatcagaaatcgcagtacatagagaagatggccgatggaaggctgttggcaacgatagcaataaccgagcctgcatccggggcaacggcttctgcagtgcagacaaaggctgaattcgatgggaaggcctgggtcatcaacggatcgaagacattcataaccatggcttcggatgcagatgcgttcatcataatggcaagatccgattcagaaaaaccggcattcaccgatttcatcctaagatccgatgacagaggcgtatcaagatcggcgtccctgaaaggcagcggaatgccggggataggatggggagagatcttcctcgaaaacgtggaaaccggacaggatagggtactcgggaacagaaacgagggcataaagataataccgacgatagccaaggttttcaccataggtgcggcatcaatatcgctgggcatcatggatgtgctgaatgcaaatgccctggaacacataagggaaaggaagatcaacggctcgtcgctttcttcatttcaggtcgtccaggacaggtacctgcacatgtacacgaacggccaggcagcaagcgctctaatataccgtgcagccatcaacgatgacataaaactggcgtacgccgcaaaggtgtttgcaacagaaaaggcaatagagaatgctgtgaccgcatcaaggcttttcggcgcaaacgggtatgaaagatccgtcggcatagcctcttacatcgacgatgcgctggctgtgcccctgcacttcataaacaatgacgtactcacaggcctcttcatgaattcggtttaa

SEQ ID NO: 41968 - DNA, 2313 bp, Thermoplasma acidophilum
gtgaagatgatcaaggaagtagttaaaagggatggaacggtagtaccgtttgaaaagaacaagatcacgatggcgatctacaaggccatgctctctgtcaagaacggaaccatgaaggatgccgagcagcttgctgacaaggttgtggcaaggctgaaggacaaggagaggccttccgttgaggagatacaggatgtggttgaagacgtgctgatgacctcgaagatagacggaaagacattcacagacgtggccaagtcatacatactgtacagggaaaagaggcgcgccataagggaagagaaggaactcatgggcgtcaaggatgatcttaagctcacacttaacgcggtcaaggttctcgaggccagatacctgctcaaggatgaggatggaaagataattgaaacaccaaggcagatgttcaggcgcgttgcgtcgcacataggcatagtggaggccctgtacgattacatcaagtacaagaagacgggcaaagtgcctgaaaatgcggagatcataggaaaggtatcaccgacgcaggaggaggtcctcaggagggccttcggctacatgaaggaggacggcataatcgagggaaccttcgaggaattcatggacttcatacagaccaagggaacctcggccggccattacataaacaggttcgaggaggtcatgtcatcgctggactttgttccgaattcacccacgctgatgaatgccggaacaaagctggggcagctctctgcctgttttgtgctgccggttggagacagcatagaggatatattcgagaccctgaagaacaccgcacttatacacaagtccggcggtgggaccggtttctcattctcgaggctcaggccaaaggacgacatcgtgggatcgacgaagggggtggcatcagggccggtatcgttcatgaagatattcgatgttaccacagacgtgataaagcagggtggcaagaggcgcggagccaacatgggtatactcaactacaaccatcctgacataatggagttcatactgagcaaggactctgaaaacaaggtactgagcaatttcaacatctcggtcggtgtcacggacgatttcttcgacaagcttgacaacgacgattacgtcgatctcgtgaatccgaggacaaagaagataatgaagaggataaaggcaagagagatatgggacgccataatagaccaggcttggaagaccgctgatccaggcctgatattcctggacgaaataaacaggaagaaccctgtgaagaacgtcggggacatagaatccacgaacccgtgcggggaacagcctcttcttccgtatgaatcctgcaaccttggatccataaacctgtctaagtacgtggtggacggaaagaagatcgattttgacaggctcagggagactgtgtggactgctacacgcttccttgacgatgtcatagatgcaaacaagttcccggtagaacagataaagaaggtcacgaggatgaccaggaagataggactcggtgttatgggcttcgctgacatgctcataaagctcgagataccgtacaacagctgggaggccctggagattggggagaaggttatgagcttcatcaacgatgagagccacaaggcatcgcaggctctggccgaggaacgcggcgtattcccggcatggtacggatcggaatgggagaaggagggcataaagatgaggaactccacgaccaccaccatagcacccacgggaaccatatcgataatagctggctgctcatcgtccatagagcccatatttgcactggcatttgtcaggcacgttctgaacggccaggagcttcttgaggtcaacccgctgtttgaggaaaagacgcgcgagcttggaatatactccgaggagctcatgaggcaggttgcggagacaggaaacctggagaacgtgaagataaacgaggaggtcaagaagatattcgtcacggcccatgagatagatccgcagtggcatgtgctgatgcaggcgacgttccagaggtactgcgattcgggtgtatcgaagaccatcaacatgaggagcgacgcaacccgcgaggatattgccagggcttacaggatggccaaggatctgcactgcaagggcataacagtctacagggacaagagcaagaccgtccaggtgttgacggcagggacggccgagacaaagaagccggaagagaaggaggtaatcgagctggtcacgaagatgccagacaagtacctgaagatcgattcaacattcgatcccgcctgcccgacgggaaagtgcgataaatga

SEQ ID NO: 41969 - DNA, 1080 bp, Thermoplasma acidophilum
atgtccctgaaaggagttgtgatggccggaggcaagggaacgaggctgaggccaataacatattcgatcccgaaaccgctcgttccagtggctggaaagcccgtgatatcgtacatactggatgcgttttacagatcgggaataagcgatataataataacaaccggttataagttcgaatccctcataaagggtgttctggaaaataagaacagccaacagaatatacttttttctgtggaaaaggaggccgctggaacagccggaggggtaaagattgcggaaaactttcttgacgataccttcgtggtggggagtggggatatactcatagatttcgacataggagacatgataaaggagcaccagcgcaggaagaacaagataacgatcgcagtgacaaaggtggacgacccatcccagttcggaatagcggagatagatgaggaaggttacatcaagcgattcctggaaaagccaggaaagaacgagaccttctcggacaccataaatgcaggcgtttacatcatggatcgatcgcttctccggtacataccatccacggggcagttcgattttgcaaaggatctgtttccaaagctgctctcgcagggcataaagataggaacatacctcatagatggcgtgtggctggatgccggaaggccgaaggacgtcataaaggcaaaccagataatggttgagaaatatggcgaaagcttcaatggtaccggcaaggcaataataaaatcaaaggtgccgcagggctgctccataaagccgcccatatacataggcgagggtgtgcacgtaggaaacaacagcaccatatcaggatcggccgtttacgatggcgtttcgataggcgatgacgttcagatcgagaattctgtcataatggcatcgtcaaagataatgcggggaacgaaggttgtgaactcagtgataatgcagaacacaactataggcgaagactgcgagatacatgacagcgtactgtcgcagaaattaaacctacagaacggatcgaaggtattccaggttgccctgtcatctgagatagtacaggatgaaaactag

SEQ ID NO: 41970 - DNA, 888 bp, Thermoplasma acidophilum
atgacggatcttctccaggagtttgaggaaaagagagacattctgagaaaagcaatagaagagcacataaagaaaagggatgaagctgcacagcagagccgtaattatgctgaacagagggaccagctcaacgccaaggcccacgagatgagggaccaagtcaaacagaagatatcacagaagaacgccctcatcgaggaagttcagaagataaggacggaaaaggaagagcatttccaaaagctctcagagctcaggaaggaatacaagaagataactgaagaagccaactacgccagcgtcaatcagagggacatcaaggcaaaggagagagaactgcagaagctcataaagaaacaggagacaatgcagctacccaaggcagaggaggacaaggtagttcaggagataaagcgcctcagcaatgagatcaagaagatgaaggaggacagggagaagcagctgagcgagaacgagaaggtaaaggcgctcctggccgagatcgacaaggagaagacgcttgcaagggatctcaagaagagagcagaagagatatccaatcagatctctgagataagcaatgacataaataagtccctgcaggagcttgatgaggtcaggaagaaggccgatgaaatgcatgagatggcgatcaaatacggcaaggaatctgagcaggagcacgaagcattcatacaggcgaagaacgaccttaaggatctggaaaaggtcatagctggactcaggacaaagaagagagccacaaagaagaaggagaaggatgacgagcttcagcagaaggcagaggtactcttcgagaaattcaagaacggcgaagagctgacaaccgatgatctgctgatacttcagaaggctggcttcctgtga

SEQ ID NO: 41971 - DNA, 1083 bp, Thermoplasma acidophilum
atgccaacgatcgaagaacggattaaggaaattgaggacgagatcaagcgtacacagtacaacaaggcgacagagcatcacatcggtctgctgaaggccaagatagcgaaactgcagatggaggccagcgcaagccatggcggttcacacagtggatttgcagttccgaaatccggtgacgcaacggttgcgctcgttggttttccaaacgttggcaagagcagcctgctcaacaggttgactaactcagagagtgagattggagattatgcattcaccacgctccaacccataccgggcatactcgagtacaagggcgcagagatacagatactggatcttccaggcataatagagaacgcttcgtatggctccgcccgtggcagggagatactgagtgcggtgagggcagccgatctcatcgtgatagtcacggatgtacaggctggaggcatagacaagatactgacagagctttacaatgccgggatcgtcgtgaacagaaagcgcaggaatgtggagataaggaagacaacatcaggcggcataaggctgcacaggccaaagaacgtggacattgatgaagattatataaaggagataatgaaggagttcaagctggtcaacgcagacgtctacatccgcgagaatgtttccgtggaagatataatagagaccttacagggacgatacgtttacataccgtctatagtggccgtcaacaagatagacatgaatccttcattcgatacatcacaggtttcacagtacggcgaggtattcagggtatccgcgaagaccggatatggtatagaggaactgaaggaagggatattcagatcccttaacctcatacgcatatatctaaggaacaaagctggagtggtggatttccagaaaccgctcatcgtgagggagggtacgaccgtcagggaggtctgcaggaagatcaacaggagcatgattgattcattcaggtacgctatcgtgtcgggaaagaacaggccgatcggtgaacagcgggttggaatagattacccgcttatggacgaggatatcgttacgataataagcaggtactga

SEQ ID NO: 41972 - DNA, 1128 bp, Thermoplasma acidophilum
gtgaaggacgtcatagtgataggggcagggccatcaggatcgtttgccgcatacaggcttgcaaaggccggattcaccgttgatatcctggaagaacacagggaggttggcaaacccgtggaatgcaccggccttgtatcacagcgcgtccttaagtatgttcgcacaaagagcatcgcgggtacggtaaggggtgcaaacatattttttccaaatgggaagagtgttcacatagagaaggacgatcccaccatagtcctcttcagggatgcttttgataaggatgttgcggcgatggcaatcggtgccggatccggcatcagaataaatgcaagagccttgtccgttacggagcatgacgatcacgtaacagtcagatacagggaaaatggcagcattaaggaggaggatgccaggatagtgatcggcgccgatggtataaacagcgtcgtgaggcgcgatgtatacggtatgaggcagaagcatgtcgtttctactctgcagtacgatatggcatcagggatagaggatgaggattccgtgaacgtttaccttggatcgcagtacacgcatggcttctttggatgggcagtgcctggcggtgacattgtcagagttggcactggcagctataaagcgtccgcccgcccgtacatggataacctttcccgcaggttcggagacaacaggaccctcggcataacgggagccgggatacccataaggatggccgaacgcctcagctcgaggcggacagtcctcgttggagatgcagggggcatagttaaaccgctctctgggggaggcatatacacaggcatattctcttcggatgtggcagcgaattatgttgtggaggccctcgaaagcgatagcagtgaagcatccctgagaaagtatgatagagaaatacgaaacaccataggtaaggagctgaagaaggacgcaatgatccagcgtatatactcaaggataagcgacagatccttcaacaggatatacagcatgatatccaatgaaaagataatagatgtaataaacaggagcggcgatatagattatccttccactgtgataattaaagtacttctcagaaatccaggcatactgtattccatgtggaagtag

SEQ ID NO: 41973 - DNA, 993 bp, Thermoplasma acidophilum
atgagtggatgccagtggcaatatcagggtagcgttatgattgagatatggaccgagaaatacaggcctaagagcctttctgaaatatacggtgaagacgaaaacatccagaaactcaagtcgtttgtagagaaaaaggaaataccgcatctgctcttcgccggatcagtcggcactggaaaaacgtcaactgcaattgcacttgccatagagctcttcggcgactcatggaaggagaatatggtggagatgaatgcatccaatgaaaacggcatagacgtcataagaaataagatcaaggatatagccaggatcaaaccatccaatccactcggtttcaagatactctttctggatgaagccgatcagttaactgccgaggcacaggccgcacttagaaggacaatggagatatactctgaaacgacaaggttcatcttctcatgcaattattcctcgaagatcataccgcccatacagtccaggaccgttgttatgaggttccgccctgttcctgacgagtatataagcagaaagctgcaggagatcgcgaagaatgagggttttcagatcgatgaggagagcatgcatgcactggtcgaggtttcggccggagacatgagaaaggccataaacgtgcttcaggccgtatacacttcgggagagatctctccaaagaagatatacgagatcattggatatgccagcccggaaaagatccagaagatgatatccagggcgatcaacgggctgttcgatgaggcacgtgagatcgtcgacggcatgctgatatacgatggcctgtcaggaatagacatagtgagaagcctgcattcttatgtcagaagcagcatgatatccccgaagcagaagatcgagataataaaggcgcttgcagatgcagagttcaggatagtcgaaggatcaaacgacaggatacagcttgatgccctcatagcgaaacttgcagagataggcagcaggacagactaa

SEQ ID NO: 41974 - DNA, 726 bp, Thermoplasma acidophilum
gtgaatgggctcagagcggctgtgaagaacggggccgtgtcagttttcaaacaggacgattattttggaatagcacttcaggagacaaaggcagacagcaccagcgtacctgaggagatgtaccatcttggctattatctttacaacaatccagcgaaaaagaagggatacagcggtacgatgagcctagtgagggaaaaaccgatcgatgtctcatacggctttgaaaacgaggaaggacgcatactgaaccttgaattcgataaattctatttcataaacgtctattttccaaacgcacagcacggcctaacgaggcttgatatgaagctggacttcgatgagaagttcctggaatattcaaacgaattgaggaagaagaagcccctgataatatgcggcgacttcaatgtggctcatgaggagatcgatattgccaggccaaaggataacgaaaataacgcaggattcacaaaacaggaaagggactggatgaccaaattccttgacagcggctacgttgatacatacaggatattcatgaaggagggcgggcattactcctggtggtcgtacagattcaacgcaagggcaaagaacataggatggaggatagactatttcgtcgtaagtgatgatatcagggacagggtgaaaaaagcggagatccttgagacggttacaggatcggatcatgcgcctgtgacgctggaggttgacctttaa

SEQ ID NO: 41975 - DNA, 1587 bp, Thermoplasma acidophilum
atgatttttcatgtcatgggcttcaacttcgttagggacgtcattgagaagaatgacaggaggaagactgcgctgatcgtttcagatccggaactgaattccagaagcgaaacttacggcaccttacttaaaaaatcatacaaactcgcaaactttctgtacgaaatgaaggtcaggcctggaaacaggataatgataatgatggaaaattcactggagatctaccatgcggtgacggcatcgatagcgctgggcgcggtatacgcaccaacggcatcaatacttccggattcccagataaagtacaggatcgaccatcttaacccgaaggcgatcttttcggacagcggatcatacgataaattgaagggatatggatataccgtggtgaatcttgaagatccagacacggctaaggaaatagatgggtatcaggagaccttctccagattctacgacgatcctgacgcagaacacgtgatattcttcacctccggcacagagggcaatccaaagatggtcctccacaacaacacatacccactcggccacaggacaacggtgagatggctcgacctcagggcacaggatacgcactggaacataagcagtcctggatgggcaaagtggggctggtcctcttactattccccaatgatctccggttcaacggtattcaacatgcgatacagaaagttcgatcctgaagttgcactgaaggccatggagaagtttctgataaccagcatatgcgcaccgccaactgtgtggcgcatgtttctgctgcaggatctgtcatctatgaatctgcacctgagaaaagcagcctcagctggagaacccctcaaccctgagataatagatcgtataaggcagtatctgggcgtgaccgtcaaggatggatacgggcaatccgaatcaacgctgatggtgggcaaccttgagaaacagacagtcaagccgggatctatgggaaggccgctcgatccatacagggttgttatagtggatgatgcggggaacaggcttccgcccaacacaacaggccatattgcagttgacatcggcgaaaggccaaacgggctcttcgtctcatacatgaacgatccgtcgctgacacgcgatcgcttcagaaatggtctgtattacacaggtgatatgggctacatggatgaggatggctatctgtggtttgtttcaagatcagacgacgttataaagtcgtccgattacaggatagggccattcgaggttgagtctgctctcctcaggcatccagccgttgcagagtctgcggtagttggcactcccgacgagatcaggggagaccttgtcaaggctttcgtcgtgcttaaatcaggctacactccgtctcaggatcttgccagggaactgagcatccatgtcagaaacctggttggcccgcacgcaaggccaagaaagatagagtttgtgggcgaactgccgaagaccataagcggaaagataatacgcaaggaactcagaaaattagaacttgaaaaatataataaggcgaagagcgatcccagcagcaaagggctgggatacgagttctacgtggattga

SEQ ID NO: 41976 - DNA, 552 bp, Lactococcus lactis
atgctcgaaaaaaatcttgataaggccattgaaaaagtattagtttcagaagaagaaattatagaaaaatccaaagaacttggagaaatattaacaaaagaatacgaaggaaaaaatccattagtcttaggaattcttcgcggttcagttcctttcttagctgaattaatcaaacatattgattgtcacttagaaactgactttatgactgtatcaagttatcacggcggaacaaaatcctctggtgaagtaaaattaatcctagatgttgatacagcagtcaaaggtcgtgatattttaattgttgaagatattatcgatactggtcgtactttaaaatatctaaaagaacttttggaacatcgtggggcaaacgtaaaaattgtaacacttcttgacaaaccagaaggacgaattgttgaaattaaaccagattattcaggttttacaattcctaatgaatttgttgttggatttggtttggactacgaagaaaactatcgtaatcttccatatgtcggagttttaaaaccagaagtttataacaaataa

SEQ ID NO: 41977 - DNA, 2088 bp, Lactococcus lactis
atgaataacaacaaacaaccaaaacaaggaaattttgtaaaaaatatcttgatgtgggtaatcttggctattgttgttgttgtcggtttcaatttcttcttcagtagtaatcaatcaagcgtggataaaattagctattcacaattgatgacgaaacttgacggtaacaagattgaaaacgtcacaatgcaaccttctgatagcttaattactgtaacaggtgaatataaagaacctgtaaaagtaaaaggaacaaataatttcccacttttaggtaattctagtagtgaagttaaaaacttccaagcttatattattccaactgacagtgttgtcaaggatatccaaaatgcagctaaaagtaatgatgtaaaacttagtgttgttcaagcttcatcaagtggtatgtgggttcaaattctctcatacatcattccaatgcttctatttgttggtatcttctggctcatgatgggcggaatgggcgctcgtggcggaggcggcggtggaaatccgatgtccttcggtaaatctcgtgctaaacaacaagatggtaaaacatctaaagttcgttttgctgacgttgccggttctgaagaggaaaaacaagagcttgtagaagttgttgatttccttaaaaatccgaaaaaatatcatgatttaggagctcgtatcccagcaggtgttcttcttgaaggccctccaggtacaggtaaaacattgcttgctaaggctgttgccggtgaagcaggagttcctttctatagtatctcaggttctgatttcgttgaaatgtttgtcggtgtcggtgcctcacgtgtccgtgacttatttgaaaatgctaagaagactgcaccatcaattatctttattgatgaaattgatgctgttggtcgtcaacgtggcgcaggtcttggtggtggtaacgatgaacgtgaacaaacccttaaccaattgctcgttgaaatggatggtttccaagatgatggcaactcagtaatcgttattgctgcaactaaccgttcagatgtgcttgacccagcgcttttacgtccaggtcgttttgaccgtaaagtcttggtcggagctccagatgttaaaggtcgtgaagccgttcttaaagttcatgctaaaaacaaacctttagcaagtgatgttgatttgcacaatgttgctacacaaactccaggctatgtcggagctgatttggaaaatgttttgaatgaagctgcacttgttgctgcgcgccaaaataaaaaagaaatcaatgctgctgacattgatgaaggaatggaccgtgcaatggctggtccagctaagaaagatcgtattcaatcaatgcgcgaacgtgaaatcgtggcttaccacgaagcaggtcacgctattgttggactcgttcttgaaaatggatctactgttcgtaaagttaccgttgttccacgtggacgcatcggtggttacatgcttgctcttccagatgaagaaatcatgcaaccaactaatttccatcttcaagaccaacttgccagccttatgggtggacgacttggtgaagaaattgtctttggtgtagctactccaggggcatcaaatgatatcgaaaaagcaacacacattgctcgttcaatggtaactgaatatgggatgtctaagaaacttggtatggtatcttatgaaggagaccatcaagtatttattggtcgcgactatggtcaaactaagacttactcagaagcaactgctgttatgattgatgatgaagtgcgtcgtattctcggtgaagcttatgaccgtgctaaagaagcaattgaaacacaccgtgagcaacataaagcaattgcggaagctctgcttaaatatgaaacacttgatgcgaaacaaatcatgtcactcttcaaaacaggaaaaatgcctgatgaagcagcggcagcagaagtaccagaaccaaaaacatttgaagaatctctcaaagatgcaaatgcgaatgttgatgatttttcaaacattaatatctataatggtgatgaaaaaacagattctaaaccagaagaaaataaggaaaaatcagaagatgaaacagccgaataa

SEQ ID NO: 41978 - DNA, 1176 bp, Lactococcus lactis
atggatttattaaaaaaatttaaccctaatttagataaaattgaaatttcattgattcgtcagtttgaccaacaggtttcatctattcctgatgttattaagttgactttgggagaacctgatttttatacgcctgagcatgttaaacaagcagggattgtggcgattgaaaataatcaaagtcattatactggaatggctggtttactagaactacgtcaggcagctagtgaatttatgaataaaaaatatggtttatcttatgcagcagaagatgaaattttagttactgttggagtaacggaagccatttctagtgttttgttatcaattttggttgctggtgatgaagttttgattcccgcgcctgcatatcctggttatgagccattaattacgcttgctggcggttctttggttgaaattgatacaagagctaatgattttgttcttacgcctgagatgcttgaacaagcgattgtcgagcgtgagggaaaagttaaggccgttattttgaattatccagcaaatcctacaggggtaacttataatcgggggcaaattaaggctttagctgaagttttgaaaaagcatgaagtatttgtgattgctgatgaagtttattctgaactaaattatactgaccaaccgcatgtgtcaattgctgaatatgcacctgagcaaacaatcgttcttaatggtttatcaaaatcgcatgcgatgactggttggcggattggattaatctttgcagcgcgtgaattagtggcacagattattaagactcaccaatatttggtgacttcggcttcaactcagtcacagtttgcagcgattgaagctttgaaaaatggtgcttatgatgctcttccgatgaaaaaagaatatcttaaacgtcgtgattatattattgaaaagatgtcagaccttggtttcaaaattattgaaccagatggagctttctacatttttgcaaaaattccagctgatttagaacaagattcattcaaatttgctgtggattttgcaaaagaaaatgcagttgccattattcctggtatcgcttttggtcagtacggtgaaggatttgtccgcttatcttatgcggcttcaatggatatgattgagcaagcaatggcaagattgacggattatgtgactaaaaaacgtggctga

SEQ ID NO: 41979 - DNA, 1419 bp, Lactococcus lactis
atggttgttggtgcacaagcaacagaagttgatttggttgttattggttcaggccctggtggttatgttgcagccatccgtgcggctgaacttggtaaaaaagttacaattattgaaaaagataatgttggtggggtttgtttaaatattggttgtatcccatcaaaagcattgattaatattggtcatcattaccaagaatctttggaggaagaaaaaggagaaaatccttttggtctttctgtcggaaatgttaaattaaactgggaatctgcccaaaaatggaaacaagataaagttgtcaaccagttgacaggtggtgttaaaatgctacttaaaaaacacaaagttgacgtgattcaaggaactgcagaatttattgataacaatacaataaatgttgaacaagaagatgggttccaacttttgcaatttaatgatgtgattatctcaactggttcacgtcctatcgaaattccttctttcccatttggtggtcgcattattgactctactggtgctttgtcacttccagaagttcctaaacatttgattattgttgggggaggagttattggttctgagcttggtggagcataccgtatgctcggttctaagattacaattgttgaaggtttggaccacattttaaacgggtttgataaagaaatgtctgatatcattgctaatcgcgttaaatctgctggttctgaaatctttacttcagcaatggctaaatcagctactcaaactgataaagatgtaactttgacttttgaggttgacggaaaagaacaaacggtgactggtgattacttactcgtttctgttggacgtcgtccaaatactgatttaatcggcttgaacaacactgatgttaaattgactgaccgtggtttgattgaagttgacgattcttatgcaactaatgttcctcacatttatgcaatcggtgatgtggttcctggtccaatgctcgctcacaaagcttctttccaagctaaagttgctgctgctgcgattgctggagctgaggacgacgtggacttacacgttgctttgcctgctgtagcttatacaacaactgaattagcaacagttggagaaacgcctgaatcagttaaagaccgtaaagatgttaaaatttctaagttcccatttgctgcaaatggccgtgccatttcaatgaatgatacgactggtttcttacgtttgattactgaaactaaagaaggggccttaatcggtgctcaaatcgttggccctggtgcatctgacttgatttctggtttatcactagcgattgaaaatggattgacttctaaagacatttcattgactatccaacctcacccaacacttggtgaagcgattatggatacagctgaattggctgatggcttaccaattcacgtttaa

SEQ ID NO: 41980 - DNA, 1599 bp, Lactococcus lactis
atgactgagatttttaaaatgcctgatattggcgaaggaatgcacgaaggagacattgccaactggttagttaaagttggagatgttgttaaagaagatgacccaattgctgaagtacaaaatgataaacttatgcaagaaattctctctccttattctggtaccgtaacaaaacttttcgttgaagctggaacaaccgtagaagttgattctcctttggttgagtttgatggtgacggttcaggctcttctgcagctgctcctactcctcaagaaacagctggttctgatactgctacaactgatgcaccttctggagaagctcaaatcttcacgatgcctgatattggtgaaggaatgcatgaaggagatatcgccaactggttagttaaagttggagatgaaattaaagaagatgatcctgttgcagaggttcaaaatgataaactcatgcaagaaattctttctccatattctggaaaagtcactaaacttttcgttgaagctggaacgactgtagaagttggggctcctttaattgaatacaatggaaatggggctgctccagcagctgctagtcctgctccagtcgcagaagcacctaaagcagctagtcctgcaagtcctgcaaatgctccattgactaaaacaacttctactggtcacattcttgcgatgccttctgttcgtcattatgcacgcaaggctggtattgatttaagtcaagttcctgcaactggtcgtcacggtcacacaacgttggccgatgttaaagcttttgaatctggcagtgtcgctcctatcgctcaaacaacaccagaagccgctccagcacctaaggctgataaaccagctgctcctgttgctgaaaaagcgccaagcgttaaagcaggagctggtgatcgacgtgaagcaatgaatccaactcgtaaagttgtttctaaagttatgactgctcaacatacacacattccaccagtaacaaactttgaccaagttgaagtttctaaactcgtgaaacatcgtgctgtctttaaagaaattgctgcaaaacaagatattaaattaacctatcttgcttatgttgctaaagctttggctactactgctcataaattcccagatatcaatgcttctgttgactatgaaaaacaagaaattgtttatcacgaacatgtcaaccttggaatcgctgtaaatgctccaactggtttgtacgttccagtgattcatgaagctgaaactaaatcaattcttgagattgctaaagaaatcgctgaattagctactgctacacgagaaggaacacttaaacctcaacaaatgcaaggttcaacaattacaatttcaaatattggatctgctcgtggttcttggtttacaccaatcattaatggttctgatgtcgtaattttaggactcggttcaatcgttaaagaaccaattgttaatggtgaaggcgaaattgttgtcggacaaaacatgaaattgtctatgacttatgatcaccgtttgattgatggaatgttgggtcaaacatcacttaactacttgaaatctctattggctgaccctgagttcatgcttatggaaatctaa

SEQ ID NO: 41981 - DNA, 981 bp, Lactococcus lactis
atggcagtaaaaacttatattgcagcaattacagaagcgcttgatttggcgctcgaaaaagataaagatgcactcatttttggtgaagacgttggacaaaatggtggggttttccgtgctactgatggtctgcaagcaaaatatggagaagaacgtgttttcaatactccacttgctgaatcaggaattggtggaatggcaattggtcttgcaacacaaggtttccacccaattatggaaatccaattcggaacctttatctttgaagttttcgactcaattgctggacaaatgagccggacacgttaccgttttaataacacacgttcaaataatattgtcgtgcgtacaccttatggaatcggaactaaaacgcctgaaatgcacgcggattcaattgaagggctattttcacaaatccccggaattcgtgttgtaatgccttcaaatccagctgatgctaaaggattattgctggcttcaattgaaaataacgaccctgttattttccttgaaaaccttcacctttatcgctcacttaaaggtgaagttcctgaaggttactatactacaccacttgatactgctgcagtcgctaaagaaggatctgatgtttcaatcattgcttatggtggaacagttccacttgctcttaaagctgctgaacaactcgaaaaagatggaattaaagctgaagtccttgacctcagaacagttgctcctcttgatattgagtcaattggtaaaacagttgaaaaaactgggcgtgtggtcgttgttcaagaagctcaacgtacagccggtatcgcagcgaatgtcatggccgaaatttcagaacgttttgttttgaaccttaaagcgccaattggacgtgttagtggtcctgactcaattttcccatttgcacaagcagaaaatgactgggcagttaaagctgaagatattgtgaataaagttaaagaggtggttgactatgactga

SEQ ID NO: 41982 - DNA, 1125 bp, Lactococcus lactis
atgtcaaattcagaacaaatcttagatttcaaagcgcagctagaactgcaagacactacatttccaatgcttcaaattcttaacgaagaaggaaaaattgttgacgaagatggtcttaaacgtgcaggactttctgatgaaaaactcgttgaactctttaaaagtatgctttttgcacgtcaagttgacattcgttcaatgaaattagctaaacaaggacgtatgggattctttggacctcacgctggtcaagaagcttctcaaatggcctcatcattcgctttcactgacgaagactggctcttcccaggttatcgtgacttgccacaaatttacgcaaaaggttggccaatttggaaaggtcttctttggtctcgtggacatcaacttggtaatgagtatactaccgatgatggtaaacctgtaaactcatggttcccacaaattatcattggtgctcaatacgttgaagctgctggtgtcgcgctcggactcaaaaaacgtaaaaaagatgctgtagctttcgtttacactggtgatggtggttcttcacaaggtgatacttatgaaggaattaactttgctggagcttataaagccccacttgttgcctttatccaaaataacggctatgcaatttcgacgcctcgtagtctccaaagtgccgctcctcatttagctgctaaaggttgggccgcaggtgctccttctatcgtagttgatggaatggacgcgattgctatgtatcttgcttctaaagaagctcgtgcttgggcagtagctggaaatggtccagttgttattgaagcaattacaaaccgtttagaaccacactcaacagctggtgatgacccacttcgctatcgtactaaagaagacattgaagcttggtggaaaaaagaacctctcgttcgtatgcgtaatttcctgactgaaaaaggactttgggatacagagaaagaggaagcttatattgctgaacttgatgcaggtattgatgccgacattaagaaagccaacaatgttgaaaaacaaaaaatttctagcttcattaaaaatacacttgaagtgccaagccaagcaatggcagaacaaattgcaaaatttgaaagcgagggcaaataa

SEQ ID NO: 41983 - DNA, 1281 bp, Lactococcus lactis
atgactaatcacaattataaattcgacactttgcaagtccatgcaggacaagtccctgatcctgtcacgggttcacgcgccgttccgctctatcaaacaacttctttcgtttttaacaattcagaccatgccgaagctcgttttgctttacaagatcctggagctatttattcacgtttaggaaatccaaccaacgatgtttttgaagcacgcatcgcagctcttgaaggtggaagtgcagcccttggtgttggttctggctcagccgctattacctatgccatcttgaatatcgctacagtcggtgataatattgtttccgcaagtaccctttatggtggaacctatcaccttttttctgggactttaccaaaatatggaattacaactaaatttgtcaatccagatgacccgaagaattttgaagaggcgattgatgaaaaaaccaaagctatttattatgaaactttgggcaatccgggaaataatgtgattgattatgatgccattggtcaaattgctaaaaaacatggaattcccgttattgttgatgcaacgtttactacccctgtgacctttaaaccatttgaacatggtgctaatgtaattgttcattcagcaacgaaattcattggcggtcatggtacttctattggtggagtcatcgttgatggcggaaactttgattgggcaaatggtaattttcctgattttacacaagctgatgaaagctacaatgggattaaatttgccgaattgggtgaaattgcttttgtgactcgggttagagctattttattacgtgatacgggtgcggctttatcaccttttcattcttggcttttcttacaggggctagaaacactctcactccgggtagaacgtcacatctccaatactaaaaagattgtagaatttttagacaatcatcctaaggtggaacttgttaaccatcctctgcttgaaagtaattcctatcatgcgctctatcagaaatattatccaaaagatgctggatctatctttacctttgaactcaaagacaaagatgagaaaaaagcgcgtgatttgattgatcatcttgaaattttctcacttctagccaacgttggagataccaaatcattggccattcatcctgcttcgaccactcaccagcagctgaatgccgaagaacttgctagtgcagggatttccaaaggaaccattcgattatcggttggtattgaagatgtaactgacttgattgctgatttagagcaagcattagaaaaaatataa

SEQ ID NO: 41984 - DNA, 2148 bp, Lactococcus lactis
atgaaatttaaaaagaaaaattatacctcccaagtagatgaaatggattgtggatgtgctgctttatcaatgattttaaaatcctatgggacagaaaaatcgcttgcctctcttcgtttacttgctggtacaacaatcgagggaacttccgctttaggaataaaaaaagcaggagaaggtttaggttttgtagttcaagtactaagagctgatgcaagcctttttgaaatgaagaaagtcccttacccttttattgctcatgtcatcaagaaccaaaagtatccacactactatgtgataactggcgcaaataaaaattcggtattcatcgcagatcctgacccaaccgttaaaatgacaaaactttcaaaagaagttttcttatcagagtggacaggcattagcttatttctttcacctaccccatcctatcagcccactaaagaaaaaacttcttcattattatcttttatcccaattatcacccgtcaaaagaaagtcattctcaatattgtaattgcctcattcattgtaacgttgattaatattctagggtcttactacctccagagcatgattgatagttacattccaaatgccttaatgggaactttagggattatctcagtagggctattgttaacttatattatccaacaagtcttagagtttgctaaggctttcttactaaacgttctttctcaaagattagccattgatgtcatcctttcctatattagacacattttccaactcccgatgtctttcttttcgactagaagaacaggggaaattaccagtcggttttccgatgccagttctattttggatgctattgcctcaacgattctttcgctctttttagatttaaccattgttcttatgacaggactgattttagggcttcaaaatatgcaactctttcttctcgttcttttggcaatcccactttatattgttgttattattatttttactccgctttttgaaagacaaaatcatgaagttatgcaaaccaatgccatcttaaattcctcaattattgaagacattaatgggattgaaaccatcaaagcgctcgccagtgaacaagagagatatcaaaaaattgactacgaatttgcaagttatctaaaagaggctttcactttacaacagtcagaagccattcagacggcaataaaaacgacagtacaacttgtactaaatgttcttattttatggtttggtgcaactttagtcatgcatcaaaaaattaccctcggacaactcattacttttaatgccttgctttcttactttacaaatccaattactaatatcattaaccttcaaacaaaactacaaaaggcaagggtagccaatgaacgattaaatgaggtctatcttgtacccagtgaatttgaagaaaagaaaacagaactgtccctctcacattttaatttaaacatgtctgagatttcatatcaatatggttttggcagaaaagtcttatctgagataaaactgtctattaaagaaaatgaaaagttgaccattgttggtataagcggttcagggaagagtactcttgttaaattattggtcaacttctttcaacccacttctggtaccattactttaggtggaattgaccttcaacagtttgataaacatcaacttcgacgattaatcaactatcttccccaacaaccttatattttcacaggttcaattatggataatttacttttaggcgctagtgaagctacttcacaagaagagattattagagcggtggaattggcagaaatccgtgcagatattgaacaaatgcaattaggttatcaaactgaactctcaagtgatgcaagtagtttatcgggaggacaaaaacagagaattgcgctcgctcgtgccctcctttctcctgccaaaatactcatcttagacgaagccaccagtaatcttgatatgattactgaaaagaaaatattaaagaatttgttggcactagataagacaattattttcattgctcaccgcctctctgtagcggaaatgagccatcgtatcattgtcattgaacaaggaaaagtgatagaaagtggttcacattcagaactgcttgctcaaaatggcttttacgcacaactttaccataactaa

SEQ ID NO: 41985 - DNA, 1410 bp, Lactococcus lactis
atgggatttatgagaaaagctgattttgagctttatcgagatgcagataaacactataatcaggtgttaaccacacgtgattttcttgcactaggtgttggaacaattatttcgacttctatttttactttaccaggtcaggtcgctgctcaatttgcaggcccaggtgttgtcttttcttacctgcttgctgcattggtcgctggttttgttgccttggcttatgctgaaatgtcaacagtgatgccatttgcgggttcagcctattcttggatttcagtcttatttggcgaaggttttggttggattgctggttgggctttgcttgcggaatattttattgccgttgcctttgttggttcaggcttctcagcaaatctgcaacaattgctagcgccactcggtttccatctaccaaaagtattggccaatccatttggtacagacggtggagttgtcgatattatttcacttttagtcattttactctcggcaattattgtctttcgtggggcatctgatgctggacgaatcagtcaaattcttgttgtgcttaaagtagcggctgtcattgctttcatcattgttgggattacggtcattaagccagcaaattaccatccatttattccaccacacaatcccaaaacaggttttggtggcttctcgggaatctggtctggggtatcaatgattttcttggcctatatcggttttgattcaattgcagccaattcagcggaagctaaaaaaccccaaaaaacaatgccacgtggaattattgggtcgcttctaattgctgttgttctatttgcagcagtaaccttggtacttgtagggatgcatccttactcagcctatgcaggaaatgcagcgccagttggttgggctcttcaacaatcaggttattctgttttatcagaagttgtaacagctattgcacttgccggaatgtttatcgcccttttgggaatggttcttgcaggttcacgtttgctttatgcttttggacgcgatggacttttacctaaaggtttgggtaaaatgaatgctcgaaatcttccagcaaatggtgtgtggaccttagccattgttgctattgtcatcggggcattcttcccctttgctttccttgctcaacttatttcagcaggaactttgattgctttcatgtttgttacacttggaatctattcacttcgtcgtcgtcaaggaaaagatttgccagaagcaacttacaaaatgcctttctatccagttttaccagctcttggttttattggttcattatttgtattttggggattggatgtgcaagcaaaactttattcaggaatttggttccttattggaattttgatttattttgcttatggaaatcgtcgaagcagaaaatcagaagaaaaataa

SEQ ID NO: 41986 - DNA, 1038 bp, Lactococcus lactis
atgagttttaaagaaataagtcctaagataaatattgatgcaattaagatgttgggacatctcaacagtgagcaacaagaaaaaaaattgcaacgagataaagaacttgaagcaattataaaaggtgaagatgaccgtttactcttgattattgggccatgttcgtcagacaatgaagaagcagttttagaatatgctcgccgtttagctaaacttcaagaagcagttaaagataaaatttttatggtcatgcgtgtctatactgcaaaacctcgtacaaatggcgatggctataaaggattgattcacgaaccagatgctgatggtcataccgatttaatcaatggaatcaaaatggttcgtgacttacattacaaggtcatcactgaaactggtttaacaactgctgatgaaatgctttacccagaaaatcttccaatggtagatgatttggtcagctaccatgcgattggtgcacgttctgttgaaaatcaacaacaccgttttgttgcttctgggattgatgtgccaactggtttgaaaaatccaacatcaggaaatttgaaagtgatgtttaatggaatttacgcggctcaacaatcacaagatttcctctttggtcgtgcagaagttcaaacatcaggaaatcctttagcacatgcgattttgcgtggtggacaagatgaaaatggaaaataccatccaaactactacactgataacttgcttgatacaattgaaatttatgaaaaaatgggcttgaaaaatccttttattgtcattgatacaaaccatgataactctggtaagaaatttatggaacaaatccgtattgttcgtcaaaccttagttaatcgtgactgggatgataaaattcgccaaaatgttcgtggcttcatgattgaatcttacctagaagatggtcgccaagataaaccagaagtatttggtaaatcaattactgacccatgtttaggttgggataaaacagaagcacttgttcaagaaatttacgaagctgaaaacaaaaataactaa

SEQ ID NO: 41987 - DNA, 1728 bp, Lactococcus lactis
atgacaactatgcttaaaggtatcgccgcatcatcaggtgtagcagtagctaaggcatacttgcttgtccaaccagatttgtctttcgaaacaaagacaattgctgatacagctaatgaagaagctcgccttgatgcagcacttgctacatctcaaagcgagcttcaacttattaaggacaaagcagtaacaacccttggtgaagaagcagcatctgtatttgacgctcatatgatggtcctcgctgacccagatatgactgctcaaattaaagcagtaatcaacgacaaaaaagttaacgctgaatcagccctcaaagaagtaactgatatgtttatcggtatctttgaaggaatgactgataatgcttatatgcaagaacgtgcagctgacattaaagacgttacaaaacgtgttttggctcaccttcttggtgttaaattgccaagtccagcgcttatcgatgaagaagtaatcatcgtagcagaagacttgacaccatctgatacagctcaattggacaagaaattcgttaaagcctttgttactaacattggtggacgtacttctcactctgcaattatggctcgtactttggaaattcctgctgttcttggaacaaataatattactgaacttgtttctgaaggtcaacttttggctgtttcaggattgactggtgaagtaattcttgatccatctactgaacaacaaagcgaattccacaaagctggtgaagcttatgctgctcaaaaagcagaatgggctgctcttaaagacgctgaaactgttacagctgatggacgtcattatgagcttgctgctaatatcggaacacctaaagacgttgaaggtgttaacgataacggtgctgaagcaattggtctttatcgtacagaattcttgtacatggatgcacaagatttccctacagaagatgaccaatacgaagcatataaagctgtacttgaaggaatgaacggtaaaccagttgttgtccgtacaatggacatcggtggtgacaaaacattgccttactttgaccttcctaaagaaatgaacccattcctcggatggcgtgcacttcgtatcagcctttcaacagctggtgacggaatgttccgtacacaattgcgtgcactcttgcgtgcttctgtacacggacaacttcgtatcatgttcccaatggttgctctcgtaactgagttccgtgcagctaagaagatttatgacgaagaaaaagcaaaattgattgctgaaggtgttccagttgcagatggtatcgaagtaggtatcatgattgaaattccagcagcagcaatgcttgcagaccaatttgctaaggaagttgatttcttctcaattggtacaaacgatctcatccaatatacaatggctgcggaccgtatgaatgaacaagtttcttacctttaccaaccttacaatccatcaatccttcgtttgattaacaatgtaatcaaagcagctcacgctgaaggtaaatgggctggtatgtgtggtgaaatggccggcgaccaaactgctgtaccattgcttatgggtatggggcttgacgaattctctatgtcagcaacatcagtactccaaactcgttcacttatgaaacgtttggattctaagaaaatggaagaattgtctagcaaagctttgagcgaatgtgcaacaatggaagaagttattgccctcgttgaagaatacactaaataa

SEQ ID NO: 41988 - DNA, 1197 bp, Lactococcus lactis
atgatgggaaacaaaaaaattgtcttggcatattcgggtggattggatacaagtgttgctgtaaaatggttgactgataaaggatttgacgtcattgctgactgcatggacgttggtgaaggaaaagacttgaattttattcatgataaggcgcttcaagtaggggcagtggaatctgttgttttggattgcaaggaagaattcgctaaaatatttgttggagctgcactcaaaggaaatttaatgtatgaaaataaatatcctttagtatccgctttgagtcgccctttgattgctcaaaaattagtagaagtagccaaagaaaaaggggcaacggctattgctcatggttgtacaggaaaaggaaatgaccaagtgcgttttgaagtagccatccattcccttgcgcctgagcttgaagtcattgctccagttcgtgaatggcattgggctcgtgaagaagaaatcgaatatgccaatcaaaatggtgttcctattcctgctgatttagacaatccctactcaattgacatgaatttatggggacgtgcgattgaagctggtgttcttgaaaatccttggaatacttgtccagaggatgctttctttatgactaattctgtagagaacgctccaaacgaagctgaatttatcgaggttgagtttaaagaaggattaccaatcgccttaaatggaaaaagcttagaattgcatgaaatcattaaaaaagtgaatattattgcaggaaaacatggaattggtcggattgaccatattgaaaatcgcctggttgggattaaatcccgtgaattttatgaatgtcctgctgccattactttattaaaagcacataaagatttggaagatttaactttcgttcgagaacttgcacattttaaaccagttcttgaaaatgaattagcaaacttgatttacaatggtttgtggttcaatcctgctactaaggctttgatcgcttatcttgatgaaactcaaaaagtagttaacgggattgtaaaaattaaattatataaaggtttagcaacaccagtgggacgtaaatcaactaattcgctttacagcgaaaaattagcaacatatactgctgcagatgagtttgaccaagcagcggcagttggatttattaaattgtggggtctacctactcaagtcaatgctcaagtaaatctcaaataa

SEQ ID NO: 41989 - DNA, 1380 bp, Lactococcus lactis
atggtagaaaaactttggggaggacgttttgaggcgtcactagataaacaaacggaagaatttggagcatcaattaaatttgagcaacgacttgctccttttgatttaaaaggctcattagctcatgtaaagatgttgggtgaaacaggaattattactaccgaggaatccaaaaaaattgccgaaggtctgaaaaaagtagaagaaaagcttcttaatggccaaattgaattcaagatggaaaatgaagatatccatatgaatatggaatcttatcttcatcaagaaattggtccactagctggtaaattgcatacggctcgctctagaaatgatcaagtggtaacagatatgcatctatacctcaaaagtatcttagaagccgttttagaagctttaaaagtgttaagagaaacaattgtaaagctcgctgtaaaccaaattgacactattatgcctggttatactcatttgcaacatgcacaaccaatttcctttggtcaacatctaatggcttactatcaaatgctgacacgtgattttgaacgttttgaatttaatgttaagcatacagatatgaatcctttaggagcggcagctctagctgggacgacgtttccgattgatagaatgttgacgacgaaactacttggttttgagaaggcttatgataattcaatggatgcggtcagtgaccgtgactttattttagaatttctctcaaatgcaagtttgttaatgatgcacttatcaagattttgtgaggagcttttactatggtctagtcatgaattcaaatttgtcagtctgtctgatacatattctacgggttcttctattatgccacagaagaagaatccagatatggcagaattaatcagaggaaaaacaggccgcgtttatggaaatcttacagctttattgactgtgatgaaaggtttacctttagcttataacaaagattttcaagaagataaagaaggaatgtttgatagtgctgatactataataacttctttaacagttatgaatgggatgttgtcaactttaactgtaaaccgtgtaaacatggaaaaatcaactgaacaagatttttctaatgcaacagagttggctgattaccttgcaacaaagggtcttccttttagaaaagctcatgaattagtgggtctcttagtgttagattgtataaaaaaaggaatttacctccaagatgtaaatttacaagattatcaaatgctatctccattaatcaatgaagatgtttatgaagttttaaaatcaagaacggcagtttcaagaagaaattctctaggtggtacaggatttgaatcggttaaaaaacaaatagaagaagctaaaaaagaacttcaaatttga

SEQ ID NO: 41990 - DNA, 786 bp, Lactococcus lactis
atgaaaacacttatcactggcgaaaataaaggaattggttttgcacttgctcaaaaccttggtcatcgcggctatgaagtcttggtcggagcccgtaatgaaacgcgtggacaagaagccgttgaaaagctgaaagccgaaggaattactgccaaatttgtcaaagtagatttagatgacttaaatcaattgacgagtctgtcagcactaacagatattgatttacttattaataatgctggaatttctgggaatattcattcagataaagggcaccttgatatggaaaaatcagcttttgattattcaacaactgatttagaagaaacaattaaaaccaattttttgggaacacatgctgtgatcaaagaacttcttccacattcactgacagaaaatgctaaaattattaacatcaccgtacccgtttctcaagaatattggatgccacttgcttatgtcacttcaaaagctgcacaaaatgccatgacctttgcttttggtcatcaattcaaaaaagataaatctaaaaaacaaatctttgctgttatgcctggtgcagttgcaacagatttgaacggtgcaaaagttggggatagtccgtttgtaaaatctcctgaagaaacagctcaaatgattagtaaatttatttttgatgacaaaaatcataatgctcaaattattaattttgacggaacaatttatgataactatgaaccaggcttacgtaacaaagtcattaaagatgtcgctaaaaatggtttaaagcgtaaatttaaaaaataa

SEQ ID NO: 41991 - DNA, 1215 bp, Lactococcus lactis
atgagaaaatttgaaaaatcgcataaacttgataatgtcagctatgatattcgtggtccagtattggatgaagcacaaagaatgcgagccaatggtgaaaaaattcttcgattgaatacaggaaatccagctgaatttggctttcttgctcctgatgaagtcattagtgacttgattcaacatgctgtggatagcgaaggatattcagattctaaagggattttctcggctcgtaaagcgattatgcaatactgtcagctcaagggttttcctaatcttgatatcaatgatattttcacaggtaatggggtttctgaattgattgttatggccatgcagggacttttggacacaggggatgaggttttgattcctatgcctgattatccactttggacggcttctgtcagcttagctggaggaacagctgttcattacctctgtgatgaacaggctggttggttccctgacattgatgatattcgctcaaaaatcacaagtaatacaaaagccattgttttgattaatcctaataatccaacgggtgcgctgtattctaaagatttattgcttgaaattgttcaagtggctagagaaaataatttaattattttctctgacgaaatttatgaccgattggttatggatggagcagttcatgttccgattgctagcttggcaccagatctttttgtggtcacaatgaatggcctctcaaaatcacaccgcattgcgggattccgtgtggggtggatggttttgtcaggtgaaaaatcacatgtcaagggttatattgaaggtttgaatatgctggcttcaatgcgactttgttccaatgttttagctcaatcagtcgtacaaacttcacttggtggcactcaatcggttgataaattgctgttgccgggtggacgagtttatgaacaaagagaattcatttataaagccatcaatgatattccaggattatctgcggtcaaacctcaagcagctttctatattttccctaaaattgacagagaaatgtataaaattgataatgatgaacaatttgtcttggactttttgaagcaggaaaaaatcctgcttgttcatggtcgaggatttaattggaaagagccagaccatttccgaattgtttatctgcctcgtgtggacgaattagcggaaatacaagaaaaaatggaacgtttcctttggcaatatcgtaaataa

SEQ ID NO: 41992 - DNA, 1437 bp, Lactococcus lactis
atggagcacaaaaaattaaaagcatttccaaatgattttctatggggttcggcttcggcagcctatcaagttgagggagcaccttttgaagatggcaaaaaagccagtgtctgggataattttgtccgtattccaggcaagacttttaaaggaacgaatggggatgtcgctgttgatcattatcatcgctataaagaagatgtggctttaatgaaagagttgggccttaaatcctaccgtttttcaattgcttggacgcggattttacctgacggacgtggcgaagtcaatcaagcaggcttgaaattctatgaagatttgattgatgagttgattgctaatgagattgaaccaattgtcacgatttatcattgggatttgccccaagccttagaagatttatatggtggttgggaatcacgagaaattatcgcagattttgttaactatgctgaagttttgtttaatgcttttaaaggtaaagtaaaatattgggtatcgcttaatgaacaaaatatttttacaagtcaaggttggtcactcgcgactcacccacctggaaaaagagatatgaaacttttttatcaggtcaatcatattgctaatctgacaaatgctgcggtaatcaataaatttcatgaacttgaaatggatggacaaattggcccttcgtttgcctatacgccacaatatgctaaggattctgacccactcaatgttttagcggctgaaaatgcagaagagctttatagtcacttttggatggatgtttatctttacggagaatacccaattgcggcaatggcttatttacgtgaaaatgggctagcacctgaatttgaagctggggatgctgaacttttgaaatcagctaaacctgattttctaggtattaattattaccagacagctactaacgcatggaatccagttgacggaggagttggagtcggttcctttaatacaagtggcaaaaaaggaacaaccaaagaatcaggaattccaggcctccataaaaaaattcaaaatccttttattgaccgaacaaattgggattgggaaattgaccctgaaggcttgagaattgcacttcgtcgtatcacttctcgttatcgtattccagtgatgattacagaaaatggcttgggcgaatatgataaagttgaagacggaaaaattcatgatgattatcgaatcaaatatctagaaagtcatgttaaagcaatcaaagaagcgatgacggatggagcaaaagtcattggttatcacacttggtcttatactgacctcctttcttggttaaatggctaccaaaaacgttatggctttgtctatgttgaccaagatgaaacaatggaaggttcattgaaacggataccgaaggattcttattactggtatcaacatctcatcgaaacaaatgctgaagaagtctaa

SEQ ID NO: 41993 - DNA, 981 bp, Lactococcus lactis
ttgctcacattttggcaggattatcccgaaattcagaataaattaaaggatgttcaagcgctcatgattgagcgtttaaaaattaataatcaagagatagaagcagcactagagaaatttgcatcacgtggcgggaaaatggttcgtcctgcgctttttttgctgttcgctgggattgtccctaatggctctaaagatgaagagaagatcattaaaatcgccgcatcattagagatgcttcattcagcaacattgattcacgatgatattatcgacgactctcctttaagacgtggtttaccgtcaatagagtcacaatttggcaaagatgtagctgtttatgctggagattttgtttatactgtttattttgaattattgattgaaaccatgaatgggacaagttttgtcgctaaaaatgctcaatcaatgaaaaaaattcttcagggtgaattgactcaaatgcaatctgcttttgacaaaaataatacagcgagacgctatatgaaagcaattagtggaaaaacagctgaattactgagtcttagctgtttagaaggtgtttattttgctggtggggataaaaaattacaacattctgcccgtaaaattggtcgagcaattggtcttgcttttcaagtttatgatgacattttaaattttacagtaggacttgatgaagctgataaacctattttgacagatttccgtcaagggatttatacattacctttactcttggctcgtgaagtaaatgatgaagcgattgctccttatttagaagcgccagaaaatttgtcaagacaagaatgtttagatttagcagaattagtgacagaatcaggtgggatagcaggagcgctccttgttgctggaagattaacagaactggctttgaatgaaattcggaaattaccagagtcgacaaatcggcagattttagaagaagcaacacaaattttattggaaagaaattattga

SEQ ID NO: 41994 - DNA, 870 bp, Lactococcus lactis
atgaaagggattattttagcaggagggtctggaacacgactttacccactgacacgtgctgcgtcaaaacaattgatgcctatttacgataaaccaatgatttattacccattgtcaactttgatgttggctgggattaaagacattttaattatctcgacaccaacagatactccacgttttaaagagttacttcaagatggttctgagtttgggattaatctgcaatatgcggtacaaccatcaccagatggattggctcaagcctttattattggtgaagaatttattggcgatgattcagttgcgcttattttgggtgataatatttatcacggacctggaatgtctaaaatgctccaaaatgcagctgcaaaagaaaaaggagccactgtttttggttatcatgttcctgatccagaacgttttggtgtcgttgaatttgatgaaaacatgaatgctgtttctattgaagaaaaaccagaagaacctaaatcaaattatgcagtaactggtttatacttctacgataatgatgttattgaaattgccaaaaacattgaaccttcacctcgtggagagcttgaaattactgacgtaaataaagcttatcttgaacgtggtgatttgtcagttgaattaatgggccgtggctttgcttggttagatactggaacacatgaatctctccttgaagctgcacaatatattgaaacagttcaacggatgcaaaatatgcaagtggcaaacttggaagaaattgcttatcgtatgggttatattacagctgacgatgttcttaaattggcccaaccacttaagaaaaatgagtatggtcagtacttgcttcgtttgattggaaaagactaa

SEQ ID NO: 41995 - DNA, 1050 bp, Lactococcus lactis
atgactgaatttaaaaatatcgttgtgacaggtggagcaggatttatcggctcaaactttgtacactatgtttataacaatcatccagacgtgcatatcacagttttggataaattaacttatgcaggaaatgttaataacattaacatgttatttgacagtggacgtgtcgaacttgttgttggcgacattgcagaccctgaaattgttgatcaagtggcttctaaagcagacgcaattgttcactatgcagctgaaagccataatgataattctttgaaatctcaagatgaatttatccaaacaaactttatcggaacttatactttgattcaagcagctcgtaaatatgatttacgcttccaccatgtttctactgatgaagtttatggtgatttgccttatcgcgaagatttgccaggtcatggcgaaggtgaaggtgaaaaatttactgacaaaacaccttacaatccttcaagcccttactcttcaactaaagcggcttctgatttgattgttcgtgcttgggtccgttcatttggacttaaagcaacaatttcaaactgttcaaataactacggacctttccaacacatcgaaaaatttattcctcgtcaaattactaatattctttcaggaatcaaaccaaaactttacggtgatggtaaaaacgttcgtgactggattcatacagaagaccattcatcaggtgtttggacaattttgactaaaggtcgaatgggcgaaacttatcttatcggtgcagacggtgaaaaaaataacaaagaagttcttgaagatattttgactcgtatgggcaaagataaagacgattatgaccgtgtaactgaccgtgctggccatgaccttcgttacgcgattgataatagtaaattacgtacagaacttggttgggctccaaaacatactgactttgaatctggtttgcaagcgacaatcgactggtatcgtgaaaacgaaaactggtggaaagctgaaaaagaagctgttgaagcaaaatatgctgaaacacaaaaagttttggattaa

SEQ ID NO: 41996 - DNA, 1197 bp, Lactococcus lactis
atgaatgacaatattgcagtaaaaatagaccatgtaagtaaattctttcatcttccaactgaagcgacaaatagtcttagaacaactttagttaaccgtcttcggggaattaagggatataaagaacagcatgtattaaaagacattgatttcactgttgaaaaaggtgacttttttggcattgtaggacgcaatggttcagggaaatcaacattactaaaaatcatttcacagatctatacaccagaaaaaggcaatgtgattgttaatggtaaattggtttcatttattgaacttggtgttggttttaacccagaattaactggtaaagaaaatgtttatctgaatggagcaatgcttggattttcgcgtgaagaaatttcagacatgtatgatgaaattgttgattttgccgaacttgaagagttcatgaatcaaaaactaaaaaattattcttcaggaatgcaagtacgtttagctttttctgttgctattaaagctcgaggagatgtacttgttcttgacgaagtgcttgccgttggagatgaatcttttcaaagaaaatgtaacgattactttttggagcgtaaaaaatcaggaaaaacaacgattttagttacgcacgatatgggagctgcaaagaaatattgcaataaagcaattcttatagaaaatggattgattaaagtttctggtgatgtaaatgatgttgctaatcagtatagtttggataatcttcaaacagaagtgacagcaaggtcagatttagagattgatgtcaaagaggaatggattgaaaatttagaagttaatttcatcaatcagcaaaaaattacaccaaatgacgaggttaaatttgaagtaagttatgatgttaaaaaggatacagaaacatatattgctttttcattaaccgatgtggaccgtaatatttggatttataatgacaattcgcttgattacctcacaaaagggaaggggcataatagagcaatttacacttgtaaattagatcaagtcaacaacttaaaactcaagttacaagtatcaattagaaataagcgggacgagatgattgcttttgcagatgagaaagtaattttgattaatcgcaatgatatttcagatgatgataagagcgcacaggattctgccacaggactaattcagcggaatgggtcatgggagtttgaataa

SEQ ID NO: 41997 - DNA, 1140 bp, Lactococcus lactis
atgaaggaaaaaacagttgcaatttttaatggttattatattccccatcttggaggagtagaacgttatacttataacatcgctaagaagttgactgaaaagggttaccgtgttattatcataacaacccaacatgatgaaaacttaaccaatgaagaaattcaagaaggaataaaaatttatcgcttgcccataaaaaatctttggaaaaatagatatccttttttgaaaaaaaatcgaatttatcattcattaatagaaaaaattgaagcagaatcaattgattattatgttgctaatactcgctttcatcttcctgctatgcttggggttaaaatggcaaaagcaaaaggaaaagaagcgattgtaattgaacatggttcatcttacctgacattaaataacccagttctagactttatgctaagaaaaatagaacaattgcttattggaagggtaaaaaaagacacaagtttattctatggtgtctcaaatgaagcatctgagtggttaaaaacttttgatataaaagctaaaggagttctgcctaatgcagttgcagttgatgagtattttaatcaaaaaatagaaaaagatgagaagaaactcaccatctcctatgctggtcgtctgattcctcaaatgaaaggtgtagaaatactcctatctactttttctaaactctcaaaagaacgaaaaaatttagaattaattattgctggggatgggccacttttaaatgaggtcaaaagaaagtattcgcaaaaaaatatcaagtttttggggtatgttccttatgaaaaagtattagaaattgatgctaaatcagatgtgtttgtactcatgtctcgtagtgaaggttttgcaacggcgatgctagaagcagcgatgttagagaatgttatcataacaactcccactgttggaggggctagagatatcatgcctgatgaaacttatggctatattattgaaaataatgaaacaaaattatttgaaacattaacaaaagttttagataataaagagcatatgagattaatgcagaagaaaatttctaaaaatgtgttggaaaatttcacatgggagcaatctgcaaaacaatttataaaagtttttaacgaattggatgaaaaataa

SEQ ID NO: 41998 - DNA, 1482 bp, Lactococcus lactis
atgtcaaactgggaaactaagtttttgaaaaagggatttacttttgatgatgtattgctgattccagcagagtctcatgttttaccaaatgaggtgagtatgaagacaaagttggctaaaaatttgactttgaatattccaattatctctgctgccatggatactgtaactgactcaaaaatggctatttcaatggcgcgtcaaggtggacttggtgtagttcataaaaatatgtcagttgaggaacaagctgaagaaattcataaagtgaaacgttcagaatctggtgttattacagatccatttttcttgactccaaatcataaaattgaagaagctgaaaacttgatggcaacttaccgaatttctggtgtaccaatcgttgatacgcttgaaaatcgtaaattggtagggattattactaaccgtgatttgcgttttattacggattataatcaacaaatcaaaaatatgatgacttctgaaaatctgattactgctccggttggaacaactttagatacagctgctcgtattttgcaagagcataaaattgaaaaattacctttggttgatgaagctggtaaattggctggtttgattacaattaaagatattgaacgtgtgattgaattcccaaatgctgctaaagatgagcaaggtcgtttgcttgttgctggagcagttggtgtatcttctgatacttttgagcgtgcggaagctttgtttgctgcaggggctgatgcgattgttattgatacggctcatggacattcagctggtgttttacgtaaaatccgtgaaatacgtaatcatttcccagaccgtactttgattgctggtaatattgctactggtgagggtgctcgtgctttgtttgaagctggtgttgatgtggttaaagttgggattggtcctggttctatctgtacgactcgtgttgttgctggtgtaggtgttccgcaaattacagccatttatgatgcggcaaatgtggcgcgtgaatttggtaaaacaattatcgctgatggtgggattaaatattctggtgatattgttaaggcgcttgctgctggtggagacgctgttatgcttggttcaatgcttgcaggtactgacgaatctcctggggaatttgaaatcttccaaggtcgtaagtttaaaacttaccgtggaatgggtagcttggcagcaatgaaaaaaggttctaaagaccgttatttccaaggggctgttaatgaagctaacaaacttgttccagagggaattgaaggacgtgtggcttataaagggacagcgacagatatcgttttccaaatgcttggtggtttgaaagcaggaatgggatatactggtgcggctgatattactgctttgcatgattcagcacaatttatcgaaatgtctggtgctggtttgaaagaatcacatccgcatgatgtacaaattactaaagaagcacctaactattctgtacaataa

SEQ ID NO: 41999 - DNA, 660 bp, Lactococcus lactis
atgaagaaaacagattggtcacaacccttacgcaatcgattagcagaagattattttcctaaaatgattgaatttatcaatcagacttatcaagagggcaaagtatatccaccagaaaatcaaatttttcgggcgattgaattgactcctttggcacaaacaaaggttatcattgttgggcaagacccttaccctcagcccgggaaagctcaaggcttggctttttcttatcctgctactttcaaagtgaatcgtccagactcgattgttaatatccaaaaagaattgcgtgaggaaggtttttctaaagatgacagtgatttgacggcttgggccgaacaaggtgttttacttctaaacgcagttctgaccgtacctgagtttgcttcaaatgcccatgctggtaaaatttgggaaccgttgacagacgaaattatcaagattgcctcagatgatgagcgaccaaaagttttcattctttggggtggttttgctagaaagaaagccaaactaattgatggaagtaagcatctcatactagaagcggcgcatccgtcacctttgtcagcaagtcgtggattttttggttcgcatcctttctcaaaaaccaatgaatttctggttgaatctggtcaaagtccaattgattggagtaaataa

SEQ ID NO: 42000 - DNA, 1197 bp, Lactococcus lactis
atggcaaaattgactgtaaaagacgttgaacttaaaggcaaaaaagtcctcgtacgtgttgactttaatgttccaattaaagatggcgtaatcacaaatgataaccgtatcactgctgcgcttccaacaattaaatacatccttgaacaaggtggacgtgcagtcctcttctctcacttgggacgtgttaaagaagaagctgacaaagctggtaaatcacttgcaccagtagctaaagctctttctgaaaaacttggtcaagatgttgttttcccaggaactactcgtggcgcagaacttgaagcagcaatcaacgaacttaaagatggagaaatccttctcgttgaaaacactcgttttgaagacatcgacggtaaaaaagaatctaaaaacgacccagaacttggtaaatactgggcttcacttggtgacggaatcttcgttaatgacgcatttggtacagctcaccgtgctcatgcatcaaacgttggtatctcagcaaacgttgataaagccgttgctggtttccttcttgaaaacgaaattgcttatatccaagaagcagttgaagctccagaacgtccattcgtagcaatccttggtggttcaaaagtttcagataaaatcggtgttatcgaaaaccttctttcaaaagctgataaagttatcatcggtggtgggatggcttacacattcttgaaagctcaaggttacgaaatcggaacttcactcgttgaagatgacaaacttgatcttgctaaagaattgcttgaaaaagcagctggaaaattgattttgccacttgaccacaaagttgctaacgcatttgctggttacacagaagttaaagaaactgctgaccaaaatattcctgcaggcttcatgggacttgacgtagcaagcaaaacaattgctgactacaacacacaacttgaaggtgctaaaacagttgtttggaatggtccagttggtgtatttgaaaacacagacttccaagcaggtactgttggattgatggaagctatcgttaaacaaccaggtgttaaatcaatcatcggtggtggtgactcagcagcagcagcaatcaaccttggttatgcagataaattctcatggatttcaactggtggtggagcttcaatggaactcctcgaaggtaaagtacttccaggacttgcagctttgactgaaaaataa

SEQ ID NO: 42001 - DNA, 948 bp, Lactococcus lactis
atgttaaaagggattgatttgacttaccctcagttgacttatctaccagaaactggaattctctatgataatacatataatgaaaaaacagttccaattatttcaggtggaggaagtggtcatgaaccggcccatgtaggttacgttggttctggaatgcttgcggcagctgtgactggtcctctatttataccaccaaagtctaaaaatattttaaaagctattcgccaagttaactcaggcaaaggcgtttttgtgattatcaaaaattttgaagctgacttaaaggaatttaatgaggcaataaaagaagcgagaactgaaggaattgatgtaagatatattgtcagtcatgatgatatttcggtaaatgcttataattttcataaaagacatcgaggagttgctggaacaattttacttcataaaattctcggtgcttttgctaaagaaggcggaagtattgatgaaattgaacaattagccctgtcactttccccagaaatttatactttgggtgttgccttagcacctgttcattttcctcatcaaaagacttcatttgttctagctgaagatgaagtttcttttggaattggaatacacggagaacccggttatcgtgttgaaaaatttgaaggctcagagcgtattgccatagagttagtaaataagttaaaagcagaaattaactggcaaaaaaaagcaaataaaaattatattttgcttgtaaatggtttgggttcaacaacattaatggaactttacagttttcaatatgatgtgatgcgccttttagaacttgaaggcttatctgttaagttttgcaaagttggaaacttaatgacaagttgtgatatgtcaggaatttcattaacgctttgttctgttaaagatcctaaatggttggactatctgaatgttccaacgggagcttttgcatggtaa

SEQ ID NO: 42002 - DNA, 747 bp, Lactococcus lactis
atgaaatcaccgattgctattaatgatattagtgtgaaatttggcgataaggcaatattagaccatttatcctatgaatttgaaagtggaaaaattatttgtttgattggaccttctggagctggtaagtcaacctttatcaaggccattgttggaatgcaaaaattggattctggcaatgttaagattcttgaaagaaaaattcctgacagagaagtattagggaaattaggctatatggcgcaagaagacgccctatttaaggaattgaccggcaaacaaaatttagaattttttggttctttgcaaggaatcaaaaaaaaggatttacaaggaaaacttgataaggcagctgctacagtaaatctgactaagcagttaaatcaatcaatttctaattattcaggaggaatgcaaaggcgcttatcactcgctattgctctgcaaacggatgctccgattttacttttagatgaaccaactgttgggattgatccagaattgcgtcaagaaatttgggaagagctgcgaaatcaagcaaatcaagggaaaacaatattaattacgacgcatgttatggatgaagctgaacgttgtgatgtcgtactgatgcttagaaatggtaaatttatagcagaaggttcgccaaaggaaattaaggaaaagtatcaagttgcctcggttgaggaagcttttattgttgcgggaaaaaatttagagttacaaaataagggggcagcgaaatga

SEQ ID NO: 42003 - DNA, 1836 bp, Lactococcus lactis
atgctaacgattggaaggcgatatttaaatttttggcctgtattttgggcactttttttgttagttattcaagttgtgactaatctttggcttccaacgattacagcggatattatcaataaaggcattggtcaatctgatatgaaatatatctggtttatgggtctaattatgcttttcgtttctctggccagttggctttcggcaattggaaatgtttattttgcttccaaacaatctcaaggattgggactgaaattacgccatgatttatttaagaaagttttattcatggacgagcgcaattttcaggaatttggtgatgcaactttaattacacgtacaacaaatgatgtgactcaattgcaaaatgtctttcaaacgatgttacgaatgatgctcatggcgccaatgatgctcattggttctattttcatggcttggaaattatcacatgatttactgctggtttttttgattgccctgcctattttaactttggctgtcgtcattaatattgctatttccatgccacggtttcggtcaatgcaaacaaaagttgataaaattaatctgatttttcaacaaggtttaactggtgttcgggtgattcgtgcttttagacgagaccaatatgaaattgataaatttgatgaggctaaccgtgatttgacacataccagtcaagtggttttgacgacgattgcgatgttaatgccaattatgacagttattctcagttttacaaatattggaattgtttggtttggcgctcatcttatcagtaaaaatatgatggaaatgggttcattagttgcctttttgacctatgccacacagattttgatgtcatttatgcaattatcagcagttgctgtcatggtgccacgagctcaggtttcagctgttcgagttcgagaaattttagaatctaaagataaaattactgatgaaaattcgagcatatccgtagaggcgctaaagcgccaacggctatcctctgacggaaatgacaagttgtctgaaagcaattctgtccgcaattctctagctcttaatcatgtgtctttcaaatttgatgaagcaaaaagacaagcgctaagtgacttgtcagtaaatgtagcagctggtcagaccttagcaattattggggggactggttctggtaaatcaacgattttgaatttgattgccagattaattgacccgacaaatggaagtgtcacaattgatggtactgatattcgccaaatttcacagtatgacttgcatgaaaaagtttcttttacgcaacaaaaagctcaacttttttcgggaactgtccgctcgaatcttcaatttgggaaaagtgatgcaacagatgaagaaatgtggcaagctttggaaattgcacaagctgctgatttcgttcgtgaacaaggtggacttgagctggcggtcgaacaaaatggcgcaaatttctctggtggtcaaaaacaaagaatttcgattgctagaaccttgattaaagaggcagaaatttatctatttgacgattcattttcggccttggactttgctactgacagacaattacgaacagctattaatcactcggaaaaacataaaaataaaatcaaggtgattgtggctcaaagaatcgcaaccgttatgtcagctgaccaaatcttagttttagaaaatggaattgccgtaggacttggtactcatgaaagtttagcaaaatcctgtccgcaatatcaagaaacaatgcaatctcaactctcggatgatgatttggtcaagatgggtgtttcaattgcacatttgaccgccagaggaggtgatgaccaatga

SEQ ID NO: 42004 - DNA, 846 bp, Lactococcus lactis
atgacattaacagacacttacacactaaacaatggcattaaaattccaaaagttggctttggaacttggcaatctgcgagcggagaagaagcttataatgcggtaaaagcagcacttgaagcaggatatcgtcatattgatacagcggcagtttataaaaatgaagaatcagtcggtcaagcaattgctgattcaggaattccccgtgaggaacttttcgttacaacaaaactttggggtgtaggaacaacagaggacgctgcgaaagccttggatgaatccttgaaaaaattgggacttgattatgttgatttgtacctcattcattggccaaatcctaaagcattccgccctgattttgaaacacgtaatcttgcagtttggaaagccatggaagcaggcgtaaaagctggtaaaatccgtgcaattggtgtttcaaacttccacccacgtcacctaaaaccattgttgaaatttgctgaaattaaaccagcagttaaccaaattatggtcaacccaagtgatcaacaagaagaaattgtaagctttaatgttgacaacaatatcttgactgaggcttacagcccacttggaacaggtaaaatctttgaagttccagaacttgcagacttggcaagtaaatacaacaagagtattgctcaagtggtattgcgttggtctcttcacaaaggatatttaccacttcctaaatcagtaacccctgcaagaattaaagaaaatgcagaaatctttgattttgatttaagtattgaagatattgcttttattgacagccttcatggaaaagctggtttggctaaaaaccctgatgaagttgatttctaa

SEQ ID NO: 42005 - DNA, 1269 bp, Lactococcus lactis
atgacagtcacaatcgaaaacatccacgcaagagaaatttttgattctagaggaaatccaaccgttgaggtagatgttagattaacagatggaacattaggacgcgcagcagtaccctcaggagcatcaactggagaccgtgaagcagttgaattaagagatggtggagaccgtcttcaagggaaaggcgtttctaaagccgtcgcaaatgtcaatggcgaaatttatgaagccttgaaaggacaatcaccatttaatcaagcaaaattagatcatttgatgattgagcttgacgggacaaaaaataaatctcgtttaggggctaatgcaattttaggggtttcaatggccatttctcgtgcggcagcgaatagtgaaaaaattccactctatcgctatcttggtggagttgatttggaacttccacaaccatttttcaatgtcattaatggtggagtacatgccgattcaggaattgacgttcaagaatttttgattacaccagtcaaacgggaaagttttcgcgatggtttagaaaaaattgcaaatatctaccatactctgaagaaaattttagctgacaaagggctagaaacagccgtaggtgatgaaggtggctttgcccctaaacttggttctactgaaaatgcaattgctacactttatcaagcaattgaaagtgcaggatatgttcctggtgaagaaattgcgattgccattgacccagcttcaagtgaattttatgatgataaagaaaaagtttatcgttttgaagggcaaaaattgacttctaaagaactattgacttactatgaaaatttagttgaaaaatatccagcacttatttctattgaagatggattttctgaacatgactgggagggctttgcagctcaaacgaaagctcaaggtcaaaaaattcaattagtaggtgatgatatttttgtgacaaatcctgaaattttcaaagaaggaattaaaaaaggtgtagcaaatgctattttgattaaacttaatcaaatcggaacagtaactgaagcgattgaagccattagtttagcgagaaaagcaggctataagacaatgatttctcatcgttcaggtgaaacagttgatagctacattgccgattttgcggtagccatgcatgctggccaaataaaaacaggttcaatggctcgaagtgaacgggttgaaaaatataatcaattcttgcgaattgaagaagaattaggaaaagatgtagctcttgctagttttccaggatag

SEQ ID NO: 42006 - DNA, 2541 bp, Lactococcus lactis
atggctgtaaaacgtttaattgaaacttttgttccggaaaattataagattttcctcgatattgaccgtaaaaccaagaaaataaaaggtcaagtggcaattactggggaagcaaaagatagtgttattgcctttcatgccaaaggtttacactttagtaaagttcgtgcttttagtgtcgacacaaacttcattgaaaatgaagaagatgaagaaatcgttgttaaaattggtgaaacagggcgcgtgactgtttcatttgaatatgaagctgaattgactgacaacatgatgggaatttacccttcatactatgaagtcaatggcgaaaagaaaatgctcattggtacacaatttgaaagccattttgctcgtcaagcctttccttctattgatgaaccagaagcaaaagcaaccttcgatttgtcagtaaaatttgatgaagaagaaggcgacatcattgtttcaaacatgccagaactcttgaatattaacggaattcacgtttttgaacgtactgtcaaaatgagttcttaccttttggcttttgtattcggtgaacttcaatttaaaaaaggaaaaacaaaatctggtgttgaagtaggtgcttttgcaactaaagatcatagtgaagctgcgcttgatttcccgcttgatattgctattcgttcaattgaattttatgaagattactataaaacgccatatccactcccacacagttggcacattgccttacctgacttttcggcaggagcaatggaaaactggggatgtatcacttatcgtgaagtctgcatgcttgttgaccctgaaaatgcaaccattcaaagcaaacaatatgtagcaactgttattgcacacgaattggcacaccaatggttcggtgaccttgtaacaatgcaatggtgggatgatttgtggctcaatgaatcatttgccaacaacatggaatatgtttgtatggatgctttggaaccaagttggaacgtttgggaatcattctcaatctcagaagccaatatggcactgaatcgtgatgcaactgatggagttcaatctgtccacgttgaagtgactcatccagatgaaattggaacgctctttgacccagcaatcgtctatgccaaaggttcacgtttgatggttatgcttcgtaaatggcttggagatgaagattttgctgctggtttagctctttacttcaaacgccaccaatatggaaatacagtcggagataatctttgggatgccttggctgaagtctctggaaaagatgtggcagctttcatgcattcatgggttaaccaaccaggttaccctgtcgttactgccgaagtcattgatgatactttagttttgagtcaaaaacaattcttcgttggtgagggtgctgataaaggacgtttgtggaatgttcctttgaatacaaattggtcaggattgccagacttactttcttctgaaaaagttgaaattcctggttttgctgctttgaaagcaaaaaatgatggtaaggccctctttttgaatgatgcaaatatggctcattacattattgattacaaaggacaattgttgacagacctcctctcagaagttgagactttggagaatgtcactaaattccaaatcttgcaagatcgtaaattattggctaaagcaggtgtaatttcttatgctgatgtcgtaaatatcttgccagcatttaccaacgaagaatcttaccttgtcaatactggtttgagtcaactcattagcgaattggaactttttgttgatgaagattcagaaactgaaaaagctttccaaagcttggtaggaaaacttttcgctaaaaactatgctcgcttaggttgggataaagttgctggcgaatctgctggtgatgagagccttcgtggaattgttttgagtaagactttgtatgctgagaatgcagatgccaaagcaaaagccagtcaaatctttgcagcacataaagaaaatctagcaggaattccggctgatattcgtccaattgttttaaataatgaaattaagacgacaaattctgctgaattggttaaaacttatcgtgaaacttatgttaaaactagcttgcaagaatttaaacgtgagcttgaaggggctgtcgcattaatcaaggatgaaaaagtcattgctgaattgcttgaaagcttcaaaaatgctgatattgttaagccacaagatattgctttctcttggttctaccttttgcgcaatgatttctcacaagatgctgcttgggcttgggaaaaagcaaattgggcattccttgaagaaaaattgggtggagatatgagttatgataaatttgttatctatccaggaaatacttttaaaactgctgataaattagcagaatataaagctttctttgagccaaaattagaaaatcaaggtttgaaacgttcaatcgaaatggcaatcaagcaaatcacagcacgtgttgctttgattgatagccaaaaggctgacgttgataaatcaatcaaagaaatttctgaaaaattataa

SEQ ID NO: 42007 - DNA, 1722 bp, Lactococcus lactis
atgaagcataaatgggttgccttattctcaatcgtttcaacctttatttatgcaggagtacagctttaccaaccccaaatcatgaaacgaattatgaccgtaatgtcatcaacaacttatagccgtcatcaaatggctgacaaggtttcaggatatggagttgagcttttggttgttgctgggatagggatcatttttgctatctttagtacactttcagcggcacgtattgcccaagaaattggagcagacgttcgtgaagcgacttacaaaaaaatcaatacattttcttatgaaaatattgaaaagttcaatgccggaaaccttgttgttcggatgacaaatgacgtcacacaagttcaaaacttgatgatgatggttttccaaattttgatgcggattccagtccttttgattggtgcggttgttctttctatcacaactcttccaagattatggtggattacagtccttttaattgttttaatcgtattagtcacagccgttttaatgggacgcatgggccctcactttatggctttccaaaaattgatggaccgtattaacgccattgctaaacaaaacttgcgtggttcacgtgtcgttaaatcattcgttcaagaaaaaaatcaaatcaaagattttgatgaaacttctgatgaactttacgatcataactgggcagtaggaaaactcttctcagcaatgattccactctttactgtgattgctcaaggagtaatttggcttgctatttactttgtttcaacttttgtaacagagtcaacaacagttgcccaagatagtattggtgggattgctacattcatgacttatatgggaatgattatgtttgccattatcatgggtggtatgatttcaatgtttgcttcacgtggtatggtatcaattggtcgtattaatgaagtgttaaatactgatccagccatgaaatttgatgaaaatgctaaagatgaagttctttcaggttctgtcaaatttgaccatgtgtcattctcttatccaaatgatgaagaaccaacacttaaagatattagctttgaagtagaacctggtcaaatggttgggattgtcggagcgactggtgctggtaaatctacattggcacaattgattccaagactctttgacccaacagaaggtaccgtttcagttggtggaaaagatcttaaaacagttagccgtggaacattgaagaaaaatatttctattgttcttcaaaaagccattctcttctcaggaacaattgctggaaatattaaacaggggaaagccgatgcaactgatgaagaaatgactcgtgctgcacgcattgcccaagccgcagaatttattacaactaaagatggtcaatatgattctgaagttgaagaacgcggaaataacttctcaggtggtcaaaagcaaagactttcaatcacacgtggagttgttaaaaatccaaatgtcttaattttagatgactcaacatcagcccttgatgctaaatctgaaaaacttgttcaagaagctttgaataaagaccttaaagacacaaccacaattattattgctcaaaagatttcatcagtggttcatgcagataatattttggttcttgaccaaggaaaacttgttggtcaaggaactcaccaagaattagttgctgagaataaaatttaccaagaaatctacgacacacagaaagcacaggaggactaa

SEQ ID NO: 42008 - DNA, 1995 bp, Lactococcus lactis
atggaaaataccaaatcaacaagaaaaatgtctgacaccacacgtgccatccgatttttttacctctatctgaaaagatataaactccaatttgctgtaattatgattttcatcattttagcaacttggttacaggttgtttctccatcacttttgggggacgccatcactaatttgactaaatatgtgactgacttctttacacatcaacatgctggtcaatcccaagatgcactacaacaaattgctcaacaattaagccaacaaatgcaccaaacagtagattggcacaatgttcctgaagttgtgaaatctttgccacaagcagcacaagaccaaatcactgctaatcttcctaaaggaacaactttagaaacacttaaaacagtggcaacttcacatgcagccagcacttctacattcatgaaaggaatgtggcaattgcttgcagtctatgtagcaacaggtgtatcaatgttgatttataccttgctctttagtcgtatcgttgctcattcaacaaatcgcatgcgtaaaggtttgtttggtaaacttgaacgtttgacaatttcatattttgaccgtcatcaagatggtgatatccttgctcgtttcacatctgacttggataacattcaaaatactttaaaccaagcactcgtttcggttatttcaaatgctgcggtctttgtgggtgtcattatccagattttcaataaagatgtgacatttgcttggttgacagttgctgcttctccagttgccattttatctgctgtgattatcattcgtcaatcgaaaaaagcaacagacaaacaacaagaagaagtttcacaacttaatgcctatatggatgaaaaaatctctgggcaaaaagcaattatcgttgaaggtttacaagaagattctattaatggattcttggaacacaatgaaaatgttaaaaaacgtacctttgctgctcaagcatggtctggtatgattttcccattgatgaatggtttccaacttttatcaattgccattgttatctttggtggaacggcctatgttcttaacgatgatagcatgtcaattgccacaggtttagggcttttggttgcctttgttcaatacgttcaaagttactacaacccaatcatgcaaatttcatcaaactttggtcaacttcaacttgccatcacaggggcaactcgtctgaatgtcatgtttgatgaaccagaagaagttcgtcctgaaaatggtaagaaatttgatacgattaaagacggaattcaaatcgaaaatcttgattttgaatatcttccaggaaaaccagtcctcaaaaaagttaatattgatgttaaaaaaggacaaatggttgccctcgttggtccaactggttcaggtaaaacaacagttatgaacttgatgaaccgtttctacgatgttaatggtggagcaattaaatttgatggaactgatattcgtgaatttgatttagatagcttgcgttcaaatgtcggaattgttttgcaagagtctgttctctttgatggaacgattgctgataatatcaagtttggtaaaccaaatgctactcaagaagaaattgaaacagtggctaagacaactcacattcatgatttcattgatagcttacctgacaagtacgaaacacatgtttcagatgatgaatcagtcttctcagttggtcaaaaacaacaaatttctatcgcacgtaccattttgacaaatccagaacttttgattttggatgaagcaacttcaaatgtggatacagtaactgaacaacaaattcaatgggcgatggaagctgctattgctggtcgtacttcattcgttattgctcaccgtttgaaaacaattcttaatgcagataagattgttgttcttaaagatggtgaagttatcgaagaaggaaatcaccatgaacttgttgctcaaggtggcttctactctgaactttatcacaatcaatttgtttttgaataa

SEQ ID NO: 42009 - DNA, 1266 bp, Lactococcus lactis
atgaaaaaaatagtaattaatggtgggaagcgtatttcaggaaccatcccaatttctggcgcaaaaaattcagtagtcgctttgattccagcaactatcttagctaacgatgttgtaacgcttgaaggagttccagatatttctgatgtcgcaagtttagtcgaaatcatggaaatcatgggagcaaaaattgaacgaaatcttgaagaaggacgacttgtgattgatacacgcagtgttgtttctcgtccccttccttatggaaaaatcaactctttacgtgcttcttattatttcaatggtgcacttttgggacgttttggtcaggcaacagtaggcttgcctggtggctgtgatttaggccctcgtccaacggatttgcatgataaagcctttaaagctctaggggctaagaagattcaagaagaagaagctgagcacttagaagtgattggtgattcattagttggaacaaccatttatatggatgttgtttctgttggggcaactattaatactatgcttgctgctagtcgtgcaaaaggtttaactatcattgaaaatgctgcccgtgaacctgagattattgatgtggcgacacttataaataatatgggcgcgcaagttcgaggagctggaactgacattatccgcattactggagtggatgaaatgcacggtgctcaacatacggtgattcctgaccgtattgaagcgggaacttatcttgccttagctgctgctatgggagatggtgtcatcattgaaaatgttatttatgaacacttggaatctttcattgctaaacttgaagaaatgggtgtaggtttgaccattcgtgaagatagtattgaagttcataaatcagaaaatctaaaatcagtcaatattacttctgttccttacccagggtttgcgacggatttgcaacaaccaattacaccacttttattgaaagcaaaaggtcgtggttcaattgttgatacgatttatcaaaaacgtgtcaatcatgtccctgaattagctcgtatgggtgctaatatttctgttttagatgatcgaattatttatgacgctcctaatgaattaactggtagttgtgttcaagcaactgacttacgtgctggtgcggctttggttactgctggaattattgccagtggaactacaaaaatctctaatattgagtttatcctacggggttatgaccacattattgaaaaattgactgctgttggtgtagatattcaattgattgaagagtga

SEQ ID NO: 42010 - DNA, 819 bp, Lactococcus lactis
atgaaacttaataatcagattgaaattccggaacttggtttgggagtttttcaaattccaaatgacgaaaccgctgatgttgtcaaaaacgcaattgttaacggatatcgtttaattgatacagctaaaatttatgaaaatgaagaaggaactggtcaaggaattaaagaaggtttggctatgacaggactttctcgtgatgatcttttcatcacttcaaaactttggggagataatcattcttatgaagaaacagttcaaaactttgaaaaaagtttgaaaaaattggatttagattatctagatttatatcttatccactggccaggcacacattatgcttacaaagaagcttggaacgcaatggaagatttatataaagcaggcaaaataaaagcgattggtgtcagtaactttcaaaaatcacatttagaagaacttcttagctatgctaaaatcactcccgttttaaatcaaattgaactccatccaaaattatcacaagaagaacttcgtaatttcttagaacttcatgatatcaaggttcaagcttggtcacctttgatgcaaggtcaattattagacaatgaagtcctcaaaaaaattgctgataaacatggaaaatctgtggctcaaattattcttcgttgggatattcaacaagatattttagtaaatgtaaaatctattaaaagtgaacgaatgatagctaatcgtcaaatttttgatttttcacttgactctgaagatatgaaagctatcaactcactcaatgaagaacttcgtgtcggtccagatccagaacattttaatttttaa

SEQ ID NO: 42011 - DNA, 702 bp, Lactococcus lactis
atgccaaaattagtatttgcacgtcacggtgaatctgaatggaatcttgctaaccttttcacaggttgggctgacgttgacctttctgaaaacggaactaaacaagcgattgaagctggtaaattgattaaagaagctggaatcgaatttgatattgcttacacttcagtattgaaacgtgctatcaaaacaactaaccttgctcttgaatattcagaccaactttgggtaccagttgttaaatcatggcgcttgaacgaacgtcactacggtggtttgacaggtttgaacaaagctgacgctgctgcaaaacatggtgatgaacaagttcacatctggcgtcgttcatatgatgtattgccaccagcaatggatcatgatgataaatatacagctcacggagaccgtcgttacgctggtcttgaagattcattgattcctgatgctgaaaacctcaaagttactttggaacgtgctcttccattctgggaagaccaaatcgctccagctttgaaagaaggaaaaaatgtcttcgttggtgctcacggtaactcaatccgtgcactcgttaaacaaatcaaaaaactttctgatgacgaaattatggatgttgaaatccctaacttcccaccacttgttttcgaatttgatgacaacttgaacgttcaaaacgaatactacttggctcctaaaaaagcataa

SEQ ID NO: 42012 - DNA, 564 bp, Lactococcus lactis
atgtcattagtaggtaaaaaaatagaagaattttcaacagatgcttatcttggtgggaaatttattaaagtttccgataaagacttttatggaaaatggtctgtgctttgtttctatccagcagacttttcatttgtttgtccgacagagttagaagatttagaagaaacttatccaaccttgaaatcgcttggtgtagaagtttactcagcttcaactgacacccattttgtccatgctgcttggcatgaacatagtgatgctatttcaaaaattacttatccaatgcttgcagacccttcacaaaaaatttcacgtgcttttgatgttcttgatgaagaagcaggattggctcaacgtggaacatttattattgacccagacggtgtgattcaagcgcttgaaattacggctgatggtattggacgtgatgcaagtcaattggtcgataagattaaagctgctcaatatgtgcgtaatcatccaggggaagtttgtcccgctaagtggaaagaggacggagcaagtcttcacgttggtattgaccttgtaggtaaaatatag

SEQ ID NO: 42013 - DNA, 1644 bp, Lactococcus lactis
atgaaatttagtgaactcggcctgtcagaaggaatcgtaaatacacttacagagattggttatgaacaaccaacaccaatccaagaacaaacaattaaacttgcacttgaagggcgtgacgttctaggtcaagcgcaaacaggaactggtaaaacagcagcatttggtcttccaacaattgaaaaaattgatgcttctaatccagctattcaagcactcgttattgctccaacccgcgaacttgcggttcaaggacaagaagaacttttccgttttggtaaatcaaaagggcttaaagttcgtactgtttttggtggttcaagtattgaaaaacaaattaaaggccttaaagctggtgcacatattgttgtgggaacaccaggacgtttggttgacttgattaaacgtaaagcaattaaattggatcaacttgaaactttgattcttgatgaagctgatgaaatgttgaacatgggattcttggaagacattcatttcatcattgaaaaaacaccagaagctcgtcaaacattgcttttctcagcaacaatgccaaatgacatcaaaaaaattggtgtgaaattcatgaagaatcctgaacacatcaaaattgcagccaaagaaatgactgctgaccgtattgatcaatattttgtaaaaacaaaagaatttgaaaaatttgatgttttgactcgtttgcttgatgttgaacgtccagaacttgcaattgtttttggtcgtacaaaacgtcgtgttgatgaattgattcgtggtcttaaattgcgcggttaccgtgctgaaggaatgcacggagatttggaccaaaataaacgtttggctgttttgcgtgatttcaaagcaggacatattgacgttttggttgcaactgacgttgctgctcgtggactcgacgtgtcaggagttactcacgtttataactacgacattactcaagaccaagaaagctatgttcaccgtatcggtcgtaccggccgtgctggtaaatcaggacgttcagtaacatttgtttcatacaatgaaatgggttatcttcgtgccattgaaaatatgactaaaaagccaatgaaaggcttgaaaccacctacaaaagaagaagcttaccaagcgtcactctcagtagctatggatgatgtccttcgtgatttgtctgatgattcagctaaagcaaaattggctaaatttgacaaacaagcagcgagcctacttgaaaaatttgatgctaaagaattggttgctttacttcttcaaggtcgcgtaaaagaccctgataatcaagaagaagttaagattacagctgaacgtccattgccatataatggtgaaggaaaaggcttcaagaaaaaaggtaaaggtggcggcggacgctacaaaggtcgtggaaatggcgaccgtgatggcaaccgtggcggttaccgtggaaatcgtgatggtaaagatggcgaccgcggtggagatcgcaaacgcaactggaaagaccgtgatgataaccgtggcggttaccgtggaaaacgtgatgaccgtcgttttgacgatcgtaaacaaggagaaaaaactcctcgtaaacgtaccacaggaactgaaaaatcagctggcttcgtaatgcgtagccgtggtgacaaataa

SEQ ID NO: 42014 - DNA, 1374 bp, Lactococcus lactis
atgaatacaaatcaaaatgaagaaaataagccctcacaacgtggtttaaaaaataggcatattcaacttattgccattgctggaacaattggtacgggattattcctcggtgccggaaaatcgattcacctcaccggcccatcaattatttttgtttatttaataatcggtgcgcttatgtatattctcctaagagctatcggggagatgctttaccaagatcccaatcaacattcctttttaaattttgtgtcacgttatctcggtgaaaaacctggttactttattcagtggtcttatttactggttgttgtttttgtagctatggctgagctaattgctattgggacttatattaatttttggttgccggatttaccaatttggatgacagaagtctttgtattagttcttctaactttattgaatactttaaatccaaaattttttggagaaaccgaattttggtttgggatgattaaaattgtggcgattattggtttgattttaacggcaataatcctcatttttagtcattatcatacaggaactgatactgtaagtgtaactaatatcaccaaaggcttcgagttcttcccaaatgggctttctaatttctttgaaagcttccagatggtcatgtttgcttttgtttcgatggaattcatcggaatgactgcagcagaaacagataatcctagaccaactttgaaaaaagcgattaaccaaattccaattcggattgtcctcttttatgttggggcactgttggcaattatgagtatctaccaatggcgcgatattccggctgataaatcaccatttgttaccattttccaactcattggaattaagtgggcagcggctttagtgaactttgtcgtactaacttctgctgcttcggctttaaactctgccctcttttcaatcactcgtaatctttattctttatcaaaactcaataatgataaaatacttaaaccatttactaaattttcaaaagctggtgtaccagtaaatgctttacttttcacctcattattaattctatttactccattcatctcgatgattcctgcgatttctaattcttttgtctttattacaagtgtcgcaaccaatctttttctagtggtttatctgatgaccttaattacttatcttaaatatcggaaatcaagcgattttgatcctaaagggtttgttttacctgcagcccacatctttattccattagccattgctggatttgtcttaatctttatttcactattctgctttaaagatacaattgttccggccattggttctgtgatttgggttcttatttttggactatttactttctttaaaaaaataaaaacagctgaataa

SEQ ID NO: 42015 - DNA, 1380 bp, Lactococcus lactis
ttggaaaatcttcaagagaaacatgaagctcaacggggcttacagaaccgacatattcaacttattgctattgctggaacgattggtaccggactttttctaggagctgggaaaaccattcaaatgactggtccaagcgttatctttgcttatattcttattgggattgcgatgttctttttcttaagaacaatcggagaaatgctttacaacgaccctagtcagcattcatttttaaattttgtcacaaaatattcaggcgtcaggacaggttacttcactcagtggtcttattggttagttattgtttttgtttgtatctctgaattgacagcaatcggaacttatattcaattttggcttcctcaggttccactttggttgattgaaattgtcatgctagctcttctttttggacttaatactttaaattctcgcttttttggtgaaactgaattttggtttgcgatgattaaagtagcagcaatcattggaatgattgtcactgcgattattttagtagctggtaattttcactatagcactgttttaagcggaaaaaccgttcatgactctgcttcactaagcaacatttttgatggctttcaactcttcccacacggtgcttggaactttgttggtgccttacaaatggttatgtttgcctttacttctatggaatttattggaatgactgcggcagaaacagttaatcctaaaaagagtttaccaaaagcaattaatcaaattccagtacgtattttacttttctatgttggagcacttttggctattatggctattttcaactggcactacattccggctgataaatctccatttgttatggtttttcaacttattggaatcaaatgggcagcggcgctcattaactttgttgtcctgacttctgctgcttcagcgcttaatagttcattattttcagcaacacgaaatatgtactcacttgctcaacagcatgacaaaggaagattaactccttttacaaaactttctaaggcgggaattcctatcaatgccctttatatggcaactgctctctcgcttttggctcctgtcctgactcttattcctcagataaaaaatgctttcgattttgcagcctcttgtacgactaatttatttttagtggtttactttattaccctctacacttattggcaatatcgcaaatctgaagattacaatcctaaaggtttcttgacaccaaaacctcaaattaccgttccctttatcgtagctatctttgcaattgtctttgcttctttgtttttcaatgctgataccttttatccggccttgggagcaattgtctggacaattttctttggactctactcgcactataaaaaaatctaa

SEQ ID NO: 42016 - DNA, 1434 bp, Lactococcus lactis
atggaaaatcaaaatcaggtcaagcgcaaccttaaacagcgccacatcaccatgattgcattgggtggtacaattggaacaggtttatttttaacttcaggagcaacaattagtcaagcaggtccctggggcgcagttcttgcttattgttttattggtattatggtttacttcgtaatgacttccttaggtgagatggcgacatatttgcctacctcaggttcattctccgattatggcggtcgttatgttgatcctgcttttggctttgcattagggtggaactattggctcaatggagcgattaccattgccgtggatttaacgacagcaggattgattacgcagttttggttcccgcaccttccgtcttggatattttcaggaattgcgacggtcttaatttttattattaatgttatggcggttggagcattcggggaaacagaatattggttatcaacgattaaagtgattacgattgtcctctttttagctattggtttacttaccatttttggagttttgggacaaggaaatgttgatgtcgttgccaatttaagtgctggcaatcatggctttgttggtggaatttcaggatttgttggagttttacttattgccggattctcttttcaaggaactgagcttttagggattaccgcaggtgaatctgaagacccaggtaagtcaattcctaaagcaatgaactctattttctggcgtatcttacttttttacatcttttcaatcattgtgattgctgcaattatcaattttaaagaccctcgcttgttaaatccaaattcgacagctgtcatgagtccatttactattgtctttaaaaatattggctttgcagttgcagcttcagttatgaatgcggtcattcttacttcggtaatttcatcagcaaattcagtaatgtatgcttcaacacgtattctttattcattgggacaagaaaaaggcgcaccaaaattctttggacgaacagcaaaaaatggaattcctttttatgccctattagccacaacaattatttgttttattgctttcttaactggaatatttggaacgcaaatttatcttttcttggttgatttatcatcactaacaggctttcttgcttggcttggaatttctatcagtcatatccgttttagaagagcctatattgctcaagggaaaaaattggaagatcttccttacaaagctaaatggttcccatttggtccaattgttgcgctcttgatgactgcggcgattgccattaatcttgacccagccatgctctttagtgagcactggggtgaaggcttagctttatacgctgcaattcctattttcattattctttattttggttataaatggaagtataatacaaaaattattccacttgaagaagtagatttgagtcgggaaaaataa

SEQ ID NO: 42017 - DNA, 945 bp, Lactococcus lactis
atgaaaattacaagcagaaaagtagttgttataggaacaggttttgttggaacaagtattgcttattcaatgattaatcaaggacttgttaatgagttggttttgatagatgttaatcaggataaagctgagggtgaagccttagatttattagatggcgtttcttgggggcaagaaaatgttattgtgagagctggagattataaggattgtaaaaacgctgatattgtggtcgttacggctggggtaaatcaaaaaccaggtcaatcacgtttagatttggttaatacaaatgctaaaattatgcgctcaatcgtgactcaggttatggactcaggttttgatggtatttttgtaattgcttcaaatcctgtggatattcttacctatgtcgcttgggaaacttctggtcttgatcaatctcgaattgtcggaactggtacaactttggatactactcgttttagaaaagaattggccacaaagctagaaattgatccacggagcgttcatggatatattattggcgaacatggcgattctgaagttgcagtttggtcacacacgacggtaggtggaaaacctattcttgaatttattgttaaaaataaaaaaataggggttgaagatttgtctaatttgtcaaataaggtaaaaaatgctgcctatgagattattgataaaaaacaggctacttattacggcattggaatgagtacagctagaattgtcaaggccatcttaaataatgaacaagcaattctaccagtttctgcctatttacgtggtgaatatggtcaagaaggtgtctttaccggtgttccatctattgtaaatcaaaatggtgttagagaaatcattgaactaaatattgatgcttatgaaaagaaacaatttgaaaaatctgtcagtcaacttaaagaggtaatagaatctattaagtaa

SEQ ID NO: 42018 - DNA, 636 bp, Lactococcus lactis
atgaatggaattctaatttcccttgagggacccgatggagcaggaaaaacaacggttttaaaagaaattttacctgaaatccaaaaaatgaagcgcgaaattgtcccaactcgtgaaccaggcggtgttcgagtggcggaagaaattcgccaaattattcttgatccaaagaatacagatattgattctaaaaccgagttaatgctttttgcggcggcgcgtcgtttacatatgcaagaaaaaatgttgccagctttacaagcgggtaaagttgtcattgttgaccgatttattgattcatctgtcgcctatcaggggtatggccgtgatttgggtgtcgaagttgttgattggcttaactattttgcaacagatgggttgaagcctgatttgacgctttattttgatgttgatacggatgttgcccttgagcgaattatgaaaaatcgagctgatgaggtaaatcgtttagatttggaaagagctgagatgcatcgtaaagttcgtgaaggttatttggagattgttgtaaaagaacctgagcgttttgtaaaaatagatgcaagtcaacctttagaaaaagtggtagctgatacactttccgtcctcaaaaaaagatttgtcagtgaattttaa

SEQ ID NO: 42019 - DNA, 933 bp, Lactococcus lactis
atgactatcaataaaatggggacgggaattgcccattccaaactaatcttaattggagaacattccgttgtatatggtcagccagcaattgccttacctgtaacaattcttaaaactacagtgacaattacctcatcaaaatatggccaatacattgaaaataacgaatttcgtagaagacttgatttaatgggagatgaatttgaaggaattcgtcaactcattatgcgcttactctctaaatttcattcatcaaaaatgccattctctttagaaattgattcaaatattcctcaaggacgtggcttgggagcttctgcttcattggcaactgccattatcagagctttttatgatttctttgatgctgaacttccgcaaaaagatttactcttttatgccaacttttcagaaaatattactcacggaaaatcttctggaattgatgtggcaactgtaaattctgaacaccctttgtggtttattaaagacagcacaattgaaccctttgaactcaatcttcatggctttatcgtgattggcgatactggtgttcacggctttacgagtcaagccatcaatattgttcgcgaaaaacttgttgaagaaaaagaaaaaacacaagattcaattaatcatttaggtcaattagcgaccgattcaaaagattttttgatgacagacaaactcaaagaatttggtcatgtcatgaataaagctcacgaaagattatctgatttgggagtttctcatccacgtctagataatttagtcgaaactgctcgtaaaaatggtgcacttggtgctaaattaactggttcagggctaggtggcgtcatggttgcccttgctgaaaatgaaaaagatgctattcgtatcagtcaacgtcttctaaaaaatggcgctaaaaatacttggatttactcattttaa

SEQ ID NO: 42020 - DNA, 957 bp, Lactococcus lactis
atgaaaaatattgttactgcaagggcgcatacaaatatcgccttgattaaatattggggaaaagcggatatcgctctaaatattccaacaacctcttctttgtcaatgactctggagccattttatacaacaacctctgttgaatttactgacaatgagtctgattccttgattttgaattctgaagtggcagatagcagccgtgtcagtcaatttttggaaatgatgcgtggacaatatggaaatttccctaaagtaatgattcaatcagaaaatcatgtgccaacagctgctggtttggcttcaagtgcttcaagttttgctgctctgacagctgctatgtttggacttttagatttagaaaaagatgattcagaaatgtcacgaatagctagacgcggttcagggtcggcttctcggtcaatttttggaaatttttcagtttggaataaaggagaagatcatcaatcttcctttgcggaatctttttacaacgaagatattggtctttcaatgattgttgctgaaatctctgctgaaaagaaaaaaatgtcgtcaactaagggcatgcaattggcacaaactgcaccaacttacagtgcttgggttgaaaaatcggccattcaactggaagaaatgaagcaggccattttaaatgctgatattgaaaaagttggtctagttgctcaggataatgcattaggtatgcatgaacaaaatcgtctctctaatcaaccttttgattatttcacgcatgaaacaagacacgtgattgactttgtgaatcaggcttatcaatcaggattgcttgcttttgtgactattgatgccggtccaaacgtcaaaattattactgaccacgcgactgaaaaagttctcttagctaaattacaagcggaatttccagaattaacatttgatatcgcacgtgctgggggcgcttatgaatatctctga

SEQ ID NO: 42021 - DNA, 990 bp, Lactococcus lactis
atgaatatctctgagaaaaaaatgtcaatcaaagtgccaggaaaacttttttttgcgggagaatattcggtcacaaaagaaggaaacctcgcccttatcacaacaattgaaacaaattttgaagtaagaatttcagctactacagggaaatcaattttcaaaacaaatgttggactatctgattttgaattttctttgtctaaaattgaatttactaaagaaaatccgtggaattttgcactgacagctttaaaaaatactttgtcagctgctgacagctttgaaaaaaaatctgtcagtaaaattttatcatcatctccagaaatttctcttgagattgtcagtgatttaggctttggtgaaaataaaaaaggctacggctcaagtgcttcagtcgtttgtggtctagttaatgcagtcaatcagttttttgatttccagttgtcacttgaaaaacgttttgaaattgccgcaaaaacacattttgaagttcaaggctcaggttcaatgggcgatattgctgctattatgtatggtggttctgttttttatcaaaatcataagcgagtcatacctctcgaaattccttgggcaacttatgtggttcaaacaggaaaagcggcaaaaacgagtgaaaaaataaaaataaagctttctgatgaattttatcaagcttcaaatgagctggtcattgaattggcaacggcgattgacattcaagattttgctttattcaaagaaaagttatcagaaaatcaacttttgcttttggagaatattccagaaggttatatgactaaagaattagctattgctttaaacttactcaatagctatcctgaatttgctgctaaaatctctggggccggttttggggagaatattattttatttgctcaaaatacccaagctattgctgaagtccaaaataaattatcggaatatggaatcaatcttgaaaaatttaaggttgctcaaaaaaataactga

SEQ ID NO: 42022 - DNA, 1341 bp, Lactococcus lactis
atgaaatttacagactttaattttaaagattatattaaccaaacgttagagaatatcaaatttgaaaaaccaactgaagtacaagaaaaattgattccaattgttctctcaggccgtgacctggtaggggaatcaaaaactggttcaggaaaaacacacacttttttactcccaattttccaaaaaattgatactgatcttgatgaagtgcaagcagtcattacggctccttcacgtgaattagctactcaaatttacaaagcagctcaagaatttacaaaagttaatgacaagcttcgtgtttcaaactttgtcggtgggactgataaggcccgtcaaatcaaaaaattggaatcatcacaaccacatgtcgtaattggaacaccaggtcgaatccatgacttaatcaaatctaatgctttaattgtgcatactgctaatacttttgttgtcgatgaagcggatatgacacttgacatgggatttttggcagatgttgaccaaattgcttcaagttttggtaaacgtgtacaaatgctcgttttctcagcaactattcctcaaaaacttcaaccatttttgaaaaaatatttgcataatcctgtcatgcaaaaaatcgccaataagacagtaatttcagatacaatcgaaaattggcttgtttctaccaaaggaagttctcataatcaacttttgctccaattgacaaaagcaacgaatccttacatggcaatgatttttgccaataccaaaggtcgtgttgatgacattcatcatttcttgacaagtaacggacttaaagttgcaaaaattcatggtgatgtaccgccacgtgaacgtaaacgtatcatgaattcaattaaaaatttggattatcaatatgttgtggcaaccgatattgccgcgcgtggaattgatattgaaggtgtgtcacacattatcaatgatgaaattccaaaagatttaactttctttgttcaccgagtgggccgttctggccgtaatggattacaaggaacagccattacactctatagtccttctgatgattcaagtattcgtgagattgaaaaaatgggtgttacattccagccaaaagctattaaagatggtgaaattgttgattcttatgaccgtgaccgtcgtgaaaaacggacgaaaaaacaagatgaaatttcaacaaaaaccattggtgcccttaaaaaaggtaaaaaacacgttaaaccaggttacaaacgtgcaattaaatggcaaattgaagaagataacaagaaaaaacgccgtgctgagcgtaataaaaatgcccgtaaaacacgtgattctcgtaaacaaagtttctaa

SEQ ID NO: 42023 - DNA, 1437 bp, Lactococcus lactis
atgactttaaaaaaagacttcctctggggaggagcagttgctgcacatcaacttgaaggaggatggaatgccggcggaaagggagtttctgttgctgatgtcatgacagcagggagcaatggagtagagagaaaaatcacagatggggtaattgagggagaaaattatccgaatcatgaagctattgatttttatcatcgctacaaagaagatattgcactctttgatgaattgggattaaattgttttagaacttccattgcatggactcgtatttttccaaatggagatgaagcggaacctaatgaagaaggtttgcaattctatgatgatttatttgatgagtgtttaaaacatgggattgaacctgtaattactctatctcactttgaacttccttatcacttagtgacagaatatggtggctttcgtaatcgtaaactcattgatttctttgtccatttttcagaagtcgtaatgaatcgttataaagataaagttaaatattggatgactttcaatgaaatcaacaaccaagcaaactatttgcgtgattttgcaccatttactaattctggtttaaaattcccagaaggagcaagcgaaaaagaacgtgaagaaatgatgtatcaagcggctcattatgagttggttgcttctgccaaagttgtcgctctgggacataaaatcaatccagatttccaaattggatgtatgattgccatgtgtccgatttatcctgcaacttgtaaaccagaagatatgatggcttcaaccgttgctatgcaacgtcgctattggtttgcagatgttcatgttcgcggacattacccaagctatttaaaagcctattttgaccgtaaggaatttaaacttgatattcttgatgatgatttgaaagcattggaagaaggaaaagtagattatattggtttttcttactacatgagttttgcaattaaagaccatggtaaagctcctacttttgattacaatgaagataaagatttagtcaaaaatgaatatgttaaagcttctgaatggggctggcaaattgatcctttaggattacgttatgcaatgaattggttctatgaacgttatgaaaaaccactcttcattgttgaaaatggttttggtgctgtagatgaagttgaagctgacggaagtattcatgacccttatcgagtagattatttaaaagctcatatagaagcaatgaaaaatgctgtagattatgatggagttgacttaatgggttatactccgtggggctttattgaccttgtttctgctgggacaggtgagatgaaaaaacgctatggcgtcatatatgtagataaggataacgaaggaaatgggacattagaacgttcgaaaaaagactcctttacttggtatcaaaaagttatcgcaacaaatggtgaagaactttaa

SEQ ID NO: 42024 - DNA, 1359 bp, Lactococcus lactis
atgggtaaatatttcggaacagacggtgttcgcggggaagcaaatgttgaattaacgccggagatggcttttaaacttggtcgttttggtggctatgtccttagtcaacatgaattaggtacaccaaaagtttatgttggtcgcgatacacgaatttctggacaaatgcttgcgagcagtttgatttcaggacttttgtctgttgggattgaagtttatgatttaggagtcattgcaacaccaggtgtagcatatttagttaaaaaagatggtgcctctgctggggtcatgatttcagccagccataatccagcacttgataatggaattaaattctttggtggtgatggttataaattagaggatgaaaaagaacttgaaattgaagcattgattgacgctgaagaagacacattgccacgtccatctgctcaaggcttaggaatgctgcatgactatatcgaaggtgttcgtaaatatcaagctttcttaaaaacaacagcagaaggtaattttgaaggctataaggttgttcttgataccgctaatggtgcagcttatacttctgctcgtgccgtttttgctgatttagaagcgaatttgacagttattggtgaaaatcctgatggactcaatatcaatgtaaaagtaggctcaactcatcctgaagcgatggctaaaaaagttgtcgaaacaggaagtgacctcggacttgcctttgacggtgatgctgaccgcctgattgccgttgatgaaaatggagaaattgttgatggcgataaaattatgtttatcgttgggaaatatcttcttggacaaggaaaattggctcaagatacgctagtaacaactgtgatgtctaatcttggatttcatttagcgcttgaagaagcagggattaattcagtgattacagccgttggtgaccgttatgttgttgaagaaatgaagaaaaataattacaacttcggtggtgaacaatcgggtcatatgattttccttgattacaacacaacaggagatggtcaactttcagccattcaattgttgaaagtaatgcgtgaaactggcaaatctttatctgaattagcaagtgaagttacgatttatccacaaaaattagttaatgttcgggtaaaagataatgcagctaaaaaatcagcaatggatgtgccagcgattcaaaaagtaatttcagaaatggaaacttcaatgaatgggaaaggtcgtattttagttcgcccttcaggaactgaaccactcttgcgtgtcatggctgaagcgccaactcatgaagaggtcaatcatgttgtagataccattgttgaagttgttgaagcagaaattggtgtaaaataa

SEQ ID NO: 42025 - DNA, 666 bp, Lactococcus lactis
atgtttaaagcagtattgtttgatttagatggtgtaattacagataccgcagagtatcattttagagcttggaaagctttggctgaagaaattggcattaatggtgttgaccgccaatttaatgagcaattaaaaggggtctcacgagaagactcgcttcagaaaattctagatttagctgataaaaaagtatcagctgaggaatttaaagaacttgctaagagaaaaaatgataactatgtgaaaatgattcaggatgtgtcgccagccgatgtctatcctggaattttacaattactcaaagatttacgttcaaataaaatcaaaattgctttagcatcggcttctaagaatggtccatttttattagagaaaatgaatttaactggatattttgatgcaattgctgatccggctgaagttgcagcatcaaaaccagcaccagatatttttattgcagcagcacatgcagtgggtgttgccccctctgaatcaattgggttagaggattctcaagctggaattcaagccatcaaagattcaggggctttaccaattggtgtagggcgcccagaagatttgggagatgatatcgtcattgtgcctgatacttcatactatacattagaatttttgaaagaagtttggcttcaaaagcaaaaatga

SEQ ID NO: 42026 - DNA, 510 bp, Lactococcus lactis
atgttaactaaaaaaaactatcagtcacctttaggagaaataacgcttttaagtgatgaaacttatttattaggagtgtggtttaaagagcaaaaatactttgcggccaattatgatttaaatcaggcaaaagaggataagagtcttccaattattaatgctatagattggttggacgcttattttaaaggagaaaaccctgatttaaaaaaaataaaattgaaaccagaagtaacggaatttagaaaaaaagtactcaaaatattaagtgatgtcccctatggtagtctaattacttataaagaaatatcaaatctccttcaggttaatgaagagaaaaaaagaaatatgtcacaggcggttggtggagcagttggacataatccactttcaatcattatcccttgtcaccgagttgtggggaccgatggttccatgacaggatacgctggtggactagagaagaaaaaagctcttttgacacttgagcaagcacatttaaaaaaataa

SEQ ID NO: 42027 - DNA, 1284 bp, Lactococcus lactis
atgatggataaaataattgtaaaaggtgggcaaacaaaacttcaaggtgaagttgaaattgaaggagcaaagaacgccgttcttcctcttcttgcagcaacattactcgctagtgagggtgaagttgtacttactaatgtccctattttaagcgacgtttttatgatgaataatttggtaaatcatcttggaactgcgattagctttgaccaagaagcaaagaaaattattgctaaatcaaattcagaaataaaaacaactgcaccatatgagtatgtcagcaaaatgcgtgcctcaatcgttgttatgggaccaatcttagcccgcaacggacaagcacgtgtatcaatgccaggtggatgttccattggatctcgaccaattgatttacatttacgcggttttgaacaaatgggagcaacaatcactcaaaatgctggttatattgaagctaaggctgataaattaaaaggagctcatatttatcttgactttccatcagtaggagctactcaaaatcttattcttgctgcgacactagctgacgggacaacgacacttgaaaatgcagcacgtgaaccagaaattgttgacttagcaaacctcctaaataaaatgggagcaaatgttaagggggccggaacagatacaattattattaaaggtgttgaaaaaatgcatggggcaaaccattcagttgttcaagaccgaattgaagcaggaactttcatggttgcggccgcaatgacacaaggtgatgttttaatcaaagatgcgattgctgaacataaccgtccattgatttcaaaacttagcgaaatgggtgttaattttatccaagaagaatctggacttcgagttgttgggcctgaaaaactaaaagcaacaagcgttaagactttaccacacccaggatttcctacagatatgcaatcacaaatgacagctgctcaggccgttgccgtgggagaatcagtgatggtagagacagtatttgaaaatcgtttccaacatttgaaagaaatgcgtcgtataggattggaagttgacattactagaaatacagcgcttattcaaggaaattcaaatttacaaggcgctgcggtaaaatcaacagatttacgggcaagtgccgcattgattcttttgggattggttgccaaagggcaaacaactgttagaagattaagtcatttagaccgaggttactataaattccatgaaaaattaaaagctctgggagctgatattattcgtgtagaagacgaagacggagaaggctaa

SEQ ID NO: 42028 - DNA, 2247 bp, Lactococcus lactis
atgctttgtcaaaattgtaatattaatgaagcgacgattcacctttacacaagtgtaaatggtcagaaaaaacaaattgatttgtgccaaaactgttatcaaattatgaaatctggcggtcaagaagctttatttggcgcaggaaatgcctcaaatggaaattctgatgaaccatttaatccatttaatgatatctttagtgctttgcacggtcaagattttaatggagcagcaagcactcaaactccaccaacacaaacaggtggacgtggtccgcgaggtccacaaaatcctcgggcaaaacaacctaaaggaatgttagaagaatttggaattaacatcacagagtcagctcgtcgtggcgaaattgacccagtgattgggcgtgatgaagaaattaaacgtgtcattgagattttaaatcgtaggactaagaataatcctgtattaattggtgaacctggtgttggtaaaacagcagttgttgaaggtttagcgcaaaaaattgtggacggagatgtgccgcaaaaactacaaaataaagaagtgattcgtcttgatgttgtttctcttgttcaaggaacaggaattcgtggacaatttgaagaacggatgcaaaaattaatggatgaaatcagaaaacgtaatgatgtgattatgtttattgatgaaattcatgaaattgttggtgctggttctgccggtgatggcaatatggatgcaggaaatatcctaaaacctgcgcttgcgcgtggtgagcttcaattggtcggagcaacaacgctcaatgaatatcgcatcattgaaaaagatgctgcgcttgaacgccggatgcaaccagttaaagtcgatgaaccatcagttgatgaaacaattactattttgcgaggcattcaagcacgttatgaagattatcatcatgtgaaatacactgatgaggctattgaagcagccgctcatttgtcaaatcgttacattcaagaccgtttcttaccagataaagccattgaccttttggatgagtctggttctaagaaaaatctaaccttgaaatttgttgatcctgaagatattaatcgtcggattgcggatgcagaaacgaagaaaaatgaagcaacacaggctgaagattttgaaaaagccgctcatttccgtgaccaaatcactaaacttcgtgaattacaaaatcatgaagtttcagatgatgaaattcctgtcatcactgaaaaagatattgaacaaattgttgagcaaaaaacacatattccagttggtgatttgaaagaaaaagaacaaacccaattgattaatttggctgatgatttgaaagcacatgtgattggtcaggatgaagcagtggataagattgctaaagctatccgtcgttctcgtgtgggacttggtaaacctaatcgtccaattggttctttccttttcgttggtccaacaggtgttggtaaaacagaacttgctaaacaattggctaaagaattatttggctcaagtgaaagtatgattcgttttgacatgtcggaatacatggaaaaacattcggtggccaaattgattggagcccctccaggatatgtgggttatgaagaagctggtcaattgactgaacgtgttcgtcgtaatccctacagtttgattttattagatgaaatcgaaaaagcacatccagatgtgatgcacatgttcttgcaaattcttgaagatggacgtctgacagacgcacaaggacggacagtatcctttaaagatagtttgattattatgacttctaatgccggaactggtaaagttgaagcctctgtcggatttggtgctgctcgtgagggacgaactaaatcagtgcttggtcagcttggcgatttctttagccctgaattcatgaaccgttttgacggaataattgaattctctgctttgagcaaagaaaatctccttaaaattgttgatttgatgcttgatgaagtcaacgaacaaattggacgtaatgatattcatcttagtgtcactcaagcagcaaaagaaaaattagttgatttaggttacaatccagcaatgggtgctagaccacttcgtagaacaattcaagaaaatatcgaagattcaattgctgacttctatattgaacaccctgaatacaaagaattggttgctgatttgattgatgataaaattgttatctctaatcaagctcaagaaacagcagaaacgactgatgaagaagttcctgctgaataa

SEQ ID NO: 42029 - DNA, 1014 bp, Lactococcus lactis
atggtagttaaagttggtattaacggttttggtcgtattggacgtttggcattacgtcgaattcaagaagtcgaaggagttgaagttgcgcatatcaacgatttgacagacccagcaatgcttgcacatttgctaaaatatgatacaactcaaggtcgttttaaagggactgttgaagtcaaagaagatggttttgatgtcaacggaaaatttgtgaaagttacggctgaacgtaatccggaagacattcaatgggctgattctggtgttgaaattgtgcttgaagccacaggtttctttgcgactaaagaaaaagctgaaaaacatttgcatcctggtggagctaagaaagttttgattacggcacctggtggaaatgatgttaaaactgttgtcttcaatacaaaccacacaattcttgacggaactgaaacagttatttctgccggttcttgtactacaaatagtttagcaccaatggccgatgccttaaataaaaactttggtgttaaaggtggaacaatgactactgttcactcttatactggtgaccaaatgacccttgatggtccacatcgtggcggagacttccgtcgtgcgcgtgctgctgccgaaaacattgttccagcatcaagtggagcggctaaagcaattggtcttgttttgcctgaactttctggtttgatgaaaggtcatgctcaacgtgtttcaactccaacaggctcaattaccgaacttgttactgtacttgaaaaacacgttacagttgacgaaatcaatgaagcaatgaaagctgccgctgatgaaagctttggctataatgttgatgaaattgtttcatctgatattattggtatggcttacggttcactttttgatgctacattaactgaagtgactgacctaaaagacggtggacaattagttaaaacagctgcttggtatgataatgaaatgagtttcactgctcaattaattcgtactcttgaatattttgcaaaaattgctaaataa

SEQ ID NO: 42030 - DNA, 456 bp, Lactococcus lactis
atgactaaaaaatacgctatgactgctacagaagtgatggaagttattccgaaccgctatcctatcatgtttattgactacgttgatgaaatttctgaaaataaaattgttgcaacgaaaaatgtaacgattaacgaagaagtttttaatggacatttccctggtaatccaactttccctggtgttttgattcttgaatcactcgctcaagctggttcaattttgattctcaaaaaagaagaatttcaaggaaaaatggcttatattggtggaattgataaagcaaaattccgtcaaaaagtcactcctggtgatgtaatgaaacttgaatttgaaattacaaaattccgtggaaaagtaggaactgctgatgccgcagcttatgttgatggtaaaaaagtaaccacttgtcagttcactttcatcgttgatgaagcagctgaacaaacaaactaa

SEQ ID NO: 42031 - DNA, 753 bp, Lactococcus lactis
atgtttttagaaggtaaaaaaattgttatcatgggtgttgctaacaataaatctattgcttggggctgtgctaaagcaatgaaagatcaaggtgcaacattaatttatacttaccaaaatgaacgaatggaaaaacaattagctaaattggctgaaccagaagatttgctcattgaatgtgatgtaacttctgatgaatctattcgccgtgcttttggtacaattgaggcacgtgtcggtaaaattgacggacttgttcatgccattgcttactctaaaaaagaagagcttggtgggaatgttacagatatctctcgcgatggttatgcccttgctcaagatatttcagcttacagcttgcttgctgttgctaaagcagcaaaaccattgcttaaaaaaggttctggtatcgtaactttgacttacatgggttcagttcgtgccattcctaactacaatgttatgggaattgctaaagcagctcttgaatctacagttcgttatcttgctgctgaaatggcacatgtaggtgttcatgtgaacggaatttctgcaggagcaattaaaacacttgcggtttctggagtttcaggttacaaagatttgattaaagaatctgacagccgtacagctgatggtgttggtgtaacaattgatgatgtgggtcaaactgccgctttccttgttagcccacttgcctcaggtgtcattggtgatatcgtttatgttgataaaggtgttcatttaacataa

SEQ ID NO: 42032 - DNA, 1098 bp, Lactococcus lactis
atgatttataattttggcgcaggacccagtgtacttccaaaggaagtcttgaagaaggttcaagaagaactgttagactttgaaaaaagtggtatgtcagtgatggaaatttcgcatcgctccaaggctttccaaaaagtaattgatgaggctgagaacgatttgcgtgatttgatgtcaattcctcaaaactataaaattttgtttttacaagggggagcttccagtcaattttcaatggttccaatgaatttggcaattggcaaaaaggcttattacaatatttcgggcgcctttggtgaaaaggcttatgatgaagcggtgaaattgagtcatttccttgatttgatggcgattagtttgggctcgactaaaaaagataattataatcatctattgaaaattgataaatctaaaattgatgaaaaaaatggggcctatctccatttgacaacgaataatacgattgaaggaacaagtatttttcctgaaaatttgcctgagtttgcaagccttcctttggttgctgatatgagttcaaatattttggcggttgattatgatgtgagtaaatttggattaatttacgctggagctcagaaaaatttaggtattgctggtttaaccattgtcattattcgtgaagacttattgaatgaagctgaaagcctctcatcaatgatggattatcagattttggttgaaaatggctcgatgtacaataccccgccgacttttgctatttatgtggccgggctggttttcaaatgggtaaaagcgcaaggtggcgtaaaaaaactcgaagaaatgaatcagagaaaagctcaattgttgtatgatttaattgaccaatctgacttttatcagaacccaatcaaaaataaagatgagcggtcgatttgcaatgttgtttttacaagtccaagtcaagaattggatgagctattcacccaaaaagctgaagaaaaaggtttcaaatcactcaaaggtcatcgttccgtgggaggaatgagagcaagtatttacaacgcttttcctttagagggggttgttgaattagtgaaatttatgaaagaatttgaagagggatataaatga

SEQ ID NO: 42033 - DNA, 1419 bp, Lactococcus lactis
atggcacaagcaaactttggtgttgtcggaatggctgtaatggggaaaaaccttgcactcaacgtagagtcacgtggttataccgttgcaatttacaaccgtacgacttcaaaaactgaagaagtttataaagaacatcaagataagaatcttgttctcactaaaacacttgaagaatttgttggaagtcttgaaaaaccacgtcgtatcatgctcatggttcaagcaggagcagcgacagatgcgacaattaaatcacttttaccactcttggataaaggcgatatcttgattgatggtggaaatactcatttcccagacacaatgcgtcgtaatgctgaacttgcagactcaggtattaacttcatcggtacaggagtttctggtggtgaaaaaggtgcgcttttaggcccatcaatgatgcctggtggtcaaaaagaagcctacgatttggttgcaccaatttttgaacaaatcgcagctaaagctcctcaagatggtaaaccatgtgtggcttacatgggagcaaacggtgctggacattacgttaaaatggttcacaacggaattgagtacggcgatatgcaattgattgctgaatcttatgatttgttgaaacgtgttcttggtcttagcaatgcagaaattcaagccatttttgaagaatggaatgaaggcgaacttgatagctacctcattgaaatcactaaagaagtattgaaacgtaaagatgatgaaggcgaaggctacatcgttgataaaattcttgataaagcaggaaacaaaggaactggtaaatggacttcagagtctgcccttgaccttggtgtaccacttccattgattacagaatcagtatttgctcgttacatttcaacttataaagatgaacgtgttaaagcaagcaaagttttatctggaccagcggttaatttctcaggcgataaaaaagaagtcattgaaaaaatccgcaaagcgctatatttctcaaaaattatgagttatgctcaaggatttgctcaacttcgtaaagcttctgaagaatttgattgggacttgccttacggtacaattgcacaaatttggcgtgctggatgtatcattcgtgcagaattcctccaaaatattactgatgctttcgacaaagatagcgaacttgaaaacctcttgcttgatgactactttgtagacatcacaaaacgttatcaagaagctgttcgtgatgtagtttcacttgctgttcaagcaggaattccaattccaacattcacatcagcaattagctactacgatagctatcgttctgaaaatcttccagctaacttgattcaagcccaacgtgattacttcggtgctcacacttatgaacgtacagacaaagctggaatcttccactacgactggtacacagaagattaa

SEQ ID NO: 42034 - DNA, 558 bp, Lactococcus lactis
atgttagaaaaaaggagcactgacaattctgtcagtaacaaaaacatggaattaaaagactatattgcaacaattgaaaactatcctaaagaaggcgtagtttttcgcgacatcagccctttgatggcagacggaaatgcctataactatgctgctaccgaaattgttcagtatgcaagagataaagaaatagatatggttgtaggtccagaagcacgtggtttcatcattggatgtccagttgcttttgcacttggtgtaggatttgccccagttcgtaagcctggtaaattacctcgtgaagtcattgaagcaacttacgaaaaagaatacggaacagacacactcacaatgcattcagatagcatcaaaccaggacaacgtgtcttgattgttgatgatttgcttgcaactggtggaacaattgccgctacaattgaacttgttgaaaaaatgggtggaattgttgttggatgtgcattccttatcgaacttgatgaacttaaaggtcgcgaaaaaatcggagattacgattataaagttctaatgcactattaa

SEQ ID NO: 42035 - DNA, 2451 bp, Lactococcus lactis
atgaaatttgaaaatataaaatatacaccaacgcttgaccgaattttagaaaaagcggaagagtatgctcaccaatatcaatatggcaccattgaaagtgctcatttactggctgcaatggcaacgacctcaggttcaattgcatacagcctccttgctggaatgaatgttgattcttctgacttactgattgatttagaggatttatcaagtcatgttaaggtcaaacgttcaactttacgtttttcacctcgtgcagaagaagtgatgactgcggcaagttttttagcaattcataataactcagaagccgttggaacagaacacttgctttatgccctacttcaagtagaagatggatttggtcttcaacttctgaaattacaaaaaatcaatattgtatctttgcgaaaagagcttgagaaaagaactggactcaaagttccagaaagtaaaaaagctgtgactccaatgtcaaaacgcaagatggcaaagggagttgcagaaaattcaacgacgccaacgttagactctgtatcctcagatttaaccgaagaagctcgcttgggtaaacttgacccaatgattggacgagaagctgaaattgaccgtttgattcatattctcagccgcagaacaaaaaataatcctgtcttagttggagagcccggtgttgggaaatcagcaattattgaaggtttggcccaaagaattgtcaatggtcaagttccaattggtttgatgaatagtcgaattatggctttgaatatggcgactgttgttgctgggacaaaatttagaggtgaatttgaggatcgtttgacagctattgttgaagaagttagcagtgatccagatgtcattattttcattgatgaattacacacaatcatcggtgctggtggcggaatggattctgtcaatgatgccgcaaatattttgaaaccagcgcttgctcgtggtgattttcaaatggtcggagcaacaacctatcatgaatatcaaaaatatattgaaaaagatgaagctttagaacgccgtttggcgagaataaatgttgacgagccaagtccagatgaagcgattgctattttgcaaggcttacgtgaaaaatttgaagactatcatcaagtgaaatttactgaccaagccattaaaagtgctgtaatgctcagtgttcgttatatgactagccgaaaattgcctgacaaagccattgatttacttgatgaagctgcagcagcagtgaaaatttctgtcaaaaatcaacaaacaaaacgtcttgatttagaaaaagaattaacggaagctcaagaagaattatcagaagctgtcattaaacttgatatcaaagcgtctcgtacaaaagaaaaagcagttgaaaaaattgctgacaagatttataaattctcagtaaaagaagataaacgtcaagaagttactgaccaagctgttgttgctgttgcctcaacactgacaggtgttccaatcacacaaatgactaagtctgaaagtgatcgtttaatcaatcttgaaaaagaattacataaacgagttgttggacaagaagaagctatttctgccgtttcaagagccattcgtcgggcacgttccggtgttgctgacagccgtcgtccaatgggttctttcatgttccttggaccaacaggggtcggtaaaaccgaacttgctaaagcactggctgacagtgtgtttggtagtgaagataatatgattcgtgttgacatgagtgaattcatggaaaaacattcgacttcacgcttgattggagctcctccagggtatgtaggttatgatgagggtggtcaattgacagaacgcgttcgtaataaaccttattctgttgttcttttagatgaagtcgaaaaagctcatcctgacgttttcaacatcatgttgcaaattctagatgatggctttgtgactgatactaaaggtcgtaaagttgatttcagaaatacaattattatcatgacttcaaacttgggagcgactgctcttcgtgatgataagacagttggttttggcgctaaaaatatcacagctgattattcagccatgaaatcaagaatattagaagagcttaaacgtcattatcgtcctgagtttcttaatcgaattgatgaaaatattgttttccactcattggaaagtcaagagattgaacaaattgttaaaattatgagtaaatctttgattaaacgtctggcagaacaagatattcatgttaaactcacaccgtcagcggtgaaattaattgctgaggtaggttttgacccagaatatggtgcacgtccgctccgcaaggctcttcaaaaagaagttgaagaccttttaagtgaacaattgctctctggtgaaatcaaagcaggtaatcatgtttcaattggggcatctaataaaaaaattaaaatcgctcaaattgtttga

SEQ ID NO: 42036 - DNA, 1302 bp, Lactococcus lactis
atgtcaattattactgatatttatgctcgcgaagtccttgactcacgcggtaacccaacacttgaagttgaagtttacactgaagacggtgcattcggtcgcggtatggtaccttcaggtgcttctactggtgaacatgaagcggttgaacttcgtgatggcgacaaatctcgctacaacggacttggtactcaaaaagctgttgacaacgtaaacaacatcatcgctgaagctatcatcggttatgaagttactgaccaacaagctattgaccgtgcaatgatcgctcttgacggtactgaaaacaaaggtaaattgggagctaacgctatccttggtgtttctatcgctgctgctcgtgctgctgctgatgaacttggtgttccactttacaactaccttggcggattcaacgctaaagtattgccaactccaatgatgaacatcatcaatggtggttctcactcagacgctccaatcgctttccaagaattcatgatcgtaccagttggtgcacctacattcaaagaagcgcttcgttggggtgctgaaatcttccacgctcttaagaaaattcttaaagctcgtggacttgaaacagctgtcggtgacgaaggtggattcgctcctaaattcgacggaactgaagacggtgtagaaactatccttaaagcaatcgaagcagctggttacaaagctggtgaagatggcgttatgatcggtttcgactgtgcatcatcagaattctacgaaaacggtgtttacgactacactaaattcgaaggtgaaggcggtaaaaaactttcagcttctgaacaagttgactaccttgaagaactcgtttctaaatacccaatcatcactattgaagatggtatggacgaaaacgactgggatggatggaaaatccttactgaacgtcttggtaaaaaagttcaactcgttggtgacgacttcttcgttacaaacactaaataccttgaacgtggtatccgtgaaaatgcttcaaacgctatcttgatcaaagttaaccaaatcggtactttgacagaaactttcgaagctattgaaatggctaaagaagctggtttcacagcaatcgtttctcaccgttctggtgaaactgaagattcaacaatctcagatatcgctgttgcaactaacgctggtcaaatcaaaactggttcactttcacgtacagaccgtatggctaaatacaaccaattgcttcgtatcgaagaccaattggctgaagtggctcaatacaaaggtcttaaagcattctacaaccttaaaaaataa

SEQ ID NO: 42037 - DNA, 1524 bp, Lactococcus lactis
ttgaaattcaaacacgaacccctaaatttgtatctaaactttaaaaaatcagctgaacagtttcctgatagcccaattatctttgatgaggctgttggagctttccccgaactagctcttgaaacgacttaccaaaagactcatcaagcaattgttgataaggcaagtctcttatctgagttgggaatcaaaaaatcggataaagtcattatttttaaatcaagtgcttttgatacctatcttttagctgttgctgtttcttatctaggcgctgttccagcaatgatttcttatcatcttcctgccgaaacaatggatattttagctggacgtttaggcaatccttggctcatttatgaccaagttactgacaaaactgtaaatgaaatgaagaatcttgaagattctaaaaaactttctgtcagtaaatttgctttggaaaaacctactcaaattgctgacagtcagcaattggccagtgatgagattgcttatctcactcatacttctggaacaactggtgtaccaaaattaatcgctcactctgctaattcaatgggttggcgttgggtgcttcaaagaactgtaatggattggatgcctgataaggaagaaattttagctttccatatttctcctgttcattctcgtttcaatataggggtttcatcagcaatgacctttgggtttggccttatgcccctcaatgatttatcaaaagataatcttgtcaatctttttgctaaacatcagccttatgcttttgaaacacatccaaacgattttgttcgtctagcgaatcttgcaaagcaagaacctgagatttttgcttcaattcgttaccttcactcaacttttgatgcaattaataaagaaacaatgcacacttttctttctgcctctaagcaaaaagatccagtcttcctacaaatttatggacaatcagaatgtggcccaatgatttggaaaaagcaccgtttatcaactttagcagacactaatgcccgtgaaatggggattggtatgcctggattatccaaagcacgtattgccgatgaagatggaaatgaatgtcctgcaggtacgcctggaagaatccacttcctctcaaaaggaagagctttgacttactataaagaagaagaacgttttaataaagaagtctatggtgactggtgggatactggcgattggggtctcatgaatgaagacggaattctctttttacatgacagacaagttgatttaattgataaaattgaatctaatttggcaattgaagatcttctgttagaccaacacgacttcttagatgaagttgtgattattcgtgataaatctggtaaaccacaacctattttggctctagctgaaaatgcggaaatggattggtcagcttggtgggcttcaattgttgatttgccatttttaaatgaacctattcttatggcttacgatgaaattcctcgtacagcaacaatgaaagttcaacgattagctcttgaaagagaattagctaaataa

SEQ ID NO: 42038 - DNA, 3414 bp, Lactococcus lactis
atgaaaaaactactcgtcgccaatcgtggagaaatcgccgttcgtgtctttcgtgcctgtaatgaactcggactttctactgtagccgtctatgcaagagaagatgaatattctgttcatcgctttaaagcagatgaatcttatctaatcggtcaaggaaaaaaaccaattgatgcctatttggatattgatgatatcattcgtgttgcccttgaatcaggagcagatgctattcacccaggttatggcctcttatctgaaaatctcgaatttgctaccaaagttcgcgcagcaggtttagtttttgtgggtcctgaacttcatcatttggatattttcggtgataaaattaaagctaaagcagctgccgacgaagcaaaagttccaggaattcccggaacaaatggagcagtagatatcgacggcgctttagaatttgctaaaacttacggttatccagttatgattaaggccgctttaggcggtggtggtcgcggaatgcgagttgcgagtaatgatgctgaaatgcatgatggttatgctagagcaaaatcagaagcaattggagcttttggttctggcgaaatctatgttgaaaaatatattgaaaatccaaaacatattgaagtccaaattcttggagatagtcatggaaatattattcacctccatgagcgtgactgttcagtacaacgacgtaatcaaaaagtcattgaaattgcgccagccgtgggactttcactggacttccgtaacgaaatatgtgaagcagcagtcaaactttgtaaaaatgttggctatgttaatgctggtacagttgagtttcttgttaaagatgataaattttatttcattgaagtaaatccacgtgttcaagttgaacatacaattacggaacttatcacaggtgtagatattgtccaagctcaaattttgattgctcaaggtaaagacttacatagagaaattggacttccagcacagtctgaaattccacttttgggttcagcaattcaatgtcgaatcacaacagaagatccacaaaatggattcttgccagacacaggtaaaattgatacttaccgttcaccaggtggttttggtgtacgtttagatgtcggaaatgcctatgctggatatgaagtaactccatattttgattcacttttagtaaaagtttgtacttttgccaatgaatttagtgacaccgtaagaaaaatggaccgcgttctccatgaattccgtattcgtggtgtcaaaacaaatattcctttcttgattaatgttattgctaatgaaaacttcacaagtggtcaagcaacaacaacctttattgataatacaccaagtctgttcaacttcccacacttacgtgaccgtggaacaaagacgctgcattatttatcaatgattacagtcaatggcttcccagggattgaaaatactgaaaaacgtcattttgaagaaccacgtcaaccccttcttaatcttgaaaagaaaaagacagccaaaaatatcttagatgaacaaggggctgatgctgttgttgattatgttaaaaatacaaaagaagtattattaacagatacaactttacgtgatgctcaccaatccttgcttgctactcgcttacgtttacaagatatgaaaggaattgcccaagcgattgaccaagggctaccagaacttttctcagctgagatgtggggtggtgcaacctttgatgtggcttatcgtttcttgaatgaatcaccatggtatcgtctgcgtaaactacgtaaactcatgccaaataccatgttccaaatgctcttccgtggttcaaatgcagttggttaccaaaactatccagataatgtgattgaagaatttatccgagtagcggcgcatgaaggtatcgatgttttccgtatctttgatagtcttaactggttaccccaaatggaaaaatccattcaagccgttcgcgataatggaaaaattgcagaagcaacaatttgttatacgggagatatcctagacccaagccgaccaaaatataatattcaatactataaagacttagcaaaagaattagaagcaacaggtgctcatatcttggcagttaaagatatggcaggtttattgaaacctcaagctgcttatcgtttgatttcagaattaaaagataccgttgatttgccaattcatttgcatacacacgatacttcaggaaatggaattattacatattctggtgcaactcaagcaggtgtagacattattgacgtagcaacagcgagtcttgctggcggaacatctcaaccatcaatgcaatctatttactatgcacttgaacatggtcctcgccatgcttcaattaatgtaaaaaatgctgaacaaattgaccattattgggaagatgttcgtaaatattatgcaccatttgaagcgggtattacaagtcctcagacagaagtttacatgcatgaaatgcctggtggtcaatacactaacctaaaatctcaggcagcagcagttggtcttggacatcgttttgatgaaatcaaacaaatgtatcgtaaagttaacatgatgtttggagatattattaaagtaactccttcttcaaaagtagttggagatatggctctctttatgattcaaaatgatttaacagaagaagatgtttatgcgcgtggtaacgaacttaatttcccagaatctgtagtatcattcttccgtggagatttaggacaaccagtgggtggcttcccagaagaattacaaaaaattatcgtgaaagataaagccgtaattactgaccgtccaggcttacacgcagaaaaagttgattttgaaactgttaaagcagacctagaacaaaaaattggctatgaaccaggagatcacgaagttatctcatatatcatgtatccacaagttttccttgattatcaaaaaatgcaaagagaatttggagcagttacactacttgacactcctactttcttacatggaatgcgtctcaatgaaaaaattgaagtacaaattgaaaaaggtaaaacactcagcattcgtttagatgaaataggagaacctgacctagctggaaatcgtgttctcttctttaacctaaatggtcaacgtcgagaagtcgtaattaatgaccaatctgtacaaactcaagttgtggctaaacgcaaagccgaaacaggaaatccaaaccaaattggagctactatgccaggttctgttcttgaaattttagttaaagctggtgacaaagttcaaaaaggtcaagccttgatggttactgaagccatgaaaatggaaacaactattgaagcaccatttgatggcgagattgttgaccttcatgtggttaaaggtgaggcaattcaaactcaagacttgttaatcgaaattaattaa

SEQ ID NO: 42039 - DNA, 1326 bp, Lactococcus lactis
atgaatttattgagtaaagaagaaaaaatgattaaaaattcacaaattcctagtgaattttacaaaaagtacaatgttaaaaaaggtttaagagacattaatgggaaaggagttttagcgggtttaaccaatatttcggcgatacattcttttgataaagaaggaaaccaaattcccggtattttagagtatagagcttataatattaaagatattattaatgatttaagaaaagaaaatcgttttggttttgaagagatgacttatctattgttatttggagaacttcccacggcaaatgaacttcaggaatttcaaaaccttttagccagtaggagaactctaccagaattttttatccgtgaaactattttaaccaacccttcaagtgacgtgatgaattcgatgagccgttgtatactagctcttgctagttacgatgagaaagtttcagatatctcgattgaaaatgttttagaacaatcttttggacttattgctgattttccacttcttgcgatttacagttaccaatcttatgttcattattttaaaaaagaaagtctttatatccattatcctgatccaaaaatgacgaccgctgagaatattttacgaatgcttcgcccagactgccattacacagaggtagaggctaaagtattagatattgccttgattcttcatatggaacatggtggaggtaacaattcgacttttacgactcatgtggtcacctcaagtggaacagatacttatgctacaattgctgctgccctctccagtttgaaagggcctaaacacggtggagctaatattaaggcagcaaaaatgttggaaaatataaaagaaaatatttctaattatgaagatgacgctgaaatagaaaagtatctccataaaatcttaaataaagaagtttttgataagcaaggattaatttatggtattggtcacgccatttatagtttaagcgacccacgatttgaggtttttaaatcctatgtagagactttagtaaaagaaaaaggattggaagaggaattcaaattatatgaaaaagttgcaaggctagctcctaaagtaatatcggaaaatcggaaaatatataaaacaatttgtccaaatgttgatttctactctggctttgtctatagaatattggaaattccacaagaattatttactccattatttgcgattgctagaattgtaggttggttagcacatcgtatagaagaactaattaatatgaataagattatccgtccagcctatgaaagtgtcttagaatcaaaaaattatataaagttgggggaaagatga

SEQ ID NO: 42040 - DNA, 2547 bp, Lactococcus lactis
atgaaaaaaataagtatttctaaaaaaatataccattattatgatatctcagaaactgaaagaattgaagattttccatatagtttacgagttcttttagaaagtttgattagacagaaaaatgacgagaatatcaatcaggctcatattcaatccgttaaagactatttaaaaggggaagttggtcaagaaacagttttcttaccaagtcgtgttgttcttcaggatttcacaggagttccagctattgttgaccttgcagcaatgagagacgcaatggttgaattaggaaagaatcctgaattaattaacccagaaattccagtggatttggtaattgaccattctgttcaagtggattttcaaggaaatgaagaggcttttctgctaaattcaaaaaaagaatttgaacgtaatcgtgaacgttacgaatttttaaaatgggcagagcaatcttttgataattttagagtagtccctccagcaacaggtattattcatcaagttaatattgaatatttaagtgaagtaattaccgaaaaaaatggcgttttatatccagatagtgtttttggtacagatagtcatacaacaatgattaatgcccttggtgttcttggttggggagtaggaggaattgaagcagaagcagtgatgctaggagagcctagttcattgactgttccagaagtagtaggagttagattaataggtaagttaggagcatttgctactgcaacagatttagctttgacaatcacaaaaattttacgagatgaaaaagtggtaggaaaattcgttgatttttttggagaaggactaaaaaatttaagtttagcagatagagcgacaatttcaaatatggctcctgagtatggtgccacatgtggatattttccgattgataatgaaactttgaaatatcttcgggcgacaaatcgttctgaggaagtggttgcgcgagtagaaacctatgcaaaggcaaataagttattttatgacgaaaaacgtgaaccatactataataagacgattaatgttgatttaagtgaagtagcaacacgattatcaggtccctctcgtccccaagatatgcttgaattgtctgagctagcaaataactttgaagactttgctaaaaaacaaaaacctctgaaagaagaggatggaaaaattgcaattgccgctattacaagttgtaccaatacgagtaatccacatgttatgatgatggcgggattacttgcaaaaaatgcagtagaacaaggccttacggttcctagctgggttaaaacttcattagctcctggttcaaaagttgttacctcttatttagagaaagcgggtctccttccttatcttgaaacgttgggattttatgtagtaggatatggctgtacaacctgtataggtaactcagggccacttttaagtgaaatggaaacagagattagaaataaagaactgattgcaacgagtgttttgagtggcaatcgaaattttgaaggtcgaattcatccattagtgaaggcgaactatctagcaagtcctccattagtagttgcgtatgctttagcgtgttctgttcgtaaaaatttaacaactggtgctctggggactaatctagaaggtgaaaaggtatatttgaaagatattctgccaacttctgatgaagtgaatgatttagtgcaaaaatacgtaacaagtgatttatatgctgaaagttatgctaaggtttttgatgaaaatacagtctggaataatatcaaaacaaagaaaagtgaagtttatgactggaaatctgaatctacctatatttctaatccaccatattttgaaaacttaactatgataaataaaccgatagcttcactgtcaaatttacatgttttagcaaaatttggtgattctatcacaactcaccatattagtccagcagggaatattcctttaaaatccccagctggggattatctaagttctcgaggacttgcttataaggattttaatagttttggttcaagacgcggaaatgataaagtaatgacaaggggaacatttgctaatatccgtatcaaaaatcagcttgttgctcctcttgagggaggttattctctattcaataatgaaacattacctatttatgaggtagctaaaaaatataaagaacaaggacaaggattaattgttcttgctggtaaggattatggaatgggttccagtcgagactgggcggccaagggaacaaaattacttggagtcaaggctgtaattgctgagagttttgaacgtattcatcgaagtaatctcgtcatgatgggtgttcttcccctacagtttctagataatgaaaatgccgaaactttaggattaagtggttatgaaagtttttctatagagctaccagaaaatcccaaaattcatgaaaaaattactgtaagtactgccgaaaaaaactttgaggttcttttacgctttgattctcaggcggatttagattactatgctaatgacggtataatgccttatgtgattcggaaaaaataa

SEQ ID NO: 42041 - DNA, 1239 bp, Lactococcus lactis
atgaaaattgagatgaaaaatggaaaattagttgtgccagattatccagcaattggttatattagaggagatggtgttggcgaagatatttttcctcaggcgcaaaaagtttttgatgctgcggttctaaaaatttatggtcaaaaaaagaaaatagaatggcaaaaattattggcaggaggagaagcatttgagacttgtggagaatatctgcccaaagaaactctcgctcatattaatgaaaatttaattgcgataaagggaccactaatgaccccggtcggtgaaagctttcgttcaattaatgttactttaagacaaaaaatggatttatatgcttgcgtaagaccagttgaatattttaaagggataaaatccccagttaaggcgccagaaaaagttgacatgacaatttttcgagaaaatacagaagatatttatgcaggtattgaatttgctagtgaaacaaatgagtctcacaacttattaaaatttttagaaaaagaattgaatgtccattctattcgctttccaaaaacttcagcactaggaataaaacctgttagtcctgaaggaagtaaacgactggttaatgcggcttttgagtacgctctgaaaatgaacaaaaaaagagtgacctttgttcataagggaaatattatgaaatttactgaaggaggatttagaaattgggcctatgaggttgctagggaatatccaacttttacaaaactagaatacgatgaaatcaaaaatgaaagaggaagtttacaagctgaaaatgagaaaaaagcagcattaaaatcaggaaaaatttatgtagatgatgtaattgctgacaacttcctccaacagattattttaaatcctgaaaattttgaagtaattgccactcttaatttaaatggtgattatatttcagatgcacttgccgcacaggttggaggaattggaattgcaccaggagcgaatattaattataaaagcggtcatgctatttttgaagcaactcatggaacagctccagatatcgctggaaaaaatatagcaaatccttctagtctaattttatctggagtgatgatgtttgagtatttaggctggcaagaggtagctgaattaatcaaaattgctctttcattttcattcaggaatggaaatttgacagctgatttaggtggaaaactttcaacttcaaaattttccgacgttttaattgattttataaaaacatattaa

SEQ ID NO: 42042 - DNA, 2757 bp, Lactococcus lactis
atgaaattttatcaaaaatccaaagaagaattattacatagttatgatgttaagatagataggggactttcgagtactcaggttactgataatcgagaaagatatggtgaaaataaacttccagaagaaaaggaagaaagctatttaaaagtattttttaaaagttttaaagaaccaataatcattgttttattaggggcagtcgctctatcattttttagttcattttattcattccaaatagttggagataaaaaacatggtttagaatctttatatgaagcgattgctatagctattttgattattataaatgcatttttaggtttttggcaagaaatcagtgctcgtaaaaatttaaattcactaaaagaaatgaacaatcgttttgcatctgtactaagagatggagccttagaaaaaatttcatcaaatgagctagttgttggtgatatcgtaaaagttacagtaggtgattttgtggaggccgatataagatggttagagcttgatgaacttcaattaattgagtctcatttaacgggtgaagctgatgctataataaaaaatatagaggtcattaatgaaaacgtcgaaattggtgatcaaacgaatatgggattttctggctctatcgtttcaaatggacagggaattggaatagtcgtagccacgggagaaaacacagaacttgggaaaatttctcagttgatgaaagatgagggaataaaatcatctccattacaagaaaccgtaaaaaaacttactaaaacactgatgaaaatatccgctgggattgttttattaacttttgtatttggattaatcagttctggagaattttcaattaactcaattacttcagtattttcaacctcaatcgctctcgcagttgcctctattccagatgctttaccagttgttctctcaatagtattgacaatcggtgcagtcaaaatgtcaaaaaataaaggtctgattaaaacactaagtagtgtggagactttagggagtacttcttacatctgttctgataaaacaggtacattgacccaaaatgagatgaccgttacaaaattttatgctaatggtcaactgtataatgtggatggtctgggatatagttccattggtgaaattcacttgatagcaaaaggtgaaaaaaatataaattttgctcaatttatgaaaaatatcgttttgtgtaatgattcaagtgtcaaagaagttgaggggcaagtaaaaacttttggtaatcctacagaagttgctcttaccgttcttggtagtaaagccggctatagcaagaataagctattaaaaaacaacaaaattattagaactcttccttttagtagcagtagaaaaatgatgagcgtcattgttcaaaatgatgaaggattctacgtttataccaaaggagcaccagatgttttaatggaaaaagcttcggggattttgattggagatatagttgaccaatctgagcagtcaaaagataactttattaaagtggtagatgattatgcggatgaagcactaagaaccttggctgtggcctacaaaaaagttgatgaagaagaggcattatacggagccacggaagacgtagaaaaagattttatattaaccggagttgcaggaataattgatcctccacgagaagaagtgaaagaatctatcagacaacttcatgatgcaaatattaatgtggttatgattacaggggatcatgaaaaaacagctcgtgcgattgcctatgatttggggattgtaaaagaaaaaaatgcaacagttttaaagggaattgaccttgaagaaatgtcagatcagaagctttatgcagaagtaaaaaatgttaatgtttatgcaagagtgacaccagagcataagcaacgtattgttaaacagctccaaaatcatcaacaagttgttgctatgaccggagacggagtaaatgatgctccagctttaagagctgctgatattggagtggcgatgggaattactggtacagaagtaactaaagattctgcagatctcattttactagatgataaatttacaacgatagaaaaatcagtttatagcggtcgtactatctatgctaatataaaaaactttatgagacacgaactgacaacaaatgttgctgaagttttggcccttgtattaggtttagttttatttagaagtagtgttggaaatgtagcagcaatgactccgacattgactgctttaatggttctttgggttaatatggtgagtgatgcgattccatctttttctttgggttatgatgttgccgaaacagatttgatgaaagaaaaaccacggaaccctaatgaatctattcttgctaaccacacgtggtctagggttttgattaggggaacagttatgggaacgatggtttatcttggatttctcctggctgctcaaaatggattgaacgctagtgaagcacaaacagttgcttttctgactttagtttatggacaattatggcatgtatttgatgcaagaagttcaagaacattgtttagacgtaatccttttgggaatattagacttgttggagcagtgttatttgcaggagtttcttcatttttagtaacaatcattccgtttttcaatagtgtgatgggaactgctcagttaacattacctgtatatctacttgtgatttttattcctgctctacctacattaatattgtcaggaataaaagaagtttttaaaataaaaatatggtaa

SEQ ID NO: 42043 - DNA, 1143 bp, Lactococcus lactis
atggcaattgaaatgcttggtcttattcttgctggtggtcaagggacgcgtttaggtaaattgacaaaagatgttgcaaaacctgctgttccttttggaggtcgttatcgtatcattgattttgccttatcaaattgtgcaaattccaatgtaaaaaatgttggcgtcattactcagtatcaacctttaactctaaatgctcatattggaaatggagcaccatgggggttaaatggaatcaatagtggagtcactattctccaaccctattcttcacaagaaggttctaaatggtttgaaggaacctctcacgctgtttatcaaaatatctcttatattgaccagcaaaatccagaatatgttctcattctctcgggagatcatatttataaaatggattatgaagccatgttagaaagccataaagaacgtgaagctagtttaacagtttcggtgatggaagttccgcttgaagaagcaagccgttttggaattatgaataccgatgataatgaccgaattattgaatttgaagaaaaacctaaagaaccaaaatcaaaccttgcttcaatgggaatctatattttcaattggaaaaggcttcgcgaagttcttgtgaacggttactcgaaaggaaatccaatggaagatttcggtggggatgttatcccggcttatattgaagctggagaaaatgtgtttgcttaccgctttaagggatattggaaagacgttgggaccattgattctcttcatcaatccagtatggaatttcttgatttaaataatgaattaaatattacagataaatcttggcgaatttattcacataatgatatttcagctccacagtttatcacagaaaaatccaatgtaaaaaatgcacttgttggtgatggctgttacgttgatggaacagttcttcattcaatcctttcacagaatgtccatgttcaagaaggaacagtgattgaggacagtttcattatgtctgggacatttattggggaaaacgttacaatcaaaaatgcaatcattggtgaaaatgcaaaaattggtgataatgtagaaataatcggtgaaaatgaagtcgcagtgattggtcacggagaaattaaaggagaaaataaaaatgaacaatag

SEQ ID NO: 42044 - DNA, 1140 bp, Lactococcus lactis
atgaacaatagtaataaaatggcagcaatcctctcaaatatttcttcaagcaaacacttaagccccttaacagaggttcgtccgattgctactcttccttttgattgtaaatatcatttgattgattttccattgtcatcattatcaaatgcccatgtagataatatttttatgacctttaatgaaggagaaacgcaatctgtttttgaccatctaggttcaggtggcgaatggggcttggatggctttaatagtcgttactttgtctatattcaacaagattttgaccgtttaagggaacaaggtaaggattattttgctcaacagttaaattttttgcgtaaatctaaagcaccatatacagttcttttgggcagtaaatttatttgtaatgtcgatttaacggctgttcttaaaatacataaattggcaggtaaggaaataaccaccgtttataaaaaagtttctccagatttagcaagtgaatatgatacaattcttcgttttgatgaatcagggaaaatgagtaactgttatgttaatcaattagaaaatccccaagaaaaagaagccctttgtttgaatctctttatcgtgaacaccgattggttgattaattttataaaagagatgcaagatataggagaattgacttcaattgcccgtctcattcgtgtttatatgaagaactatgatgtgaatacttatgaatacacaggttatatgagtaatatcactaatattaagtcattttatgatgccaatatggtcatgctcgacccccaaaattttacctctcttttatatagtagccaacctgtttatactaagattaagaatgaagttcccacttatttttctgagaatagtaaagtggagaatagtcaattaggttctggttgtattatcaatggtaaagtaaaaaattctctcatttctcgtggagttaagattcaagatgatgccttaattgaagaatcattagtttttaccaactctgaagttaaaagtggcgctcaagttaaatttgccatcattgataaaggagtggttgtcgaaaataatgtcaaaattattggtagttcagaaaaaccagtagtgattcctaaaggaacagttgtgaccgcagatatcttatag

SEQ ID NO: 42045 - DNA, 1452 bp, Lactococcus lactis
atgaaagagagaaaaatgaaagttttatttgcatcgagtgaatgtgcccccttttttaagacgggaggacttggagatgtagctggagcactgcccaaagaattggctaaaaaaagtgaaatagattcagttgctgtgatccttccttattttaagaatgaaatgaaagaagaatatcgttcacttttaaaagatgaattttatgattttgttgatgttggttggcggcacgaatatgttggagttaaaagtctagaaaaagagggtgtgaagtattattttctagataatgaacattattttggtagggggcaactctatggttatggcgatgatggagagcgctttgccttttttgacttggctctttgccaactcttagaaaagttagatttcattccagatgttttgcatgtcaatgattggcagactgcaatggttccctttttacttaaagaaaaatacaactggattaaggcctatgaaaaaattaaaacagtactgaccattcataatattgaatttcaaggcttgatgcatggagatgctttaagtgagctttttggtatgggaatggagcgctattttgaaggagtggtccgtcataatggtatgctaaatatgttaaaaacaggaattttatatgcggatcgggttaatacagtttcgccaacttacgctaaggaaatccagacctcagaatttggttgtggtttagaatcgattttgcaatatgtagatggaaaagtttctggaattttaaatgggatagattatgatatttataatcccgaaaatgatatattaattccttaccatttcagcgaggaagagctttctggtaaaggtcaaatgaaagcagagctccaaaagcgaacaggattaccattgaatccaaatgttccattgattgggatggtttcccgtttaacgaatcaaaaaggatttgatttagttttgagtcagttggaaaaagtattggaagaaaatgtgcaaattgtcctattaggaacaggtttccctgaaattgaagaaggttttagatatttttctcaaaaatatccagataagttgtcagcaaatattgcatttgacattcaatttgcacaggaaatttatgctggttctgatttcttcttgatgccatctgcttttgaaccttgtggcctatcacagatgattgcaatgagatatggaactttaccaatcgttcatgaaattggtggtttgaaagatactgtgattccatttaatcctattagcaaagaaggaacaggatttggttttgttgattttgaaggacagattttagtggagacgattaatcgtgcacttgaagtttatggaaaagaaccagaagtcttaaataaaatggttttatcagcaatgagtaaagatttttcttggggaacgaaggctcagcaatacattgaactctatcaagaattataa

SEQ ID NO: 42046 - DNA, 2403 bp, Lactococcus lactis
ttgaaactttctaaaaaacaatttaagcaagatttcgaagagcgtctaacttcaaaatttgcgactgacctgacaaaagcaggttatcaagaaatttatgatgcattggcatctgttgtgaaacattactatgctaatatttgggtagccgataatcaatataaggatgaaactggaaaaaaacaagcatattatttttcgattgaatttttaccaggaaaaatgcttaaatcaaatttacttaacttgggtattttaaataccgttcgagaagggttaaatgattttggaattgaactggatgaggttgctaagatagaaccagatatggccattggaaatggaggtttggggcgcttagctagctgtttcatggattctttagcttcaacggggcttccaggaaatggaaatggcattcgctatcggtatggattattcaaacaaaaaatagtagatggttaccaagtagaattacctgattcttggctaaataatgggaatccttgggaagtacgtagagcagacaaagcagttgaagtaacatttggtggtgaagtttggttagaagatgatggaaaaggaaatcttattcctcattataaggaccaggaacgtgttctagctgttccatatgatacgcccatggttggttttgaaaatacaacggtcaataatatgtgtctgtggcgctcagaagtgccagaggaattagaccctaaatttcaaaatttggattatatgcgacaaacttcgatgctctctgctgaactttatccagatgattctaattatgatgggcgacttttacgtttgaagcaagaatatttctttgtttctgctggacttcaacgaattttgcatcactataaaggaacacaaaaaaaagatattcgaaaaattggggattatattgctgtccatattaatgatacgcatcctgcactttgtgttccagaattcatgcgccttttagttgatgaatatggtgtgggctggaatcgagcttgggatacaacccttaaggtaatgtcttataccaatcatacaattttatcggaagctttggaaaagtggccagaagagatgattaaacaacttttgccccgaatttatcaaattattgtggaaattgaccggagacgtacggctgagttgcttcctaaggtgggtgcaacgctggtgcataatacgagaattatcaaagatggacaaattcatatggccaacttgtcaatcattggttcacattcaaccaatggcgtagccaaattgcattctgatttattaaaggatgttgaacttcatgatttctatgaaatttatcctgaacgttttaataataagacaaatggaattgctgaccgtcgttggattcagattgcaaatgaacgcttgtctggaattattgatgaaacaattggtaaatcatggcgtcatgatttagatgaattgaagctgctgaaaaattttaacaatgatgaaaaaacacttgaacaacttcaaaaagctaaatttgatgacaagctacgattggctgcggtgattaaagaacaaaaaggaattacggttaatcctgatgcgatttttgatgttcaagtaaaacggctgcatgcttataagcgacaattgttaaatgctttgcatattctaaaattatattttgatttgaaagataatccggaattagataggattcctcgagtatttattttcggggcaaaagcggctccttcatatcattatgctaaatctatcattaaagtaattaacgaaatagcaaatatgattaataatgatcaaacgattaaggataaactcaaagttgtctttatggaaaattataatgtaagtttggcggaagtgattatcccagcagccaatgttggagaacaaatttctttggcctctaaagaagcatctggaacttcaaatatgaagtttatgctaaatggtgctttaaccattggaacacttgatggcgcaaatattgaaatttttgaagccgcaggggatggaaataattttgtttttgggctgactaaggatgaagtttatgaatattatcgcaatggtaattataatgcgcgtgatatttatgagcaaaatccagtagttaatcgaattttgaatgccttaattgatggaacggtgccaaatattaaaagtgaaggtcgtgaaatttttgattcgctcaccgtctataatgatgaatattttgtacttcgtgattttaatgattatgttcgggcacaagctgaacttgaaaaactttaccgtgaccaaaaagcatggactcaagcaagtttaatgaatattgccaatgtgggacgttttagttctgaccgaacagttagggaatatgctgatgacatttggtatataaaggctaaaaaagaatga

SEQ ID NO: 42047 - DNA, 1803 bp, Lactococcus lactis
atgtattattataatccgtggaatttagattataaacaaccttttggggccatcaaggttggaaactcaatgagcttgagatttgcaactgaccaaccttctgtacttgtgacatgtgtaattcgacgtgattttggaaaacgttatgaattttctatgaccaaagattcaggcggagattttagacttaccattccttttgatgaagagccaggactttatttttatcattttgaaatagtcgagtcttcggatttgggagaaactaggcgattttatggttgttctggcataggaggagaggggcttctatatactgatgaaaatgatgttaaaccttatcagctgactgtatttgaaaaagaagatcaagctcccagctggtatcgtgaagcagttttctatcaaattttcccagatcgtttctataatggaaatgaaaatggtcaaatcaatcacccaaaacccaattcatttatctatggaagaaaaacggataatcctttctatgttaaagaagaaaatggtgatattgcacgttgggattttttcggtggaaatttaagaggaattattaaaaaaattccctacttaaaagaactgggaatcaatgcgatttatcttaatccaattttttctggtacaagtaaccatcgctatgatacgaatgattacctaaaaattgattcaatgctaggtaggcaggaagattttgaagaattgattcagttgcttcatcaagaaaaaatgcatttgattttggatggtgttttttctcatgtaggaaaaaactcgctttatttcaatattaatggtgattatggcgatgatgagggagcagcaaaaaatcctgattcaccttattttgattggtttaaatttgaaaattatccttttgagtataaatcttggtggggaattaaagatttacctgaaatagacaaagataatgattcttttcgcaattttatttatggtgagaaaaattctgttttagctaaatggaatgccttgggtattgatggttggcgtctggatgttgctgatgaactccctgattcatttattaaaggaattcgagaaaatcttgactcttattcagataagatattgattggtgaaatttgggaagatgcttccaacaaaatttcttatggaaaaagaagaaattatattcttggtggaagtttgcaagctgctatgaattatccgtttcgtgatttaattattaatttattaaatggtcatcgttctagtcaagatgtcgctcatcaattgatgactttgcaagagaattatcctaaagatattttttataataatttaaacaatctagggactcatgatactgaacgaattttgacaatggttggagaaaagaatttgtcagtagcgttagcaatgctttttgtattaccaggaattcattgtatttactatggagatgaagcaggattgtcaggtggcaaagaccctgagaatcgtaaatattttccttgggataacatttcacccaatgtttacaatgtttataaaagttggacgcaaaaacgtctgtcagaaaatagcttgaaatatggagagttttcaactttttttactgacaggttgttaggaatattgcgatatacagattcagaagtttttgttgaactcattaatccgagtgaagatgagcttaatatagaagttcaagaaattacttttttacaaaatctgaaattcttaccagaattaaaaaaattactgacagaaaaagtgattagtggaaaaacaaatttagaattaaagatgaaaatttaa

SEQ ID NO: 42048 - DNA, 1848 bp, Lactococcus lactis
atgtttccgatattggggattctggcagtttttcaattcattgcaattgccggtcaagctttatttctagctactgcgattactaagctttggcaaggaccattattttctcataccattccttgggttttgggcttttttgcttgctttttgagccgtgaaattattaattttggtcgttcaaaggctctggataaacttgcttaccaattagcaacaaaattgcggggggatatgttggataaatttttccgacttggtccagttgctattgctaatttaggctcgggctcagctgcaacaccagtaatcacaggaattgatcaggttgaaaattatattaaattggtcctatccaaagttttaaatatgatgatcatcccaatgttaattttgattccagtgtattttcttgattggcaaagtggaattgtgttaactttgacatttccttttgcaattatttttatgattctattgggatacgcagcacaaggacgtgctgaacgtcaatataaaactttccaatatttatcaaatcactttttagattcattgcgtggaatttctacattgaaatattttggattgtctaaagattactcaaattcaatttataaaacttctgaagactttcgtaaagaaacgatgggcgcattgagaattgctatgctttcaacctttgcccttgatttttttgcaagtctttcggttgctgttgtcgcactttttttgggacttcggttaatgagcggtgatattttactttttccagctttagcggctctaattttagcgccagaatatttccttccactgcgtgattttgcaagtgattatcatgcgacgcttaatggaaaaaatgctttggcagctgttaatgaagttctatcaactgaggaaaatactttgtcagtacttacagaaaaagtaacttggagtgcaaattcacaacttcaactgacagagttaggaaaaatttatgacacagggcgtggaatctcaaatgttattctgtcagtaaatggctttaaaaaaattgccattgtcggaaattcaggttctggtaaatcaacattgctttcaatgctggctggatttctaaaaccaacagctggtgaaattaaactaaatgagcaaagtttgacttctttaactgacgaaaactatcgtcagtcagttcaattcattccacaaaagacttatatttttgcaggaacttttcgtgaaaatttagctttttacgaacctgattctactgatgacgaaatcaaagcagcagcaaaacttgctggtttagaaagtcttatcgatgaaattggtcttgatggacaaattggggccagtggccgtacaatttcagggggacaggctcaacgtgttgcattagccagagcatttttaagtcatacccgcaatattttgtttcttgatgaaccgacagctcatctggacattgaaaccgaattagaaattaaagcaaatattttacctttacttgaaaataaacttgttttcattgctactcatcgtcttcattggctttcatcaatggatttggtcattgtattaaacgagggacaggtcgcaggaattggaactcctgaacaactattatctgaaaatacttactatcaaaaattacttagtcagatgcgtggggttgatgatgacaaaaatttattagacaatgaaacgagcgaatcagtaaaggaccaagaagaaaaagaatctgagaggtcaaacttttcgtcagtaaatgataaatctactgacagctctgtcagccaagctcgtcagataatgggggtcagaaataatgaaattaaaaaatattttgttcggtaa

SEQ ID NO: 42049 - DNA, 1722 bp, Lactococcus lactis
atgaaattaaaaaatattttgttcggtaatgactggatttctccatttttgaaaaaaaatcgttcaggctttattctatctattttcttaggaacgattacaatttcgatggcgggacttttgatgttcagctcaggatatgtcatttctaaatcagcaacaaaaccagaaaatattttaatgatttatgttccagttctctttgtacgtatttttgggattggacgaccagtgatgcattatgtcgaaagattaacttctcataattggattttaaaaatcacaagtctcttacgaaaaaaactctatttgcgactggaaaaaacggccgttacattagcagatcgttaccgtttaggtgacttattgggtgttcttaatgaagatattggaaatctacaagacctctttttgagaacattatttccagttttaattgctggaagtttatcgattgctctaattattgctggaggatttttctcactttggtttgctttaggtttagcgctcttcttaggatttttgattgttatcttgccattaatttctttgaaatttacagtaaaattagatgaagaactcaaaatttatcgcaatcaacttttttctcatttgacagatgatattttaggattacaagattgggtgctttcaggacgaaaagaagattttctgacagcttatcgaggttctgaattatctgctagaaaaattcaagccaaactattagctttcggacgtagaagaaatttatttttacaagttgtctatggcgcattagtgatctatttgatgatttggtcttctggtgccttaagattgggagacgcgcctaattatattgcggcagttagtcttgctgccttccctttatttgatgctttttctcctttgtctgatgcggtggttgaaacgcaacgttatggcgattcaatcattcgtttaaatgacttaccagaccaagacgaagaagttaggactgaggaaattgtttctacagatttagtcatcaataatctccaattttcatttgaagaaaataaaaaaatctttgataattttaatttagaagttaaacaaggagaacatatcgctctattgggacgttcaggtgtgggtaaatcaacacttgccggattaatcagaggagatttagttccccaaagtggaagtattcaattttctggtgttgagccatctaaagctaaaaatgttgaagaaaaaattggtgtcattaatcaatccccttatctttttgcgacaagccttcgttctaatttgactttggcgaaactcaatgccagtgatgctgaaatttgggaagctcttgaattagttggcctccgtaaaatggttgaatcattacctcaaaaacttctgacaccagtagatgaagcgggagaacgattctctggtggagaacgtcaacgcttagccttggcacgggttcttttatcagatgttgatgttgtaattcttgatgaaccaactgtatcacttgacccaatcacagaaaatcaactcttaagtctcttttttgaacagctccgtgataaatcaattatttttattactcatcatttattaggtgttcatcatatggaccgagttctatttttagaaaatggctcgattaaatttgatgggaaacccgcgtcattactggagaataatccaacatttaaggaactttatcaacttgatttaggaaatgaataa

SEQ ID NO: 42050 - DNA, 675 bp, Lactococcus lactis
atgtcaaaagaaaccaaagctcttacgataaaccctcagcttgcagcttttcaagaagaacttcttaaaagctatgacaaggcaaacctatcagcaaaaaagggacaaactttatttgttggctcatcattaatggagatatttcctattgagaagtgggaggaagctggagaagttactttttcacactatatctacaatcgggcggttagagccacgacgacctcatttttattagaacacatagagagtcaaatttttaatttggaaccctcaaaaatctttattaatattggaacgaatgatatcggttttgagattccagaagaagagtttttgaataactatgatcaaattctttctcaaatagaaagtaaattacctcaaacgcaagtttatgtgatgcgctactatccgattaatacggttgattttggtcaagactcagatgaaaaaactttatttgaaacgagaagtaataaaaagtttcaaaaagcttcagataaaataaaaaaacttgcagataaccatcattttcactttattgatgttaatgatggtttatctgatgaaaatggcaatttgaaaaaagaattaacttttgatggagcgcatctaaatccagcgggctatcaacttgtcttagaaaacctcaaagtttatttggaagaataa

SEQ ID NO: 42051 - DNA, 1755 bp, Lactococcus lactis
atggccaatcgtatcgaaggaaaagcggttgacaaaacatccattaaacatttcatcaaattgattcgtgctgcaaagccacgttatcttttctttatcattgggattctagcaggaatcgttggaacactaattcaattacaagtccccaaaatggttcaaccacttgttaatagttttggacatggagtaaacggtggcaaagttgccttagttatcgctctttatattggttcagctgctgtttcggctattgcagcaattgtccttgggatatttggtgaatcagttgtaaaaaatctaaggacgcgtgtctgggataaaatgattcatctgccagtaaaatattttgatgaagttaaaacaggagaaatgagttctcgtttagccaacgataccacccaagttaaaaatttaattgcaaacagtattccacaagcttttacgtctattttacttttggttggttcaattgtcttcatgcttcagatgcaatggcgtttgacccttgccatgattattgctgttccagtagttatgctcattatgttcccgattatgacttttggccaaaaaattgggcgaactagacaagattctttagcaaatttccaagggattgctagtgaatcattatcagaaattcgcttagtaaaatcttcaaatgctgaaaaacaagcctctaaaaaagcagaaaatgatgtcaatgccctttataaaattggggtaaaagaagccatctttgatggtttgatgtcaccagttatgatgttatcaatgatgctgatgatctttggacttcttgcttacggaatttatctcatctcaacaggagtcatgagtcttgggactttgcttggaatgatgatgtatttgatgaacttaatcggcgccgtaccaactgtggcaactttctttacagaacttgctaaagcttcaggatcaacaggtcgtttgaccgaattacttgatgaagaacaagaagtacttcatcaaggagaaagtcttgatttggaaggaaaaaccctctcagctcgccatgttgactttgcttatgatgattctgaacaaattttacgtgatatctcttttgaagctcaacctaattcaattattgcctttgccggaccttcaggtggtggtaaatcaacaattttctctcttttagaacgtttttatcaaccaacggcaggagaaattacaattgatggtcaaccgattgataatatttctttggaaaattggcggagtcaaattggttttgtcagtcaagattcagcaattatggctggaaccattcgtgaaaatttaacttatggacttgaaggagactatacagatgaagacctttggcaagttcttgacttagcttttgcaagaagctttgttgaaaatatgcctgatcaacttaatacggaagttggtgaacgaggtgtgaaaatatctggtggtcaaagacaacgtttagcaattgctcgtgctttcttgagaaatccaaaaatcctgatgcttgatgaagcaacggctagtttagatagtgaatcagaatcaatggttcaaaaggctttagatagtttgatgaaaggtcgcacaacgctcgtaattgcgcatagactttcaacaattgttgatgcggataagatttacttcattgaaaaaggtcaaatcacagggagtggcaaacataatgaacttgttgccacacatccactctatgctaagtatgtttcagaacaattgactgttggtcaataa

SEQ ID NO: 42052 - DNA, 1263 bp, Lactococcus lactis
atggctgaacatttggccccccttattgacaatcaatcacgggttgcgctcctttcagaaaactctgttgaaatggcagtcgttttgtttgccttgctcggtttgtcaaaagaggttcttcttttgaataggcatctgaccgaatacgaactggctgaccaaatcaaggaactcaaaattgacaaagtctttacttcggatttactgacagaaaaagttactgacagcatttctttttcggaaatttggactagtaacccttgccctgtaagtctgtcagcagattttcctgatgaaaaaattgcagtcatcatgaacacttccgctactaccggaaaatttaaatctgtccctattacttggggcatgatttcaaatcacgtcaaagcctcaaaggaaacgcttggcgcttatgacaatgataattggcttgtcatcttacctatgtttcatgtctctgggctttccattattatgcgtactttatataatgcaacatcagcgaccgttgttgataaatttgatgaaaaccaacttcttgaaatgatcaattctgggaaaatcaacatggtttcactcgtcccaaccctccttacaagaattgctgacaaattgcatagcaataacttacgtttaattctacttggtggtgaatttattccccaacctttaatcaaaaaatgccaagaattaggtcttcctatttacaaaacttatggaatgactgaaagtttttcacaatctgtcacttttaatattttagatttccctgataaaacaagctctgtcgggcggcctttaccaggtgttgaaattgagattcgtcaagctgaccttgctggcgttggtgaaatttggttaaaatctccgatgttgatgaaagcttacctaggccaaaagccttacggcacagcttttgaaacaggcgatattggttatcttgatacggacggttttctctatctgctcaatcgcagaaaagatatcattatttctggcggtgaaaatatttaccccaaagaaatcgaagatttagtttattctcttcctgaaatcaaggaatgtgcacttgttgctaagccagatgccaagtggggacaagtgccaattctcttcgtttcaggcaatatttcccaagaaaaattagaaaactttctcactgaaaaactggcaaaatacaaacgaccacaatccatcactttcatggatgaattgcccaaaaatgcttctggaaaaatcttgagaaaagagcttaaaggatga

SEQ ID NO: 42053 - DNA, 1353 bp, Lactococcus lactis
gtgaaagttgcaaaatttggaggttcgtctctcgcatcagcttcgcaaatcaaaaaagtttttgatattgttcaagccgataaacaaagaaaatttattgtggtttctgcaccaggcaaacgttcgggggctgatactaaagttaccgatgctttgattgcttattataaagcttataaatcagctgatgaaaaaggaattcactattatcagaattggattattgaaagatttcgagaaatctatgatgaacttggcttaaaaagtccagtcattaatcaaatcgcagaaaatatcaaccatttagcccagttagatttagataatgtttttacttatgatacttttttagccgctggtgaaaataataatgctaaattagtcgcagattttttcaatcattctggcttaccaagtcgctatgttcatccatcagatgctggaattatggtttcatctgatcctggaaatgctcgattgcttggtggagcttatgaacatattaaatatcttaatgaacttgaagaaacattaatcatccctggtttttttggaatcacaaaagagggtgaggtttgcactttttcccgtggtggttctgatattactggctcaattattgcggctggtgtgcgagctgaactctatgaaaactttactgatgtgaatggaattttcgctgctcaccctggcatcgttaagaatccagcttatatctctgaattaacttaccgtgaaatgcgagaacttgcttattctggtttttctgttttacatgacgaagcactcgttcctgcctatcgtgcccatgttcctttggtcatcaagaatacaaataaccctgatcatcccggaacaaaaattgttgttcaaagagagactaaaggctcacctgtcgttggaattgcttcatctagtgccttctcttctctttatgtcagtaaatatctgatgaaccgtgaagttggattcggccgaaaagtcctttctgtattggaaaatttaggagttcgttttgagcatatgccaactggtattgatgacatgtctatcattattcgcagccgctatctaactcaacctatttcaaaagcccttatttctaatcttacagaatcgctccatccggatgaagtctatattgaccgtgatttctctattatcaccattgttggtgaagatatgaaagaacacgttggggttaccgctagagcaacggcagcactttctaaacagggcatttcaatcgctatgctttcgcaaggttcaagcgaagtttccgtcatgtttattgtcaaagaaaaatacgaaaaagaagctctaaaagcgatttattcagccttttttgactaa

SEQ ID NO: 42054 - DNA, 669 bp, Lactococcus lactis
atgaaatttaaagcagtgatttttgatatggatggtgttcttgttgacaccgaacgttattatttacaaagaagagaagaattttttggcggtcatggaatttctattagccacttgacgcctagtgattttattggtggaaatatgaaagatatttggccacgaattttgcaagggtcttttgatgaagaaaaagcgagtgaattgcaagaagactatgagcaattcaaagaaaatcatccgatgccttatgcagaacttttattttctgatgtgcctgatattttagaatttttgcgtcaaaaagaagtaaaaattgcacttgcttcaagttcgtcaatgtttgatatcaaacaaatgttagatattcatcaattgaattcttattttgaagtagtggtttcaggaaatgactttaaacaaacgaaaccaaatccagaaatttatcaatcaacaatgaagaaattgggcgtaacaccttctgaaactttaattattgaggattctgaaaaaggaattcaagctggagaagcagctggtgcgaccgtttgggcaattgaagacaaacgctttggcatgaatcaagagaaggctgacttaaaggtagattcactgacagctattcaaaaattactgacagaatcatcactaaagatgataaaggcttaa

SEQ ID NO: 42055 - DNA, 978 bp, Lactococcus lactis
atgacttttgcgaaaattacgcaagtggcacactatgtgcctgaaaatgtggtatctaatgatgacttgtccaaaataatggatactaatgatgaatggatttacagtcggacagggattaaaaatcgccatatttcaactggagagaacacctcagacttagcagctaaagttgctaagcagttgattagcgattcaaatttaagcccagaaacgattgacttcatcattgttgctacagtaactccggactcattgatgccttcaaccgcggcacgggttcaagctcaagtaggagcagttaatgcttttgcttacgatttgactgcggcttgttcaggctttgtctttgctctatcaacagcggaaaaattaatttcctcaggagcatatcaacgagggcttgtcattggcgcagaagtcttttcaaaagtaattgattggtcagaccgatcaactgctgttcttttcggagatggagctgctggtgtgcttattgaagctggcgcgagtcaacctctgattattgctgaaaaaatgcaaacagatggaagtcgtgggaacagtttactttctagttatgctgacatccaaactccatttgcctctgtttcatacgaaagttcaaacttgagtatggaagggcgagcaatttttgattttgccgtacgtgatgttcctaaaaatatccaggcaactttagaaaaagctaatttgtctgctgaagaagtagattattatctccttcatcaagcgaattcaagaatccttgataaaatggctaaaaagcttggtgtgacgcgccaaaagttccttcaaaatatgcaagaatatggtaacacatcggcagcaagtatccctatattgttgtcagaatccgtaaaaaatggtatatttagtttggacggtcaaacaaaagtcgtcttgacaggatttggcggtggcctcacttggggtacagcaattattaatttataa

SEQ ID NO: 42056 - DNA, 222 bp, Lactococcus lactis
atggcagtatttgaaaaagtacaagatattatcgttgacgaactcggtaaagaaaaagaagaagtaacactcgaaacttcatttgaagagctcgacgctgattcacttgaccttttccaaatcatcaatgacatcgaagacgaattcgacgttgaagttgatacagaagcagatatgaaaacagttgctgacctcgttaaatacgtagaaaacaacaaataa

SEQ ID NO: 42057 - DNA, 927 bp, Lactococcus lactis
atgactaaaacagcatttttattctcaggtcaaggggcacaaaagcttggaatggcacgtgacttatatgaccaatatgaaacagttaaagcaacttttgatgaagcaagtcaagctttaggatatgatttgcgagctttgattgataatgatgaagaaaaactaaatgaaacaaagtacactcaacctgcaattttaacaacctctgttgctattttacgtttgttaagtgagaatgggattaaacctgaccttgttgctggtcttagtcttggtgaatattctgccttggtagcatcaggaatcattgattttcaagaagcagttaagcttgtagctaaacgtggtcaatatatgacagaagctgcaccgactggttctggtaaaatggtcgctgtaatgaacacagacccagccttgattgaagaaatttgccagaaagcggccgaatttaaaggcggtattgtgagtccagcaaattataacacgcccgcacaaattgttattggtggtgaagttgaggcggttgattatgctgttgagttgctaaaagaagccggagttcgtaaacttattgaattaaaagtttcaggacctttccatacagcaattttaaaaccagcatctgaaaaattggctttggagcttgataaaattgattttagaccttttgaattaccattaatctcaaatacgagtgctaaagtaatggaaaatgatgaagtcaaaggacttttgacgcgtcaagtcatggaaccagttcgtttttatgaatcggttgaaacaatgcaaaaactaggggcgactcgctttattgaagttggtcctgggagagtactttcaggtttcattaaaaaaattgataaaaatgcagaaattgctaatgttgaaaatttagcttcatttgaagctttgattaatcagtaa

SEQ ID NO: 42058 - DNA, 732 bp, Lactococcus lactis
atggaaattaaaaataaaaatgtctttgtgactggttcaacacgtggaattggtaaagcaattgcgcttcaatttgctaaagcgggttctaatctaattattaatggtcgttcagcaatttcagaagaattattagctgaatttacagcctatggtgttaaagcagttggtatttctggtgatatttcaaaatcagaagatgcaaaacaaatggttgcagaagcgattgaaactcttggttcagtagatattttggtaaacaatgcaggaattactcgtgatggtttatctttgaagatgtcagaagaagattttgagtctgttcttaaaatcaacttgactggggctttcaatatgacacaggctgttttgaaaccgatgaccagagctcgttctggagcaattattaatatctcatcagttgttggacttatgggaaatgctgggcaagcaaattatgccgcttcaaaagcaggacttattggtttgacaaaatcaattgctagagaagttgcggcacgaaatgttcgtgtcaatgctgtggctccaggatttattgaatcagatatgactgaagttctttctgataaagttaaagatgcaatgaaggggcaaattccaatgaaacgttttggaatgcctgaagaaattgcaacagcaactcaattcttggctgaacaagaatatatgactggacaagtacttaccattgatggtggagtttcaatgtaa

SEQ ID NO: 42059 - DNA, 1230 bp, Lactococcus lactis
atgacaaatagagttgttatctctggttatggtgtagttagtgcaattggaaatagcccagaagaattttggaacaatcttaaagctggtaaaactggaattggtccaatcactcactttgatgctgaagcaacagggatttctgttgcagcagaagtaaaagaatttccatttgataaatatttccagaaaaaagatgcacgacgcatggatactttctcactttatgcggtttatgcagcacttgatgcaatggaaatgtctggtattacagaagaaaatactaattttgaccgtttgggctgtatcatggcttctgggattggtggacttgaacaatcacaaaaaaattcacaagcaattgtcgctaaaggccctcgtaaaggggtagcaccactctacgttccacttgctattgctaatatggcaactggtaacgttgctttacgtacaggtgctcgtggggtttcgcgtgctgaagtaacggcttgtgcggctggtgctaattcaattggttcagctttccgtgaaatcaaacatggttacgctgatgcaatgattgctggtggtgctgaagcggctatttgtgaacttggaattgcaggttttgctaatttgactgctttgactaaagaaactgaccctgaaaaagcatgtattccattcgataaaaatcgttcaggatttgtaatgggcgaaggttctggtgtattgattttggaaagccttgaacatgcacaagctcgtggcgctaatatcttggctgagattgttggatacggaaatacaaatgatgctttccatatgacaactccttcaggagtgggtgctgaaaatgcgattaaattggctttggaagaagctggtgcaagtccagctgatgttgattacgttaatgcacacggaacttcaacacatgccaatgaagaaactgaaagcaaagcaattcacaatgtaattggcgataaagcttatgtttcatctacaaaagcattgcacggtcatgcacttggtgcaacaggtgcaattgaagcagtggcaactgttcaagcacttttgaatcaatatgcaccagtaaatgctggaacaactgaacttgatgaaggaatgacaattaatgttgttcttggtgaaggtaaacctgctgatattaatcttgcattgtcgcaagactttggtttcggtggacacaatgctgtattggcattcaagaaatggactggagagtaa

SEQ ID NO: 42060 - DNA, 435 bp, Lactococcus lactis
atgactgaagtaaacattaatgtaactgaaattatggaggctttgcctcatcgttatccatttctattagtcgatcgtgtgattgatattgctgaggatgaaattacagcaattaaaaatgtgacgattaatgaagaatttttccaaggacattttccacaatatccagtaatgccaggggttttgattatggaagctctcgcacaagcggctggtgttttagaattatctaaacctgaaaacaaaggaaaacttgttttttatgcgggaatggacaatgttaagtacaaaaaacaagtcactcccggagatcaattggtcttacatgctaaatttatcaaacgtcgtggtccaattgcggttgttgaagcagaagcaactgttgatggaaaattggcggctaaaggaactttgacttttgccttagggcgttag

SEQ ID NO: 42061 - DNA, 1368 bp, Lactococcus lactis
atgtttaataaaattttgattgccaatcgtggcgaaattgctgtaagaattattcgtgcagctcgtgaattaggagtgggtacagttgccatttattcaactgcagaccgcgatgctttacatgttcatttagctgacgaagcaatttgtgtgggcccagctagaagtactgagtcttatcttaatatgaataatattctgtcagctgctgtggcaactggcgcacaagcgattcacccaggttttggattcctttctgagaattcaaaatttgctcgtctttgtgaagaaatgaatattaaatttatcggtccgtcagcaaaagttatggatatgatgggtgataaaatcaatgctcgtgcagaaatgattaaagctggtgttcctgtaacaccgggttctgagggcgaagttcataccactgatgaagcagtaaaaattgctgaagaaattggctatccaatcatgcttaaagcatcagctggtggtggtggtaaaggaattcgtaaggttaataatgttgaggaacttgttccagcatttgaggcagcacaagcggaagcacaagcagcttttggtaatggagccatgttcatcgaacgaatgattttcccagcgcgtcatattgaggttcaaatcttaggagatagtcaaggaaatgtgattcatcttggtgaacgtgattgttcattgcaaagaaataatcaaaaagttcttgaagaatctccgtcagttgcaattggacacactttacgaaatgaaataacagctgcggctgttaaagctgctcagcatgtttcttatgaaaatgcgggaaccattgagttcttacttgatgaatcttctggtaagttttatttcatggaaatgaacacacgtgttcaagttgaacatccggtcacagagtttgtatcaggtgttgatattgtaaaagaacagattcgtgtagccaatggcaatgaattgtctgtcaagcaagaagatgtgacttttagtggacatgcgattgaatgtcgaattaatgcggaaaatcctaaatttaattttgcaccaagtccaggaaaaattactaatcttttcttgccaagtggtggagttggtttgcgggttgatagcgctatgtacagtggttacagtattccgccatattatgatagtatgattgctaaagtcattgttcatggtgaaaatcgttttgaagcactgatgaaaatgcaacgcgcccttcttgaatttgacgttgaaggggtcattacaaatgttgatttccaactagaattaatttctgacccacatgttgtggcaggagattatgatacaagcttcttaggaaatgttttcttaccagaatatcaaaaagaagattaa

SEQ ID NO: 42062 - DNA, 1143 bp, Lactococcus lactis
atgacaagtataaaaacgaaagtaattcatggtggtatttcaacagacaagacaacaggagcagtatctgttccgatttatcaaacgtcaacttataaacaaaacggacttggacaacctaaagaatacgaatattcacgttctggaaatccaacgcgtcatgccttggaagaattaattgcagatttagaaggtggtgttcaaggatttgcatttagttcaggacttgctggaattcatgcggttctttcgctattttctgcaggagatcatatcattttagctgatgatgtttatggtggaactttccgtttgatggataaagtgctgacaaagacagggattatttatgatttagttgatttgagtaatcttgatgacttgaaagcggcttttaaagaagaaacgaaagctatttattttgaaactccttcaaatcctttattaaaagttttggacattaaggaaatttcagcaattgctaaagctcatgatgccttaacactggtggataatacctttgcgacaccgtatttacaacaaccaattgctttaggagctgatattgttttgcattccgcaacgaaatatttaggtggacattcagatgtagtggcaggactagttacaaccaattcaaaagaactcgccagcgaaattggctttttacaaaattcaattggggcggttcttggaccacaagacagctggttagtgcaaagaggtattaaaacacttgcgcttcggatggaggctcattcggcaaatgctcaaaaaattgctgagtttttagaaacttctaaagccgtctcaaaagtttattatccaggtcttaatagccatccggggcatgaaattgctaaaaaacaaatgtctgcctttggagggatgatttcatttgaattaacggatgaaaatgccgtcaaagattttgttgaaaacttgagctattttacgttggctgaatcactaggtggcgttgaatctttaattgaagtgccagcagtgatgactcatgcttctattccaaaagaacttcgtgaagaaattgggattaaggatggcctaattcgtctatcagtaggggttgaagcaattgaagatttactgacagatatcaaagaagcacttgaaaaaaaataa

SEQ ID NO: 42063 - DNA, 1005 bp, Lactococcus lactis
ttgagaagattctcatctaaatattataccaaaaaacctctaaaatcgcattgtctgattaagtttgttataattatcatagaaaagttaagaattcctttaagtcacagctctttggaaattcttttaaaaaataaaggaacgattatgaactataaatttatctcatggaatattgactcactcaatgctgcattgactggaacctcagaacgtgctgccctttctcttgctgttgttaaaaatcttgcccaagcacaaccagacgttttagccattcaagaaaccaaacttccttctactggacctaaaaaagctcatttggaagttttggaagaactgtttaaaggttataaaatcgtctggcgttcatcagtagagcctgctcgtaaaggatattctggaacaatgattctttataaagaaactctaccagaaccagtcatcacttttcctgaaattgatgctcctgaacctatggatgccgaaggtcgaatcatcacccttgaatttcctgatttctttgtcactacggtttatacaccaaatgcgcaagaaggcctgacacgacttgatttacgtggaatttgggatgataactatcgtaactatctcacaagccttgatgctcaaaaacctgtctttgcttgtggagatttcaatgcggcctatacagaaattgacttagccaatccccgtggtaatcacaactcagctggatttactgaccaagaacgtgaaaaatttggtcaacttttagaggctggatttactgatacctttcgtcaactccatggtcaagttgagaaattttatgaagaaggacgtagtatttatacttggtttgcccaacgtgcaaaaacttcaaaactaaataattcaggttggagaattgactactggctggtttccaatcgtcttgcccaagcagttaaagtttctgaaccccttgattctggtgaacgtttagaccacgtccccattctcttagaatttgaactctaa

SEQ ID NO: 42064 - DNA, 732 bp, Lactococcus lactis
atgaaattttctgggaaaaaagtgctaattacaggtgctgccagtggtattggcttggctcaaacaaaagtatttttagccgaaggcgcagaggttgttgctgtggacttacaagaatttactgacgaatctatcattaattcaaaaaatctgtcagtaaaaattcttgatgtttccgatgctcaatcagttgaaaaattagctgacgaagtgggaagtattgatgttttactcaatacagcgggcgttttggatgcttataaaactttggaagaaactgactttgcagaatggcaacgaattttatcaacgaatctcaattcgatgtatttgatgatttcagcattcttgccaaaaatgaaagctcaaaaatcaggagtaattatcaatatggcttcggttgctggcttgattgccggtggtggtggcgtcgcttatacgaccagtaaacatgccattgttgggttgacaaaacagttagctttggatgaagcgcaacacgggattcaagtagcagccatcgctccaggtgccatcaatacaccgatgaatgcggctgatttcactgaaaataatggtcagatggcccaatgggtagctgatgagacaccagctaaacgatgggctagtcctcgcgaagtggctgatttgaccctctttttagcaagtccacaagcctcttatatgtcaggagcaattgtcccaattgatggtggctggacaatcaaataa

SEQ ID NO: 42065 - DNA, 1023 bp, Lactococcus lactis
atgaaaaaagtagcaattgtcggaattagaggttatagcggcttagaactgttccgaattttctattatcatccagaagtagaagtaacaaaaatatatgcaacaagtcattatggagaaaaattatcagaacactttccgcaacttgaaggcttgactgacttgactatcagtgaatttaatgaagaagaaattatggcagaatgtgatgcagttttctttgcaacctcagcgggtgttagtcaaaaattagctttaacgtttattgataataattttcctgtcattgatttatcaggagattttcgattagctgatttagaaatatacaataaatggtataaaaatacaaatttaaaaaatgaatatttattaagcggtcaatataatctggcagacattggtcaagcaaaagctaactatatagcgaatccaggttgctatgcaacagccacactacttgcactttatccgttagttaaaaataagatgattgatttagactcaatcattgtggatgccaagtcaggactttcgggagccggaaaaggtctgtctgacgcgagtcattttgtgaatgttgtcgataatatgtccatgtataaaatcaatagtcatcaacatattccagaaattgctcaacaattgaagatttggaattcaaattttcaagccttgcaattttcaacttctttaattcctgtgagtcgagggatttttgttagtagctatgcaaaagttgcagctgattttgattttgaaacgataaaaaatgcttatgaacaggtctatgcgacaaaaaactttgtcagaattcgacgacaaatgccccacctctcagatgtgattgggaccaatttttgcgatattggattagcttataatccagtgacaaatgttttgtcagttgtttcggtgattgacaatcttatgaaaggggctgccggacaagcagtacaaaattttaatcagttatttggctacgatgaaagtttaggcttgaaatttatgccaagtctttag

SEQ ID NO: 42066 - DNA, 1191 bp, Lactococcus lactis
atgaaagaaataaaagggacaattgcaagtccaaagggatttttggcagatgctgttcatgcacaattaaaatataaaaacttagatttagggttaatactaagtcaagttccagctgcgattgctggcgtttttacaaccaataaagtttgtgcagcgccagtattgattgaccgtcaaattgtcaaaaaaggacaagcacgggccattatttgtaattcggcggttgccaatgcagtaacaggcgagcagggttatgcaaatgctttgaaaacacaaaaattgcttgctgaaaaatttgaactcaaagctgaggaagtggcggtttgctcaacaggggtcattggagtacagcttccgatggaaaaaattgccacaggaatttcaaagttatcccaaaatgaagggacagcagcatattttgccaaagccattttaacaacagatacccaaactaaaacaattaactttgaagctgaaattgggggtcaaatcgtgaatatggccggggtttgtaagggatcggggatgattcatccaaatatggcaaccatgcttgcttttattacgacggatgcaaaaattgctcaagctttactacaaaaaacattatcagaaattattgaaacgacatttaatcagattacagtggatggagatacttcaacgaacgatactgttttgttgatggcaaatggccaagctaaaaataatgaaattttagaaggaagttcagactatcttttgtttaaagaaatgctggcaaaggtttgtcagtccttagccaaacaaatcgccgctgatggtgaaggtgcaactaaactgattgaagtgaccgtcaaaggagcgccaaatgatttaacagcgcgatttattgccaaaaaaattgtgggttcaagtttagttaaaacggcaatttttggtgcagaccctaactgggggcggattatttcgtcaattggtcaggtggctaattttgaagtttctgatattgaattaaaacttcaagatgaacttgtgctttatcattcaacaccagttgactttgatgcagcttttctttctgagaaattaaaagaagataaaattgaaattattgctgacttgaatgctggaagtggcttgggtcaggcttggggctgtgatttgacttataaatatgtcgaaattaatgctttatatacaagttaa

SEQ ID NO: 42067 - DNA, 1134 bp, Lactococcus lactis
atgacaaatttatttgaaaattatggtcgcctaccatttagcttaatcaaaggagaagatcaatatttatttgatgacaggggaaataagtatttagatttcacaagtgggattggggtcatgaatttaggatatagttttgaaaagggaaaagtggcggtgaaagctcaattagacagcctgtctcatctttcaaatctttatcaaaatcctttgcaagaagatgtggctgaaaagttaagtcaaaatcattcatataaagcttttttttgtaattctgggactgaagctaatgaagcagctttaaaattaactcatctcatcaaaaaagatcagaaaattttggcgtttacagatggctttcatggtcgtacttttggtgctatgagtgcaaccatgcaagaaaaaatccaagcaggattttcgcctttattaccaaattttgtggctagtccttttaatgatgtggtagcacttgagcaaattcttgaaaaagaaaaaattggcgcgattatttttgaaattattcagggtgagggtggcgttttaccaatttctccagattttgttgaagctctaaaaagttgtcagcaaaaaggaattttactgattattgatgaaattcaaactggaattggtcgaactggaaaattatttgcttttgaacattttgattttgagccggatatttttaccttggcaaaagcattggcgaatgggattcctacaggtgcgatgctcgctaagaataaatatgccagttatttttcagcaggaaagcatggctcaacatttggtgggaatcctttagctatggcttcggctaatgaagttttaaaagaaattgacagtgactttttagaaaaagtgactgacaaaggtatttttttcttaaaattactgacagaaaagctgtcagtaaaagcgacggttaagtccatcagaggtttgggattgatgattggaattcaattaactgacgagaaaaaagttccagaagttcttgctttactgcgtgaaaatggtctcttagccttgtcagctggtcatgatgtcattcgcctgcttccaccacttgtcatgacgaaagtagaactgcaaaaaggagcagagctattggagaaaattttatga

SEQ ID NO: 42068 - DNA, 852 bp, Lactococcus lactis
atgagagattcacaaaacacagctcagactttgaccgaaagtctcaaatattttctgaaatatcgtgaccaaacggttgtcattaaatatggtggcaatgcaatgattgatgaaaaagtgaaagaaagtattctaaaagatattttattacttaaaacggtgggaattaaagtagttttggttcatggcggcggacctgcgattggagaattacttgaaaaatatgagcaaaaaagccaatttgttcaaggtttgcgcgtgacagataagaaaacagctcaattagcactgacagctttagctggaaaagtaaataaaagtttggttcaagatatcattcgtttaggtggcaatgcgattggcgtttcaggaattgatggtaaattgatagaagccaaacctatttctgaagatttagactatgttggagaaattacagcgattcatccggaaatcattgagcgtatcaatcaaacggatgctgttcccgtcattgcttcggccggcattggtcttgatggtgaaatttataatgtcaatgctgataccgcagccagtcgaattgccggtgcattgagtgctgaacaatttattttattaagcgatgttcgtggcttatatggcaattttcctgacgaggagtcatttattgatgaaatcaatctgaccaatctagaaaagttagtcaaagagaaaaaaatcactgacagaatgattccaaagattgaagccattaaatatgccatgtttgaaggattgggtcaggctgttttattagatggccgtgttccgcacgccttattattggaattatttactgacaaagggcaagggacaatgataaatcattga

SEQ ID NO: 42069 - DNA, 1002 bp, Lactococcus lactis
atgtttcaaggaagaagttttttaaaagaaatagattttagtaaagatgaattgttatatctgattgattttgcaattcatcttaaaaagttaaaaaaagaacatattcaacataaatatttattagataaaaatattgcccttatttttgaaaaaacatctaccagaacaagagcagcttttacaacggccgctgtagatttgggagcacatcctgaatttttagggccaaatgatattcagttgggcaaaaaagaatctatttcagatacggcgaaagttttgggttcaatgtttgatggcattgagtttcgtgggtttaagcaaagtgatgtggaaattctagccaaggattcaggtagacccgtttggaatggattgactgatgtttggcatccgacacagatgctggcagattttatgacaatcaaggagcattttggccatttacaagatttaaccctcgcttatgttggtgatggacgaaataatgtggcaaattctctattagtgactggagcaattttaggcgtaaatatcacaattatttcgccagagtccttgcaacccgctttagaaatacaaaaactggcacgtaaatatgccatgaaaagtcgcagtaaaataagtatccgaacagatttaaatggacttgaaaatgctgatattgtttatactgatgtttgggtcagtatgggtgaggaagctcaaacagccaagcgaattaaattattgaaatcctatcaaattaatcaaaaagttgttgaaaaaattattaataaaaactttatttttatgcattgtttacccagctttcatgatttaaacacggaagtgatgaaagaaattaaggaaaattataaccttaatgaattagaggttactgatgaagtttttaattcaaagaattcggtcgtttttgaacaagctgaaaatcgaatgcataccataaaagaagtcatggcggctactttaggggatttatttattcctaaaatataa

SEQ ID NO: 42070 - DNA, 2775 bp, Lactococcus lactis
atgtatcttaaaaaaatggaaattgtcggcttcaaatcttttgccgataagactaaagttgaatttgataaagggataaccgcagttgtcggtccaaatggttctgggaaatcaaatattgttgaagcattgcgctgggttttgggcgagcaatcggctaaagcacttcgtggtggaaaaatgcccgatgttatttttgctggaactgaaaaaagacgtgctcttaattatgctgaggttattgctcattttgacaactctgatcattacctgcaaggacaagatgagaatgaagaagttgttattacccgacgtttatatcgaaatggcgattccgaatttttgatgaatggtcgtaaatgtcgtttacgtgatattcatgatttatttacagatactgggcttggtcgtgactctttatcgattatttcccaaggacgaattgaatctgtttttaattctaaaccggaagaaagacgtgccatttttgaagaagcggcaggtgttttaaaatacaaaaatcgacgaaatgaaactgaatcaaaattaaattcaacccaagataatcttgaccgtttagaagatatcatttttgaattaaatagtcagctcgttcccttacaatcgcaaagagatactgcacttcgttttcaagaactagaagcagaacgttcagacttgtcactttctgtactggttggtcagttggaatctaaaaaagccaaatatgatcaaacagaacttgatttggcgcaagtggcacaggaattagcgagtttatcaactcgtaaaaaagtttacgatgagcaagtcagtcaattacgtacagaacgccaaaaagtagaagccgagcaagaaaaattgcaagctgaccaacttaatttttctaatctaaaatcagatttaacaagaaaaattgaattatttgatgttcaaaaagattcatcagaaaaatcagctgcggaacgcgaagaacgtttagaaaacttaaaaagtcgtttagaaatcactcaacaaaatttggcagaagttcaaaaaaaatcagaacttttactgacagaaaaaaatgacttagataaattactgacagagctgtcagcagatttagcgaccttatctgaatcaccagaagtggtcatggaacggttacgtgatgaatttgttcaattagttgaagaagaagcccaaatctcaaatgaaatcgttagaaataaagctgaaattacagatttgagccgtagacaatctgaacaggatgagtctgtcagagaaaatttgactaaatttgaaaaaatcagtcaagatttatctgaagcacaggaaaatttaaatactgttaaaaaagaaatcgagacccttttagcgaaatttgaagaaggaaatcaagcagagaaaaaacaggcagaattagaacgtttagcccaaaataaaatgtatgattatctgcaagaacttaaccaacataaggcccgtttgacttccttgcaaaatatccgtgagagtcatagtaatttatttgctggtgtccgtgccgtgatgcaaaatgcttcacaaattggtggtgtgattggggttgtttctgatttattgaccttcgaccctaaatatacaacagccattgatattgctctaggtggcgggagccaaaatgtagtcacagaagacgaaaatgcggctaaaagagcaattgcttttctacgtgaaaaaagattaggacgggcgacttttctaccgttgacaacgattaaaggacgagactttaatggtttaaatcgtattcaaaatatgacaggatttgttgatttagcaatcaatcttgtaagctttgaaagtcggttgcataaggcgatgagctcacttttaggaacaacggtgattgttgattctggagaaaatgcaactgctatcgctcgagcaatgaattataatgttcggattgttacgcttgacggaacacagattaaccctgggggttcttatgcagggggagctgggaaacgtaattcaacaacttttacttctgttgaaataagtaatttagaaaaacaaactaagttatcagaagagcagttaaaaatttcagaaaaagaagttcaaaaagcccaaagtgctcgtcaagaattgctaaaagaaattgaacttttgaaaactcaaggggaagaaaaacgttttgttgaacaatctttgaatttgaaaattgaacaattaacagaacaaaaagttgcgctagaacaattaactaatctgtcagcaaatcaagaagcaacaggtaatttgcttgaattaactaaagaaaatgaacataaagtagaagttcttgcaaaaattacagagcgaaaagctgaaattgaaaagcaacttgaagaagttaaaacgaatagtcaagcgcataaagccttgcaatcagagaaaacaagtgctttaaatcaggctcaacttcgtcaatcagaagtggtcagtgaattgaaattcaccaaagcagatgaaaaacgtttactgacagacttgtcagccttgacagaagaaaaaaatcaactgatagcacttttaaaccctgtccaatttgatgaaacagaaagaaataatttctcaaaacaactgacagaagtagaagaacgcttgagtcaaattaatgtccgaatggttagtttaaaatttgaacgtgaagatttagcagctcaaatggaagatttagaacatcacaatcaagattttatccagcaaacacaagaacttaacacgaaaaaaacgcgttatgaaatgcaattggaataa

SEQ ID NO: 42071 - DNA, 1341 bp, Lactococcus lactis
ttggaaactaatcaatccttaaagaaaaaaatggccgcacgccatattactatgattgctcttggtggagcaattggtgctggtcttttcaaaggaagctcatcagccattgctgccgctggtccctctgtcttaatcgcttattttatcggaggaatcgttctttattttgtaatgaagagtttagaaaagcttgttctaagttcaaaagatccacacggcttgtccggacttgttcagccttatctgggtaatcatacggctgattttacggactgggtttattggtcaatgtggatgattaatatcattgctgaggctgttgctgctgcaagttttttgcagctctggtttgctaatgttcccacttgggtttttgtcttgattattgcccttttaacttcccttattaacttattctcagttgctctctttgctgagacagaatactggttggcatttattaaaattagtgttgttattttgttgattatttttggtgtttttcttgtggcaaaacaaatttttgatactaatctagtgactactttctctggaatgaccgctcatggtggctttgctcctcatggctttaaaggggtcattaattctttattaattgttatctattcgtatggtggttctgaattaattgctattacagttagtgaaacagaagatcctaaaagagccattcctaaagccatccgcggtgtaatcgggcgaattatttcattttatattattccgatgttcttacttcttgtgatttataattggcaaacgttggctacttcttcaatgagcccttttgtgatggtctttaataaaatgcatattccttttgctggcgatattgtcaacttgattatcattcttgccctcttctcatcaattaattctggaatctatgcttcatctcgccttttgtatttccgtttaaaaaatcgtcaaggtaaaatggctcaaagaatggctcatttaaataaacatcacgttcctcaaagagcagttattttctgttcaggtacactttatatcggtgttgttctttcttattttgtcggtgatcgtttgtttaattacttggctggttccctttcttacactgttttagccgtttggattttaattagtctcgctggttttggtctctctcttaaaacaaaatcattatccggtagaacaatgagtctcttagcactgattgctctctttctcattctgattggtattttatttactaatccaattggtgtgactgtcttcacagcaattctttatttcatcatctttatcagttatcaaaaaaagaatgattctgtcagtaatttaaactaa

SEQ ID NO: 42072 - DNA, 975 bp, Lactococcus lactis
atgtcgtattcaaatttgaagttgttttcgctctcttctaaccacgaattagcccaaaaagtggctaaagaaattggaattgagcttggaaaagtaagtgttggtgcacattcggatggcgaaactgtcgttcatattgacgaatcagttcgtggtgatcatgtgtttatccttcaatcaacaagtgaccctgtcaatgataacttgatggaactcttgattatgatggatgcattgcgtcgtgcctctgctgcatcaattaacattgtcttaccttactatggttatgctcgtcaagaccgtaaagctcgtgctcgtgaaccaatcacatcaaaactcgtagcaaacatgcttcaaattgctggtgccgaccgtttaattactttcgaccttcacgcaccacaaattcaaggattcttcaacattccagttgaccaccttatgggttcaccattgattgctgaatatttccgtcgtcaattggtttctgctggtgatgatatcgttgtcgtttcgcctgaccatggtggagtaggacgtgcgcgcaagttagcaaacttcttgaaagcaccactttctatcattgataaacgtcgtcctcgtgccaatgtggcagaaattatgaatatcatcggtgatgttcaagggaaaaaatgtatcttgattgatgacatgattgatacggctggaacaattactttagcggccaatgcccttaaagaacttggtgcaacagaagtctacgcttcatgtactcatgccgtactttcaggaccagctatagagagaattaataattcagcaattactaaactcgttgttttggatactattgaaatgccagaagaacgtcaaagtgaaaaaattgttcaactttcaattgctcacttgcttgctgatgcgattattcgtattcacgaacgccgtccattgtcaccactctttgaattacatcttccttcagaacaaatctaa

SEQ ID NO: 42073 - DNA, 1362 bp, Lactococcus lactis
atggaaaataaaatgccaaaagattttttctgggggaattcaacttcgtcaatgcaaaccgaaggcggctggaatgaaggaggaaaagggccctctgtctatgatgtgaataccgttggacgttctgccaaagattggcaagtaacaaatgataattatcatcattattcccaagatctagatcttatgaaagaaatgaatatgaatatgtatcgtttccaaatttcttggtcacgaattgttcctgacggcgatggtgaatttaatgaggaaggaattgccttttataatcgtctgattgatgatttgcttgctcgtggaattgagcctatgatatgtctctatcatttcgatatgccattaaatctggctgaaaagtacaatggttttttgagccgaaaagtgaaagaagcatttgtaagatttgggcaagaaatgatgaaaagatttgctgacaaagtcaaatattggattgtttttaatgagcataatctttattttgctgacggttttgagcattattcgggagttttgaaaaaagagctgacactctctgatatgtatactgtttttcatcacaccatgcttgctcattgtgaattgacccaatttttgcatgaaaattttgaagcaaaaataggaggaatgttggcgactacggaaatatatcccgcaactttttcaccaaaagataatttatatcttagaaaatttgatgaattttataatcgaaatctctgtgatgtttatgcttttggtcattattcgcatgaggttatgacctatgttaaaaatcagaacatccaaatggattttcaaaaaggagatgaagaaattttaaaaaatggaatttctgactttatttctttttcttattatcgctcaattttacttgatgcaagtcagctgacagaaaatgatgcaccaaattcttatttgactaaaggaatgaaattaaatccgttgcttgaacataatcaatgggattggtccattgacccagaaggctttagaagaattctaagtagattatataatgaatttggattgcctgtttttcctattgaaaatggcattggtcagtcagaaatctgggatgggaaaacaaaaattgctgatgacttgagaatttcttatcatcagaaacatcttgaagccatgaaaaaggcaatatttactgacggggtagaagttatgggttatcttggttggggattgattgatattcctgcttcatctggtgctattgataaacgttacggtgctgtttatgtggattcaaaaagtcataaacgtattccaaaaaaatcatttcattggtttaaaaatgtttttgcttcaaatggtgatcatttggattag

SEQ ID NO: 42074 - DNA, 2163 bp, Lactococcus lactis
atgcggagtcaatcatttgtaattacaggaatgacctgtgcaaattgtgtaaatacagtttcaaaaacattgaatcagtcagataaaattatggaagcaacggtaaatttggcgactgagaaagccaaaattgttgctgacgataatatttctgaccaagaaattattaacttagtggaaaaagcgggttatggagccattgttaatgacaaagctcatcaggaaaaaattgcacgtcaagctgcaaaaaaagcaagaaatttggctttgtctttttggattgctttaattttgactttacctttagtagttgcaatgtttgctgatatcttcggagtacatgcaaattgggtcatgtttttacatgaaccaatcgtacaattgattttggcaactccagtacaattcgttattggttggcgcttttatgttggcgcttatcatgctttgcgaaataaatcggcaaatatggatgttttagtggctttaggaacttcggttgcttacttttcgagtttgattttggctgtttttatgagccaagcgaatgctttgaattttgaatcatcgatggtaattatcactttggtggtcatgggtaaacttttagaacataatgcaaaagagaaaacaacgcaagcaattactggattaatgtctagtcgagcaaattttgttcatacggaatcgactgatttagcgattgaagaagttcaaatgggacaagtgattcgcattttgccaggggagaaagtgcctttggatgcgatgattctttctggcaaagcatcctttgatgaatctattttgacaggtgaagccttacctgttgtaaaaatggatgatgaagtcatttttgaaggaacaattaatttagatggtgaagttaaagcggttgttgttcatgatttaaatgattcaacaatttcaagaatggttaaaatgatgagtgaagcacaaggctcaaaaccaaacattcaaaaattagctgacaagatttcagggatttttgtgccagttgtgttagttattgctctgataactttcattgcgacttgggctgtcagtggaattttactgacagcaatcatgcattcagtagcagttttggtcattgcttgtccttgtgcgcttggtttagctacaccaactgccattatttctgggactggtttggctgctaaaaatggtttgttgattaaaaatgccaatgctttggaacttgccggattagttaaaacagtattttttgataaaactgggacaattacaacaggtgaatttgaactgacagattttaaattgctgacagaaagtgaaaaagttactgacagctttaattctattgaagaaaaactagcaagtgataagtttaaattattggctagtctagaagctcactctaatcaccctttggctaaatctcttaaatttcaaggtgatttatatgaactgacagatttatcagaacttgcgggtcgtggactttctgctaaaattaatggtcaggaatattttgcgggcaatgataaattaatgacagacttaaatctgtcagtcccagaaacagatgatacggtcatttatttggcaaataaagaaaaattattagcgatggctgtttttagttcaagtctcaaagatgatgcgcttaagacaattcaaaccttgcaaaaacgtggtctaaagactgttatgttgacaggagataatcaaaattcggcagaaaaaattcaaaaacttgttcatttagatgaagttaaaagtggtttaagacctgaagaaaaagcagaaattgtgcaaaatagcccaaattcaatgatggttggtgatggaatcaatgatgctattgctttagcatcagcgaccgttgggctggcaatggcaactgggtcagatatagctatggaagctggtgatgtgactgttactagcggtcagcttcataaaatttccactttctttgaagtagctaaaaaaacaatttctaaaattaagcaaaattatttttgggctttcgtttataatgtcattggcattccgcttgcagcttttggattactcaatccaatgctcgctgcagcggcaatgagtttatcatcagtttctgttattttgaattccttacttttgacaaaaacaaaaataaaaaacgttgaataa

SEQ ID NO: 42075 - DNA, 1308 bp, Lactococcus lactis
atgtttgattatattattattggtgccggacccggtggactaggattagcttatcgtttaaagactaaagataacaaaatcggaattattgagaatgataaatggggaggaacttgtccaaactatggttgtgacccaacaaaaatgatgatggcagttgtcgaagccaaaagtcgtgtcgaacagttaaaagggcagggtatttctggtgaattaaacattgattggaaagggctgaaaagtcgtaagctaaatattactgacccttatgaaaaatcaacttttactggtttgaaaaatgctggaatagaaacaatatatggcagtgccgcttttaatgaccaaggaaagcttgaagttgaagggaaaacttatcaagctaaaacttacattatcgcaacaggaagccgtccacgtcttttagatattgatggaaaagaatttttaaaaacaagtaatgattttttagcgcttgaagaatttcccgctcaaatcagctttttagggagtgggccaatttcattagaactggctcaaattgctaaagcggctggaagcgatgttactattatttcacgtaaaaaagcgagagttgctcattttgatgaagaaatggggcaagaatttattaattaccttaaagctcaaggtattaaatttatcgaggatatttctgtagataaagtcgaaaaagttgctgacggatttttactgactgacgggactgattttgaacataaaacagatttagtgattgcgggagtaggccgtcagccaaatagtgataagctaaatttagaaaaagtaggtgtcgaaacggatgctaaaggtatcaaggtaaacgaatatttacaaacaagcaattctaaaatttatgcgatgggagatgtactttctaaaaatcaacctcatttgacgcctgtttcttcttttgaaggagcttatttaggtgaaaatttagttaaggatgaaccgcaaaaaattgcttatccagcaattcctacaatcatttttggaacggcaaaactggctgaggttggccatttggcaggtgaggggattcataccaagactttggatttaagttcttggtatacttataaaagaattaatgaccccttggcaaaattaaaagttgcactcaatgaaaagcgagaaatcgtgggggcatcaacggtaagttcagtggctgatgaagtgattaatttaattaatattttaattcaacaaaaaatgactttggcggatgttgaaaaaatgattttcacttatccaacagtggctagtgatttagaatatttttactga

SEQ ID NO: 42076 - DNA, 2088 bp, Lactococcus lactis
atgtcaaataaaactcattcgtctaatcacgatgaaatgatgtctgagcatcatcataatcatgaaataatggatatggagcacgaaaaccatgagatgcacaacatgcacaatatggataatatgcatgatatggacaatatggatatgatgaatcatggaggacacatgatgcatatgggtgatatgagtaaaaagctcaaagtggctatcattcttatgattccgctactactcatttcaccaatcgctggctttactatccttaaattccccggaagtgaaattttgcaacttatacttggtacaattatcttcttttactctgggactcctttttttagcggagcaaaaggtgaattaaaaagccgtaagccagccatgatgatgctgattacaatgggaattaccgttgcctatgcttattctgtttatgccacaattatgagtcttaacggacatatgggcatgaacttctggtttgaactggcaactttaattgtcattatgttgattggtcacctgattgagatgaaagcaatcatgggtgctggcgatgcattgaaagatttagcaagccttgttcccaaaaaagctcacttaaaaagtgggaaggatgtggagctttcagaactaaaagttggcgatttgcttttagtgaaagaaaatgaaaaaattcctgcagatggccttatattaagtgaagcgctcgttgatgagtcaatgattactggtgaaagccgagcagtcaataaaaaaacaaatgaccttgtttatggtggttccctcaatcaaaaccaaccatttgagatgaaagtcacaacccttggaaaagattcatttctcaatcaagtggccgaattagtcaagaaagcccaagctcaaaaatctaatttggaaaatatggctgacagagtggctggttaccttttctatgctgcacttattgtcggtatcttctcattaattttttggacaattagctctaactttagttttgctctacttcttgcggtttctgtttttgtaattgcatgtccacacgctttaggtcttgcggttccacttgttgtttctcgcctaaccagtatttctgctaaaaatggtttattaattcaaaacagaacttctctagaaaaaataaatacaattaaatatgccttaatggataaaacgggaacattaactgacggtaagtttattgttcgtaatgttattgattttactgatgaaacagacattctccaaatcatggcagcacttgaaggaagttccactcacccgattgctcaatcaatcgttgcagctgctaaacctcttggaaatctaaaagttgaagcggttgaaaatattccaggagttgggattaaagggcaagttaatcaaaacttttatcaaattgttaactataaatatcttcgtgaaaatcaactttcttatgatgaacaaaagattgctcaatatttagatttaggtttaactgtatctttcctaatcaatgaacaacaagatgttttaggatttattgccttaggagattctcctaaagcagacgcgaaagcctttattaatggtttattagcccaaggaattacccctgttatgctcacgggtgataataaagaaactgctaaaaaaattgctagtgcactaaatattcccgaatttagagcggaattaaaacctgaagataaagcagaaattgtgaaagagtaccaaaagaaagccggcgtgcttttcattggtgatggtgtcaatgattccccagctcttgcaactgctacgattggttttgcgattggagcaggaacttcggttgctatcagtaccgctgatgtcgtcctagttaactccaatccaagtgacgtcttggatatgattaatatctccaaacgcatgcttagaaaaatgaaacaaaacctctggtttggagcaggctataacattattgctattcctgttgcagcgggtattctttatccatttacagggatttatattgaccctctcattgcagcagtcctgatgtcaatctcaaccgtgattgtctcaatcaacgcgatgggattgaggtatgataaaaaatag

SEQ ID NO: 42077 - DNA, 885 bp, Lactococcus lactis
atgaatgttagcttatggtataatagttctatgaacttgatagatggaaaagcacttgctgctaaaatgcaagctgagttgaaagttaaagtcgataaattaaaagaagcggacaatgttccaggtcttgccgttattcttgtgggcgaagatcctgcgagtcaaatttatgtccgaaataaagcacgacaagccacagcaattggtttaaattctagtgtggttcgtctaccagaaactgtgtcggaacaagaactgttagatttaattgaacagtataatcagtcagaacaatggcatggtattttggtacaattgccattgccagaacatatttctgaagaaaaggttttactagctattgatccagaaaaagatgtggatggttttcacccaatgaatatgggacgtttgtggtctggaaatcctttgatgattccttcaactccagccggtattatggaaatgttccgagaatatgatgtggaactttctggtaaacgtgcagttgtgattggtcgttcaaatatcgtcggaaaaccaatggcgcaattattaatgatggctgatgctactgtgacgattgctcattcgaaaacagaaaacttgcgcgaattgactaaggaagctgatgttttggtggttgctattggccgtgaccggatgattaaagctgaggatgtcaaagaaggtgcagttgtaattgatgttgggatgaaccgtgatgaagatggaaaacttcatggcgatgttgattttgatgaagtaaaagatgttgcaagtttgattacccccgttcctggtggagttggtccgatgacgattacaatgcttatggaacagacagttcgtgcagcaagtagaaaaatgaatgaaaataaatag

SEQ ID NO: 42078 - DNA, 858 bp, Lactococcus lactis
atggatacgaagatactaaagttagaagactttttaactgaattttatgaaagcgctgaatttccaactggcttagccgaatcagcaaaatattctttattggcaggcggtaaacgaattcgccccctcctttttttaaacctattagaggcttttgatttagaattgagtaaggctcattatcatgtggcagccgcacttgagatgattcatacgggttctttaatccatgatgacttaccagcaatggataatgatgattatcgtcgagggcagttaactaatcacaagaaatttgacgaggcaactgcaattttagctggtgatactttattttttgaccctttctttatcctttcaactgctgatttatccgcagaaataatagtagcgttgacgcgtgaattggcctttgcttcaggttcttatggaatggttgcgggtcaaatcttggatatggctggtgaaggaaaagagttgacattagctgaaattgagcagattcatcgcttgaaaactgggcgacttttaacttttccttttgtagctgctggaattgttgctcaaaaatcaacggatgaagttgaaaaacttcgtcaagtggggcaaattttgggattggcttttcaaattcgagacgatattttagatgtcacagcaacttttgctgagcttggaaaaacaccaggtaaggatattttagaggagaaatcaacatatgttgctcatttaggacttgagggagcaaaaaaatcactgacaggaaatttgtcagaagttaaaaaattactgacagacttatcagttactgacagctctgaaatttttaaaattattgagcaattggaagtgaaataa

SEQ ID NO: 42079 - DNA, 1668 bp, Lactococcus lactis
atgttacaagagatttcaatcaaaaattttgcaattattgaagaaattcatctatcctttgagagtggaatgacgattttaactggggaaactggtgcgggaaaatcaataattattgatgcaatgtctttattattaggtgggcgtgcttcgagtgattttgtgcggcatggggcaaacaaagccgaaatagaaggtctctttttctttgataaaactccagaattgaaggcggtattattagaacttggctttgaagaagtagattctgaaattattttaagacgtgagatttttgctaatggtcgttccgtttgtcgaatcaatggtcaaatggttaatttagctacgctaagacaagtgggtgaattattagttgatattcatggtcaacacgatagccaagaattgatgaatccgaaaagccatcttcgtttacttgatgaatttggtgacgaagcctttgatcagataaaaaataattacaaactcaaatttgaaaacttcaaaaatttgcgtcaacagctcaatttacgacaaaaaaatgagcaagaatttgctcaaagaattgaaattcttcaatttcaggctgaagaaattgaagcggcggaaattaatcttgaagaagatgaacaattagttaatcgccgagaaaagttaaataatattaaaaatattgctgattcgcttagtagtgcttatctagcgcttgatgatgaagataatgattattcaagtcttaataatatccgaacaacaatgacagaattggataaaattagtaactttgataatgactatcaagaacttgctgacaagacagctgaaagttattatgtattagaagaagttgctaatcaaattcaaagaatcatgagtgatttagaatttaatccagctgaacttttacaaattgaagaccggattatgaccttgaccactttgaagaaaaaatatgggccagaactgtccgatgtgatgaactatttagagaaagtccaacttgaactctcagaactgacgggttcggaaaatgactcagaaaatctagaaaattcagttaaagttgcacaagttcaactcattgaagcaagtaaaaaacttaatgaagcgcgccataaaattgccaaagaagttgaaaaagatattaaacacgaactttctgagctttatatggaaaaagctgatttcaaagttagttttgaaggggcaaagttttcggcaaacgggaatgagcatgttgaattttttattcaaaccaatccgggagaaggatttaaaccgctggcaaaaacagcttcgggtggtgaactttcacgtttaatgctcgctataaaatcaagcttttcaagacgtgaaaataaaacagccattgtttttgatgaggtcgatactggtgtttctggtcgtgttgctcaagcgattgctaataaaatatataaaattgctagacatgggcaagttcttgcaatttctcaccttccacaagttgtggccattgccgatagacaattttatattgaaaaagcttcaaccgatgacattactacttccacagttagaaaattaaacgctgaagaaagagtaaatgaaattgcgaaaatgcttgctggtgaagatttaactaaagaagccttagctcaggctaaacgtttattgagcaaataa

SEQ ID NO: 42080 - DNA, 1113 bp, Lactococcus lactis
ttgcctgaaacgacaaccatcctatatagaggaggcgtttttatgcgcgcagcacgtttttacgaccgcggggatatccgcattgatgaaattaatgaaccaatagtaaaagctggccaagttggcattgatgtggcttggtgtggaatttgtggaacagatctccatgaatttttagatggcccaattttttgtccgtcagcagaacatcctaatccaattactggagaagtaccaccagtcactcttggacatgaaatgtctggggttgtaaattttataggtgaaggagtaagcggacttaaagtaggtgaccatgtcgttgtcgaaccttatatcgttcccgaagggactgatacaagtgaaactggacattataacctctcagaaggctcaaactttattggtttgggcggaaatggtggaggtttggctgaaaaaatttctgttgatgaacgttgggttcacaaaattcctgataacttaccattggatgaagctgctctaattgagccactatcagtcggctatcacgctgttgaacgagcaaatttaagtgaaaagagtacggtattagttgttggtgctggaccaattggactattaactgctgccgttgcaaaagcgcaaggacatactgttatcatcagtgaacctagtggacttcgtcgtaaaaaagcacaagaagcacaagttgctgattatttcttcaatccaattgaagatgacattcaagctaaagttcatgaaattaatgaaaaaggagtggacgcagcctttgaatgtacctctgtccaaccgggatttgacgcttgtctagatgcgattcgtatgggtggaacagttgtcattgtcgcaatttggggcaagcctgctagtgttgatatggcaaaattagtaatcaaagaagctaaccttttaggaacgattgcttataataacactcatccaaaaacaattgatttagtatcaacaggtaaaataaaattggaccaattcatcacagctaaaatcggtttggatgatttgattgataaaggattcgatacgctgattcatcataatgaaacagctgttaaaattttagtttcaccaactggtaaaggtctataa

SEQ ID NO: 42081 - DNA, 762 bp, Lactococcus lactis
atgtctaaaattgcagcagttactggagcaggtcaaggaataggttttgcaatcgcaaaacgtctctataatgatggttttaaagtagctattattgattacaacgaagaaacagctcaaaaagcagcaaaagaacttggagaaaactcatttgcgattaaagctgatgtttccgaccgtgaacaagttatttcagctttgaatgctgttgtcgacaaatttggtgatttaaatgttgtagttaataatgccggaattgccccaacaacacaaattgaaacaattacacctgaacaatttcatcaggtctataatattaatgttggtggagttttgtgggggacacaaacatcaacagcactttttagaaaattaggtcatggaggtaaaattatcaacgcaacctcacaagctggagttgttggaaatccaaatctaatgctttattcttcttcaaaatttgctgttcgtgggatgactcaaattgctgctcgtgatttagcagaagaaggaatcacagttaatgcttatgcaccagggattgtaaaaacaccaatgatgtttgatattgcgcatcaagttggtaaaaatgctggtaaagatgatgaatggggaatgcaaactttcgcaaaagatattgccatgaaacgtttatctgagcctgaagatgtggcaaatgttgtttcattcttagctggccctgattcaaactatattaccggtcaaacaattattgttgatggaggaatgcaattccattaa

SEQ ID NO: 42082 - DNA, 1623 bp, Lactococcus lactis
atgcgtgcacatgaaattttaaacaatccttttttaaataaaggaacagcttttactatgaaagaacgtcaagaattggggttgattggtcttcttccaccaactgttcaaacaattgaggaacaagctgaacaaacttacgaacaatatttgacaaaaccatctgatttagaaaaacgtcatttcttgatggaaatttttaatacaaaccgtactttgttttactacttattcaacaaacatattgtagaatttaatccagttgtttatgatccaacaattgctgatacaattgaaaactacagtcatttgttcgtagatccacaatatgctgcttatcttgatattaaccaccctgaaaacattactgaaacattgaaaaatgcagcaggtgacagagaaattcgtcttattgttgtaactgatgctgaaggaatccttggtattggagactggggaactcaaggtgttgatatctcagttggtaaattaatgatttatacagccgcagcaggtattgatccagcgtctgtacttccagttgttattgatgcaggaacaaatagaaaagaacttttagaagatcatttgtatcttggaaatcatcaagaacgtatttacggtgatcaatactacagtttcgtcgatcaatttgtagaaactgcagaatcaattttccctaaattgtaccttcactgggaagatttcggacgttcaaatgctgcaacaattttaaataactacaaaacaaaaatcccaacatttaatgatgacattcaaggaactggtattgttgttttaggtggtattttcggatcacttgacattacaggtgaaaaattaactgatcaagtatatctttgctatggtggtggttcagccggtgcagggattgctggtcgtgttcatgctgaaatggttagtgaaggtctttctgaagaagaagcttacaaacatttcttcatgattgatcaacaaggtttactttttgatgatatggaagaccttacaccagctcaaaaaccatttgctaaaaaacgtgctgattataaagatgctggagatatgactgaccttcttaacgttgttaagacagtaaaaccaactattttagtaggaacttcaactaatccaggtgcctttacaaaagaagttgttgaagcaatgtgtgctaatacagaacgcccagtaatcttccctatctcaaatccaactaaaaaaatggaaactacagctgaacaagttattgagtggtctgatggaaaagcttttgtcgctactggtgttccttcaggaacaatcagctacaaaggtgttgattatcaaattggtcaagcaaataactcacttatctacccaggtttgggcttaggaatgttggcatctgaagcaaaacttttgacagatgaaatgatcggtgcagctgcacattcattgagcggtttagtagatccaggtaaaccaggtgctcctgttcttcctccatttgaatttgttgctgatgtatcaattaaagttgcagaagcagttgctaagaaagctcaagaacaaggtcttactgaatctaaagaaactgatatggctaaagcagttcgtgatcttaaatggtatccagagtactaa

SEQ ID NO: 42083 - DNA, 696 bp, Lactococcus lactis
atggtaaatatttatttagttcgacatggaaagacaatgtttaatacaattggtagagcgcaaggttggtctgatacacctttaactgcggcaggagaacaaggaattattgaacttggtctaggattcaaagaaaaaggcattaaatttgaccgagcttattcatctgattctggacgtacaatccagacaatgggttttatcttggctaattctgataatgaaggaattccatacacttatgataaaagaatccgtgagtggtgttttggttcatttgatggtggctatgacggagaactttttgatggtgttttaccaagaatatttaccgaaactggaaatcatcataccgacgaatttcctccagatgaagtaattgctaatgcgatttttgaagttgatacggctggctgggctgaaccttgggaaaaactttcaggacgtatcatggatggttttacagatattgccaaggaatctgaagcaaaaggggctaaaaatattgttattgtcagccatggaatgaccattggaacttttgtaaaactcgctcacccagaactccctcgtccacatggtcttgataatggttctgtcacccatttaagttttgaggatggaaaattcaccattggaaaagtcggagacatgtcttatcgagaaatagggagtgaaaagttagctaaaaaatga

SEQ ID NO: 42084 - DNA, 2169 bp, Lactococcus lactis
atgtctctaaaacaacttaaagatgtaacttatttcaagcttaataacgagattaatattcccgttaatggtagcattcctcttgctaaagataaagaagcaattactgctttttttaaagaaaatgtcgaacctaatcgttatgaagccgatacatatatcgataaactcaattggctcgttaaagaagaatatctagaagctgagtttcttgaaaaatataaacccgaatttattaccaatcttcggaaagaattgagtaaatttgaatttcattttgattcatttatggctgcttacaaattttataatcaatatgccatgaaaaacaatgacggttctctctatcttgaagattttgaagaccgtgtgttaatgaatgctttatacatggctgacggcgatgaaaaattagctaataatcttgcttttgcaatgattaatcgtcgttatcaacctgcgactccgacttttctaaatgctggacgtaagcgtcgtggtgaatttgtttcttgtttccttctacaattaactgatgatatgaattcaattggacgaacaattaactctgccttgcaactttctaaaaatggtggtggtgttggtctaaacttgactaatttacgtgctgctggtgcacctatcaaaggttacgatggagtggcagctggtgtcgttcctgtcatgaaactttttgaagacgccttttcttatgccaatcaattggggcaacgtcaaggtgctggtgttgtttatttatcactattccatccagatattatggaattcttgtccactaaaaaagaaaatgcggatgaaaaaattcgtgttaaaacactctctcttggggttactgttcctgataaattctatgaattggttaaaaagggagaaacaatgtatctctttgagccatattttgttgaaaaatattatggtaaaccttttgccgaagtcgatattacagctgaatatgacaaaatggtagccaatccagaaattcgtaaaacatcgattaatgcccgtgaacttgaacaagaactttcaaaacttcaacaagaatctggttatccttacatcgtaaatgttgacacagtcaatcaagctaaccctgttgatggtgtaatttcaatgtctaacctttgttctgaaattttgcaagtccaaacgccttctgttttgaacgatgaccaaacttataaggtggttggaactgacgtcgcttgtaacttgggttcaactaatgttttgaatatgatgacttctagcaatgaatttggaacttctattgaagcaatggttcgcgctttaactttcatctccgaaacttcaaacctcgatactgttccaactgttcgtaaaggtaatgatgaaatgcatgcgattgggcttggagcaatgggcttacattctttcttagcacaaaatcaaattcattatgacagcaaagaagccgttgaatttactagtgtttatttcatgttgttgaactattatactttagtggcttcaaataaattagctgttgaaaaagggtctagcttcaagaattttgaaaaatctgcctatgctgatggttcttattttgataaatatttaacacatgattattttgcagctgtctcttctaaagttcaagaacttttcaaagggattgctgttccaacaatcgaggattggactgctttacgtgacacagtaaaaacttctggactctataattcataccgtatggctgtggctccaaatggttctatttcttatatcaatgactgttcttcttctattcacccaattgtcaatcgcatcgaagaacgtcaagaaaagaaagttgggaaaatttattatccagctgctggacttgccactgaaacaattccttattacaaatcagcttatgatacagatatgcgtgcagtaattgacgtttatgcagctgctacagaacatgttgaccaaggtttgtcactcactttatttatgcgttcaactttacctgaaggtctctatgaatggaaagtggcaaataataaaatgacaactcgtgacttgtctattttgcgtaactatgcttacaaaaaaggaatcaaaacaatttactacattcgtacatttactgacgaccaagaagaagtcggtgctaaccaatgtgaaagttgcgttatttaa

SEQ ID NO: 42085 - DNA, 1818 bp, Lactococcus lactis
atgtgtgggattgttggtgttgtaggtagtaaaaatgcaactgatattttgatgcaaggactagaaaaacttgaatatcgtggttatgattcagcaggtatttttgtaaatggtcaagaaacagcagcaaaattagttaaatctgtcggacgtattgcagacttaagaggaaagttagggattgatgtttcaggaacagccggcattggtcacacacgttgggctactcatggtaaaccaacggaagacaatgctcatccacatacttcaacatcaggtcgctttattttagtacataatggtgtgattgaaaattttgttgaacttaaaaacgaatttttgatgaatgatacttttaaaggacaaaccgatactgaaattgcggttcatttaattgctaaatttgctgaagaagaaggactatcaacacttgaagcattcaaaaaagctctaagcttaattcaaggttcttatgcctttgctcttatggatagcgaagatgcagaagtgatttatgttgccaaaaataaatcaccattattaatcggccttggcgaaggctacaacatggtctgctcagatgctatggcgatgattcgtgaaacgtctgaatttatggaaattcacgataaagagcttgttgtgttaacaaaagataatgttacagttatggattacgaaggtaatgtactttcacgtgagtcatacacagctgaacttgatttatctgacattggaaaaggaacttatcctttctacatgctcaaagaaattgatgagcaacccgcagttatgcgtaaactcattgcgacttatgcaaatgaagatggaacaatgaaagtcgatcaagacattatcaaaggaattcaagaggctgatcgtatttatattattgccgccggaacgtcttatcatgcaggttttggggcaaaaatgatgcttgaatctttgacaaatacaccggttgaacttggtcttgcttcagaatggggctatgatatgcctttgctgagccaaaaaccattctttattttcctttcacagtctggtgaaacggctgacagccgtcaggttttagtaaaagtaaatgaattaggacttccaagcttaacagttacaaatgttcccggttctactttgtcacgcgaagcaacttatacaatgttaatcggtgctggaccagaaattgcagttgcttcaaccaaagcatatacaggacaaattgcaactttggcttttcttgcaaaggcagttggtgaggctgaaggggaagttaaagcaaaagaatttgatttagttaaagaattgtctttagttgctcaatcaattgaagccactttatctgaaaaggatgaaattgcagcaattgtagctgacttattgccaactactcgcaatgccttctatattggtcgaaaacaagattattatgtagcaatggaagcttctctcaaattaaaagaaatttcttatattcaatgtgaaggatttgctgctggagaattaaaacatggaacgatttcattgattgaaaaaggaactccagtacttgctttaatttctaataatgaagaagtagcagctcatactcgtggaaatgtaatggaaacagtggctcgtggagcctcagctatcacaattgttgaagaaggagtggctcgtgaagatgatacaattgttgtcaaccaagttcatccttatttgtcagcaatttcaatggttattccaacacaattaattgcttattatgcgtcaatgcagcgtggacttgatgttgataaaccacgtaacttagctaaagcagtaacagttgaataa

SEQ ID NO: 42086 - DNA, 1908 bp, Lactococcus lactis
atgattttactgcaagggaatggaattgcacgcacttttggtgacgatgttttatttgaaaatatcaattttagtttacaagaccattcaagaattgccctagttggccgaaatggagctggtaagtcaaccttgcttaaaattattgctggagttgaagaagcgagtcgcggaactgtatccaagaccaaagatttgacaatgaattatttagcgcaagatactgggctgaattcctcaaggacaatatttgccgaaatgctctctgtttttgattcgcttcgccaaatggaaaaacaattgcgccagatggaattgcaaatgggagaacttgctggggatgaattgacagctttgatgaaacgttacgatgctttatcagaagaatttcggatgaaaaatggatttacttatgaatctgaaattaagtctgtcttaaatggttttcgttttgatgatgcaatgtgggaaagagaaatttcaagtttatcagggggacaaaaaacacgtttggctcttgctaagatgttgcttgaaagaccacaacttttgattttggatgaaccaactaaccacttggatattgaaactttagcttggcttgaaaattaccttaaaaattacgaaggtagtttattaattgtcagtcatgaccgctactttttggataaagtggttaatgaagtcttagaattatctagaggagaattgactcgtttttctggaaattattctcgctatgttgaacaaagagagcaaaaactcttgttagaactcaaaaattttgaaaaacaacaaaaagaaattgctaaattagaggactatgttgccagaaatttagttcgggcttcgacgactaaaatggcgcaatcgcgtcgtaaaaagttggagaaaatggagcgtttagacgcaccaacaagtgatgataaatcggccaatgttacttttactcctgaaaaaacgtctggaaatgttgttttaaccgtttcagaagcaacggtaggttatgaagataatcgtctctctggtccgattaacattgacgagcgtaaaggtgagtcccttgctattgttggaccaaatggagtaggtaagacaacattgattaagtcaattgttggacagattccatttttagcaggtcaagcaaaattgggtgccaatgttactttgggatattatgaccaagaacaaggaagattgacagcttccaatactgtcttagacgaattatggaatgagcatcgcttacttaatgaagttgaaattcgcaatatgcttggagcttttctttttagtggagatgatgtaaagaaaacggttgggatgctttctggtggtgaaaaagcccgtcttttacttgctaaattagcaatggatcacgataactttttagttttagatgaaccaacaaatcacttggatattgattcacgtgaggtcttggagaatgctttgattgattttccaggaacaatcttgtttgtttctcatgaccgctatttcatcaatagagtagctaccaaagttttagaaattgctcccgaaggaagtacagaatttttgggagattatgattattatgtcgagaaaaaagaagaagtacaagctgagagtaattcttcagaaaatggggagccgatagaaagtttagctcaacaagattttacagctcagaaagaagctcaaaagaatcgacgtaaagtagagcgcgaaatcaaggcttgtgaagagaaactagccgatttggaagcaaaaattgcagctctattattggaaatgcaagaaaataccgctgattttgttaaattaggagaattaccagctgaaattgacctctttaatgatgaaaaagatgagatagaaatgactcttttggaagcgatggaagaattggaaaatttgtaa

SEQ ID NO: 42087 - DNA, 2277 bp, Lactococcus lactis
atgaatccactattacaaggaatgaacgaaaaacaagcagaagcggtccaaactacagaagggcctttattgattatggcaggagctggttcgggtaagactcgtgtcttaactcatcgaattgcttacttaattgatgaaaaaatggttaatccttggaatattttagcgattacctttacaaataaagcagcaaaagaaatgcgggagcgtgctttatcacttactccaagagcacaagatacattaattgcgacctttcactcaatgtgtgtaagaattttgagacgtgatgccgatcatattggttataatcgtaattttacaattatagatccaggggaccaaaaatcgttgatgaaacgaattttgaaagaagctaatttagatcctaaaaaatgggaacccaaagggcttttaaatgcgatttcaaatgctaaaaatgatttattagatgaatcagcttatgaagctcaaacaagcgctagacatccatatgaaatggttgttgcgcgtgtttataagatttaccaaaaagaattacgaaaagcagaatcaatggattttgacgatttaatcatgcagacgttgcgcctttttgatgaaaacccggatgtcctttcttactatcaaggaaaatttcaatatattcatgttgatgagtatcaagataccaaccatgcacaatatcagttggttaaacttttagccagtcgttttcaaaatatctgtgtcgttggggatgctgaccaatcaatctatggttggcgcggagcagatatgcaaaatatcttagactttgaaaaagattatccaaaagctaaagttgttttgcttgaagaaaattaccgctcaacaaaaacaattcttgatgcggcaaacaatgttataaaaaataatttaaaacgtcgaccaaaagaactctggacgcaaaatgatgctggagataagattgtttatttccgcgctggaaatgaacaagaagaagcaaataaggtttctgaaattatcacatcaggcattcgttcaggacgttcttatgctgactatgctgtgctttatcggactaatgctcagtctcggacaattgaagattcttttgttaaatctaatattccctatacaatggttgcgggaactaaattctactcacgtaaggaaattcgtgatgttattgcttacttaaatgtagtagcaaatccagcggataatatgagttttgaacgaattgttaatgaacctaaacgaggagtcggtccgggggcattagaaaaattacgtcgttttgctgacagtcgtggactttctttagcagattcaagttttgatattatgttatccgatattcgtggaaaagcggctggtgagatttataatttggcaatggcctttgatttgttgagaacccatagtgaaagttcaacaatcacagaattagttgaagaaatgttagagcgtactggctatgtcaaagctttgcaaatgatgccaagtatcgaaaatcaagcacgaattgaaaatattgaagaattcttgtcagtaactaaagggtttgatgaaaaatcagaaattcctctagatgaagaaacgggagagccaattgttgaaactggattagataagttgagccgtttccttaacgaagttagtttgctttctgaaacagatgcttatgaggaagaatctgaccaagtaacaatgatgaccctgcatgcggcaaaaggtttggaatttccaattgttttcttaattggaatggaagaaaacatttttcctttatcacgggtaaatgaagatattgatgagttggaagaagaacgtcgtttggcttatgttggaattacacgggcagaagaaacgctctacttaatgaatgccaatcaacgtgtgctttatggtaaaacgaattataatcgtcccagccgttttatttcggaaattgatgatgaattactagaatatgctgggattgctcgtaaagcaaattcaagcttcaatgcttcttataaatctggtggttttgccagtgggatctcgatgtcagatgcgcttcatcaaagaaaagcagtcattaatccaactgcagctcaagcgacgattaataattctgaaacagaagattggcaaattggcgatacagcgattcaccgtaaatggggcgaaggtatggtattaggaatttctggttctggtaaaaatatggaactcaagattaatttcccagaagtcggaatgaaacgtttattagcagcaatggctccaattgagaaaaaatag

SEQ ID NO: 42088 - DNA, 1509 bp, Lactococcus lactis
atgaaaatttggactaaactaggcttgctaacgcttgtgggcctctctttgacttcttgtgggagtaatacaaagaatacaaaaggacaatcaagttcgtctcagaaagttgaaacctcggctggtgcaagtaaatcaaacatctatgctgatccttctactttaagtgataaatacgatgtgattattgttggttctggtggggctggaatgactgcagcaattgaagcaaaagatgctggaatgaatccagtcattttagaaaaaatgccaattgctggtggaaatacttcaaaagcctcagctggtttgaacgcatcagaaacatcagtcgaaaaagcacaaggtgtcgctgattcaaatgataaattttatgaagaaacgctcaaaggtggtggtggtacgaatgacaaggcactccttcgttattttgttgaccactcggctggtgctgttgattggttaaatacaaatggaattgttttagataatttaactacgacagggggaatgtcagtttcaagaactcaccgaccacatgatggttcagcagttggtggttatttggtaaaaggtcttgaagaaaatattaccaaacgaaatattcccttatttgtaaatagtgatgttaccaaaattactgaaaaagatggtaaagtatctggagttaaagttaagattgagggtgaaactaaagatatttcttctaaagcagtcgttgttacaacaggtggattcggtgcaaataagaaaatgattgcaaaatatcgtcctgaccttaaagattatgtgacaacaaatgcggctggttcaactggtgacggaattactatgatttcagaacttggtggggaattagttgacatggataaaattcaaattcatccaactgtattccaaaaaacaggttatcttgtttcagaatcaattcgtggtgaaggggcgattcttgtaaatcaaaaagggaaacgtttctttaatgaaatggatactcgtgataaagtttctgctgctgaacttaaacaaccaggaaaatattcttatgttatttttggagaaggaactaaagataaagtaaaagcagttgaacagtatatatctaaagatatggtcgttgaagctgacagtatcaagggacttgctgacaagctcgacattaatgaaaaagcactgacttcaacaattgatggttggaacaaagctgtatcaactaaaaaagatgaagactttggtcgtacaacaggaatgactactgaagtatcaggtaagtattatgccattaaagtggctccaggaattcaccatacaatggctggggtaaaaattaatacaaatactcaagtcttgaaaaaagatggtagtccaattcaaggattatatgctgccggagaagttacaggtggtctccatggtggtaaccgcattggtggtaacgctgttgctgatattgttatctttggacgacaagctggaactcaatctgcggcctatgctaaaacaagcaattaa

SEQ ID NO: 42089 - DNA, 972 bp, Lactococcus lactis
atgaaaattaataacaaaaaagttgtaattgttggagctggagccgtagggagtacttatgctcataatttagttgttgatgatttagcagacgaaattgcaataataaataccaacaaaagtaaagcttcagccaacagtttggacttgcttcatgcgcttccctatttaaatgcagctcctaaaaacatttatgctgctgattattcagatgtttctgatgcagatattgttgttttgtctgccaatgctccatcagcaactttcggaaaaaatccagatcgcctacagttattagaaaataaggtcgaaatgattcgtgatataactcgtaaaacaatggatgcaggttttgatggtatcttcttggtcgcatcaaatccagttgatgtccttgcccaagttgttgcagaagtatctggcttgcctaaacatcgtgtgatagggacaggaacgcttttagaaactagtcggatgcgccaaatcgttgcagaaaaactccaaattaatcctaaaagtattcatggatatgttttagctgagcatgggaaatcaagttttgccgcttggtcaaacgtgacagtcggtgcgattccattaacaacgtggctcaaaaaatatcctaatccagagtttccaaccttcgatgaaattgatcaagaaattcgtgaagtaggtttggatatctttatgcaaaaaggaaatacctcttacggaatcgctgcttcattagctcgtttgacaagagcaatttttagaaacgaaagcgtgattctgccagtttctgcctatttgacaggagagtatggtcagttcgatttatatacaggaagtcctgcaattattgatagaacaggtgttcgagcagtcctagagttagaattaactcaagaagagcaagaaaaatttaaagcttcaacggttcttcttaaagagaattttgattcaattaaagaaaaatgtactttgtaa

SEQ ID NO: 42090 - DNA, 759 bp, Lactococcus lactis
atgtcacgtaaaccaattatcgctggtaactggaaaatgaacaaaactttgtcagaagcgcaagcttttgttgaagctgtaaaaaataacttgccttcatctgataatgttgaatcagttatcggtgcacctgcacttttcctcgctcctatggcttaccttcgtcaaggttcagaattgaaacttgctgctgaaaatagctactttgaaaatgctggagcgttcactggtgaaaatagtccagctgctatcgttgatttaggtgttgaatacatcatcatcggtcacagcgaacgtcgtgaatatttccacgaaactgacgaagacatcaacaaaaaagcaaaagcaatcttcgctgctggagcaactccaatcctttgttgtggtgaaactttggaaacttttgaagctggaaaaacagctgaatgggtttcaggtcaaatcgaagctggtcttgctggcttgagtgctgaacaagtttcaaacttggttattgcttatgaaccaatctgggcaatcggaactggtaaaactgcaacaaacgaaatcgctgatgaaacttgtggtgttgttcgttcaacagttgaaaaactttacggaaaagaagtttcagaagctgtacgtatccaatacggtggttcagttaaacctgaaacaatcgaaggattgatggctaaagaaaacatcgacggtgccctcgttggtggagcttcacttgaagctgatagcttccttgcattgcttgaaatgtacaaataa

SEQ ID NO: 42091 - DNA, 594 bp, Lactococcus lactis
atgaagttattagaagaccgcattcatacagacggtcaagtattaggacaagacattcttaaagttgaccgctttttgacacaccaagtggattatcaattgatgaaggaaatcgggaaacgttttgcacaggtttatgcaaatgcaggagttacaaaagtcgtaaccattgaagcaagtgggattgcccctgctttatatgctgctgaatcactcaacgttccaatgatttttgctaaaaaagcaaaaaatgtaactatgaatgatgatttattgattacagaagtttattctttcactaaaaaattaacttcaactgtccaaatttcaagcaaactcattgaagaaggcgataaagtcttgattattgatgactttttagctaatggtcaagcagcacttggtttggttcatttaatggaacaagctaaagcagaagttgtcggtttaggaatggtaattgaaaaatctttccaagatggccgtcaaaaacttcttgaccaaggaatgaaacttaccagtcttgcccggattgaaaaatttgaagatggtaaagtcatcttcgccccagccgatgataaagatttcgactaa

SEQ ID NO: 42092 - DNA, 507 bp, Lactococcus lactis
atgataattggaatatgggcagaagatgaagcaggtcttatcggtgaagctgataaaatgccttggtctttacctgctgaacaacaacattttaaagaaacaaccatgaatcaagtgattttgatgggacgaaaaacgtttgaaggcatgaataaacgtgtattgccagggagaataagtattattttaactcgcgatgaaacttatcaatcagataatgaaaaagtgctcatcatgcacagccctaaggaagttctagattggtaccataagcaaaataaagacttatttatcacaggaggagctgaaattttagccctttttgaatctgaacttgaattgctctatcgaacagttgttcatgaaaaatttaaaggagatacttattttccaagtacatttgactttggaagatttaagctagtctctgaaaaatttcacgataaagatgagcggaattcttatacttttacaattaaaaaatatgaaaaagtgaaacaaccatga

SEQ ID NO: 42093 - DNA, 1284 bp, Lactococcus lactis
atgtctatagaagaagcattggaatggatacattcacgtttaaaatttaatattcgcccaggcctaagtcgtgtttcggcccttttagaattgcttggtcatccagaagagtctttgtcaatgattcacgttgctggaacaaatggaaaaggctccacagtcgctttcacacgctcaatctttatgcaggcaggtctgaaggttgcttctttcacaagtcctttcatcaccacttttggtgagcggatgtcgattaatgcactcccgattgctgatgataaattaatttattatgtagaaatgatccaaccacttgttgctgaacttgataaagatgctgaactgactggaattaccgaatttgaaattatcacggcaatggcttttaaatatttctctgatgagcaggttgatttagcggttattgaagttggtttaggtggacttcttgattcaacaaatgtgattaaacctgttgtttctggaattacaacaattggtttagatcatattgatattcttggttcgaccattgaagaaatcgcagctcaaaaggctggaattattaaaccaggaattccagtagttgttggaaatattgaattaaaagcacttcgggttatatgggaagtggctagaaaaaatacagcgcgtgtttatcaatttccatatgattatcgtacggaagtggaagaacacgaacattttaatttcttttctggtcaagaagcaatattggatattgaaaaatctttagttggcttacatcaaatagaaaatgctggtatggctattgaactttctctggtttatgcaagtaaggttgggattgaattgactgaggatgtgattcgctctggaattcgtgaggctttttggccagctcgtatggaaaaattgggtgaaaaaccactcattttactggatggtgctcataatgttcatgcgatgaatcgtttgcttgaaaatcttagctctgagtttccagataaaaaaattacaatcattttttcagccattaccacaaaagatattagtcaaatgataaaaatgcttcaaactgtgaaaaattcgcatctgattttgacaacttttgattatccaaaagctttgaatttgggagattttcaaagattggaagaagaaggggttgaattggctccaagttgggaattagctttagttcgtgcgcaaaaaaatttagctgaagatgatttgttattagttacaggctctctctatttctcatctcaagttcgtgagtttttgaaaaaagagaagtaa

SEQ ID NO: 42094 - DNA, 1287 bp, Lactococcus lactis
atgacagtaaatatagcaatattggggtttgggacagttggaactgggcttccaactttaatttctgagaataaagaaaaactatcaaaaattttagatgaagaaatcgtcatttcaaaagttttgatgagagatgaaaaagcaattgaaaaagctagagcacagggttatcaatatgattttgttctaactttagaagaaattttggctgattctgagatttcaattgttgttgagttgatgggacggattgaaccagctaagacctacattacgaaagtgattaaagcgggtaaaaatgttgtcacagccaataaggatttactggctgttcatggaactgaattgcgtgctttggcagagaaacatcatgttgctctatattatgaagcggctgttgctggtgggattccaatcttaagaactttagccaattcattttcatcagacaaaatcacacatcttttaggaattcttaatggaacaagtaattttatgatgacaaaaatgtcagaggaggcatggacttacgaccaatctttggccaaagctcaagaacttggttatgctgaatctgacccaacaaatgatgttgacggaattgatgccagttataaattagcgattttaagtgaatttgctttcggaatgacgctaagtcctgatcaaatttctaaatctggcctcagaacgattcaaaaaactgacgttgagattgctcaacaatttggctatgttttaaaattgacaggtgaaattaatgaggttgaatcaggaattttcgctgaggttagcccaacttttcttcccaaaagtcatccattggccagtgtcaatggtgttatgaatgctgtttttattgaatcagatggaattggggattcaatgttctatggggcgggagcaggtcaaaagccaaccgctacgagtgttttagctgatattgttcgaattgttaaacgggaaaaagatggaacaattgggaagtcatttaatgaatacgcacgtccaacgagcttagctaatcctcacgatattgtaaataaatattatttttccgttgaaacaccagattcaactgggcaattattgcgcttggtggagttatttacaagtgaagatgtctcttttgaacaagttttacaacaaaaaggtgatggacatcgcgcagttgttgtgattatcagtcatcagattaaccgcgttcaacttttggccattcaagataaattaaaagaagaagtagattttaaattacttaattattttaaagttttgggggactag

SEQ ID NO: 42095 - DNA, 1083 bp, Lactococcus lactis
atgagttggcaaaataaccttcggtcagtaagtccctatattgcaggtgaacaacctgaacttactgacataatcaaattaaacactaacgaaaatccatatccgcccactagtgtagctcaattatttaatgaacgttataagacaaaaaatttgcgtctttacccaagtactgacgcgaaaagtttaagaaaaaaattggccgactatcatcatttagaagttgaacaggttattattggaaatggctctgacgaagttttgtcacttagttttctgaccttttttaatagtcaaagccctttattaatgcctgacattacttattctttttaccctatttattgcgaactctatcgaattccttttcaaaaagtccctgtggatgatgattttaaagttttaataaaagattattgtattgaaaatggcggaattgtgattgcaaatcctgatgctccaacggctttggcactaaatcttaaagatatagaagaaattctgaaaaaaaatcaaaactcaattgtcttgattaatgaagcctatattgattttggtggtgaaacatgtcttcctttgcttaaaaaatacgataatttagtagtggttcaaactttttctaaatcacggagtttggcaggaattcgtttgggtgtagcttatggctctgctgaagcaatttctcatttgtatgatgtgaaaaattcatttaattcctatccaattgatagtttggcacaaattattggagaagcaagtttaatggatgaacattattttcaaaaaaacattcagaaaatcattaagacaagagaagtttttaaagataatctggttaatttaggatttgaagtgactgattcaaaggctaactttgtttttgttcatcatccaaaagtaaaagcggaagaactttttaaggcgctttatgaggcaaaaattattgtcaggcattggaatcaaccacggattgatgattggttacggataactattggaactaataaagaaatgaacaaagtgattgaatttttaaaaggctatttaaaaaagaatgaggaaattgacgaatggaaaaaataa

SEQ ID NO: 42096 - DNA, 1296 bp, Lactococcus lactis
atgctcaaacaaattgattatcaaggaaagcttgaagaaattgctgaaaaatttcaaggtcgaaaaacagaactatcaaaagaagttaataaaactgttcaacagattgtagaagacattcaaaaaagtggagatactgccttatttaactatgctaaaaagttcgatggttatgatgtgaatactagtaatttactcgtcacgcccatggaacgtgaaacaggactagaacaaattgatgaggattattttagaattcttagacgcaccaaatcacaaatcgaagaatttcataagcaccaactgggaaattcatggaatatttttaaggaaaatggtgttatcatgggacaaattgcgcgtcctctggaacgtgttgctctctatgttcccggaggaacggctgcatatccctcaacagtcattatgaatgctgttccagcgcttttagcaggcgtcaaagaaattattatgattactccagttaaaactgatggaaaagtaaatcctaatattttagcagctgctgaagtttgtggaatagaaacaatctataaagtgggtggagcacaaggcgttgctgccgttgcgtatgggacagaatctattcctaaagttgataagattgtcggacctggaaatatttttgtagctacagctaagaaaatctgttatggggtggtagatattgatatgattgccggtccgtcagaagttctagttattgctgacgaaactgccaatccaaagtatattgctgctgatttaatggcgcaagcagaacatgataaacttgcgtcagcgattttagtgacgacttctgaaaaacttgttcaacaagtagatgaggaattaaatagacaagttcaaaatttggaacgtagtgaaatcattgaaagttacatcagtaattacggtggagccattgttgtaaaaaatattgatgaagcctttgatgtttccaatcagctggctccagaacatttagaagttttgactagtgaacctttaacccaacttccaaaaatcaaaaatgctggctcaatttttattggagagtatacgccagaaccgttaggcgactatatgtcaggaagcaatcatgtcttaccaactggaggaacagccaaattttactctggtttgggtgtttataattttataaaatatttgacttatagctattatcctaaagaagttttggctgcttttaaagaggatgttgagacatttgcaaaatcagaaggattgacggctcatgctaactcaatttctgtgagatttgatgaaatgtaa

SEQ ID NO: 42097 - DNA, 603 bp, Lactococcus lactis
atgacacgcatatcacacatcacgcgtaataccaaagaaacacaaatcgaactttccatcaatcttgacggcacaggtcaagcggacattagtacaggtattggttttctcgaccacatgctgacacttctcacctttcacagcgattttgacttaaaaatcataggacatggggatcatgaaacagtagggatggacccgcaccatctcattgaagatgttgcgattgctcttggcaaatgtatcagcgaagcattaggtaataagctcggtattcgacgttatggaagttttaccattccaatggatgaagctttggtgacttgtgatttagatattagtggacgaccttatttggtatttcatgctgatttatcaggaaatcaaaaacttggtggctatgatacagaaatgactgaagaattttttcgtgttcttgcttttaatgctgggattacgttacatctgaacgaaaattatgggcaaaatacgcatcatattattgaaggcatgtttaaatctacagcgagggcgctaaaacaagctgtaagtattgatgaagcgaaagttggagaaataccgagcagtaagggagtgttatga

SEQ ID NO: 42098 - DNA, 780 bp, Lactococcus lactis
atgctaactaaaagaatcatcccttgtcttgatattaaaaatggtaaggttgttaaaggaattaattttgtgagtttaagagaaataggtgattccgtggaattggccaaaatatatgaagaacagtgtgcagatgaaattgtttttcttgatattacagcatcttttgaagaacgtgaaattattggtgaattaattggtcgggcggcgcgtgaactttcaattccattaacctttggtggaggaattcgttcaattgacgattttagaagaattcttgctagaggagctgataaagtatccgtcaactcagctgcaattgaaaatcctgaacttattcgtcaagcggctaacgaacttggcgttcaatgtgttgttgttgctattgatgctaaaaaacgagcagaccataggggatatgatgtctatatcaaaggtgggcgtgaaaatgcaggtcttgacttagttgattgggctaaaaagtgtgaaagattaggagcaggcgaaattttactaacctcaatggataaggatggaacaaagacaggctacgatttggaaatgctgaatgacgtttgtactgctgttaatattcctgttgtagcaagtggcggttgtgggaagatttcggacattgttgaagtttttcaaaatacaagaagcgatgctgcccttgttgcttcattatttcattatggcgaagcaacagttgatgaagttaaagacgaacttataaaaaataatattccagcaagaattattaagaaggagacattatga

SEQ ID NO: 42099 - DNA, 639 bp, Lactococcus lactis
atgagaccagattttcataagcaggaacttattcctgttattgttcaagattatcaaacaaatcaagtattaatgcttgcctatacaaatgaagtggcttttgagaaaatgcttgaaactggtgaaacttggttttggtcacgttcacgacaaaaactttggcacaaaggagaagaatcaggtcattttcaaaaaataaaaggaatgcgtttggattgcgaccaagatactttattggtttttgttgaacaaattggtaatgcttgccataccggaacttactcttgtttttatgatgaacttattccttttgatgactctgatatttttagtgagttggagaagcaaatcatcgaccgaaagttacatccagtcgaaaaatcttatacgaattatttgcttggagagggcattgataaagtattaaaaaaagttggtgaagaagcaagtgaagtgattattgctagtaaaaattcagataaaggagaacttttaggagaaattgatgatttactttatcatttgtttgtattaatgaatcagcaaggtatttctctagaagaagtacggcaaaaagcaaaagaacggcatcagctagaaggaaataagaaggaatttcatacaaggacggcagattaa

SEQ ID NO: 42100 - DNA, 963 bp, Lactococcus lactis
ttgtctaaaaaaattgtgacacttgcgggagatggaattgggccagaaattatgtcagctggtttaagtgttttaaaagctgtcagtaaaaaaattgattttgagtatgaattagaagctaaagattttggaggaattgcaattgataagcatggtcatcctttaccagaagaaactttgcaagcagttaaaaatgctgacgcaatcttgctcgctgcaattggtcatcctaaatacaacaatgcaaaagttagaccagaacaagggctacttgctttacgaaaagaattaggactgtatgctaatgttcgtccattaaaaatttatccggctctaaaaaaactttctcctatccgaaatgttgaaaatgttgatttcctaatgattcgcgaactgacagggggaatctatttcggtcagcatgaattggcagatgacaaagcacgggatgtcaatgattattctgctgatgaaataagaagaattcttcattttgctttcaaaagtgctcaaagtcggcccagaaaattactgacttcggttgataaacaaaatgtccttgcaacttctaaattatggcgaaaaatggctgatgaaattgctgacgaatatcctgatgtacgattagagcaccaattggtcgattcttgtgcgatgttactgattactaatccgcaacaatttgatgtgatagtcactgaaaatctatttggtgatattctctctgatgaagcaagtagtttggccggtagcttaggagtgatgccttcgagttcgcatggatttaacggtttagcactctatgagccaattcatggttcggcaccagacattgcaggaaaaggaattgcgaaccctgtttcgatgattctatcaattgccatgatgctaagagaatcttttgggcaagaagatggggctacgatgattgagaaagccgtaacccaaacttttactgactga

SEQ ID NO: 42101 - DNA, 1383 bp, Lactococcus lactis
atgtcaggtaaaacaatatttgataaactttgggatcagcatgtgattgctggaaatgagggagaacctcaactgctttatattgaccttcatgttattcatgaggttacgagtccgcaagcatttcagggcttacgtgaagcaggacgtcgtgttcggagaaaagatttgacatacggaactcttgaccacaatgttccaacacaagatatttttaatattcaagatttgatttctaaaaaacaaattgatacttttactaaaaatgtcaaagaatttgatgttccagcggagactcatggtggaaaaggacaaggaattgttcacatggtagcacctgaatctggcagaactcaaccgggaaaaacaattgtttgtggcgatagtcataccgcaacaaatggagcatttggtgcaattgcttttggaattggtacaagtgaagttgaacatgttcttgcaactcaaaccatttggcaagttaaacccaagcgtatgaaaattgaatttcaaggtcatccacaaaaaggaatttatagcaaagactttatcctcgcattaattgctaaatatggtgtggatgcaggtgtaggttatgcggttgaatatagtggggatgctatcagtgatttaagcatggaagaacggatgacaatctgtaacatgtcaattgaatttggggcaaaaattggcctgatgaatcctgatgaaaaaacttatgactatgtcaaagggcgtgaacatgcacctaaaaactttgatgaagctgtcagtaaatgggaaaaacttgtcagtgattctgatgcacaatacgataagattttaagtcttgatgtcagccagttgaaaccaatggtgacatggggaacaaatcccggaatgggcctagaatttggcgaaaagtttccggaaattaacaatgatttgaattatgaacgtgcttatcagtacatggatttaaagccaggccaaactgcttctgctattgatttaggctatattttcattggttcttgtacgaatgctagacttggtgatttagaagaagcagcaaaaattattggagacagacatattgctgatggactgacaggaattgtcgtccctggaagcagacctgtgaaagaagcggctgaagcacaaggtcttgataaaatttttaaagaagctggttttgaatggcgggaaccgggttgctcagcctgtcttggaatgaatcctgaccaaattccagaatacgttcattgtgcttcaacctctaatcgaaattttgaaggacgtcaaggacataatgcaagaacgcacctgtgctctccagctatggccgctgccgccgcaatcgctggtaaatttgtagatgttagaacgctcgtaacagattag

SEQ ID NO: 42102 - DNA, 2133 bp, Lactococcus lactis
atgccaacttcaactaaaagtaaaacaaaaacaactacaaagaaaaaaacaacacgaaaaagagtcactccaggtaaaaatctggttattgtagaatcgccagcaaaagctaaaacaattgaaaaatatttaggtcgaaactacaaagttgtggcttcagtaggtcatattcgtgatttgaaaaaatcaaccatgtctgttgatatagagaatgactatgaacctcaatatattaatattcgtgggaaagccccattaatcaactctctcaaaaaagaagcaaaggctgccaaagccgtctatctcgcaagtgacccggaccgtgaaggtgaagcaatttcttggcacttagcacatatcttaaatcttccacttgaagaaaaaaatcgagtggtctttaatgaaatcactaaagatgctgttaaaaatgcctttaaggagccgcgtcaaattgatgtggatctagttgatgcccaacaagcacgccgagttcttgaccgtttggtgggttattcaattagtcctattctatggaaaaaagtcaaaaaaggactttcagcaggtcgagttcaatctattgccttaaaactaattgttgaccgcgagaatgaaattaatgcttttattccagaagagtattggtcaattgatggtgaatttaaaaaaggaactaaaaaattcaaagcatccttctggggaattgacggaaaaaaacatcctttaaaaaccaatgaagatgtcatcaaagtcatggaacgtttagacggtcctgattttaacgtagataaagttgaaaagaaagaacgtcgcagaaacgctcctcttccttatacaactagctcaatgcaacaagacgcagctaataaacttaactttcgtacccgtaaaacaatgatggttgctcaacaactttatgaaggtcttactttaggaagccagggccatcaaggtttaattacctatatgcgtacagactcaacacgtatttctcctgttgcacaaagtgcagctcacaattatattgctgatcaatttggagaaaaatatagtaaacacggttcaaaagttaaaaatgcctctggagcccaagatgcccacgaagcaattcgaccttcaaatgtctttaacactccagacgccattgctaaatatctagacaaagatcaactaaaactttacacactcatctggaatcgtttcgttgccagtcaaatggtcgcagctattttcgatactgttaaagtaaatctgtctcaaaatggtgttatctttattgctaatggttcacaagtgaaatttgacggttatctgcgaatctacaatgattctgataaatcaaatatgcttccagagatggaagaaaatgaaactgtcaaaaaagcgaatgttaaaccagaacaacatttcactcaaccaccagctagatattccgaagcaacactcatcaagacattggaagaaaatggagtgggacgtccctcaacctatgcgcctacactagaaacaattcaaaaacgttactatgtgagattgtcagcaaaacgttttgaacctacagagcttggagaaattgtcaataagcttattgttgagttcttccctaacattgtaaatactgaatttacagctgaaatggaaaaagatcttgatgaagttgaagaaggaaaacgtcaatggattgaggttgttgaccaattttacaaaccctttgcaaaagaacttgaaaatgccgaagaaggtatggaaaaaattcaaatcaaggatgaacctgctggctttgactgtgatgtttgtggaagtccgatggtaattaagttgggacgttttggaaaattttacgcttgtagcaacttcccagattgccgaaacaccaaagcaattgtcaaagaaataggcgtaaaatgtccactttgccatgaaggaaatattattgaacgcaaaacaaagaaaaatagaattttctatggttgtgatcgttacccagactgtgaattcacaagttgggacaaacctatcggacgtgattgtcctaaatctggacattttcttgttgaaaagaaagttcgtggtggcggtaaacaagtggtatgttcaaatgatgaatgtgattatcaagaagaaaaacaaaaataa

SEQ ID NO: 42103 - DNA, 843 bp, Lactococcus lactis
atgattgaacaagaaaaatatacgcttaatgatggacatttgattcctaaaatagggttaggaacatttcagattcgtggatatgaaggggtggagcaaattttaacggctatacaaagcggttatcgtttacttgatacctcaactaattatgatagcgaaggagcagttggagaggcaattcgtcgttctggcatccctcgatcaaatttttttgtgacaactaagctacctggtaaatatcatcattttgaagatgctttgaagatgattgaagagtctttattacgaacaggattgagctattttgatctttacttgatccactggccactaccaaagcgagataattatgttgaagcttggaaagcactaattgcagcaaaaaaaaggggtcttgtaagatcaattggggtatctaattttgaggaagaccatctcgacaaaataattcaagaaactggtgttataccagcaattaatcaaaatgagattcacccttactggcctcaagaaaagctattaaaaattaataaaaagtatggcattttaactgaggcatggagccctttaggccgaggtagtaaagagcttgaggaaagcctgattcaaaacatagctcaaaaatatggtaaggatactgggcaaatcattctaagatggcaagttgaaagaggtattatacctattgttaaagcaacttctccagaacaccaaagaagaaatatagatatttttgatttttcactttcttctgaagagattaataaaatcacagccttaaaacaagaaaatggcagggtagataatcaagatcctaatgagtatgaagaatttgtgtaa

SEQ ID NO: 42104 - DNA, 1830 bp, Lactococcus lactis
atggctttttctaaaaaaacaagacaagaagcaatcacaaaaattcaaaatgaagagatggatttactcgttatcggaggagggatcactggtgctggtttgacattacaagcggcggctgctggcatgaaagttgctgtacttgaaatgcaggatttctcagaagggacatcctcacgctcaacaaaactcgtgcatggtggcatccgttacctcaaaaacttcgatgtcgaagtcgtttccgatacagtttcagaacgcgctgttgttcaaggcattgcgccacatattcctaagccagatccgatgttacttcctatctacgatgatgaaggcaagacaacgtttgatatgttttctgtgaaaattgcgatggatttgtatgaccgtttggccggtgtggatgaagattcgccatatgccaactacactatctcaccagaagaagtcctgcgccgcgagccactcatcaagaaaaaaggtttgcaaggggctggagtctatcttgactaccgtaacaacgatgcccgcttggtgattgataacatcaaaaaagctgtggaagacggtgcccaagccataagcaagatgaaagtgattgattttatctatacggatggacaaatttctggtattcgtgcgcgtgatttgttgacagatcaagtcattgaagtcaaagctaaacttgtgattaacacaagtggaccttgggtagataagatccgttacctgaacttcactcgtcccatcgtgcccaaaatgcgtccaacaaaaggtgtccatcttgtagtagatgcggccaaattgcctgtaccacaaccaacttattttgatacaggcaaacacgataaacgcatggtctttgccattccacgtgaaaataaaacttattttggtacgacagatacggattatcatggcgactttaccgatccaaaagtaactcaagaagatgtagattacctcttggatgttattaatttccgttacccagaagcaaatattacgattaatgacatcgaagcttcatgggcaggattgcgtccattgttaggcggaaattctggatcagactataacggcggtgataatggtgcggtctctgaaaccagctttaacgctgtcgttgaggcggtgctccgctataaaaataaaacagcaacaaaagccgaagtggagcatttgttgaacaatatggaatcaagcctttccgaaaaaggagatgcaccatcttccgtttctcgtggcagctcacttgaacgcgagagcgatggtttgattactttagcgggtggtaaaatcacggactaccgtaaaatggcggcaggtgcgatggagcttatttgccaattgcttgaggaggactttggtttgaaatacgaacctattgactctaaaaaataccaaatctctggtggcgaatttgacccaactaaagttgaagaagttgttgctgaaaacatgaaagttggtgtcgctgcaggtcttacagaagaagaagcaaaatacattgctgacttttatggtatgaatgcactccaagtctttgcctatgcttctgaaatggaagcttatgaaggcttatctctagccgaatccgcacgtctttgctatgcgcttgaggatgaaatgatcttaacaccagtggactacttgcttcgtcgtaccaaccacatcttgtttatgcgtgaaggagtagatgctatcaaggtacatgttgtcaatgccatggcggacgaccttggctggtctgcagaagaaaaggcagaacaagaaaaagctttggaagaagcacttcgtgaatcggacttgtcggatttgaagaagtaa

SEQ ID NO: 42105 - DNA, 1497 bp, Lactococcus lactis
atgacagaaacttcttacattatggcaattgaccaaggtacaacaagctcaagagctattatatttgataaacatggtaaacatatcggcagctcccaaaaggaatttacacagtactttcctaaagaaggttgggtggaacatgatgccaacgaaatttggaactctgttcagtctgttatcgcaggggcttttatcgagtcggggattaagcctgtacaggttgcgggtatcggtattactaaccaacgtgaaactaccattatatgggacaagaaaacaggaaaaccaatctatcatgctattgtttggcaatctcgtcaatctgccgatattgccaatggtcttaaagaagcaggacatgaggaactcttccataaaaagacaggacttattgtcgattcatatttttcagccacaaaaattcgttggatccttgaccatgtcgaaggagcacaagagcgtgcagaacgcggagagctcctctttggaaccatcgatacatggctcttgtggaagttgacagatggtgatgcacactatactgactattctaatgccagccgtaccatgctctacaacattcatgagttgaaatgggacgaagaaatcctgaaaattcttaatatcccagcttcaatgcttccagaagtcaagtccaactcagaagtttacggcgtgactaaaggtttccatttctttggctctgaagtgccaatctcaggtatggcaggggaccagcaagctgcattatttggtcaaatggcctttgaacctggaatgattaaaaatacctatggtacaggttcgtttatcgtcatgaacacaggtgagaaaccacatatttcgaaaaataatatgcttacaacgattggttatggcattaatggaaaagtttattacgccttagaaggaagcatctttgttgcggggtcctctatccaatggttacgtgatggtttgaaaatgttggaacgtgccagtgattccgaagaagtggcactccagtctaggagtcaagatgaagtttatgtggtgccagcttttgtcggccttggtgctccgtattgggaccaagaggcgcgtggtgcgatgtttggcttgacacgtggaacaacaaaagaagatattgtgaaagcaaccttacaagggatagcttatcaagttcgtgatgtagtcagcaccatgaaagaagatacaggaattgatatgtctgtgctcaaggtagacggtggcgctgcaaacaatgaatatttgatgcagttccaagctgatatcttgaatatcccaatccaacgtgcgggagatttggaaacgacagcacttggtgcagccttccttgcaggacttgccgttggtttctggaaagacttagaagagcttaaagaatcctatgaaccgggcaaaattttccaaactcagatgcaagaagaacgtagagaagaactctatgccggttggaaaaaagccgtgaatgcgacacgtgctttcaaataa

SEQ ID NO: 42106 - DNA, 1023 bp, Lactococcus lactis
atgacttttaaagaactcagtaacaaaattaacattaaagatgtaagagagctaaatcatttaaatgatgagcaacaagaaaagaaagaaaaacgtgataaggaacttgaagcgataattaagggtgaagacgatagaatcctcttagtcattggcccctgctcatcggataatgaagctgcagttctagaatatgctcacagattgttaaaacttcaaaaagaagtagaagataaaatttttattgtgatgcgtgtttatactgcaaaaccgcggacaaacggagatggctataaaggcctcattcacgaacctgatgcagatggacatacagaccttatcaatgggataaaaatggttcgtgaccttcactataaagtaattactgaaactggtctgactacagcagatgagatgctatacccagaaaatctaccattagttgatgacttagtaagttactatgcagttggcgctcgctcagttgaaaatcaacaacatcgctttgttgcctcaggaatagatgccccaacaggaatgaaaaacccgacatcagggaatttaaaagttatgtttaatggaatgtatgcagcccaacaatctcaagattttctatttgggaatgctgaagtagaaacatcaggaaatccattagctcatgccatccttcgtggtggacaagatgaaaatggtaaaaaccatccaaattactatacagataatcttcttgaaagtatcgaaatatacgaaaaaatgggtttacaaaatccatttattgttattgatactaatcatgataactctgggaagaagtatatggaacaaataagaattgttcgtcaaacattagtcaatcgtaattgggatgaacaaattcataaatatgtcagaggatttatgattgaatcatatcttgaagacggtcgtcaagacaaaccagaagtatttggaaaatcaatcactgacccatgtttgggttgggataaaacagaagaacttattaatgaaatttataattcgtga

SEQ ID NO: 42107 - DNA, 2280 bp, Lactococcus lactis
atgactatgaaaaaatcaattattgctttcccacgtatcggttcaaaccgtgaattaaaatttgctcttgaaaaatattttcgtaaagaaattacagaagaagaattacaaacagtagccaaagaaattcggttggaaaattggaaaagtcaaaaagaagctggaattgactcacctatttccaatgacttttctttctatgaccaaaccttagatctatcaattgctcttggtgcaattccagggtcttataaaaatttagaattaagtgaactagatactttatttgcattagcgcgtggtttccaagatgaacaaaatgacgtaaaagcaagaccaatgaaaaaatggtttaatacaaactatcattatttagttccagaaattaacaaagatacaattattaaagcaaatttttcaaaattattaaatgaatataaggaagcaaaatctgctggatttgaaaccagaccaacaattattggcccatatacatttttagttttagcagattacaagtcaggagccacgaaagatacagtattatctgatgttattgtagcttttcaaacactattaaaagaacttaatcaactaggagtagaatggttacagattgaagaaccagcacttgttttagaccaaactgaagaagaaaaaaaattatttgtgagtatttatgaagaactacttaagagtaaaaacaaccttaatatacttcttcaaacttattttggagatgttcgtgatagctataaagaaataataaagcttgattttgatggtattggtcttgattttatagaaggaagagattctttagctcttattcaaaaatacggttttcccaaaaagaaaatactttttgcaggattagtaaatggaaaaaatatttggcgtaataattatcaaaagacacttgagctactaaccgctttagatgaagtagcagatatcgtaattaatacaagctgctctttacaacacgttccagtaacaattaaaaacgaaactaaattatcaaaagaaatccttaaacacttttcatttgccacagaaaaattaaatgaaattgatgaaatttccgatatttattttaataaaaacacttcttttttgaagaagaatgtcgaactttttgaaaatgaaagagttcgtgaaaattctaaacttaagcaaaaacttgataaattaacagaaaaagactttactagacaaccttcactagtcgaaagacgagcaagtcaatctcaatcgcttaatttaccagttttaccaaccacaaccatcggttcatttcctcaaacggcagaagtgagaaaagttcggctacaaaataagcgaggagaattaagacaagcagattatgacacattcttagaagaaaaaataaaagaatgtcttaaactccaagaagatattggattagacgttttagttcatggtgaatttgaacgaaatgacatggtagagtattttggagaaaagttagaaggttatgtttttactcaaaaagcatgggttcaatcttatgggacacgttgtgtcaaacctccaatcgtgtggactgatgtcactagaccggaagctatgaccgtccgttggtcagcctatgctcaatctcaaacatctaaaccagtaaaaggaatgctgacaggtcctgtaacgattctaaattggtcttttccgcgagaagatatttcgctaaaagcaagtactttacaattggcattagctgttcaagaagaagttcttgacttagagaaagctggcattaagattattcaaattgatgaggcagctttgagagaaaagttacctcttcgcaaaagtgattggtataaagaatatctagattgggcaattcctgcctttcgtttagttcactctaaagtaaaaccggaaacacaaattcacacgcatatgtgttattctgaatttgaagatattattccatccattgacgcaatggatgctgatgtaatttcttttgaagcaagtagaagtgagctatcaattatcgatgcattgaaagctcaccattttaaaactttggttggacctggagtctatgatattcattctccacgaatacctagcgtaaaagaaatacaaaatcaattagaaaaaatattggacaaattaccaattgaacaagtttgggtaaaccctgattgtggtcttaaaacacgtggtaatgccgaaaccattcctagtttaagacacttagttgaggcaactagggtgttaagaaaggaaaaggttgtatatgacaagtaa

SEQ ID NO: 42108 - DNA, 2733 bp, Lactococcus lactis
atgaaaaaaattagaaaaacactcgaaaacacaaaaagagctacaacatttgtagataacaatgaaataaatgcaagattagaatttgcaaaaacttctacaaaagaggagctatttcaaaaatttaaaacatcaaataaaggattaagtgaagaacaagtagaaatctctcgtgaacaatatggagataatacgattacgcgtggtaaaaaaacttcacttattaaacggctttatcaagcgttcatcaatccttttaccattatattgtttgtcttagcattagtttcagcttttacggatattatcttagcagctcctggtgagaaaaatccccaaggactcattatcattactacaatggttttaatctcaggaattctgcgtttcgttcaagagactagaagtggaaatgctgctgagaatctcttaaaaatgattacgacgacgacaaacgttcatagattagaatcaggaagtcaagagattcctattgaagaagttctcgtaggcgatattatccatctatcagctggagacatggttccagcagaccttaggattattcaagcaaaagacttatttatcagccaagcctctttaactggtgaaagcgaaccagtagaaaaactagatttagctactgatgaaaaagatgattcaatcacagagtcagtaaacctagccttcatgggttcaaatgtcatttctggtagtgcttatggagttgtaattgcaactggagatgcgaccatttttggtgaaatggcaaaaagtgtaaccgaagactcaactaaaacaacttttgaaaaaggcgttaactcagtttcatgggtccttattcgctttatgttagttatggttccatttgtcttattgatcaatggtttcactaaaggtgattggatggaagctgcactatttgctttagcagttgctgttggtttaacaccagaaatgttaccaatgattgtgacaacttgcctagcaaaaggtgcagtcacaatgtcaaaagaaaaaacaatcatcaagaacctaaattctattcaaaatctaggttcaatgaatattctctgcactgataaaactggaacattaacacaagataaagtagtattaatgcgtcatttagatattcatgggcaagaaaatattcgagtattaagacatggatttttgaatagttactaccaaactggtttaaagaatttaatggatttggcaattattgaaggagccgaagccaagcaagataaaaatcctgaactgggtggtctaagtagtaaatatacaaaagttgatgaaattccttttgattttgaaagacgtcggatgagtgttgtagtaaaaagcaatactaatggagcgacttcaaaaacgcaaatgattactaaaggtgcagctgaagaaatgttagacatctgtactttagtcgaagataagggaaatgttgttcatttaactcctgaactcagagcatacattctgaaaaaagttgatgaacttaacgaagaaggaatgcgcgtgattttagtcgctcaaaaaacaaatccttcaccaatagatacattctcggttcaagatgaatctgaaatggtgttaatgggttatcttgcctttcttgatccacccaaagaatctacagcaaaagcaatcaaagcactcaataaatatggggtatcagttaaaatcttgactggtgataacgataaagttactcgttcagtttgcaaacaagtaggacttccagttgataaaactattttaggttctgatatcgaccaattagatgataatgaattggcaaaggttgccaaggaagcttctgtttttgctaagttatcacctcaacaaaaagccagaatagtaacaacacttagaaattcaggcaatagtgtcggctatatgggagatggtattaatgacgcagcagcaatgaaatcatctgacgttggaatttcagtagatagtgctgtagatattgccaaagagtcagctgatgtaattttgttagaaaaagatttaatggttcttgaaaaaggaattattgaaggaagaaaaacctatgctaacatgattaagtatataaaaatgacagcaagttctaactttggtaatatgttctcagttctaatcgctagtgcatttttaccatttattccaatgttatctattcatattctcttacttaatttaatctatgatttctcttgtaccgctattccttgggataatgtcgatgaagaatatttggttgttccaagaaaatgggatgcaagttctgtaagtaaattcatgttgtggattggcccaacaagttccgtattcgatattacaacttatctcctaatgttctttgtgatttgtccagcaacatttggaccatttagctctcttgttcctggaagtgtagcatatattggatttatcgcgctcttccatactggttggtttgttgaatcaatgtggactcaaaccttggttatccatatgattcgtactcctaaaatcccatttttacaaagtcgtgcttcggctccactaacaatcttaactttcatgggaatcattggactcacaatcattccattcacaagctttggacattcaattggtttaatggctttaccaattaactttttcccatggctaattttaacagtagtgatgtatatgatgcttgtcaccatatttaaaaaaatatttgtttcaaaatacggtgaattactttaa

SEQ ID NO: 42109 - DNA, 1827 bp, Lactococcus lactis
atggagaaatctactgacaaaatgtctgtcagagaaagttggcaagtttttaaatttattttcaaattcttattacctttcaaaaagtatttcgtttgggcttttgtttttagtgtaattacaactgctctggcttcacttatgccttttgttttgtccgtttttatggattcttatttgacacctatgaaagcgactgaccagattattttctattttgcaggtctttatttgattttagcaataatcaattcaatagctttctttttcaaatggaattatctgcaaaatggttcgatttttgttaatcaatacattcgtaagaaagtttatcgaaaaattcatcagctaggcatgcgatattttgaccaaaaaccgacgggttggttaatcaccagaatcacaaatgacaccgatttatttgatttctggcagactttgtttaatgcattaacaagtttgctttctattatcattgccttcattgctttgtttattattgaccaccaaattgcgcttgtgatgttgttgattcttcccctattgattttggcagtattgatttatcaaaaagtgagtacaaaagtttatcaagccatgcttgctaagcgttcagaattgaatacgaaattaaatgaatacatttctgggatgagaattattcaacaatttcgtcaagagagcagactaggaaatgaatttgaaaaaacaaatgatgaatattatggttatcgaaaacgagtgattcagattaatgggattttgttgagccctttggttaattttttgatggccatctcaattgttgttgtcttgttgatgtattctaatcgaagtctacatgcagtggttgaggctggtttaatttatgctttcatcagtaatgtacaaatttactttaatcctatttcaggattgatggattctttatcaaacttttcaaatggattggtggcctctagtcgcattaagacaatcatggaagaaaaagaatttgcgccacaacaaggaatttcaacttctgtcagtaaaaatgttgatgaaaaatttactgacagaaaatctgtcagcaattctccaatcattcaagaaggaaaaattgaatttcgcaatgtcagtttttcatatgacggagaacatcaagttttgaaaaatatctcattcattgtgaatcctggagaaacgcttgcttttgtaggtcatacaggttcaggaaaatcgagtattattaatgttttcatgcgcttctatgaattcacagaaggtcaagttttgattgatgatcaggacattagaagttattcaaaagaagaacttcggaaaaaaattggtttagtattgcaagattcctttatgtttgttgcgtcagttactgacaatatcaaaatgatgaatccacagattactgaccaagcagccaaagaagcggctcgatttgttcaagctgacaaattcatcaaggatttggaaaatggttacgaaaccaaagtaattgaaggtggagctgccttctcggccggtgaacgtcaattaattaactttgctcgaacgattgtgcgtaatccgaaaattctcttattagatgaagcaacagccaatattgatactgaaactgaagcgcttattcaagaaggtctgataaatatgcgacaaaatcgaacgacaatggcaattgctcaccgtttatcaacgattaaagatgctgaccaaattttagtcttgaacaagggagaaattattgagcgaggaaatcatgaccaacttttagagcttaatggttattatgcagacatgtatcgaattcaaactttacaaaaagaactatga

SEQ ID NO: 42110 - DNA, 1818 bp, Lactococcus lactis
atgaaaatttttaaagatttatggtggttttttaaggcagagagaaaaggttatggcgttggtctattagccctttttattgtttcgttaactcacttgattccgcctttaattatcggaaaaattattgaccatattgttaagcgtaacctgactttacccttaattttgagtttttctggtattttattgatcactgcactcgttgaatatggctttcgttttctttggtctaaaaatatttggggtgaagcctttaaactggaaaaaataatccgtagtcggctttttaggcattttttaagaatggatacccttttttatcagagaaatcggactggcgatttgatggctcatgcgacaaatgacctacaagcgatacagagtgttgctggacttggtgttttgacttgggcagattctttaatgacgggcgggatgacaatcattgctatgctcttatttatcgactggcgtttgacgattattgctgtccttcctttgcctttactcgcgctagtatctaaagttttaggggataaaattcatgtaagttttgaacatgcccaagaaaccttctctgaaatgaatgataaagtccaagaatcgattacaggaatgaaagcaatcaaatcttttggtgaagaagaacaagatatggctgatttccaagttaagttagataatattgataaagcctttatcagggtcaattggattgactcaatgtacgatcctttaatcactttaattgttggtttatcttatactttaaccattcttttagggggctactatgttgttcaccatgttttaacgattggtcagttagttgcttttatgacttatatcggaaatttggtctggccgatgtttgctattggtgttctttttaatgttattgaacgtggaagagcttcatacagtcgagtagaaaaattattagctcaaaaagcggaatcaaaaatttctgaaggtactttgaaaatgccaaaagaaggtcaactcctttttgatattgaaagttttacttatccaaatgagaatgaagggcgtaatttggagaaagttcaatttaatttaaaagaaggtcatgttttaggtttggtcggacgaacaggtgcaggaaaatcaacgattattaaacttttaatgagagagtttgaccattacaaaggacatattacttttgttgaccatgatattatggattatcaattagatgaatatttgccagcgattggttatgttccgcaagaacattttctattttcgatgtctgtcagagataatattcgctttgctaagatgtcagcgagtcaagaagaagttgaaattgcagctaaaacagctggaattcatgatgatattattgcttttcctgaaggttatgatactttggttggcgagcgtggcgtttcactttctggtggacaaaagcaaaggttatctattgcgagggcgctacttattcagcctaaattattgattttagatgatgcgctgtcagctgttgatgccaagactgaacagttaattttgtcaaatttgaaggccttacgtcatgaaagttcaacgttagttgtcagtcacagattgtcatcagtaatggaagctaatgaaattctcgtactagatgaaggaaaagtgattgagcgtggtttgcatgaagatttgattaaatctggaggttggtatgctcaaatgtggcaaatgcaacagattgaaagtcatttgacagcgaatgatgaagatgagaatttactgacaggatcgtcagtaaatcgggaaggagaagaaaatggagaaatctactga

SEQ ID NO: 42111 - DNA, 1260 bp, Lactococcus lactis
atgaagacaccatttgtaacaaaagaacaattagaacaaatcacgaaggaatttccaacaccatttcatctttatgatgaaaaaggaattcgtcaaaaagcgcgtgaccttcacaaagcctttgcttggaataaaggatttaaagaattttttgctgtgaaagcgacacccacaccagctattttaaaaattcttcatgaagaggggtgtggagttgattgcgcctcttatgtcgaattgttactttccgaaaaatgtgggtttgacggctctgagatgatgttttcatcaaacgatactccagctgaagaatttcaatttgctaatcaattgggtgcgacaatcaatcttgatgcctatgaagatattgaatttttgaaaaatctgacagattttatttttccggaaacaatgagtttgagatacaatcccggtggagtttttgctatgggaacaaaaattatggataatccagaagaatctaaattcggaatgacaaaagcccaactcatccaaggaattaaagatttgcaaaaattaggcgtgaaaaaatttggaatgcatagttttttggcttcaaatacagtgacaaatgattattacccagaacttgccaacaagctctttaagcttgctttagaaattagagaagaaactggaattacccttgatttcattaacttatcaggcggaattggtgtgaactatcgtcctgatgaggaggcaaatgatattgcaaaaatcggacaaggtgttcacgaagcttatgatgaagttttgagggctaacggaatagaaaatctaaaaatttataccgaattgggacgttttatgcttgctccacacggtcatttgattacaaaagttttgcatattaaagaaacttatcgaaaatatgttggcgttgatgcatcagcagttaacttgatgcgtccagccttttatgatgcttatcaccacatcacagttgctggaaaagaaaaagatgaagcgactgaaatttatgatattacaggttctttatgtgagaataatgataaatttgcaaaagaaagagcctttcctaaaatagaaataggagatttattagtgattcatgatactggtgcgcatggattctcaatgggttatcaatataatgctaaattaagaagttccgaagttttgcttcaagaagatggaaagactcgtttaattcgtcgagcagagaagccagctgattattttgcaacattagatggttttgattttacaatttga

SEQ ID NO: 42112 - DNA, 1374 bp, Lactococcus lactis
atgtatacagtaggagattacctattagaccgattacacgagttaggaattgaagaaatttttggagtccctggagactataacttacaatttttagatcaaattatttcccgcaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgatcgagtactttctgcactactaaaagaaagaaaacctgtctatatcaacttaccagttgatgttgctgctgcaaaagcagagaaaccctcactccctttgaaaaaagaaaatccaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactccctattacgacattaaactttggaaaaagttcagttgatgaaactctcccttcatttttaggaatctataatggtaaactctcagaacctaatcttaaagaattcgtggaatcagccgacttcatcctgatgcttggagttaaactcacagactcttcaacaggagccttcactcatcatttaaatgaaaataaaatgatttcactgaatataaatgaaggaaaaatatttaacgaaagaatccaaaattttgattttgaatccctcatctcctctctcttagacctaagcggaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaaccaaagagtcattttattggtcaacccttatggggatcaattggatatacattcccagcagcattaggaagccaaattgcagataaagaaagcagacaccttttatttattggtgatggttcacttcaacttacagtgcaagaacgcaaattgcaagtccaagttagccagccaagctcatctcatatgaactcttatagttga

SEQ ID NO: 42113 - DNA, 813 bp, Lactococcus lactis
atggcaattatattaatcacaggagcaagtagtgggattggctatcaaacagcagagcttttagctcagaatggacataaggtttatggtgcggcacgaagaatggacaaacttgagaaattaaaaagcgtaggggtcgagccaatttatctagatattacaaatgaagaatcttgtcgtaaattggtagatacaataattgacaacgaaggacaaattgatatactaattaataatgcgggttatggttcttatggggcaatcgaagatgttccgcttgaagaggccaaacgtcaatttgaggtaaatttatttggactagctgctctaactaaactagtcttacctcacatgcgtcaccaaaaagctggccggattattaatatttcttcaatgggcggtagattcacaacctattttggtgcttggtatcatgcaacgaaatatgccctagaagcttttagcgatgccctccggatggaagttaaaccctttggcattgatgtttctttaattgaaccaggaggaattaaaaccaattggggattaatcgcagccgatcatttagcggagtctgccaaaggaggaacttacgaagaagccgccttaaaaacagctaccagtatgagaaaacagtattctgggaacatgatgtctgaccctaaaataatttcaaaaacgatttcaaaggcagtcagctcaaaaaggatgagagctcgttatttaatcggttttggagcaaagccccttgtctttcttcataccattctgccaacaagaatttttgattggctaatcatgcgggccagttaa

SEQ ID NO: 42114 - DNA, 714 bp, Lactococcus lactis
atgataaatactaagaatttaaatgtattctataatgaaaataaagtcctgaaagatattcaactagaagttatacctgggagaatcactggtattatcggaccaaatggtgcaggaaaatctactttaatcaaggcaattcttaatattgttccacattctggagaaatactgataaatggtgaggtaagtaaaaaacaattgaaaaagattgcttatgtagagcaaaaaagtgacattgaccatacttttccaattaaggtaaaggagtgtgtatctcttggaacttatacaggattaaaattgtttcagaaacttggtgcaaaggaatggtctagagtatctgaagctttacagaaagttaatttactagactatgaaaacagacagataggagaactatcaggtggtcagtttcaaagggttttattagcaagatgtctggtccaagaagcagactatatatttttagatgaaccatttgttgggattgattcgataagcgagaaaattattatggatattcttcaggatttgaaacatcaagggaagaccattttaattgtgcatcatgatttgagtaaagtgaaagagtattttgatgacataattattttaaatagagaattaattgcatatggaccgataaatgagaactttagtcaaaaaaacttgaaaaaagcttacggtgataatatttttataggagattag

SEQ ID NO: 42115 - DNA, 3141 bp, Lactococcus lactis
atgaagcctatatatttggaaatgaattattttggcccccatgagaattctgtcgtagattttcgactgctagatgaatctcctatatttctaattagtggggacacaggcgctggaaaatccacgatatttgacgcgatgacatatgctttgtttggaacaacaacgggtgatagagatgccaaagaaatgagaagtcagtttgcaacagctgatgataggacaagcgtgacattttattttaaacaaggaaatcttttatacagaattgaaagaagtcctgaacaaaaactctcaaagaaacgaggcagtggatctactcttcaaaaatcaacagcgaaattagctattgtagatagagtaaaaggaatcgagaaaaataatattgcaataaatcctaaaaacgttggagaagaaatcactcgtcttttacatctgaatgccgaacaatttaaaaaaataattcttctacctcaaaatgatttttcgagatttttgaagtcttctactccagataaagaggcaatattaaaaagaatatttggtacctacatttttacatcttttagcaatgagataaaggctaaaaattcagagatgaatgctgtttatttagaatatgatcgaaaacaacaaaatttatatgaatcatcaatttggaatcctattgaattaaaagaactagaagatgcagctgaacaagaaaaactggatctagtcacgtctctatggaaggatcgtgttgcgagaaaaaatgagatagaaggtcaaacttttgaacaagaagaaaaagtaatttcgatagaaatagcttataaatccgcgttggaattagaaaatcagtttaaaaatctaaataatttagaaaatgattaccagcagaatattattgaaaagtcagctatttttgaagaaaattccgaatatctaaaaaaattgaaatgggcctttcccttaaaagaaagtattcatgaattagaacaagatataaaacagtcaaaaagtgtaaaaaataatattgctgggataatttctgaaaaagcaaaagatgaaattcttttgaaaaaattaacaaacgaaaaagaggacttaaataaacagcaagaaaatattaatgagaataaaaaagtagcagaaaaaatatttatccagattcagctatcacttcaagtagaaaaaaaacaatcaaaggtagaggagttaaagttagagcaagctgataatctcacactactagaaagttttaaagctaacttgggacaagcagccgaaaatatttcaactcttcaagatgatgttatttctgatgattactttattaataaaagagaagagagaaatcaattagaattaacatttcgagggaaattaattccgacctttcagaaagtgaaacattcaaaagatgatattgttgggttagaattaaaattaaaagaaaacacaatagcgctttctgaaaataaggacaatctagaaaaggctaaatttgcttataatgaaaaattaaaaggtagaagacgcttgatgatcgcacagctgcaatctgagttgcaagaaggcgaagcatgtcccgtgtgtggtgcattagaacatccgtttacagaaactattgaagaaagctcttataaagaacttggaaatttattgaaagagattgatgaatcacaaaagaaacaaacagtccttttggagaaaaataaacaattacaacaattaaagactgaacttaaaactagtcttgatttgaaaaaaatagaggcagatgagtttgaaaaagaactttcaattctttatagtgaatttattgctgattattcacaaatatttccggattcctttgatgaagtatctattgatgaaagtcttttaaatttaacgaaatcgttagagttggaagaggtaaaaaatgatgaaacaaaagtaaagcttgctgatttggagtcaaaaaaacttgaattacaggaaaaagtaaaagactttgaatatagtaatcaggagtttaatagacagatagaaaatttaaacgctgaaataacggagatagggattactgaaacaagttataatttgataaggaagcgaaataggctaatggaaaaagctgatttatttgaaaaacatctgtcagaactaatggcacaactttcagatattaaaataaaaatttcttcacaaacggccagcttaaattcatttgaaagtcaagaagcaacattacttgaaaggataagcgccaataaagaaaaaataaaagaaaaattttctgagcaagaggcattcacgacagaatttcaaatattaaaagagtgggcttatgatgatgatttaattcagatttcccaaaaagttgaacaatataaagcagataaagcaagattgaaagtcgaaattaaaaatattcagcaattaattcaaaataaaaagcgaccaaatcttgcattgattgaagaagaaaaaaaacagacaaatgaaaactatgtttttttgcaaaaaaaattggtgtctgctgaaaatgaagtagagcaagcgaagtcaattcttagtgaattaaaaaaagtcataaaacaacaagataaggatgctagcaaaaaatctgcaattactaagctttataatgcaatttcaggtagagcttccgaagataaactaaggcttgaaacatatgtggttcaaaattatttagaaaaaattcttgattatgctaaccttcattttattaatcagttgtcaaacaatagatatcgatttgaacttgctggcgagggaaataatcgacgaatggatcatggcttagatattaatatttatgataatgaaacaggggcggctcgttcagctgataccttatcgggtggagaaacatttatagccgcattgtcaattgctttggctttaagtgaagtcgtacaaaatacagctaatggtgtccaaatagaagcactatttattgatgaaggatttggttctcttgaccaagaaacattacaaaaagcaatgcaagctcttgaacaaattggtgaaaatagattagttggagtaattagccatgtagaggaaatgaaagcaactattggacaacgaattatcataaataaaatgggggatggtagaagtaatattaaatctgtcattaaataa

SEQ ID NO: 42116 - DNA, 978 bp, Lactococcus lactis
atggctgataaacaacgtaaaaaagttatccttgtaggtgacggtgctgtaggttcatcatacgcttttgctcttgtaaaccaagggattgcacaagaattaggaattgttgacctttttaaagaaaaaactcaaggagatgcagaagacctttctcatgccttggcatttacttcacctaaaaagatttactctgcagactactctgatgcaagcgacgctgacctcgtagtcttgacttctggtgctccacaaaaaccaggtgaaactcgtcttgaccttgttgaaaaaaatcttcgtatcactaaagatgttgtcactaaaattgttgcttcaggtttcaaaggaatcttccttgttgctgctaacccagttgatatcttgacatacgctacttggaaattctcaggtttccctaaaaaccgcgttgtaggttcaggtacttcacttgatactgcacgtttccgtcaagcattggcagaaaaagttgatgttgacgctcgttcaatccacgcatacatcatgggtgaacacggtgactcagaatttgccgtttggtcacacgctaacgttgctggtgttaaattggaacaatggttccaagaaaatgactaccttaacgaagctgaaatcgttgaattgtttgaatctgtacgtgatgctgcttactcaatcatcgctaaaaaaggtgcaacattctatggtgtcgctgtagctcttgctcgtattactaaagcaattcttgatgatgaacatgcagtacttccagtatcagtattccaagatggacaatatggcgtaagcgactgctaccttggtcaaccagctgtagttggtgctgaaggtgttgttaacccaatccacattccattgaatgatgctgaaatgcaaaaaatggaagcttctggtgctcaattgaaagcaatcattgacgaagcttttgctaaagaagaatttgcttctgcagttaaaaactaa

SEQ ID NO: 42117 - DNA, 1509 bp, Lactococcus lactis
atgaataaacgtgtaaaaatcgtctcaactcttggacctgctgtcgaaattcgtggtggcaaaaaatttggtgaaagcggctattggggagaatctcttgacgtcgaagcatcagcaaaaaacattgcagctttgattgaagaaggcgcaaatgtcttccgtttcaacttctcacacggtgaccatcctgaacaaggtgctcgtatggcaacagttcaccgcgctgaagaaatcgctggtcataaagtaggtttcttgcttgatactaaaggtcctgaaatgcgtacagaactctttgctgacggtgctgatgcaatcagcgttgttactggagataaattccgcgttgcaactaaacaaggtcttaaatcaactcctgaattgattgctttgaacgtagctggtggtcttgatatctttgatgatgttgaaatcggtcaaactattttgattgacgatggtaaacttggtttgtcattgactggtaaagatgcagcaactcgtgagtttgaagttgaagcacaaaatgatggcgttattggtaaacaaaaaggtgttaacattcctaacactaaaattcctttcccagctcttgctgaacgtgatgatgcggatatccgtttcggactttcacaacctggtggaatcaactttatcgctatctcattcgtacgtactgcaaatgacgttaaagaagtacgtcgtatttgtgaagaaactggaaatccacacgtacaacttttggctaaaattgaaaaccaacaaggtatcgaaaaccttgatgaaatcatcgaagcagctgatggtatcatgattgctcgtggtgacatgggtatcgaagttccatttgaaatggttccagtttaccaaaaattgatcatcagcaaagttaacaaagcaggtaaaatcgttgttactgcaacaaacatgcttgaatcaatgacttacaacccacgtgctactcgttcagaaatttcagacgtattcaacgctgttattgacggaactgacgcaacaatgctttcaggtgaatctgctaatggtaaatacccacgcgaatcagttcgtacaatggctactgttaacaaaaatgctcaaacaatgttgaaagaatacggacgtcttcacccagaacgttacgacaaatcaactgtaacagaagtagttgctgcatcagttaaaaacgctgcagaagctatggatatcaaattgattgttgctttgactgaatcaggtaacactgctcgtttgatttctaaacaccgtcctaatgctgatatcttggctattacatttgacgaaaaagttgaacgtggattgatgattaactggggtgtaatcccaacaatgactgaaaaaccttcatctacagatgacatgtttgaagttgctgaaaaagttgctttggcttcaggtttagttgaatctggtgacaatatcatcatcgttgctggtgttccagttggtactggtcgtacaaatacaatgcgtatccgcactgttaaataa

SEQ ID NO: 42118 - DNA, 1023 bp, Lactococcus lactis
atgaaacgcattgcagttttgacttctggtggtgatgccccaggaatgaatgcggctattcgtgcagttgttcgcaaagcaatttctgaaggtatcgaagtttacggtatcaatcacggatatgcgggcatggttgcgggagatattttcccgcttacgtcagcttcagttggtgataaaatcggtcggggtggtacattcttgtattcagcacgctacccagaatttgctcaagtagaaggacaacttgctgggattgagcaacttaaaaaattcggtatcgaaggtgtcgttgtaatcggtggtgatggttcttatcatggagctatgcgtcttacagaacatggtttcccagctgttggacttccaggaacaatcgataacgatatcgtaggaactgattttacaattggatttgatacagctgtttcaacagttgtagatgccttggataaaatccgtgatacttcatcatcacataaccgtactttcgttgtagaagtaatgggacgtaatgctggagatatcgctttgaatgctggtatcgctgctggtgcagatgatatttgtattccagaaaaagaatttaagtttgaaaacgtagttaacaacattaacaaaggctacgaaaaaggtaaaaatcaccacatcatcgttcttgctgaaggtgtaatgactggtgaagaatttgctacaaaacttaaagaagctggttataaaggagaccttcgcgtttctgtccttggacacatccaacgtggtggttcaccaacagctcgtgaccgtgttcttgcttcacgtatgggtgctcgtgccgttgaattgcttcgtgatggaatcggtggcgtagccgttggtatccgtaatgaagaacttgtagaaagtccaattctcggaacagctgaagaaggagcactctttagtttgactactgaaggcggaatcaaagtaaataacccgcataaagctggtcttgaactttaccgtcttaactcagcactcaacaatcttaaccttaactaa

SEQ ID NO: 42119 - DNA, 1026 bp, Lactococcus lactis
atgaatccacaaaaaattgcagttttaggaccaggttcgtggggaactgcactttcacaagttcttaatgataatggtcatgaagttcgtatctggggaaataacccagaacagatggctgaaattaatgaaaagcatacaaatacacgctattttaaagatgttgttttggatgaaaaaataaaagcatttgatcgtttagatttagctttagaagacgttgatgctattttatttgttgtaccaactaaagtgacacgtttggtcgcaaaacaagtagccgaagtccttaaacacaaagtacacattcttcacgcttctaaagggcttgaacaagggacacatgagcgaatttctactattcttgaagaagaaatccccgctcaattgcgaggagaaatcgtggtagtttctggcccttctcatgctgaagaaacaattgttcgtgatattactttaatttctgcagcttctaaagaccatgatgaagcgaaatacgctcaagcaatctttagcaacgactacttccgtctgtatactaatactgatgttattggtgttgaaacagctggcgcccttaaaaatattattgctgtaggtgcgggtgctctgcacggtcttggttttggtgataatgctaaagcagcaattattacacgtggccttgccgaaattactcgtttaggtgtggctatgggagctgaacctttaacttatagcggtttgtctggtgttggtgacttaattgtaacaggtacttcaattcactcacgaaactggcgcgcgggtgatgctcttggtcgcggcgaaaagctagctgatattgaaaaaaatatgggaatggttattgaaggtgtttcaaccactaaagctgcttttgagctcgctcaacagctaggtatcgatatgccaattaccgagacaatctacaaagttctctatgaaaatctagatgcaaaaactggaattcttgatatcatgcgccgcgaaactcgtgccgaaaatgaattcattaataataaataa

SEQ ID NO: 42120 - DNA, 942 bp, Lactococcus lactis
atgaaacaaaacattattccaactaaagcccgaaaagtacgtaaagctgttattcctgccgctggtctcggaactcgctttttgccagcaactaaagcgattgccaaagaaatgttgccaatcgtcgacaaacctactattcaatttatcgttgaagaagccttgaaatcaggaatcgaagatattttgattgttactggtaaagcaaaacgtcctattgaagaccattttgactcaaacattgagcttgaacaaaatttgcttgaaaaaggaaaaacagaattacttaaacttgttgaagaaacgacagatattaatcttcactttatccgtcaatctcatccaaaaggattgggacatgccgttcttcaagctaaagcttttgttggaaatgagccttttgtagtcatgcttggcgatgacttgatgaatattactgggaatgaaactcctttaactaaagacctaatcaatgattatgaaaaaactcacgcttcaacaatcgcggttatgaaagttcctcatgatgatgttgataaatatggtgtcattgaccctaacggtgaagtttctaaaggcctttacaatgttgaacgttttgtcgaaaaaccaaatgttgatgaagctccttctgaccttgcaattatcggtcgttacctcttaactcctgaaatttttgatgttttagaaacacaagttcccggtgcaggaaatgaaatccaattgactgatgctatcgaacgtttgaataaaacacaacgcgtttttgctcatgaatttactggaaaacgttatgatgttggtgataaacttggttttgttgaaacaacaattgaatatggtttagaacacccacaaatcggtgcgaatttgaaaaactacatcattgaaaaagcaaaagagctttctcaagatgactcaaaaaatatcactaaaaaataa

SEQ ID NO: 42121 - DNA, 960 bp, Lactococcus lactis
atggacttaaaaaataacttttggaaagactatccagagcttgaaaaagaattggttcaagttcaacaattaatgaaaagccacgttaccatcaaaaattcagatgttaaatcggctatttttgatatatttgatgcgggcggaaaaatgttgcgtccagcttatttacttttattttcaggatttactgatctttctgaaagtgaaagattggcacttgcggcttctgtcgaaatgatgcatacagcgactttggttcacgatgatgtcattgaccacgcagacacacggcgtggcgtagctactttgtcagcaaaatacggaccagaaattgccgtctatgctggggactatttatttattgctgtctttcgtctaatgtctgaacactcattagaattatcaaatttaaccaaaaatattggttcaattgagcgtttattaggtggtgagcttggtcaacttaatcatcattttaatcttcaacaaactttagatgattatattgaaaatatttcaggaaaaacgggagaactttttgcactttctgcttctgttgctcctttaatttctaaaaataatacattgaccaaacgagcttataaaattggaatgaatattgggatttctttccaaattatggatgattatttagattatgcatcgactgctcaaacgcttggaaaaccggtacttgaagacattaaacaaggcatttattctgctcctgttctctttgctttacaggaaaacaatgctcttgtttctgaattaattaaaaatgaaaaatttgatgaagtttatgattttatcaaaacttctgatgcccttgaaaaaaccaaagcacttgcaaaatcttatactctttcagcattaaatttaattgataaattaccaaaaggtaaaaatcgtgagctgattgctgaaattactagaaaacttttggagcgaactttatga

SEQ ID NO: 42122 - DNA, 936 bp, Lactococcus lactis
atgaccgaaaataatcgtctgtcagtaaaattacccggacttgatttaaaaaatccaatcattccagcttcaggttgttttggctttggtgaagaatatgccaaatattatgatttgaacaaattagggtcaatcatggtcaaagcaacaacccttcatcctcgttttggcaatccgacaccccgtgtggctgaaacagcgagcggcatgcttaatgcaattggactacaaaatccaggattagaagttataatggccgaaaaattgccttggctcaatgaaaattttccagaccttccgattattgccaatgtagctggttctgaggaagatgattatgtggctgtttgtgcaaaaattggagatgcacccaatgtgaaagtcattgaattaaatatctcatgccctaatgttaaacacggcggacaagcttttgggacagatccagatgttgcagctgcgctagtcaaagcttgtaaagcggtcagtaaggtgccattgtatgtgaaactttcacccaacgtgaccgacattgttccgattgcaaaagcagttgaagctgctggagcagatggattgacaatgataaatacactgatgggtgtacgttttgatttgaaaacacgaaaacctgttttagcaaatatcacaggtggattgtcgggtccagcaattaaaccagttgcactcaaactcattcatcaagtggctcaagtggttgacattccaatcattggaatgggcggggttgaaagtgctcaagacgttttagaaatgtatatggcaggagcttcagccgttgctgttggcactgccaattttgctgacccatttgtctgtccaaaaatcattgaaaaattaccagaggtaatggatcaatatggaattgatagcttagaaaacttgattcaagaagttaaaaactcaaaaaaatga

SEQ ID NO: 42123 - DNA, 3195 bp, Lactococcus lactis
atgccaaaacgcaatgatatcaaaaaaatcatgattatcggttctggaccaatcattattggtcaagccgcagaatttgattatgcaggaacacaagcctgtcttgcacttaaagaagaaggctacgaagttgttttagtcaattcaaatccggcaacaatcatgactgacagagaaatagctgacactgtctatattgaaccaataactttagagtttgtcagtaaaattttgcgtaaggaacgtcctgatgccttattgccaacacttggtggacaaacaggacttaacatggcaatggaattatccaaaataggaattcttgaagagcttaatgttgaacttcttggaacaaaattaagcgccattgaccaagcagaagaccgtgagctctttaaagaattatgtgaaagaattggtgagccactctgtgccagtgatattgcaacaacggttgatgaagcagttgaaatagctgacaaaattggttatcctatcatcgtccgtccagcatttaccatgggtggaacaggtggaggaatttgtgataccgaagaagaacttcgtgagattgtggcaaatggactaaaactttctccagtaacacaatgcctaattgaagaatcaattgctggttataaagaaatcgaatatgaagttatgcgtgattctgctgacaatgcgattgttgtctgcaatatggaaaattttgacccagttggagttcacacaggtgactcaatcgttttcgcaccaagtcaaacgctctcagataacgaatatcaaatgcttcgtgacgcttcactaaatattattcgtgccctaaaaattgaagggggatgtaatgttcaacttgcccttgacccacattcttatgaatatcgagtaatcgaagttaacccacgggtaagtcgttcatcagctttagcttctaaagcaacaggatatccaattgcaaaaatgtctgctaaaattgcgattgggatgacactagatgaaatcattaatccagtcactaataaaacttatgccatgtttgaaccagcacttgactacgttgtagcaaaaatcgctcgcttcccatttgataaatttgaaaatggtgaccgccacctaggaacacaaatgaaagcaacaggcgaagtcatggcaattggacgtaacatcgaagaaagtctactaaaagctgtacgctcacttgaaattggtgtttttcataatgatttacaagaagcacaagatgcagatgatgaaatcctctatgaaaaaatggttaaaacacaagatgaccgacttttctatgtttcagaagcgattcgtcgtggaattccgattgaagaaattgctgatttaaccaagattgatattttctttcttgataaattactccatatcgtcgaaattgaagaccaattaaaagtaaatatatttgaaccagaactcttaaaaacggctaagaaaaatggattttctgaccgtcagattgccaaattatggaacgttagtccagaagaagtaagacgtcgtagacaagaaaatcgaactattccagtttacaaaatggttgatacttgtgcggcagaatttgaaagctcaacgccttacttctattcaacttatgaatgggaaaatgaatctaaacgttcaagcaaagagaaaataattgtactcggctcaggtcccatccgtattggacaaggagttgaatttgattatgcgacagttcactgtgtaaaagcacttcaagcccttggaaaagaagcaattgtcatcaactctaatccagaaaccgtttcgacagatttctcaatttcagataagctctattttgaaccactaacttttgaagatgtgatgaatatcattgacttagaacaaccagaaggtgtgattgttcaatttggaggacaaacagctatcaatttagcggaacctctctctaaagctggggttaaaattttaggaacgcaagttgaagatttagaccgtgctgaggacagagatttatttgaaaaagcattacaagatttagagattccacaaccaccaggagcaacagcaacaaatgaagaagaagccgttgctaacgccaataaaattggttatccagtccttattcgcccatcttttgttttgggcggtcgagcaatggaaatcattaataatgaaaaagacctgcgtgattacatgaatcgtgcggtaaaagcttcacctgaacatccagtactcgttgattcttatttacaaggacgtgaatgtgaagtcgatgcaatctgtgatggcacagaagttcttcttccaggaattatggaacatatagaacgagcaggggttcactcaggtgactcaatggctgtctatccaccacaaactttttcacaagaaattattgatacaattgttgattacactaaacgattagcaattggtttgaactgcatcggaatgatgaacattcaatttgttatttttgaagaacaagtttatgtcattgaggtaaatccacgcgcgtcacggactgttccctttttatctaaagtgacaaacattccaatggcacaattggcgacacaaatgattttagggaaaaacttgaaggatttaggctacacagaaggcttagcagaaactcctgatatggttcacgtgaaagcaccagtctttagctttacaaaactagcaaaagttgacagcttacttggtccagaaatgaaatcaacaggtgaagcaatgggttcagatgtgacccttgaaaaagcactttataaatcatttgaagccgctaaactacacatggcagattatggttcggtcttattcacagttgctgatgaagataaagaagaaacgctagcacttgctaaagatttcgcagaaataggttattcactagtagcaactcaaggaaccgcagcattctttaaggaaaatggactttatgtccgtgaagttgaaaaactagctggtggagaagatgaagaaggaacattagttgaagatattcgtcatggacgcgttcaagcagttgtgaacacaatgggaaatactcgtgcctcattaacaacggctaccgatggtttccgtattcgccaagaagcaattagtcgcggtattccacttttcacatcactagatactgttgctgcaattttaaaagtaatgcaaagtcgtagttttacaactaaaaatatttaa

SEQ ID NO: 42124 - DNA, 2637 bp, Lactococcus lactis
atgcagccttacaatcaatccgtcaatgaagttttagaggaaactaaaagtcaattcgaaggtttgagcccaaaagaagttaaaaatcgtcaagctaaagatggtttcaatgaattgaaagaaaagaaaaaaacttcaacttgggaactttttattgatactttgaaagacccaatggttatcatcttacttttagttgcttttgtccaacttttcttgggggaatttgttgaatcacttgttattttcattgttttgatgattaattcagtggttgcggtcgtgcaaactaaacgagcagaaagttctttagatgctttgagacagatgtcggcaccctcagctaaagttttacgtaatggagagaaaacatcaattcctgcgcgtgagcttgttgttggcgatattgtttcacttgaggccggtgattttattccagcagatggacgtttaattgatgttcaaaacttacgtgtcgaagaaggaatgcttacaggtgagtctgaaccagttgaaaaattttcggatgtcattgagggagaagttgcacttggtgaccgcaagaatatggtcttcagttcaagtcttgttgtttatggacgagcagattttcttgtaacagcaattgctgagcaaaccgagattggtaaaattgctcaaatgttggaaactgcggaagctaaacaaacgccacttcaacaaaaattggaaaaatttgggaaacaattaggttgggtaattttagcgctctgtgctttaatttttgctgttcaaattttgagactctttacgacaaatcaaacggctgatatgcaaaaggctgttcttgattcattcatgtttgcagttgcggttgcggttgctgcaattcctgaagctctttcatctgttgttacaattgttttgtctgttggaacaaataaaatggcaaaacagcatgcgattatgcgtaatttgccagctgtagaaacattgggttcaacttcagtcatttgtactgacaaaaccggaactttgacgcaaaacaaaatgaccgttgttgattctttcttgccaacgcaaggcagtaaagaactgacagatttaacacaggcagaccaaaaactcttgcttaatgcaatggtgctttgtaatgattcatcattttcgcaagaaggtcagctacttggtgaccctactgaagtggctttaattgcttacagtgataaaatcggttatccatatcaagatttaagagaaaaatcaccacgtctggctgaatttccatttgattcagaacgtaaattgatgagtacaatcaatgattttgaaggtcagaaaacaatttttgttaaaggtggcccagatgtactctttaatcgctgtaatcaagttttcttggatggaaaagtgcaagaatttactcctgaattgaaagagaaatttcaagctcaaaatgaagctttcagtcaaaaagcgcttcgtgtattagcttatgcttacaaacctgtcagtgataataagactgaactcacacttactgacgaaaatgatttgattctgattggtctgtcagcaatgattgacccacctcgtgaggctgtttatgattctattgctgaagcaaaaaaagccggcattaaaacgattatgattacgggtgaccacaaaacgacagcacaagccattgccaaagatattggtttgatgaacgaaggagatatggcgctcactggtcaagaacttgacgcactgactgaggatgaacttcgtgaaaatttagaaaagatttcggtttatgctcgtgtgtctcctgaaaataaaattcggattgttcgtgcttggcaaaatgagcatcaagtaaccgcgatgactggtgatggtgtaaatgatgctccagccctgaaacaagctaatattgggattgcaatgggttcaggaacagatgtagcaaaagatgcgtcaagtatgattttgactgatgataatttcgtatcaattgtttctgctgtatcaattggtcgtgtggtttatgataatatcaaaaaatcaattagttaccttttctctggaaacttaggagcgattattgcgattgtctttgctttggtcgtgggctgggtcaatccattcactgctttgcaacttttatttattaacttggtcaatgactctgtcccagcaattgccttagggatggaaaaagcagaaccagatgttatggaaaaagctcctcgtcagttaaatgaaggaatctttgccaatgggttaatgcgggttattttgattcggggttcattgattgggattgcggcgattatttcgcaatatgttggacaaaaaacatcacctgaaatgggtgtggctatggcctttacaactttgattttggcacgtactttgcaaacttttgctgcacgttcaaattcacaaaatattttaaaacttggttttacaacgaataagtacgttttgatggctgtgactttctgtcttgctttatacagcttgactactcttccattcctcagagaaattttctcaattccagctgcttttggttggtctcaatggattgtagcagcagggcttgccgtaattgctgtaatctgtatggaaattctcaagtcaattaaaggcgtttttgaaaaacattaa

SEQ ID NO: 42125 - DNA, 1227 bp, Lactococcus lactis
ttgccagtaaaaataaaaattgaacatttaactaaaatttttggcaaacggattaaaaccgcattaacaatggttgaaaaaggtgagcccaaaaatgaaattttgaaaaaaaccggtgcaactgtaggggtttatgatacaaattttgaaatcaatgagggtgaaatttttgtcatcatgggtctatctggttcaggtaaatcaactttgttgcgtttgcttaatcgattgattgaaccaacgagcggaaaaatatttattgacaaccaagatgttgctacattgaataaagaagatttgcttcaagttcgccgtaaaacaatgagtatggttttccaaaattttggtctatttccacatcgaacaattttagaaaataccgagtatggtttggaagttcaaaatgtaccaaaggaagaacgacgcaaacgcgcagagaaggccttagataatgcaaacttgttagactttaaagatcagtatcctaaacaattatctggtgggatgcaacaacgggttgggcttgcgcgtgccttagctaatgacccagagattttgctcatggatgaagctttctctgctcttgaccctttgattcgtcgtgaaatgcaagatgagctacttgaacttcaagcaaaatttcaaaaaacaattatctttgtttctcatgatttgaacgaagcccttcgtattggtgaccgcatcgcaatcatgaaagatggtaaaatcatgcaaattggtactggtgaggaaatcttgaccaatccagcaaatgattatgttaaaactttcgtagaagatgtagatcgtgcaaaagttattacagcagagaatattatgattccagctttaactactaacattgatgttgacggaccaagcgttgccttgaagaagatgaagactgaagaggtcagctctctaatggctgttgacaaaaagcgtcaattccgtggtgttgttacgagtgaacaagctattgctgctagaaaaaataatcaaccattaaaagatgtgatgactacagatgtcggaacagtttctaaagaaatgcttgtaagagatatcttgccaattatctatgatgccccaacgcctttagcagttgttgatgataatggattccttaaaggtgtattgattcgaggaagtgttttagaggccttagctgatattcctgatgaggacgaagtagaggagattgaaaaagaggaggagaataaatga

SEQ ID NO: 42126 - DNA, 3273 bp, Lactococcus lactis
ttgatgaagaaacaaggtagacaacttaatattttgaatggtttgttcttgaaaaatacgaaagagcaagaagagaaagtactatcagcggaaattcagaaaagtcaagttgatttgaaagacaagaaagaaacattaccagtaagacaaagggaagtggagcttatgttaggaagaaattcatattcttcaggattaagaacatataagcagttacttgaaaaatatcttcaacattccgaaaaatattctgttgatttaggagaatataaaaaagcttatcttaaattaaacagtaatttgaaagattttaatctactttctcaaaaaattgccgataaaaaacaagattataactcggaaatgattaagtacgaggaagttaagaaaaagtacgagcaaagtctgaaagaatatcaagaaattactaaagagtatgaaaatgttattaacgatagaaaagctgcccaaaagaagtttgaagaaaactctttagctctgaaaaatattaatgatgaagttcaaaacctgattgataaaaaatcagtgaagaatgatgcttttatagaaataaaagaaaaattagcggtagaacaagaggaatttaaagctgctgaaagtcaattaaatggaattgtctctgtctatgaacttcttaagaaaaattatcaagaaaagaaagcaacatttgaagaatctcgaaaaaaatatcatcatgcgaataccataaaaaatgattgggagatgttgattaaagattttgaaaaaacaaaatcaaacaaagaaaaattcgagcaaaatcttcaggctatagatgacaaggtaaaagctacagaggaagaagccaatatctcaaatgaaatttataattttgttgaaccttctttagtagctatgacagaaaaatacaaagaacacaaaaaagtatatgaagcagcagctatagcctataatatttccaaaaagggttatgatgcagaatatgcaaagtttagtgaacttaaagaaaattttcaggaaataaatagtctgaagaatccaagtcagactgtcattggatatatcactcgggatatggaggctgccaaaaatagagttgataatttggcgaaagacttttatccgctggaggaaaagtttaatctacaaaaaaatatttttgagcaaatcagcacgagctatgttttggtaaaaaatcttgtagatgaaaaaaagggtaaatccaaagtttctaatggaacattaactgaaacattgaacgctcagaaaaaaattacaatggttttagaggttttaaaatcaaaatatggtcttcttaatcatcagcgtgggcaatccgaagaagcatttaaggttatttctcaacaatatgaagagctagaaaaagaatttcaaaaagagcaatcttcttttagtaagataaaagagtattacacagcttttgaaactcggtataattcaactaaggaatcttacgatattgccaaagaaaaacttgctcaaagtgaggaaaatctagagattgtaaaaaaagcctattctgatatagcaggtcttctcagggttgctacggtcaataaagaatctattttagaggagtataaaaattctgaaaaagaatttaatagattgacagatacaaaagaaggctttgaatttgaagtgcaaaataattttactggtttagatgaaacttaccaaaagggagagcaactttgtttgaatttaacagaacaggcaaaaacttggcatgatgactatcctcaatatagtcattcctataagacaatactacctgaatatacaaaggtgaatagtcagctagaaaagcttagtcaacaatatgaagttgttttcaatgattatcaaaatttgaataaatctagtgaaattgttcgaacgcaatatcaacaagagatgcaaagatacaatgctgaccaagaattgtataatcaggtaagccaagaatttaatcattgtctcgatttaagaaatgttgtactcaaaaaagataatgaatttgagactgcattgaacaatttgaatcaatttatcttcaagaataatactttaacttttccaattggtgaggcgacaggttctaattttatagatgaatttaatattccagaaattgaagttagtgaatcatcttctaaattaacaaataaatttgaactctcacaatggacagaaacctatcaaaatctgtatgcattagttgattcaatttctaaagagctcaagcaagcattaacagaatatcaaaatcaactttcaatctttattaaggttggtggtaaacgggtgattgatttaggaaatagtgatatcgcctatcgcggaacaaatattgaaagttacttagaaagactagcaattaatttcaaagaatggcaatcagagtatgtcaaaagagaacaggttttttctctattagttaaaaattatcgtcaatatttagaggaatcagttaaactaaatgaaaacattgcaagaatgtcggaatctaaaaatggtttgcaagagattattaatgcaattaattcactccctaattatatggacatatatagtacttcctatcgaaatgttgaattgttagctagtgctcttggtgctgaggtttctgatttaacgcatttgcgaaatattgacgaattaaaagagattattaataaagtttattttgaacacgttttagctctgattgatgaaaacttagaaaatacaatcaatcatttctcagaaattcgttctagttatgaccaaagcattattaacctgagaaaacagttggatgaaatggaaaaaataacggggattccaacaagaaaagttatgattgaaagttctctacctaatgaccttgatttgaagagctattttacaggagctttaaatgaaaatgtaaaacaactgttttctacaatcattagtagttcatcttttattaatagcgtgaaaaaggttaatcaatttaaacgtgttcaaaatcttttatcggtaaatgaaggaggaaatgcaattattcttcctgaagttccaattgcttttgataaaaaagaacttgagttttcacttgttatagccactataaaaaatattgatgcaccagtcaaggttgagaagttagaatcagcttatgtaaaaccagaaaaaccagaaaatcttgctgataagcctagctatgttgaagatatcgtagaagtagaaaaaattgaaaaacaacatcaaaagatagatacagaaccgttaaaagctcttgcttaa

SEQ ID NO: 42127 - DNA, 1800 bp, Lactococcus lactis
atgacagtattagacaaagtaaatgaccccacagacatcaaggctcttacaccgctagaactagaagagctcgctacaaatgtacgcgatgcaattcttaatcgtgtcagtcaatatccagggggccatctcggaccaaatcttggtgttgtagaaatgactattgctttacataaagtctttaactcacctgttgataaattaatttgggacgttagtcatcaaagctatccgcataaagttttaacgggacgtaaagaattttttactgacaaagacaaattttctggaacaacaggctatacagaccctgaagaaaatgaacatgactttatacgagtcggtcatacatctacatctattgcaacagctatgggatacgccttggctcgagatgtgcaaggaaaaaaagaaaatattgtagccatcattggtgatggcgcgctctcaggaggacttgcatttgagggacttgatggcgcaggtacacttaacgggaatcttattattattgtaaatgataatgaaatggccatcaccgaaaatcatggaggaatctatcaacatcttgcagatctgcgagcaagtaaaggaacctcagcaaataatctttttaaatcatttgggcttgattaccgttaccttgaggagggaaatgatatccaaagtttgattgtcctttttgaatcagtaaaagatatcaatcggccaattgttcttcatatccacatagagaaaggacatggctataaaccagcagttgaaaataaagaaggaatgcaccaagtctttgcaccctttgatattgctacaggtcaaccagtcaatagctcaaccaatatcgttcgtagctataataatgtatttcttgactttatggaagaaaagttagccaaaggtgacaatcttatcgccattaatgccgcaattccaatgttctttggcctgtcacaatttgctaagaatcatccaaaaaattatgttgatggaggaattgctgaacaatatacagtgacacttggtggagcaatcgcagcagcaggaactcgagctattattttccaaaatgcaactttcttacaacgtgcttatgaccaacttaaccatgatttggcactgaataaagaaccagcaattgttattatcagtaatagtcaaattggcggaacaaacgatactcatcaaggaagttttgtttatagtcaaacatcaaatattcccaatgtaattgaccttgcagcaacaagtgaagaagacctttttgcaatgcttaattgggcatataatcaacatgaacatccagtatttatacacttgccagagcatactttggaaaatcgcccaacaaaaattactgattttagtaaacctcagtatgaagttgttaagtctggcgaaaaagttgcaatcttaggacttggtgcaatgcttgagaaagctgaaaatgtcgcagaagaacttgaaaaatcaggatttaatccaacggttgtaaatccattctttgcaaatcttttggatgtagctgctttagacaaattatctgaaactcatggactctttgttacgattgaagatggcactaaagatgggggatttggtcaaaaagtggcgacctatttggcaagtaaagggataaaaacacttgtatatggtgcagatactgagtttattgatgctgttccaaaagaagaactttacaatcgttatcacataagaccagaacttatggcaactgatattattgaagcaaccaaagaatctaaaggacctaatttttttaagaaaatattttctaaataa

SEQ ID NO: 42128 - DNA, 1428 bp, Lactococcus lactis
atggaattaaaattccaagaaaattttttgtggggagcagcaacgagtggcccacaaactgaaggacgttttaaaaagcagcatgacaatgtttttgattatgattttgaccattatcaagaacgtttttggggcggaattggacctgatacagccagtaattttttcaatgactttcgagaagatataaaattaatgaaggctgctggtctaaaatcaataaggacaagtattcaatggtcgcgtttgatagatgatttagaaaagaatacggtaaatgaaaaggcggttgatttctataatgctgtaattaatgaatttatagcgcaagggattcgcccgatgattaatttaaatcattttgatttaccagttgaactcttaaaaacatatggaggctgggaaagtcctcatgttgttgatttatatgcaggttttgcagcaaaatgttttgctgaattcagcgaccgagtgagtgattggtttacttttaatgagccaatggttgtcgttgagtgtgcttatctattaggtttccattatcctgatattgttgatggaaaaaaagctgttcaagtggcttatcatttgcaactcgcctcatctcttgcgattgaacaataccgaaaaatcaataaaaatcctgaaggacgaattggaatcattttaaatttaactccgtcctatccagcagctgaaaaaatagaagatttaaaagcagcagaaatggcagacctttggcaaaatcgcctctttttagatgcatcaataaagggagaatttccagaagaattagtcagccttttacaagaagaaaatgtcttgtggcagtcggaagcagaagatttgaaacggattaaggaaaacaaagtggaccttttgggagttaattactaccatccgagtcgagtacaagaacctgaatattctagtgatagtttggctcaagattggcgtcccgacaaatattacgcatcgttcaataaacgtggggtgcggatgaatgctgacagaggttgggagatacatccacaaaccatttacgaaattgccaagcgaattcaagaagattatggaaatatttcttggtttatttctgaaaatgggatgggcgtagaaaatgaagaacatttcaaagatgaagagggacaaatccaagatgattatcgaattatttttacaacagaacatcttttttggctccataaagcgattcaagaaggctccaattgttttggttaccatgtttggacaccaattgattgctggagttggcgtaattcatacaaaaatcgttatggtttgattagtttgaatatccatacccaagtgaaaactttaaaaaaatcagcttattggtataaaaatttaacagactcatcacttttacaagttccagattcaattttagaaaaatacaatcaatga

SEQ ID NO: 42129 - DNA, 1548 bp, Lactococcus lactis
atgaataattggtggaaaaaagcagtcatttatcaaatttatccccggtcatttaaggattcaaatgatgacggaattggtgacatcaatggaataatagagaaattaacttatcttgaaaaactaggagtggatggtatttggctatctccgatttatcaatccccgatggttgataatggttatgacattagtgattactataaaattgacccactttttggaacaatggctgattttgaagcgctcatagaaaaagcaaagcaacttaatattcgtgtcattatggacttggttgtcaatcatacttctgaccaacatttgtggtttaaagaatccaaaaaatctaaaaataatccgagaagagatttttatatttggcgggatcaaccgattggagaatttaaaaattggacttatgactcaagcactcaacaatattattttcatctttttagtccacagcagcctgacttgaattgggaaaatgaagaagtgcgtaaggaaattcataagatgatgaatttttggttggctaagggaatttctggttttagattagatgtcattgatttgattggaaaaaaaccagaacaagaaatcacggttaatggtccaaaactgcatgattacctaaaagagatgaatttagcaacttttggtaaaaaggactatctcactgttggtgaagcttggtcaagttcaccagaattagcaaagttatatagtggccccaatcgtcatgaactttcaatggtttttggcttctggcatctattgacatcagcaggaaacggggacaaatggaaaaaactccccttaaatgttccaaagctaaaagaagcaatgaccgcttggcagaaattgacgccaaatgaagcatggaattctctttttctaggcaatcatgatttgccacgcattgtctctttttggggagatgagggaacatacagagaaaaatcagccaaagcttttgcaattctctttcatttgatgcgtggcacttcttttatttatcaaggcgaagaattaggaatgaccaattttccttttgaaaatctgtcagcaataaatgacgtagaatcacatgaatattttactgacagaaaaaaagaaggacagtcagaagaagaaattatcaaagttttgcgagaaatgagtcgtgataatgctaggacgccaatgcaatggaccagtgatgagaaagctggttttacaaaagggaaagcttggctttctatcaatcctaatactaagataataaatgctgaccaagctgtcagtgattctaactctgtattttatacttatcaaaagttaatcaaacttcgtcaccaagaaaattggctgatagaaggagattttgaattacttgaaagtgctgacgaaatcttcgcatacttgagaaaaacgacaacaagaacttttctggtggtcgccaacttatcaaattcaagtcaacgttttgaaagttcttttgtcaaaaaaaatgaaatcatcagtaatgacagctttccagatttactgacagacatagaaatttaa

SEQ ID NO: 42130 - DNA, 1302 bp, Lactococcus lactis
atgagaaaactttctcccactttcatctatttttttggtgctttaggtggcttattatttggatatgacacaggcgtcatatcgggagcgctactttttattgaaaaagagagctggcaggtgagttcttgggcttggatggaaggatggattacagcggcagttttaatgggagctgtaattggcgcggtcgtaattggaccaatgagtgaccgttttggtcggaaacgtctgttacttttgtcagcggtcatcttttttgttggagctttaggttcaggactttcaaatagtgctgagttactaatcatctctcgggttattctcgggatggctgttgggtcagcttcagctttggtgccgacttatttatcggaactttcacccgctaaaattcgtggtggagtttcaactatgtttcaattgatgattatgactgggattttattagcctatatctcaaactatgctttaaaaggagtttcaggaaattggcattggatgcttggtttggccactgttccagcagcccttcttttcatcggtggactctttttgccagaatctccaagatttcttgttcgtcatgataatgaagcaggtgcccgtgaaatattagggatgataaatgacgatccaaactcgattgaagcagaaatttctgatattcaattgatggctaaggaagaaaaacaaggtggcttacaagaattatttggtcaaatgtcacgtccagttttgattatggcaattggtctggcaatttttcaacaggttatgggctgtaatacagtattatactttgcaccatcaatttttgttgcggtaggatttggggcaagcgcagctttacttgctcatattgggattggtattttcaatgttattgtaacttatattgcaatgagagtaatggataaagttaatcgtcggtggatgctcaattttggtgcttggggaatgggaatttctcttgtattgatgtcagtagggatgattttagcagaaaatgctcatattggctttggtaaatatttagcagttatcgctttaacggtatatattgccttcttctcagcaacatggggaccagtaatgtgggtgatgattggtgaatctttcccacttaaaatccgtggcttaggaaattcatttggtgctgctgtcaactgggctgctaactgggtggtgtcattaacattcttaccattattatcattttttggaacaggtaaaattttcctgatttatgcggcttgttgtttcctctcaatttggtttactagtaaaaaaagttattga

SEQ ID NO: 42131 - DNA, 1506 bp, Lactococcus lactis
atgacttacgtgttaggaattgacttaggaacatcaagtcttaaaggaattttgatggatgaagttggtaatttaattacaacaaaatctgctgaataccaaattgatacgcccaaacaaggctattctgaacaacgtccagaatattggattgtggcacttgaatcagtactgaccggtttgtcagtagaaatttcagattttggtcagcaacttgcaggcattagtttttcggggcaaatgcattcattagtcgttttagatgacaataataaaccagtttatccagcaattctttggaatgatgtgagaacaagcaaacaatgtcaagaaattactgacagacttggtcagcgacttttagagattacaaaaaatattgctcttgaaggatttaccttaccaaaaattctttggctccaagaaaatgaaccagaggtttggtcaagagttaaaaaaataatgttgccaaaagattacttgagcctttggctgacaggaaatatttataccgaattttctgacgcagcaggaactttacttttagatattgagaaaaaacaatggtcagaggaaattactgacgcattcaatattgataggagaattctacctgaattgattgaatccactgaccgaacaggatttgtcaaagcagaaatagctgaacgctataaactgacaaatgaagtaaaagtatttgctggtggagccgataatgctgccgccgctctgggtgttggtttaatcaatgaagaagtgggcttgatttcaatgggaacctccggagtcgtttccgcttatgaacctaaaattgcagattataaaggaaaacttcatttctttaatcacacggttccgggtgcttgttactcaatgggagtaaccttggctgccggaaattctttaaactggtataaggaaacttttggaaaaggcttgagtttcaatgaacttttgtcagaagtttacacagtttctcctggttcagaaggattgctctttacgccatatattgtaggtgaaagaacaccacattttgattcaaaaattcgcggaagttttataggaatttctgctcatcatgaacaaaaacatttttcaagagcagtgcttgaaggaattaccttttcattgcgtgattctaaagatatcatggaaaaaacgaaaaacaagaagtttaaacgtttgatttccgtaggtgggggtgcgcaaaatcccgacattatgcaaatgcaagcagatatttttaattctgaaatgattcgcttaacggttgagcagggaccgggacttggtgcttgtatgattgctgcttttggttgcggactttttgatagcttagaagcggtcactaaagcttttgttcattacaaggaagccagtttcataccaaatccaaaaaatgtagcacgttatgagcaaatttatcaaatttggaaacaagtttataaaaatacctctgaaatttctcatcaattagtagaattcaatgacgaaggttaa

SEQ ID NO: 42132 - DNA, 543 bp, Lactococcus lactis
atgcatccacatttaaaagaagttttatttaccagagaacaaattgccgaacgtgtcaaagagcttgcggaagttgtttcacgcgattatgaaggaaaaaatccacttgttgttggaatattaaaagggtcaatcatgtttacggttgatctgcttaaagaattatcaattgatgctgaagttgattttatggatgttaccagttatggttatgggatttcatcttctggagaagttagaattttgaaagatttatcaaccgtggctcatggacgtgatattttgattgttgaagatatcattgacactgggaatactctgctctatcttaaaaaattgctgacaggacgtcaagcacattcagtaaaaattatctctttattagataaaccaagtggtcgtaaagttgatattgacgctgattatgttggctttgaagtaccggatgcctttattgtgggctatggaattgattatgccgaacgttaccgtcagttgccatatattggaattttcaatgaagagtttttaattaaagactaa

SEQ ID NO: 42133 - DNA, 1590 bp, Lactococcus lactis
atggtaaagtatcttaaagaattcaaatttgaaaattttatggttttcttacttatcacgattgatattgctcttgcggtcttgagttcggtctttttagcaaatgtgctcaattctttgattgcaaaagagatgaatcaatttttcttatggttagctattgatattatcctttggatggtcgatagttttgttcaaggagcgcgtgatgtttggaaagaaattgccatacaaaaacagcttaatgctgtacgccgggatatcattgagcctctgacggaaatttcttattctgattttgaaaaaaatagtaaggaagattataattcgtggttaaataatgatacaaaactactttatgataatggtttccaccagatttattttgtttatacgggaattgttgcgatgctattctcaggaattgctattatctttttccactgggtattgcttttgacaacccttttggttggagcacttttgttctattttccaaaaatgtttaaacaatcagtggaacgagatacggaacaagtgtcggagcttgcaaatgatgccttagcgacatctacggattacttgcgtggttatgaagtgctttatcataataaacaattgggtcttatgcaagagcgaaccatggggaaatttaatcaattagctacggcgaatgtgaaattaatttttactcgtgcttggatgcagtattctttattagggacaagtatgttagggcagtttttgattttagctgttgctggttttcttatcatgaatgggcaaattggcattggtgttgtcatgagtgtcggaaatttgtcaggaacagtaactaattactcaaaaagtgtagcaaatagtttaatattgctcaatgcaactggaaagctgctagagaaatatggaaaaattactgacgaatcaaaagttactgacggagaagaagtgacagcttttgaaagtaaattagaattaaaaaatctggcagttgcatttcctgatgggcaaaaaattgagtatccagaaattgtcattgaaaaaggaaaaaaatacgcgattattggcgatagtggaagtggaaaatcaaccttgattaatttgttggttgggaataagcaagactatgaaggagaaattttattagacgggaaagattataaaggaattaatcgaaaatctttgcctcattttatgagtgtgattatgcaatttccctatctttttaaggaaacagtagaagaaaatttgactttagggcgtaaaatttcgccagatatctttgataagtcgattagaattgcttgtgctgatgactttgtatttaataaacttgatacggtttatgataaaaatttatcaggaggtcagcaagaaagattatctgttgctagagaattaatgggcagtaagccaattttagtgatggatgaaagtacggcgagtgttgacaaaaaaacagctctagctgtagaaaaaaatattttagaaaatcctgatttgacggtgattatgattacacaccatctatatgatgaaactcaaagttatttggatgaggtgattcatttaggacaggaaattgcttaa

SEQ ID NO: 42134 - DNA, 1017 bp, Lactococcus lactis
gtgtctgagaatgcgtatgcaaaatctggggtagatgtagaagcaggatatgaggtggtttctcgtattaagaagcatgtagctaaaaccgaacgtttgggtgtgcttggggcactgggtggttttggtggaagttttgatttatctgtgcttgatgtgaaagagcctgtattgatttcggggacagatggtgtgggaactaaattgatgttagccattcaagcagacaaacatgacacgattgggattgattgcgtagccatgtgcgtcaatgatattattgctgctggggctgaaccactgtattttttggattatattgccacagggaaaaatattcctgaaaaattggagcaagttgtggctggagtggccgaaggttgcttgcaagcaggagcagcgctgattggtggagaaacagctgaaatgcccggaatgtatgatgaagatgattacgatttagctggttttgctgtgggtgtggctgaaaaatcacaattaattgatggcgaaaaagatgtggaagcgggcgatgttttgcttggtcttgcctcatctgggattcattctaacggatactctttggttcggaaagttttttctgactttgatttgaatgaatcgttgcctgaacttgaccaatctttgattgatactcttttaactccgacaaaaatctatgtcaaagagcttttacccttgattaaacaaaataaaataaaagggattgctcatattacaggcggaggattccatgagaatttaccaagaatgttcggaaatagcttgtcagctgaaattgtcgaaggttcttggaatattttaccaattttcaaagctcttgaaaaatatggggatatcaaacatgaagaaatgtatgaaattttcaatatgggaattggaatggtaattgctgttgctcctgaaaatgctgaagctctcaaaaaagtcttgaatgcatttgaaattggtaaaatggtcaaaagacaagattcagcagtagtgattaaaaaataa

SEQ ID NO: 42135 - DNA, 2604 bp, Lactococcus lactis
atggacatcgaaaaaatgacaacaacgatgcaagaagcacttggttcagcgcaacaaattgcgcaagttcgtcatcaccaagtgattgaagttccacatttatggcgaatttttgttcaacctaatagttttggggcgaacttttataaagatttagggattgacctagatgactatacaaatttaattgaaaaagaaattgacaaaattaattcagtagaaggttcaaatattacttatggtcaaaacctaagtccagatttgttccaaatatttactgaagcagacaaaattgcgcaaaaaatgggcgatgaatacttatcaactgagattattctccttgccctctttgaattaaaacaaaatccattgaccagttatttggttagccatggactaacaaaagcaaaagcgcaagctgcaattgaaaaattacgcggaggtgataaagtgaccagtcaaaatgcagaagaaacatacaaagcacttgaaaaatatggggtagatctcgttgctcaagttaaatcaggtaaacaagatcctgtcattggacgtgatgaagaaattcgtgatgtcattcgagtgctttctcgtaaaacaaaaaataaccccgttcttattggtgaacctggggttggtaaaacagccattgttgaaggattggcacaaaggattgtcagaaaagacgttcctgaaaatctgaaagataaaacaatcttttcacttgatatgggtgccctgattgcaggagcgaaatatcgtggtgaatttgaagaacgtttgaaagcagtccttaatgaagtgaaaaaatcagatggacaaattatcctctttattgatgaacttcatacgattgttggtgcaggtaaaacagaaggttcaatggacgctgggaaccttttaaaaccaatgcttgcacgtggtgaactccatttgattggggcaactaccttggatgaatatcgtaaatacatggaaacagataaagcacttgaacgtcgtttccaaaaggtattggttactgaacctactgttgaagatacaatttcaatcttgcgtggtctaaaagaacgttttgaaattcaccatggagtgaccattcatgataatgctttagtcgcagcagcaaccctttcaaatcgttatattactgaccgatttttaccagataaagccattgacttggttgatgaagccagtgcaacaattcgtgtagaaatgaattcactcccaactgaacttgaccaagctaatcgtcgcttgatgcaattagaaattgaagaagcggccctcaaaaaagaacgagatgatgcttctaagaaacgtcttgaaattatacgtggtgaaattgctgaacttcgagaagaaaataatcaactcaaagctcaatgggaagctgagaaaaaagaagtgggcaatatttctgaaaaacgaaatgaattagaacatgctcgccacgaattggaagaagctcaaaatgaaggaaacttagaaaaagcagcagcccttcgttatggtaaaattcctgaaattgaaaaagaactcaaagctattgaagaaaaagcaaaatcagatgatttatccttagttcaagaatcagtcactgaagaacaaatcactgaagttgttggacgcatgacaggtattccaattaccaaattggttgaaggtgaacgtgaaaaattacttcacttgccagaaacactgcatcaaagggtcgttggacaagatgaagctgttgaagccgtatctgatgccattattcgtgcgcgtgcaggaattcaagaccctaatcgtccacttggctcattcctcttcctcggtccaactggggtaggtaagaccgaactcgcgaaagctttggctgaaaatctctttgattcagaagaacatatggttcggattgacatgagtgaatatatggaaaaacactcagtttctcggttagtcggagcacctccaggatatgtcggttacgatgaaggaggccaattgactgaagctgttcgtcgtaatccttatacaatcatcttgcttgatgaaatcgaaaaagcacatccagatgtcttcaatatcttgttgcaagttttggatgacggccgtttgactgactctaaaggtgttctcgttgactttaagaacacagtgttgattatgacttcaaatgtcggttctcaatatttgcttgataatgttggagaaaatggtgaaatttcggaagaaacaactgaaaacgtgatgtctcaacttcgggcacatttcaaaccagaatttctaaatcgaattgatgataccattcttttcaaaccattggcacttgaggatattaagaatattatcgttaaaatgactagccaactttcacatcgtcttgaagaaatggatgttcaacttgagttgagtgaagaagtaaaagtttggattgccgaaaatgcttatgaaccagcttatggtgcacgtccactcaaacgttatttgacaaaagtcatcgaaaatccattagctaagctgattatcggaggaaaaattccaccaaaatcaaaagttattgtaacgcttgtagaaaacaagattgactttgatattcaaacgattgctgaataa

SEQ ID NO: 42136 - DNA, 753 bp, Lactococcus lactis
atgtcaaacaatattgaaaacaaagtcgtcttaatcacaggagcctcaagcggtattggccaagcaactgccgaattacttgctaaaaaaggagccaaaattgtactagcagcaaggcgtgaaaatcgtttgcaggagctggctgataaaattaaaaaggctggtggacaagcaatctatcaagtgacagatgtaactaatccagaagaaagtaaaaagttggtacaatatgcgaaagaaaattttggcaaaattgatgctattttcttgaatgcaggaatcatgccaagttcccctttatcagctcttcatgttgaagaatgggaaaatatggttgatattaatttaaaaggtgtacttaatgggctcgctgctgtactgcctgaatttacagctcaaaaatcaggacatgttatcacaacgagttcagttgctggcctaaaagcatatcccaatggtggtgtttatggggcaacaaaatgggcggttcgtgaattaatggaggtactccgaatggaatctgctcaagaaggaactcatattcggacagctactatttatccggctgctataaatactgagttactgaatacaatcactgacaaagatgcagcagaaggaatgacagctctgtatgaacaatatgggattagtccagaggcaattgctcgcattgttgcttttgctcttgaacaacctgaagacgttaacgtcagcgagtttactgttggacctacaacacaaccttggtaa

SEQ ID NO: 42137 - DNA, 1047 bp, Lactococcus lactis
atgaaatcagtttattttgtcgaaaaaaataaaatgcaagttagagaatttcccaaagcgcaacttgtaaaagaaacagatgctatcataaaaattgttcgtgcctgcgtatgtggttccgatttatggtggttccgtgggatttctgaacgtcaacctggaccggtagggcatgaagctattggtctgattgaagaagtaggcaccggagttaaaaactttaaagtaggagattttgtcattgttccctttacgcacggttgtggacactgtccaatttgtttggctggctttgaagccaattgtccaaatgcaaaagatggtgtgaatggcggctatcaaggagaattctatcgggcgattaatactgatggtgcacttgtcaaaatcccgggccaaccaagtgattattctgatgaccagttggcttcattgacggctttagctgatgtcatgcctacaggttttcatgcagctaaagcagcagatgtccatgaaggtgatacagtggttgtctttggtgatggagcggttggactttgtgcagtgatttcagctaaacttttaggagcaaaacggattattgccatgagtcgccatgaagaccgtgcagcacttgcgcgtgactttggtgcaacagatattattgatgaacgtggtgaagaagcgattcaaaaaattatgtccttaaccaatggttatggtgcagatgctgccttagaatgtgtcggaacaaaacaagcaattgaatctgcttttcaagcggtaagagcaggagggcgagtaggtcgtgtgggagttcctcatgatgttgattacaatgaatggattgattctcttttttggaaaaatattcaacttggagggggagtagcctctgtcgcacgctgggataaggaaatcttacttgaagcagttttaagtggggagattaatccaggccgtgtctttacagcagaatttagcttagatgaaattcaaaaagcatatgaagcaatggatcaacgtacagcaattaaatctctattgagaatttcagaggtataa

SEQ ID NO: 42138 - DNA, 936 bp, Lactococcus lactis
atgctaaaaacaacttttgcaaatgcggaattcgctaatccattcatgaacgcttcaggagtccattgtatgacaactgaggatttagaagaattaaaagcctctcaagcaggggcctatatcaccaaaagttccacattagaaaaaagagaaggtaatccactcccacgttatgttgacttagaattaggctcaattaattctatgggcttaccaaacctagggtttgattactacttagattatgttttaaaaaatcaaaaagaaaaggctcaagaagcgccaatcttcttttccattgctggtatgagcgcagccgaaaatatcgctatgcttaagaaaattcaagaaagtaatttttcaggaattacagaattgaacctttcttgtccaaatgtccctgggaaaccacagcttgcttatgattttgaagccactgaaaaactcctaaaagaagtttttaccttcttcacaaagcctttaggtgtaaaacttcctccttattttgacctcgttcattttgatatcatggcagaaatcctcaatcaatttccgttgacttatgttaactcagtcaatagtattgggaatggactttttattgattcagaagcagaaagcgtagttattaagccaaaagacggttttggtggaattggtggagcatacatcaaaccaacagcgcttgcaaatgttcgtgctttctatactcgactcaaacctgaaattaaaatcattggaacaggtggtattgaaacaggacaagatgcctttgaacacctcttatgtggagctacaatgcttcaaattggaacggctttacacaaagaaggccctgcaatctttgatagaatcattaaagaattagaagaaattatggataaaaaaggttatcaatcaattgctgatttccatggaaaattaaaatcattataa

SEQ ID NO: 42139 - DNA, 1872 bp, Lactococcus lactis
atggcagacttcatcgcacaaaatttaagtaaatcagttggagaaaaaatggttttcaacaaaatcaattttatcattcatgatcttgaccgaattggtcttttgggagttaatggtacgggtaaaacaacgctcctaaatgttatttcaggactttcaggatttgatggagaccgcacgccctttgatcatccacaaaattataaaattacataccttactcaggaacctgattttaatccaaaagctacaattttagacaccgtcttagatgattcgcttccgcaaatgcgagcaattaaaaattacgaagcagcccttttagattatgaaaatttagctaagttagaacgtgcccaatcaggaatggatgctctgaatgcttggcaagtagaagcagatgtcaaaacaattttgactaaacttcaacttcctgactctgccactctaatcgaaagcctttcaggtggacaaaaaagacgggttcaattggctcaagctttagtcaatgattccgatttattattacttgatgaaccaaccaaccacctcgatgttgaaaccatcgcttggttgcaaaattatctaaaaaattctcgaagaaccgttctttttgtcacgcacgaccgctatttcttagataatgttgcaacacgaatttttgaacttgaagatgcgggtcttaaagaataccaaggaaattatcaagattatcttgcaaaaaaagctgaagatgaagaaagagaagccgcagcaagtcacaaggcaaaacaactttatcaatctgaattaacttggattcgtaaatcacctcaagcgcgtgctacaaaacaacaagcacggattgaccgctttgaagaccttaaagattctatgaaaactagtaaaaatctaggagatttagaactcaacattgcgagcagtcgcttagggaaaaaagtaattaattttaaaaatgccgctttttcttatcctgaccgaccaatttttaaagattttgaattaatcgttcaagggcattcgcgcttggggattgttggtgataatggcgtcggaaaatcgaccttactcaatatcattgatggtgagctagcattaactgacgggattttggaaattggtgaaacggtaaaaattggttatttcagtcaagaaattcgtggacttgatgaaaataaacgcatgattaactttcttgaagaagttgcatctgctgcgcataacagcagcggtgaaaatatttcaattgttaatttattagagcagtttctcttcccaagaagtagtcatggaacactgatttctaaactttcaggtggtgagaaaaaacgactctatttacttaaaattttattattacaacccaatgtgcttttgcttgacgaaccaaccaatgacttggatattgcaaccttaactgtacttgaaaatttcctaggctcttttccgggtgctgttttgacagtttctcatgaccgctatttccaagataaagtgagcaacgaattacttgcatttgaagatgggcaaattaatcattattttggggcttacagtgactatttagctgtcaaaacggaagaaaaatctgctgacaaagctgtcagtaaaattgaaagtccaataagtactgacaaaactgaaaatactgacaaaacgaaactgacctatatggaaaagaaagaatgggaaaccattgaaagtcaaattgctgaaattgaagagcgaatttctcagattgacacagaaatgaatgaaaatggttcaaatacagaactcctactggatttacaaaaagaactagacaacaaaacaaaagaacttgaagaaaaatatgaacgttgggaatatctatcagaaagggctgactaa

SEQ ID NO: 42140 - DNA, 1077 bp, Lactococcus lactis
atgaatatctcagaagaagtacgtcccggagccaatagatatgtgagtggtcaaggaattttgcaagatttagaaagctatcttgcgtcttttaataaacttgcgataattactggggaaaaatcttttcaggtttttcaagatttttatcctaaagacttaagttatcctgtttttcattatgatggctcggcctctatcgaaaatgggaaaaaactggccaaagaaattggtcaatccgatggccttcttgcaattggcggagggcgtttgattgatacttgtaaagttgtagcccaggagctaaactgtgagttaattattattccgaccttggtttctaattgtgctccttacacaccggttgcagctctttatcaccctgaccatacttttgataaagtgggttatttaaataaagtgagctatttaactttagttgattatgattttttattggcaacacctcatgattattttgttgctggaatcggggatacactcgccaaatggtatgaaatggaaggaatcgttcgtcaggtttcacaggaagaactttcagcctcagttcgtttgggatttgcgagtgcaaaggaaatttttaaaatattatttgctgattctaaagcagcacttaatgatttggctgaacagaaagtgacgccagcttttgggcgaattgttgatacaatcattgaactttcaggaacagttggaggttttgctgggacttatggacggatgtcaggagctcatgcgcttcataatggtctatcactttgctcagagacacatcctattttacatggctcaaaagtcgcttacggagtcttggtacaattggcttatacgggagatacttcagaaattgaaaaacttttgccattttataaggaaaatcatttacctgcttctctagcagaaattaatttaccatttgatttagaaaaattgcaagcagtagcaaaatttgcagccagtcctgtagaatcttatcgtttgattgattcaaaagttactgacgaaaaaatcataagtgccatcaaagccttagaagctcttgtcagcaaaaaataa

SEQ ID NO: 42141 - DNA, 783 bp, Lactococcus lactis
atgaaattgaataaaattaaagtgattgttgctggatttcgtggaaaaatgggagctactgcggtacaaatgattctgaatgctcaaaattttgaacttatggctttattaggaaagaaagaagaagtctcagaagcgtttggagttcctgtttttagtcgaaaagaggatttgattggatttgatgctgacatttggctagatttaacggctcctgaagcggcttataagaacactcgttttgctttagaaaatggctttagaccagtggttggaacgactgggtttaccgatgatgaagtggcagatttaattaaattttctagagaaaaagaattgggtggtcttattgcaccaaattttgccttgggtgcggttttattgatgcaattttctaagcaggctgttaaatatttcccagatgtggaaattattgaattgcaccatgacgggaaaaaagatgctccttctggaactgctgtgaagacagcagaattgatgtctgaggaacgtttggctcatcatcaaggggcagtggatgaaaaggaagctttagctggtgctcgtggtgccgatcttgaaggaatgagaatccattcggttcgtttacctggtttggtggctcatcaagaggttatttttggttcaaaaggtgaagggctgactttacgtcatgattcttatgatcgttcaagtttcatgaccggtattgctttgggaattcgtaaggtaatgacggtgtctgagttaaaatatggtttggaacattttttggatttataa

SEQ ID NO: 42142 - DNA, 828 bp, Lactococcus lactis
atgaaagaccattaccgaattcgccttggaatttttgagccagaccaaaaagcaaaagcggtagtacaattagttcatggatttggtgaatacacaagtcattatctctatttaattaatgaattagtcaatgctggttttgtttgcctaatgcacgatcagagaggacatggtgttttggcagctgctaatccaaaacttcaaggacgagctagagcttacgagagcctaattagcgatgtcttagaagtgaggaagataattggtaaaaagtatccaaaactaccggtttatctgtttggacatagtatggggggaaatatttcactcaatgttcttctaagaaatattgaaaatcaaaaactttaccaaaaagcagtaattgaatctccttggctggcgctgacaaacccaccagccgtcccgcttcaaagactggcaggttttttaggaaaaataagtccaaaaattcgagttcgaacaggcttaaaagttgaagcaatttctcaccgaaatgatttagtagatttagtaaccaaagatggaatatatcacgaacttctttctttgcggctcttttcacagattatggaagcggggcgttttgcacaaagtcaggctggaaatttgaaaataccaactttattattctgtggtgaatcagatcagatttgttcgcccgtagccattcgttcatttgcaaacaatgctgggaaaaacttagaattaatagagattgcagatggttaccatgctctccatttagatacagaggcagagaattttattgaaagaactaaagatttttttctaaaagaaaatttttaa

SEQ ID NO: 42143 - DNA, 945 bp, Lactococcus lactis
atggataagaaaaaaggaatcttattagtagctttgggaactccgcgctcatgtgaagcagatgatgtgagggattatttaaaagaatttttgggtgaccctcttgttatacaaaaaccaagatggctttggttgccgattttaaatggaattattttaaaagttagaccgcaaaaatcagcagagatgtataaaaaaatctggacagatgaaggttcccctttgatgatttacacagtagcacaagcaaagcaactacaggatatgcgcgaagattttgatgttcgttttgccatgacttacggagagccacgcattgataaagtaatcgctgagatgaaagaatctggtgttgaagaaattactgttcttccactttaccctcaatattctttaacaacagttgaacctgtaattcaacaagttaaaaaaattgatgataagataaaagtaattagagatttccacaaagtagaatcttatagcgatttacttgcagagtctattagagaaaagtggcaagcaaatgactatgataaattggtccttagctatcatggaattcccttgtcctacgtgaccaagaaaaaagatgcttatgaagagcaatgtaaagaaacaacacgtttggtagtaagtaaacttggtttgagggaagaagaatacgagcatacttatcaatcaaaatttggtcctgaaaaatggttagaacctgcgactattgatagagttgctgaacttcccaaagaaaatgctaaaaaagtattgatctgttcaccagcattcgttgcagattgtttagaaactttatttgaattagaaattgaaaataaagaagtatttgttgaaaatggcggagaaacatttgattttgttcatccttttaatgactctttagactttactagagtattaagtgaagtagttgaccaaaatagactctga

SEQ ID NO: 42144 - DNA, 1233 bp, Lactococcus lactis
atgagaaaaaaattttatcaaatgtcgcccaaagagcgattagattcattgaatctgtcagaagatactcaggaagttttgagtgaaatggctttagatacaaatattttaaacaatctaattgaaaatcaaatttccgaatttgaattgccaatgggacttgctcaaaattttgtcattaatggaaaagaatacatcgttccgatggttacagaagaaccatcagttatagctgctgcgagtaatggagcaaaaatagcggaaagttttacggctaaaatagatgaacggttaatgcgtgggcaaattgtattttatgacgtaaagaaaccagaagaaattattaagaaaatatctgaatgcaaaaatgaaatatttgaacaagctaagctttcgtatccttcaattattaagcgtgggggcggtttgagagaaatttcgagcagacttttttcaagtgagaaatttatttcagttgatttcaaagtggatgtcaaagatgcaatgggtgccaatattattaattctatattagaaggtgtagcagaactttttcgtggctggttttctgaggaaaaaattctgtttagcatcctttcaaactatgcaactgaatctttagtaaaagtgagctgtgaaatttcagttgatgctctttcaaaaaaaacaaatggtttagaaattgctcaaaaaattgcagttgcttcacaatactcaaaaattgatccttaccgtgctagcacacacaataaagggattatgaatgggattaatgctgtaattcttgcaacaggaaatgatacgcgagctatttcagcagcaattcatgcttatgcagcaaaagaaggaacatatcaaggtttggctaaatgggaagttcatgccgaaaagttatttggagagttagaaattcctttacctgtggcgaccgttggtggtggggtgaaagtcttacctaaagcacaagcggcaatggaaattttaggaatcacagatgctagagaactggccaaagttatcgccgcagttggtttagcacaaaatttagcagctttgcgcgcacttgtttcagaaggaattcaacaaggacatatgagcttacaggctcgctctttggcattatccgtgggtgcaaaagcagatgagatagcagtcataagtcagcaacttcggcaggaaaaagtgatgaatcaagaagtagctcgccgtttattaaatagtctcagaaactaa

SEQ ID NO: 42145 - DNA, 1140 bp, Lactococcus lactis
gtgaaagaaattgtaatcattgacgccttaagaacaccagttggaagatacgacggtgctcttgctgaatattcagcagcagaacttgggacacatgttgtttcaaacttattgtcaaaacatgaaaatataaaatcagatgttgaacaagttatttttgggaatgttcttcaagctggtaatggtcaaaatatagcacgtcaaattgcgattcatagtggtctatctaatacagtgcccgcttcaacaatcaacgaagtttgtggttcaggaatgaaagcagtgattttagctaaacaacttttacagcttggtgaagcagaagttgtaatcgctggtgggacagaatctatgtctaatgccccaattataaagaatcgaaaaactcaagaagaaacattaagtatgttaaatgatggcttagttgatgccttctcaggaatttctatggggattattggtgaaactattgctgaacaatttgatataagtcgagcagaccaagacgcttttgcgcaaaactctcaagaaaaagcggtcgctgcaagtcaagccggaatttttaaagaagagattgttgcgattggagaagtcggagtcgacgaaacaccacgtccttcttctagtttagaaaaattagccactttaaggacagctttcaaagaaaatggaactgtgacagcaggtaattcttctcctgttaatgatggagcttcagctgtcattcttgcaacgaaagactatgctgaaaaacatgggattccgtacctagcagaactagttgatagtacagaagttggaattgaccctgctattatgggagtttcaccaattgaagctatcaaaaaattaattaatcgttcagagcttgaactttcagatattgacctgtttgaaattaatgaagcatttgcagcatcaagtcttgctgtcaatcgtgaacttggtttaaatgaatcacaagttaacatttatggtggtgcaattgcattaggtcatgctatcggttcaagtggttctaaaattctcacgactttgtcttatgccttaaaacgtgagcaaaaacgctatggaattgctagtctttgtatcggtggaggcctaggtttggctgttcttttaaaaaatcctaacctttaa

SEQ ID NO: 42146 - DNA, 1155 bp, Lactococcus lactis
atgaaagtcggtatagataaacttggattttttgtcccaaatacttttgttgatatgagggatttagcaaatgctcgtaatgttgaccctgcaaaattccaaattggtattggtcaagatgaaatggcagtcaatcctgctactcaagatattattacttttgctgctaacgcggcagcaagtattttgactgaggaagataaaaaagccattgacatgatcatcgttggtactgaatcaagtcttgatgaatcaaaggcctcagccgttgttgttcacgatttgcttggtattcaaccttttgctcgaagcattgaaatgaaagaggcttgttatgcaactactgctggccttactcttgctcgtgaccacgttcttttgaatcctgatactaaagttttagttattgcttctgatattgccaaatatgggctaaatactggtggagaacctactcagggcgctggaagtgttgcaatgcttattacggccgatcctaaaattttggccttaaataatgataacgttgctttaactcaagacatctatgatttttggcgtccttttggtcaggcttatccttctgttgatggtaagttttcaaacgaaacatatatcgatgcttttgctaaaatctggaaagagtatagccatagaacaaatttaaagtttgaagactttgcagctatcgcctttcataccccttatactaaaatgggtaaaaaagctttattgccaatgcttgaatctgaaaaaccagccaatgctgaagaattaatggaacaatttgaacatggtatcgtttataatcgtcgtgtgggtaatctgtataccggttctctctatttgagtttgatttcacttttggaaaactctgataaattgagtgctggtcagcgtattggactttttagttatggttctggtactgttgctgagtttttctctggtgagcttgttgaaggttatgaaaatcatttacttaaaattgaacatcaatcaatgttggatgcaagaacccgtctatcaattcctgaatacgaaaacatgtttaatcaatatttagatttgaatcataatatttctttcaatgatgagacagattactccgtttcagaagttgttgataatcaccgtaagtataaaaaaagataa

SEQ ID NO: 42147 - DNA, 4950 bp, Lactococcus lactis
atgcaaagaaaatataaatttaaacttgtgacttttataatgttgctatcactgttaccgactataaattttaatggattttcttcagaaagtaaaaaagaaaatgttaagataaattatcttgaaaagatgctttcttctcaaggggtgtcagcagcaactcagacacttataaatagtcaaagcgtgagtcccagtggcactactttcaatggaaattcagtttcacaaccaaatcgtactccacttccacaaaattcagttgaagatgcgataatgcctaatagctttggatggcaacaaactatcgctaatctaacgttaccaaccaatcaagttactgctgtacaaaatggaacaattataggaagttatccaactacagatgctggtgttcaacaagcgctttatgcaatgtatagtgcaactaatgctagcacttcggattttggcttatactatggagctaatacaacactgagtaattcactcctaaaagcagtagtttctaatccaagtgcgactaatatgacatttagcacactaaaagggcatgctaaaagtttaacctggatttcaaatccagccgatctacttacgagctcaaatagttctcagccctcaggaacaaattatactggaaccttaccctcaaatgtctattttggagttccaactatttttcgcaatgtaaccgtggctgcaagtggggataatatttatgcccaagggaacgcatttgcaacgacaaatggctcatggataactggtgctcctaacatttatggtggaacggacaatagtgatatatctggaaatacaaacctatatattggagcaacaggaagtattgcgggctggaatatctatggtggtaatgcatcggctgcaacaatatctggtaatactcatgttacgattgcccagtcatcatctactataaatagtgtaactggtggaagtgcatcaggaacaacaatttcaggaaatacaaaccttgatataagtggagctattgcttctcagataacaaatatctacggtgctggaattggtacttctaattctcctgttaatgtgaatgggaatgttacaacttatgttaactcaacaaatggaggtgcaagataccaactttatcaaggtggaacagtttatggaaatataagtggttcaatctataatactttaagtggggcaggaggatggactggcgcaactagtaatataaatggtgctggtggtccagcatcaacttttaacggaggttcattccaagggaatatagggacatctggtgccggaaatgttatctcaaatagttacaatacatcatccttcacaacgggtcaagctttatttacaggtggtaatgctggaacaggcgcttcatatgctcaggcaaccaactccactaccgcggctcaagggatattatatgctaatattactaactatattaaatctgcttttacaactggaacagctggggcagtttatggaatagttggtggtaatggtcatgattctctaaaaatttctccatcacaatggggacttggaagtcagactggtcttgatagtgcagttggtgtaacagatgctaaagcttatggacagattccatctactactgtagtttcaaatgcccaaaaaattactagtaatgcaatttatggcgatgtttatacttggttacaatcaggtgttatgtcaacaacatcgggtggtggagcaaacgattggacaggttattcatatggtgcaagttcaaatgggtatcttcaaggacaatcagttttagaagctggaacggcaaatgctgataattctgttggaggtgctggagtagtatattgtagtgccatgggaggtactgcagaaacaactcttgcagcccaaggaacagttgcttatggtaaaactgatacaagttctgccattaattccggctgggatttatggggaggcggaggaacggtatggacctatcgtcaagcctttttacaaaatggtaattcctatcttattcacaataatgatattgcccgttggacctatggaggtcaatctaatggtagtcaggtcggaaattcatacaatattttgaatggggctattgttgatactcttgaaggtggtggttataccgcaactacaaagtggggaaatactacagcacaagtcaatcaaggtcaagttaattggttcttgtcaggcggttcttggggagatttgtataatactggaagtgcaacagtaaatgtttacaacggatatatcaacgctattaccggtggaaactatggccaagctggagtagagacaattgctggtgattctacagtcaatgtttatggaggtgatttctcaggttcgccaagaacaggaacaaaacaactttgcggaggtccgttctttaatggggcatcctcgattttaggaaatacagctttaaatgttgatttgacaggttcaactggctcaagcttccaacttccttctggtacatatttatcaggaggagcaggttataacaatactgtgactcacgttggttctggagtaaataacagtattagtgtcaatatatcagcaaatgctgcatccggaaatgtcttaaatggtgctgttatttacggcgacgggcagtcaactggttcaaatagtacatatacaaatgttggtacaatcaacatgaccattaacgcagatggcaacactgtaggttcggtttatgcaactaattatgtagccatgccagcttcaggtcaaagatacaatacgaatataaaaattggggatggtactaccatttctggtacgataacatccggaggaagtagtgataatctaactgatgcgattgccgtagctaataacaataaatcggctattacattaggaaatagtacttcacataacccaattaccatcaatggttcacttatcaattttaacagtgcagaaattactgaaaaagcagtagtgaatgtagcaggttcttttaaaaatggaggtggagctacagcagcaaaccacgctgcaacttactccaaacatggttcgattcaaatggatattgattctactcttggaattacttcaacatcatccgttgtatcagcaagccagttagttgcctatccaaatgcaacactttctacaccctatgtccaaacatctggattgattaatttatccgatttagatctttcaaccaataagggtaatctattttggaagccgatcggtaatccaccaacaagtattagtaatacctataatggagcctattggggaacacaagcggcattcccaattttgacgtttaatggtggagatacttctacaaaatctggtgcagtaaatattagtcctaataatttttctggtgtagattcagccaaaaattatgcatttttaggggattatacaatgtcttccctctccaccccaagtaatccaacttggattggttatgttgttccagggcaggtacgtgtatataatacaactggtgatgcagattcaggaaattggcaacatcatttaaaatctaatgttacaacagggaatcccgttgctggtcaaacgatgcaagcatgggcctcggtagcatctgatactgatgcaagttcgatcaaagtaatgtatgtgatgggatatagtgatagcacaacagctccctttagcttcaccgctaaagcaccatattacataaaatctagaacagccacggcatttgatggaaaggttttaaataattatccatcaactaatcctaattttgatgtcaatgctggaactactggtgctacacgtaactttagtacgagagactattttgtaggaaatcaacaagatggcacaaacgatcaagcaatatatggaagttatattgtacaaaatgtggctactgataacaccactagtctaagtgctggaaactatatcctaccgaataaaggttcggcaataaatgcatcatcattgactcaagcacaactccaaaaaattgttggcttaaaaggagtgggtgtaatgacagatattacgatgagtggtgatccattaagttcaataaataatgcaggtaatacgattcaagatcctactactagtgatactaatgtaaaagataaatcatatgcagaaatacctgtgagctggactttgggaaaaagttctactaatagtaacattgttgttgtaccacaggcagcagttatttcatcagatagtcagacagctcttaatgtttatgatgcaagtattacaagtgatgatgcacacgatttaaaagatcaaaaagatctgtatggtaattggacctatgctttagcttttaaagcggatggaacgatagaagaaccagtgattagcagtccgtcaaatttggttacaaccttgcaaactatacaagccaataatccaatcattgatggagatggtaatattcgtcctgttacttatacttataatggattatcaaaagatattacacttaatttaacttttggctctataagtctttctacaccaaattcttacgactttggtacattagacgtaagtcctaaaccattaatttcatgggctacaagtcctgccagtgatgtggttgttacggacacacggacaggttctgccttgaagccatggtatgtgagtgtcgcacaaactcaagatttaaaaggtttgacaaataataataatttggcttcatatcttttcttcaaagatagtacaggaagtaaagtaattacaagtgatgccttacagatttatgccaatacttcaccaactactggtacttttaagttaaatcaaaactggaattcaacctctggtgaaggaatccaattgaatattccggttgatcatcaagagaagggaacctatgagggagaattaacttggtctttaaataatgtaccttctaattag

SEQ ID NO: 42148 - DNA, 1074 bp, Lactococcus lactis
atgagcaaaagacttttaattttagaagacggaaccatttttgagggagaatcccttggtgcaaacttggatgttacaggtgaacttgtctttaatacaggaatgacaggctatcaagaatcaatcactgaccaatcatacaacggacaaattttgactttcacttatccaattgttggaaattatggcgtcaatcgagatgattatgaatcaattcatccaacctgtaaagccgtagttgttcatgaagcagcgtgccgtccttcgaactggcggatgcaaatgtcttttgatgaatttttaaaagcaaaaaatattcctggaattacaggtgtggatactcgagcgattactaaaattgttcgagaacacggcactatgaaggcctcacttgtacaagcaagagatgaagtagagcatcaaatgagccaacttcaagcgacagtattaccaacaaatcaagttgaaacaagtagtacaacgaccgcttatccatcaccaaatacaggcagaaaagttgtcgttgttgactttggcttgaaacatagtatcctacgggaactttcaaaacgggaatgtaatctcaccgttgtcccatacaacaccagtgctcaagaaattttggaaatggaacctgatggtgtcatgttgactaatggccctggtgacccaacagatgtaccagaagcaattgaaatgattaaagaaattcaaggtaaaattccaattttcggtatttgcttaggtcatcaattatttagtcttgcaaatggagcaaaaacctacaaaatgaaatttggacaccgtggatttaaccatgccgttcgtgaaattgcaacaggacgaattgacttcacctcacaaaatcatggatatgccgtttcatcagaaaacttacctgaagacctaatgattacccatgttgaaatcaatgacgactcagttgaaggagtgcgtcacaaacacttcccagctttttcagtccaatttcacccagacgcagctcctgggcctcacgatgccagctatctttttgatgatttcatggatctcatggataacttcaaaaaatag

SEQ ID NO: 42149 - DNA, 933 bp, Lactococcus lactis
atgtcagtaaaaaatggattagttcaactcgaaaacctcacaagtatggaaaaattgagtgttgatgaagtcatgggacttatcaaaagagcctcagctttcaaagcaggaacagcagaatttgatttagaaaaacaaacttttgcttcaaatcttttctttgaaaattctacaagaacgcaccatagtttccatattgctgagcgtaaattaggcttagatgttcttgaatttgatgcgcaagcaagctcaattagtaaaggagaaactctttacgataccgtcttaacacttgatgcacttggcgttgatatctgtgttatacgttcaggagtagaacattactatgaagaattagtgaattcagataatattcattgtgctattgttaacggtggagatggttcagggcaacatccaagtcaatgtttacttgacttgatgaccatttatgaagaatttggcaaatttgaaggtttaaaaatcgcaatttccggagatttaacccattcacgtgtcgccaaatctaatatgatgatgctccaaaaattaggagctagactttactttacaggcccagcagcatggtatagtgaagaatttgatgattacggtcattatgccaacctagaccgaattttgccagaacttgacgttcatatgctcttacgcgttcaacacgaacgtcatgatagtggcgaaagcttttctaaagaaggctaccataatcattttggactgacagaagaacgagcaaaaatgttgaaaccaacagccattatcatgcacccagctccagtcaatcggggtgttgaaattgctgacagccttgttgaaagcccacaaagtcggattgttcaacaaatgagcaatggtgtttatacgcgaatggcaattcttgaagcaattcttgctggaaaaaaagctaaataa

SEQ ID NO: 42150 - DNA, 522 bp, Lactococcus lactis
atggctagaaaagaaattattgacgaaatcacaatgaaacgtgcaattacacgtatcacttacgagattattgaacgtaataaagagctggacaaattggttttgattgggattaaaacacgtggtgtttatttagcaaaaagaatccaagaacgtttgcaacaattagaaggtttggaaattccttttggtgagttggatacacgtccattccgtgatgacaaacaagctcaagaagacacgacagaaattgacatcgatattacaggaaaagatgtcattcttgtcgatgatgtgctctacacaggtcggacaatccgtgcggcaattgatggaattgtaaaactcggtcgtccagctcgtgttcaattggctgtattagttgaccgtggacatcgtgaattgccaattcgtgcagactacgttgggaaaaatattccaacgggtcgtgatgaagaaatcattgttcaaatgtctgaacacgatggcaatgacagtattttaattaaacgtgaagattaa

SEQ ID NO: 42151 - DNA, 1242 bp, Lactococcus lactis
atgattgaagaacttggattaaaggttaaaaaggcgagcaaagaagtagcaaagctatcaactgccgacaaaaatgtttttttgcaaaatttagctgacagccttatcgaaaatactgacagaattatttctgagaatgaaaaagatttggctaacgctctggaacatggaatttctgagattatggatgaccgtttgcgtctaaatgcgcaaagaatttctgatatggcaacagggttgagacaagttgcagaacttcctgacccaattaggcaagtattgcaaggtttcactaatcttgatggacttaagattttgcaaaaaagagtgccacttggcactgttggaatgatttttgaaagtcgtccaaatgtgactatcgatgctttttctctttgttttaaaacaggaaattctgttttgttacgcggtgggtctgacgcgatttattctaatatggttttagttgaaattattaaggaaaatttgctgtcagcaaaaattactgacggagcagttgaattgttatctgacacaagtcatgctgaagcagaaaaaatgatgcaggcagataaatttttagatgttttgattccgcgagggtcagcgcgattgattaaccgtgtcaaagaaaaagcaacggttcctgtcattgaaactggggtgggtaattgtacaatttttgttgatgaatctgctgatttagaaatggcgacaaaaattgtgataaatgccaaaacacagcgtcctagtgtttgcaatgcagcagaaagtttagtggttcacgcaaaaattgctgacgaatttttaccaaagttggaaaatgaaatcaataaagttcatgaaattgaatttcgtgctgacgagcgtgcgctgaaagttctgtcagctggaattcctgcaactgacgatgattttgggacagaatttttagattatattctgtcagtaaaaacggttgataatttggatgaagcaattgagcacattaatacttattcaagtcgtcattcagaaagcattgtcactcatgattatttcaatgcgcaaaaatttcaagatgaaattgatgcggcagccgtttatgtcaatgcgtctacaagatttactgacggttttgtatttggcttaggtgctgaaattggcatttcaactcaaaaacttcatgccagagggccaatgggcttagaggctctaacctcaacaaaatatctgattgatggcacaggacaaattcgttaa

SEQ ID NO: 42152 - DNA, 894 bp, Lactococcus lactis
atgtcagcaaaagaaacaattgaaaaattacaaaatgcacgtatcatcacggccctagtgaccccttttaaagaaaatggccaaattaattttggagcatttcctaagctcattgaggatttacttgctaatcatacggaaggccttatcttagctggaacaacggctgaatcgcctactcttactcatgatgaagaattggcaatttttgctgcggttaataaaatagtggatggccgtattccattgattgcaggtgttgggactaatgacacacgtgattcggttgaatttgtcaaagaagttgctgaacttggttacatcgatgcgggacttgcagtgactccttattacaacaaaccttctcaagaaggaatttatcaacattttaaagccattgctactgcgagtgatttgccaattattttgtataatattccaggaagggtggtcactgaaattcaggtagagaccatcttacgattagcagaactggaaaatgtaattgccatcaaagaatgtacaaatactgataatctggcttatctcattgaaaagctacccaaagactttttagtttatactggagaagatgggctagcttttcacactaaagctttgggaggtcagggtgtaatctcggttgccagtcatatcctaggtcaagaattttttgaaatgtttgcagaaatagaccagggctctattcaaaaagcagcggctatccaaagaaaaatattacccaaaataaatgcactttttagtgtcacaagtccggctccaatcaaaacggttttgaatgcaaaaggatatgaagttggtggcttacgtttaccacttgtagcttgtactactgaggaaagtaaaataattcttgaaaaaattggaaattaa

SEQ ID NO: 42153 - DNA, 1077 bp, Lactococcus lactis
atgacacaatataatatcgccgtcgttggtgttactggtgccgtgggtacacgtatgcttgaacaattagaagaatctacacttcctatagaaaccgtacgtgcgcttgcaagtaaacgttcggcaggaaaaattgttgaatttaaggggcaagagcttgttgtagaagaattgactgaggatagttttgaaaatattgatattgctcttttttcagccggaggctcagtatcagaaaaatatgccccttatgctgtaaaagctggagctgttgtcgtagataacacctcatttttccgtcaaaaccctaatgtccccttggttgttccagaagttaatgcacatgctttggaaaaacacaatggaataattgcctgtcctaattgctcaacgattcaaatgatggttgctttagagccgattcgtcaagcttatgggcttgagcgagtaattgtcagcacttatcaagcggtctctggtgcgggtcaatcagcaattaatgaaacaaatcgtgaactccaagaagcacttgatggaaaagcactgacagaattgtcagcagaaattttaccgtctgctggagataaaaaacattatccaattgcttacaatgcgcttgcacaaattgatgtatttactgacaatgattatacttatgaagaaatgaaaatgacaaatgaaaccaagaaaatcatggaagatgattcaattgcggtttcggcaacttgtgtcagaattccagttctttacggtcattctgagtcagtttatgttgaaacgaaaaaagtagcagatattgctgaggttaaacgtttgatttctgaattcccaggagctgttttagaagatgatgttgctcatcaaatttatccacaagccattaattcagttggtcgtcgtgaaacttttgtgggtcgtattcgccgtgatttggatgcagcaaatgggattcatctttgggtagtttctgacaatttactcaaaggagcagcttggaattctgttcaaattgctgaaacgctacatgagcgtggcttagttagaccaactcatgagttaaaatttgaactgaaataa

SEQ ID NO: 42154 - DNA, 951 bp, Lactococcus lactis
atgactgaatttataacacttggcgaacctttagtcgttcttgcctcagaaaatcaagatataagtttagatgtagctgagcatttcagcaaatatttagctggtgcggagctaaatgttgcgattggtttgagtcgtctaggacataaaggaatttacctttctaaagtcggagaggattcatttgggaattttattattgaatcagtcaaaaaagcggagattgaaacgacctatctcaccaaagataaaaactattcaacaggcttttatttaaaacaaaaagtaagtgagggcgacccaaaagttgattattatcgcaaaaattctgcagcggccaatttatccattgctgaactaaaagctctagatttatcagggataaaaattgcgcatctctcaggaatttttccagccctttcagaaactagtttaaaaacttttcaagcattcaatcaaaaattaaatgaagcagatattttaaccattttcgatccaaatttacgacctgtactttgggataatcaagaaaaaatgataagaacaatcaatgatttagcaaagcaaagtcaaatcattctgccaggaataaatgaaggtgaaatcttgaccggttcatccgaaccagaaaaaatcgctaatttttaccttgagcaaagccctctcacaaagattgtagttgtcaaattaggtgctgacggtgcttttgtaaaattaaaaaatggtgaacaatattttgtttctggatttaaagtagcaaaagttgttgatacggttggagcaggagacggattcgccgttggtcttgagtctgccttacttgaaggaaaaaccttaaaagaagccgtcaagcgtgcctgtgccgttggagcattagcagttcaaagctcaggagatagtgaaggttatcccacaaaagaagaattaaaagcattttacaaggagatgtag

SEQ ID NO: 42155 - DNA, 903 bp, Lactococcus lactis
atgacaaaagtaagtgttataggaagtatttcaatggatttagtcacaaggactaaccgagtgccgaatgctggagaaacagtatttggtgaagatttcgctatggttcccggtggaaaaggagcgaaccaagccgttgcttttgccagactttctcccaatgaagtaagtatgattggagcagtaggcaaggatgcttttggtgagagtattttgcaaaacttcaaagaaaatgcagttctttttgaaaatgtgggaacggtaccacaaacaacaggaattgctcaaattactctctatgatgacgataatcgtattattattattccaggtgctaataatgaagttctaccaagttatctagcagacctttgggagaaaattaaagaaagccaacttgttattctacaaaatgaaattccacatgaaacaaatctagcgattgctaaattctgtaaagaaaatgcgataaaagttctttataatccagctccagcaagaaaaacagatttggaaatgattgattttgttgattatatcacaccgaatgaacacgaatgtaaggaactttttccaaatttagcacttgaagaaattctcaaaaaatattcaaatcgtctgattgtcaccttaggaagtgaaggagtcattttccacgatggagagactcttcaaaaaattcctgccataaaagctaaagttgtagatacaactggtgcaggagatacattcaacggagcctttgcctttggtttgactgagaacttatcaattagtgattctatcagattagctgtcgttgcttctcatttatctattcaaaaatttggcgcacaaggcgggatgccaaagctatcagaagttaaagcaaaattaaaagaacttgaaattaatctctactaa

SEQ ID NO: 42156 - DNA, 1296 bp, Lactococcus lactis
gtggttattagccgttattcacgtccagaaatggcagagatttggtcagaagaaaacaagtataaagcatggcttgaagtcgaaattcttgcagatgaagcatgggcagagcttggggaaatcccagcagcagatgtgaaaaaaattcgcgaaaatgcaacttttaatgttgaacgtattcttgaaattgaaaaagaaacacgtcatgatgtggtagctttcacacgttctgtcagtgaatcattgggtgaagaacgcaaatgggttcattatggtctgacatcaacagatgtcgttgatacagcttatggttatctttataaacaagctaatgatattttgcgcaatgatctaaaaaactttgcagaaattgttaaaaataaagctttagagcataaatacacagtaatgatgggtcgaactcacggcgttcacgctgaaccaacaacttttggcttgaaattagcgacttggtacagcgaaatgaaacgaaatattgaacgttttgaacgtgctgcaaaagctgttgaagctgggaaaatttctggtgctgttggaacttttgctaatattcctccatttgtagaagcctatgtttgtgaaaaattagggactcgtccgcaagagatttcaacacaagtcttaccacgtgatttacatgcagaatacttccaaacgttggcgctcattgcgacatcaattgaacgcatggccacagaaatccgtggattacaaaaatctgaacaacgtgaagttgaagaattctttgctaaaggtcaaaaaggctcgtcagcaatgccacacaaacgtaacccaattggttctgaaaatatgacaggtttagcccgcgtcattcgtggacatgcaattacagctcttgaagatgttagtctttggcatgaacgtgacatttcacacagttctgctgaacgtatcattgcacctgatacaacagaattattggattatatgttgaatcgttttgggaatatcgttaaaaatttgactgttttcccagaaaatatgaagcgaaatatggatgcgacttttggcttgatttacagccaacatgtcatgttaatgttgattgaaaagggaatgacgcgtgaagcagcttacgatttagttcaacctttgactgcaaaatcttgggatgaacaagtgatgtttagaccattgcttgaagaaaatgaacaaattcgtcagtatttgaatgatgaagatattgataaagcttttgattacaattatcatttaacaagagtcgatgaaatttttgagcgtgtctttgattaa

SEQ ID NO: 42157 - DNA, 681 bp, Lactococcus lactis
atgagaaaaacaaaaattgttgttccaatcatgctgacagagttagcagagcttgagaaagtttctgtcagtgattatcgaacagcagatattgttgaatggcgtgccgattttttgtcagcagatgaaattttagagatggctcctaaattctttgaaaaatttaaagaaagtaagattttatttactttaagaacagtcagagaaggcggaaatattcaagtttctgaaaaaaaatatttacagattttaaaagaaattttgacttacaatcccgcatatatcgatgtcgaattctttacgcatggcccttcatttgccgctttgaaagattttcgggataaaatggtgctttcttatcataattttgatgaagttccgtccgatttaaccaatcggttgattaaaatgcacgaagaaggaactgcctttgttaaagttgctgtgatgccagaacgtgaatgtgatgttcttgatttattacaaatcactcgtgatatgactttagaatacggtgatcattttatcagcatggcaatgggtgacttaggacgactttcaagaatttctggctatttgactggctcttgctggacttttgcaagtttagaaaattctagtgcgcctgggcaaatttctctcaaagaaacagagtatattttggatatcttagaaaaatag

SEQ ID NO: 42158 - DNA, 1434 bp, Lactococcus lactis
atgccatttagtaaagattttctctggggcggagcaactgcagctaatcaatgtgaaggcggctataatcagggaggacgggggcttgccaatgtcgaccttgttccacacggaaaagaccgttttccaattattacaggggaaatgaagcaccttgaattcgatgaagagcatttttatccagcaaaagaagcgattgatatgtatcatcattggaaagaagacctcgcactttttgctgaaatgggatttaaaacctatcgaatgtctattgcttggacaagaatttttccaaaaggcgacgaacaagagccaaatgaagaaggcttgcaattttatgaagatatttttagagaatgccaacgtttaggaattgaacccttagtaaccatcactcactttgattgtcctgtccacctaattaaagaatacggtggctggcgtaatcgaaaaatggttggtttctatgaaaatttagccagagcaatttttactcgttataaaggattagttcgctattggttgacatttaatgaaattaatatgctcctccatgctccatttatgggagcaggacttgtttttgaagaaggagaaaataaagaacaagccaaatacttagccgctcatcatgaactattagcatcggctttagcaacaaaaattggacatgaagttgacccagaaaataagataggctgcatgttagctgctggagattactatccatttgattgtaatccagaaaatgtttttgaagctcaaaaacaaaatcatgataatctctttttcattgatgttcaatctcgtggaaaatatccaaactaccttttaaagagattagagcgtgaagaaattacacttccgattgaaaaaggcgacttagaaatccttgctgaaaacacagttgactttatttcatttagttactatgcaagtcgagtcgctaaagtcaaggatgaggatgcagataaatcagctggaaatatctttgaatctgtaaaaaatccttatttagaggccagtgaatggggttggcaaattgacccacttggtttaagaatcacaatgaattctatttatgaccgctatcaaaaaccattatttattgtagaaaatggtttaggagcagtagataaacctgatgaaaatggatttgtagctgatgattatcgaattgattacatggctgcacacatcaaagaaatgaagaaagcagttgaacttgatggcgttgaactattaggttatacttcttggggatgtattgacttagtatcagcaggaacgggtgagatgagcaaacgttatggattcatctatgtcgaccgagacgattatggtaaaggaagtttgaaacggacgcctaagaaatcatttaactggtacaagaaagttattgcaagcaacggtgaagatttaacaaatgaataa

SEQ ID NO: 42159 - DNA, 1743 bp, Lactococcus lactis
atgtcagtgttagaaaaaatagacagcccagcggatttaaaaaaagtatcaaatcaagaactagaagaattagcttcagaaattagaacagcagttcttcataaagtatcaaacatcggtggacacgttggcccaaacttgggtgtgactgaattaacaattgcccttcataaagttttcaattcaccaattgataagtttatttgggatgtttctcaccaaacttatccacataaaattttaactggacgtaaaaatggatttactgatggacatttccatgacatcacaccttacaccagtcaaagagaatcagaacacgactttttcacagttggccatacctcgacttcaattgctaatgccttaggttatgccaaagcgcgtgatttgacaaatgacaaaggcaacattgttgcggtcattggtgacggttcactttctgggggacttgctatggaagccctcaataatgccggagatttcaaaggaaacctcattattttagttaatgataatcaaatgtcaattgctgaaaatcatggaggactttaccgtaaccttgccgaacttcgggcgacaaatggtcaagccgaaaataacttctttaaaacttttggtttagattataaatatcttgaaaatggaaatgatattgaatctttaattcacctatttgaagaagtaaaagatatcgaccatccaattgtccttcatattcatactgaaaaaggacgtggttatcaaccagctcttgaaaataaagaagcttttcactggcacatgcctttcgatttagaaactggtcaatcaaaagtgattgattctggtaaatcttatagttcagttatgttggattacatggataaaaaggtttcagaaggccttcctcttgttgccatcaatgcagcaattccaggaatctttggactgaaacaatttgcagctaaatatcctgaccgttatattgatgcaggaattgctgagcaatttaccattacttttggtggtgcaatggctgcggctggtgctcgtccaattattttccacaattctacttttgttcaacgtgcttatgatcaattttggcatgacttagcaattaatgaagaaccagcaattgttattgttaaaggtggagttatttcaggttcagatgaaacacaccaaggctcatcagccatgacttggatttcaaacattccaaatatcaaatatcttgctccaacttctgaagaagaatttatttcaattcttgattgggcacttgagcaacatgaagaaccagttgtgattcaaatgccagaacacggcttagaatcacgtccgacagttctcacagattattcaaccccttcatatcaaatgacaaaatcaggcgaaaaagttgccctattggcacttggcggtctttattcacatggtgaaaaagtagctaaagttttggctgaaaatggaattaatgcaaccctaataaatccacttttcatcaacgatttggaccaagctttccttgaaaacctagttgaaaatcatcaagttattgcaacgatcgaagatggaattcttgacggaggatttggtcaaaaagttgcttccttccttggtaagtatgatgttaaagttttgaactttggtgcgaaacgtgaatttaatgattctgttccagtgacagaactttataatcgttatcatttgacaccagaacttatggttgctgatattcttagtcttttgaaataa

SEQ ID NO: 42160 - DNA, 1638 bp, Lactococcus lactis
atgaaaaaaataaaaacaaatgattttcacaagatggtaggttatcagatttatccaaaatcattcaaagataccaatggagatggcattggcgacatcaatggcatcattgaaaaaattccttatctacgtgaattggggattgattttatctggataaatccaatttacaagagtccacaagttgacgggggctatgatatttctgattatcaagtcattgatgaaatgtttggctcacttgaagattttaaaaaattactagataaagcgcatgaaaatggcttgaaagtcatcatggatttggtagtcaatcatacatcagaccaacacccttggtttttagaaagtcaaaaatcaaaagataatccttaccgtgattattatttgtgggaagacgctagccctaaccaaatgccaaatgattggatttccttttttggtgattcaacttgggcttatgatgaaaaaacaaaacaagcttattttcacgtttttgccaaagagcagcctgatttaaattggaaaaatcccaaagtccggcaagaaatttatgacatgattcgctggtggttagatttgggaatagatggcttcagattagatgcgatttcacacattcaaaaaatgccatggaactataaaattaaatcttggaaaggcgacggcccgtgggtgcctttcatgaatgttgctgggattgaaacatatatgtcagatttgaaagctatttttgatgaatatggtgctttgactgttggggaagcttcaggggttcgctccaagcaagcgcccgattggaccgatgaagctggctatatcaatatgatttttgaattagaacataatgtcagaaaatcaaatggcaatggtcagggcagtatttatggctacaaaaaagtcattatgcgttggcaagaagatttgcttgaacggggttggaatgctttgtatattgaaaatcatgaccaaccaagaagtattgatacttttggcgatggttcaatagaatcagcaaaagcgttggctgtcagttatatgctcttaagaggaacgcctttcatatatcaagggcaggaatttgggatgactaattttccatttactgacgcaaagcaattgcgagctgacgagattaaaaagaaatatgaaatgttaatgacagaactgtcagcaaatcaagcactagcagaagtcacccaaaatagtcgtgaacactcaagaacaccaatgcagtgggacaattctaaaaatgcaggatttacaagtggacaagcttggatggaaattaatccaaatttttctgttattagtagtcgaactaatcaagaactcattgaactttataaaaaattgattgaattacggcatcaagaaccagcgatttcagagggttcaattaaatttcattttaaaagacatcctcaagttttagtttatgaacgagctgaatttttaattattgtcaatttggctgacaaaaaagctcatttagattttacaaaaattgacagttttactgacagctctgctgaaagttctgtcattaattatcaacaagtcttgggcagttcaaatcaaaaatttcaagaaaaaatggttctgtcagcctgggaatatcgggtttataaaaaatag

SEQ ID NO: 42161 - DNA, 1575 bp, Lactococcus lactis
atgaaaaataagcttttacttctgttagtaactttactggcgacgtgtgctttaagtgcttgtcaaaaagcaaattcaaaagattcatcagtaaaaaaagcggctgtcagccaaaaggttgataggagtttgtatcgtaatttttatgaaatatttacgagttcatttgccgattcaaatcatgatggcgaaggtgatttaaatggggtcacgcaacatttagactacttgaatactggaaaatccaattctacaacggatttgaaagtgcaaggactttggatgacaccgatttttgctagtcctagttatcatggctatgatgtcactaattacgaagaaattaatcccaagtttgggacaatggctgattttgaaaatctgattgctcaagctaaaaaacgaggaattgctgtgattttggatatgccatttaaccacacggcgactgataatatctggtttcaaaaagcactatctggcgacaaaaaatatgtggattattataattggtcagatacagccgaagagggttatagtttagccagcaacggcaaatactatgagtcagagtttgataaatcgatgccagacctcaatcttgctaatcctgaggtcaaaaaagaaattgcaaaaattacgaaactttggttggacaaaggtgtttctggtttccgtttggatgctgtcggtttttatttctcaaatgatgataaaaaaacgacagctttcacaaaatggctgacagacacggtcaaaaagcaaaatccaaaagcttatttagtgggtgaagttttttcaacggcttcggcaattgatgatatttatcagtcaggtattgattcattatttgactttccgaatgctttgcaatcgagttcaagtccaattaattcagctttagtcttaggtgaaggctctttatttggtcaacaaattgaagcatgggaccaagaaattcatgcggataacccgaaagccattgacgctcctttcttgagtaatcatgacacagaccgatctgcaacacttttaagttctttatccatgcagaaaatggctgctcaaacttatcttttgatgccgggaaatccatttatttactacggtgaggaattggggctgacaggttctggcattgaccaaaataaacgtttgccaatgccttggaatgctgctgggacagattctcccaaagcagacatttctgtgccaggtgcgacagaaattgccacaactgacggaggctcagtagctcaacaagaagccaatccgaactcactgctcaattggtacaaaaaaattttacgggtcaaagcaaaatatcctgaaattgcgactgacagattgaaaaatatttctgtcagtgaagagagcttgtctgtcattaattatggaaaggatttgactattatcaataatttttccgatacagaaaatgtgacaatgaaactcccaaaaagcgttgttgggacaaaaatcactgaccaactttctgtcagtagttctcaagcaaaattaactgatggaaaattgacaattccagcttacagcaccgttattttaaaaaaataa

SEQ ID NO: 42162 - DNA, 1626 bp, Lactococcus lactis
atgaactcacatcttaatggagtagttaatatgaaagaaaattggtggcaaaaaacagtcgtttatcagatttatccgcgttcttttatggatgctaatggtgatggtgttggagatttgcaaggaattatctctaaattagattatcttgaaaaacttgggattggtgcaatttggttgagtccagtttatcaatcgccaatggatgataatggttatgatatttctgattatcaagcaattgctgatgtttttggaacgatggcggatatggatgaattgctcatggaagctaaaaagcgaaacattcaaattgttatggatttggtagttaatcatacttccgatgaacataagtggtttgtggaagctagaaaatcaaaagataatgcttatcgtgattattatatttgggctgatgaacccaatggtttgcaatctaccttttctggttctgcttgggaatttgatgaggaatcgggccaatatttccttcatctttttagcaagcgtcagccagatttaaactggggaaatcctcaggttcatcaagaagtttatgacatgatgaatttctggattgataagggaatcggcggttttcgcatggatgtgattgacttgattgggaaagaaattgaccaagaaatcacaggaaatgggcctaaattacatgagtatttgcatgagatgaatcaggcaacttttggtcagaaaaatttgctgaccgtaggtgaaacttggggagcaacaccagagattgcggaactttattctgaccctaaacgtcaagaattatcaatggtttttcaatttgaacacatcacaaatgcttatcttgatgagggcgaaaaatgggataaaaaggaattttcagtttcaaaacttaaagaaattttagccaaatggcaagctttagaaaaaggttggaattcacttttttggaataatcatgatttaccacggattgtatcaaattggggaaatgacgggaaatatcgtttgaaatcagctaaaacttttgcgattttattgcatttgatgaaaggaacgccttatatttatcaaggtgaagagcttggaatgacgaattattcttttgaattaattgaagaagtcaatgatatcgagtcacggaatatgtttgctgaacgcttagctgctggtcattctgaaaatgaaatcatggattcaattcgtcgtgttggtcgtgataatgccagaacaccgatgcaatggacggctggagaaaatgcaggttttactgatggaaaaccttggctcgctgtcaatcctaatcatgaagaaattaatgctgatcaagccatgagtgatcctgattctgttttttatacttatcaaaagttgattgaacttcgtaaacaacatgattgggtcatttatggggacttcaagttgattgattctgaggctgatgtttttgcatatttgcggacttataagggcaagaaatatttggtcgttgccaatttatctgatgaagaaaatcaatttaaaacaggatttgtctgtcgtgacttattgattcacaatgaaaatttcctgcctgaactttctcagattaaattaaaagcttgggaagcctttgcttgcgaagtggaatag

SEQ ID NO: 42163 - DNA, 1755 bp, Lactococcus lactis
atgaacaaagctgcaatttatcatcgtcctgagtcggaatttgcttatctttatgcaaaaaatctgatgcatgttcgtctgcaaacacaaaaatctgatgtggaaaaagtcgaattattttatggcgatccttattcgtgggaagggcttgataaccctgaaacacagtattgggctagtcaaaaagtagagatgaaaaagtatctttctactaatattagcgattattttgaggccgaaattactgttgcaacgaaacgagtagattacttatttgtcattacaggtttggatggagaaaaagtagtttacacagaccaaggaatgtttgattatgatgagagcttggtgactaaaaaatatggggctttccgtttgccttatttccatgaaagtgatcgttttaaagcacctgaatgggtcaaagaaacggtttggtatcaaattttccctgaacgttttgccaatggggatacgagcaatgatcctgagggaacaaaagcttggaatccacaagatgttcctgaccgtcaagatttttatgggggagatttgcaaggggtgattgatcatttggaacatttgactgaactcggtgtgaatggcatttactttactcctattttccaagctttttctaatcataaatatgatacagaagattatatggaaattgataagcaatttggggataaggaattgtttaaaactttggtgaaagaagcacatgcgcgtggtattaaagtcatgttagatgcggtctttaatcacatcggagatacgtctgctcaatggcaagatgtattgaaaaatcaagaaaaatcaaaatttgcggattggttccatgttaatagttggccagcaacttatactccgactgatgattttgaaaatgctgagaatgcaacttatgatacttttgcctttactccacacatgccaaaactcaatacggctaacccagaggttgaagcttatcttttgaaagtagctgattattggatttctgagtttgatattgatgcttggcgtttggatgtggcggatgaagtggatcatactttctggaaaaaattccgtacaacttgtgacgcggcaaaagatgatttttatattttaggtgaggtttggcattctgcacaaccttggttagttggtgacgaattctctgccgttatgaactatgcttatactgatgcgattaaagatggtttgattacgaagaagatttctttggaacaaatggtttctaatattaatacgcaactgacattataccgtaagcaagtgaatcaaatgatgtttaatgttttagattctcatgatacacccagaattttgactgttgcaaaaaataataaaaatttgatgaaattggttgaaacgttcaccttcatgcaaccaggtgtgccttgtatttattatggggatgagtatgcggtgacaggtggaatggaccctgagtgtcgtaaggtgatgccttgggaagaaaaagatcaagatttagagatgtttgatttctttaaaaatctgattgctctacgcaaacaatatcaaggaattttaagtgattcagaagtagaatggaaaatcgtagattcagaaaatggcattgtgaaatttgaacgtggatctttgaaagctattttcaatattggcgaaaaaccggcttatttttcagctgatgaagtggttttctctaatttggttgaccaaaataatattttacaatatggttttgtaatctataaatag

SEQ ID NO: 42164 - DNA, 948 bp, Lactococcus lactis
atggcaaaacgtattgtagttgctctaggggggaatgctattttaactagcgaccctacagcgcaagcacaatctatggcacttaataagactgccgaacaattaatgcctttaataaaagacaatgatgttgaaatggtcgtcactcatggaaatggaccccaagttggtaatttacttttgcaacaacttgaaagtaattcagttaaaaatccagcaatgccacttgatacagctgttgctatgactcaagggcaaatcggttattggatggcacaagcttttacagaagctcttgctaataatggaatgtctgatgttccatttgtttctatagtgacaagaacagtagttgatgctaatgatgaggcttttaaaaatccgacaaaacctattggacctttttatagccaagaagaggctaaaaatattcagactcaatatcctgattggaaattgattgaggattctggacgaggttaccgaagagtagtcccctcaccattacctctcaaaattgttgaggctaacgcaattaaaccattgttagaatcatcagctttggttacagtatctggtggcggaggaattcctgttattgaaaaaaataagggatatcaaggagtcgaagcagtaattgataaagattttacggcagcaaaattagcagaacttgttgatgctgatgaactagttatttttacctctgtcggtaatgtctttttaaattttggtaaacccaatcaaaaagctctaggagttgtaccagttagcgaaatgcgtcaatatctagaagaaggttattttgcggcaggttctatgaaaccaaaagtggcagcagctgttgcttttgtcgaaaatactggtaagcatgccacgattacttcacttgaaaatgtggaaaactttgtcaaaagtggagcaggaacacggattgttcctgattga

SEQ ID NO: 42165 - DNA, 1023 bp, Lactococcus lactis
atggtaacaacaaacaaacgtgatttcatcacaacagaagattacactaaagaagaaattcttgatattgtaacactgggcttaaaaatcaaagcagcgattaaaaatggctactatccaccacttcttaaaaacaaatcactaggaatgattttccaacaaacatcaactcgtactcgtgtttcctttgaaacagctatgactcaattaggaggacatgcagaatatttagcacctggtcaaattcaactcggtggtcatgaaacaatagaagatacaagcacagttctttctagattgcttgatatcatcatggcgcgtgttgatcgtcatgaatcagttaataaccttgcaaaacatacaaccattccagttcttaacgggatgtcagactataatcacccaacacaagaagtcggtgatttgactacaatgattgaacatttaccagctggtaaaaaattagaagattgtaaagttgtctttgtcggtgatgcgactcaagtttgtttctcattaggtttaatcgcaactaaaatgggaatgcactttgttcattttggccctaaaggctaccaacttaatgaagaacatcaagcaaaattagctgcaaattgtgaggtttctggtggtacttatgaagtaacagacgatgaagaatcaattgtcggtgcagatttcctttatacagatgtttggtacggtttgtatgatgcagaactatcagaagaagaacgtctagcgattttcttccctaaatatcaagtgacacctgagatgatggcaaaagcaggagcacatacaaaatttatgcattgtcttccagcttcaagaggtgaagaagttgttgatgcggttattgatggtccaaactcaatttgttttgacgaagccgaaaatcgcttgacttcaatccgtgccctccttgtttggttgatgtctgattatgctgaaaaaaatccttatgatttgaaagcacaagccaaagctaaggctgagttagaggcttacttagccaaataa

SEQ ID NO: 42166 - DNA, 762 bp, Lactococcus lactis
atggaaaaagaagcagttttaaccgtcagcgacttatcgctttattacagcaagaaaaaagcgttgaatacgataaacatgacattctataagaatgaaattacagcgctcattggtccctcaggatgtggaaaatcaacgcttttacgttcaatcaatcgaatgaatgatttgattccaacagtaacaattactggagccattgattataaaggtaaaaatatttacagtcctaaagttgatactgttgatttacgtaaagaaattggcatggttttccaacaacccaatccttttccattttcaatttatgaaaatgtggtttatggattgcgtttaaaaggagtgaaagataaggcacttcttgatgaagtggtggaaaattcactcaaagcagcaaatatttgggatgaagttaaggatattttgcacagttcagcacttggactttcaggtgggcaacaacaaagggtttgtatcgcacgtatccttgctgtcaatcccgaaattatcctaatggatgaaccaacatcagcccttgacccaatttcagcggctcgtgtcgaagaaaccatgcttgaacttaaaaaagattatacaatcgcgattgttacacatagtatgcaacaagcatcacgaatttcagaccgtaccgcctttatgttagacggaaatctgattgagtataatgatacgaaaagtattttcttaaatccagaaaaacaagaaacttctgattatatttctggtaaatttggataa

SEQ ID NO: 42167 - DNA, 594 bp, Lactococcus lactis
gtgagaatttattttgtacgacatggtaagacggagtggaacttggcgcgacgtttgcaaggacaaaaaggagattcacctttattgccagaatcttatgaagcgattgaacgagttcataagtttttagaaccaattgaatttgacaaagttttgtcgagtccacaaaaaagagctttgattacggcagatttactgacaaatcaaagtgtgagtactgacaaacgattgtcggagtggaatttcggggaattagagggttggttcattagcgatgcaattgctaaatatcctaaagaaatgcatgattcacgttttgagttggatcaatttgatggaagtgtttttggagctgaatctgtgagttctgtcttgaatcgctttgattctttggctcaggatttgttgaattctaaaatggacaatgtacttttagttggtcacggggcttctggaacggctggaatgcgccatttagctggctttccaattgctgaattacgttcagttggtggtttagccaataatacggtcactgttttagaatcaaatgctggccattttgacttaaaaatttgggataaacagctatga

SEQ ID NO: 42168 - DNA, 489 bp, Lactococcus lactis
atgagtatcattttaattggatttatgggtgcgggaaagtccacagtagcaaaacttttaacagaaaattttactgatttggatcaattaattgaagaagaaattgagatgacaattgctgaattttttgaattatttggggaagctgattttcgtaaaattgaaaatgaggtttttgaacttgcgctgcaaaagaatataattattgcaacgggtggtggaataattgaaaatccaaagaatttagaggctcttgatagagaagctggagttgtctttttgaccgctgattttgaaacgctttgggaacgaatttcgatggatttgcagaatgttcgtcctctagcgcaggataaaaaggccgctcaacttttatttgaaaaaagaaaaaatgactatgcaaaagtggccgatttaacgattgatgttactgataagagtcctgagcaaattgtagaagagattcgtgaaaaatgggggataaattaa

SEQ ID NO: 42169 - DNA, 1293 bp, Lactococcus lactis
atgaaattaaagataaattcgcaaggcttaaaaggacgtttaaaagttccaggagataaatcaatctcacatcgtagtattatgtttggctctattgctaaaggaaaaactgttatttatgatattttacgtggagaagatgtcttatctactattgaagctttccgtgcgatgggagttgaaattgaagataagggtgaggtgattactgtccacggtaaaggaatttcagaacttaaggctcctgaaaaagcactggatatgggaaattccggaacttcaactcgtcttttatcgggaattttagcaggccttccttttgaaactactttgtttggtgatgacagtttatcaaaaagaccaatggatcgtgtagcaactcctttacaattgatgggggcagaaattactggtcaaaccgataaggttaaattaccgatgacaattaaaggaagcacgcatttgaaggcaattgactatgttcttccggtggcttcggctcaggtaaaatcagctgtaatttttgctgctttacaggcagaagggctgacgaaagttgttgaaaaggaaaaaacacgctcacataccgaagaaatgttagttcaatttggtggagaactaaaggtttctgataaaacaattcttgtacctggtggacaaaaacttgtgggtcaaaaagtagtagttcctggagatattagttcggcagctttttggttggttgcggccttggttgttgaaaattcagaacttattttagaaaacgttggagttaatgaaacaagaactggaattatcgaagtcattcaagcaatgggtggacagttggaaattttagagcaagataatgtggcaaaggctgcaactctaaaagtaaaagctagtcaattgaaaggaactgaaatttcaggtgatttaattcctagattaattgatgaattgccaatcattgctctcttagcaacgcaagctcaaggccaaacaattattcgagatgcggctgagcttaaagtaaaagaaactgaccgaattgctgttgtcgcgaatgctcttaatagtatgggggccaaaattcaaccaacagatgatggaatgattattcaaggtggaacgaaactccatgctccagaaaattcaattaatactttaggtgaccatagaattggaatgatggctgcaattgcagcacttttggttaaaaatggggaaattgagcttgaacgtgccgaagcaattcaaacaagttatccaagtttctttgacgatttagaacaattgtcggaaaatatttga

SEQ ID NO: 42170 - DNA, 1167 bp, Lactococcus lactis
atgcgttattttacagcgggagaatctcacggcccaagacttacagcaattattgaaggagtgccagccggtctctcattgtcagcagaagatattaatattgaacttaaacgtcgtcaaggcggctatggtcgtggcggacggatgaaaattgagtctgaccaagttgaaattacttcaggcgttcgacacggaaaaacaattggtagcccgattacacttaatgttacaaaccgtgatttcaagaattgggaacagattatggcagcccaagatgttgaagataaaattaaaaagcaacgtcgtttgaccaaaccacgcccaggacatgccgatttagttggcggaatgaaatatgaatttgaagacttacgaaatgttttagaacgttcgtcagcgcgtgaaacaacaatgcgtgttgcggttggagctgtggcaaaaaaactacttcacgaattagaaattgaaatagctaatcatgtcgtaaattttggcggacgagaaattacaagtccagaaaatttaagtgttcaagatattcgtcagacagctggccttagtgatttgtctatttttgatgagagtcaagcagaagaattacgcaattacatcgaccaaataaaaaaagctggagatacaattggtggaataattgaaaccagagtagaaggagttccggctggtcttggttcctacgtccaatatgacagaaagttggatgcaaaaattgctgctgcggttgtttctatcaatgcctttaaaggagttgaatttggacttggatttgaagcaggaaaacgaccaggaagtcaagtgatggatgaaatcatctggtctgaggataaaggctacactcgttcaagtaatcagttaggcggttttgagggaggaatgacaaatggtgaacaagtcatcgtccgtggagtcatgaaacctattccaacattgtataaacccttgatgtctattgatatcgaaagccatgaaccctacaaagcaagtgtagaacgttctgacccaaccgctcttccagcagcaggagttgtgatggaaaatgtagtagcaacggtagtcgctcaagaaatctgtgataaatttgattcagatacaatgaatgaactaagagacgctgtagccagttacaaaaagcgcttgtcagaatattaa

SEQ ID NO: 42171 - DNA, 1071 bp, Lactococcus lactis
atgaaattaaatgtgaatttaccagaacatccctatgatgtcatcatcgaaaatggggccttggctaatattggaacttgggtttcttcattgtggaagaagcaaaaaattgttttgatttctgataatcatgtcaatggactttatggtcaaaaagttgttgaccaacttgaaaaagtaggttttgaagtggcaacttttgaatttccagaaggagaagccagtaaaaatttactgacagccgaaaatgcttggaacttttgtgccgaatttggattgactcgttctgacggaattattgcactcggtggtggagtaacaggtgatttagctggttttgtagcttctacttacatgcgtggcatccatttcttacaaattccaacaagtttgaccgcccaagtggatagttctattggtgggaaaacaggaattaattccaaaatggctaaaaatatgattgggacttttacacagcctgacggcgtgttaattgacccagaagttctgcaaacgctcggtcaaagagaattccgtgaaggactgggggaggtcatcaagtgcgccctaattgctgacaaagatctctggaatttactgacagacttgtcggcggatgatttagtaaaaaagcttgataagattgaagaaattatctatcggtcttgtgaagtaaaacgaaaagtggttgttgatgatgaattagacaatggtgtacggctctatttgaactttggtcatacaattggacatgctgttgaaaatactgcaggctatggcaaagtgatgcatggagaagcagttgctatcgggatggttcaaatcagtaaaattgccgaactcaaaggtcttatgcccaaaggaattactgaccaaattcgaaagatggtcaaaaaatttggtttacctgacgaatatcaaccttgggatgaagagcttttgtttaaagcattaactcatgataaaaaagcacgaggaagaatcatcaaaaccgttattgttcctgaaattggcaccgctaaaattaatgaagtgacttttgaagaaatgaaagactatctcaaaaaataa

SEQ ID NO: 42172 - DNA, 861 bp, Lactococcus lactis
atgaacattaacggctacactcgtatggctgctgttgtagcaaacccaattaaacacagcttgtcaccatttattcataatctggcttttgatttaacgaatgaaaatggtgtttatttagcatgggaagttgaggctgaaaaattgccagctattgtggataatgttcgtactttggacatgtatggacttaatatttcaatgccttataaaacagaaattactccatttatggatgaattgagtccggcagctgaattaattggagctgttaatacagtagtcaatcaatcagggaaattaattggacacaatacagatggcataggatttttcaatagtttagaaaaatatcatttcaatatccaaaataaacaaatgcttattcttggtggagggggtgcagcaattgcaattattgctcaggcagctttgtctggagctaaaaaaattgtggtcgcagcaagaaaatcggcctcatatattccgctaaaagaaaaattggaaaagctgtcagtaaaaacagggattgaaattttactgacagacttatctgaagctgatagattacaaaaagagttgaaacagaccgacttattagtaaatgcaacctcagtcggaatggacggagaatctttgccgctggaaaagagcttagttcttcctgaaaaacttttggtggtagatgctatttataaagttagagaaacaccatttttacgttgggcaaaagggcaaggagctcaaactgaaaatggacttggcatgctcattggacaggcggcggaaagcttttatttatggacaggtaaaaaaatgcctgttgcagaaattacattagaaatggagaaagaagcatga

SEQ ID NO: 42173 - DNA, 1410 bp, Lactococcus lactis
ttgagttctggtaaaattactcagattatcggtcccgtcgttgacgtggaatttggttctgatgccaaattgcctgagattaacaatgccttgattgtctacaaagatgtcaatggcctaaaaacaaaaattactcttgaagttgctttggaacttggtgatggtgcagttcgtacaatcgctatggaatctactgatggcttgactcgtggacttgaagtccttgatacaggtaaagcagtcagcgttcctgttggggaagccactcttggtcgtgtttttaacgttcttggtgatgttattgacggtggggaagaatttgctgctgatgcagaacgtaatcctatccataaaaaagctccaacatttgacgaattgtcaactgcaaacgaagttctcgtaactgggattaaagttgtcgatttgcttgcaccttaccttaaaggtggtaaagttggacttttcggtggtgccggagttggtaaaaccgtccttattcaagaattgattcacaacatcgcccaagaacacggaggtatttctgtgtttaccggtgttggggaacgtactcgtgaagggaatgacctttactgggaaatgaaagaatcaggcgttattgaaaaaactgccatggtctttggtcaaatgaatgaaccaccaggagcacgtatgcgtgttgcccttactggtttgacaattgctgaatatttccgtgatgttcaaggtcaagacgtactgcttttcattgacaacatcttccgtttcacacaagctggttcagaagtttctgcccttttgggacgtatgccttctgccgttggttaccaaccaacacttgctactgaaatggggcaattgcaagaacgtatcacttctactaagaagggttctgttacatctatccaagcgatttatgtccctgccgatgactatactgacccagcgccagctacagccttcgctcacttggatgcaacaactaacttggaacgtcgtttgacacaaatgggtatttatccagccgttgacccacttgcttcatcatcacgtgcgcttacacctgaaattgttggtgaagaacactatgaagtggcaatggaagttcaacgtgtcctccaacgttataaagaattgcaagatattattgccattcttggtatggatgaattgtctgacgatgaaaaaattctcgttggacgtgcacgtcgtatccaattcttcctttcacaaaacttccacgttgcggaacaatttactggtcaacctggttcatatgtaccaattgacaaaactgttcatgacttcaaagaaattttggaaggtaaatatgacgaagtccctgaagatgctttccgtggtgtaggtccaattgaagatgtactcgaaaaagcaaaatcaatgggttattaa

SEQ ID NO: 42174 - DNA, 870 bp, Lactococcus lactis
atgggagcttcacttaatgaaataaaaactaagattgcctcaacgaagaaaacaagtcaaataactggagccatgcaaatggtttccgctgcgaaacttcaaaaagctgaatctcatgccaaagcatttcaaatttatgctgaaaaagttcgtaaaattacaactgatttagtttcctcagacaaagagccagcaaagaatccaatgatgataaaaagagaagtcaaaaaaactggctatctggtaattacttcggatcgtggacttgtcggtggctataattcaaatattttgaaatctgtcatgaatactatccgtaaacgtcatgctaatgaaagtgaatatactattcttgcacttggcggtactggagcagatttcttcaaagcacgtaatgttaaagtttcttatgtccttcgtggtctttcagaccaaccaacttttgaagaagttagagcgattgttacagaagcggtaactgaatatcaagcagaagaattcgatgaactctatgtttgctataatcaccatgtgaactcattggtaagtgatgcacgtatggaaaaaatgttgcctatttcttttgaagaatcaggtcaacaaaaaccatctcttgaaacatttgaattagaaccagatcgtgaaacaatcttaaaccaattgttgccacaatacgctgaaagtatgatttatggttcaatcgttgatgctaagacagcagaacatgctgcaggtatgacagcaatgcgtactgcaactgataatgctcactctgttatcaatgatttgactattcaatacaaccgtgctcgtcaagcatcgattacgcaagaaattacggaaatcgttgcaggagcctcagcgctttaa

SEQ ID NO: 42175 - DNA, 1503 bp, Lactococcus lactis
ttggcaattaaagctaatgaaatcagctcactgattaaaaaacaaattgaaaatttcacaccagattttgaagttgctgaaactggtgtcgttacctatgttggtgacggtatcgcccgtgcctatggccttgaaaatgcgatgagcggtgagcttgttgagttttcaaatggtgtccttggtatggcgcaaaacttggatgcgacagacgttggtattatcgtacttggtgatttcctctcaattcgtgaaggtgacactgtaaaacgtacaggtaaaatcatggaaatccaagttggtgaagaactcatcggacgtgttgtaaatccacttggacaacctgttgatggacttggagaacttaatactggtaaaactcgtcctgttgaagcaaaagctcctggtgttatgcaacgtaaatcagtctctgaaccattgcaaactggtcttaaagcgattgatgccctcgttccaattggacgcggacaacgtgaattgattatcggagaccgtcaaacaggtaaaacatcagtcgctattgatgcaatcttgaaccaaaagggtcaagatatgatctgtatctacgttgcgattggacaaaaagaatcaactgttcgtacacaagttgaaacgctccgcaaactcggtgcgatggattatacaatcgtcgtaactgcgtcagcttctcaaccttcaccacttctttacatcgctccttatgctggagctgcaatgggtgaagaattcatgtacaacggtaaacacgtcttagttgtttatgatgatttatcaaaacaagcggttgcttatcgtgaactttcactcttgctccgccgtccaccaggtcgtgaagcatacccaggtgacgtattctacttacattcacgtcttttggaacgtgctgccaaattatctgacgatcttggtggtggttcaatgactgcactgccattcattgaaacacaagccggagatatctcagcttatattgcaacaaacgttatctctattactgacggtcaaattttccttgaaaatgacttattctattcaggtgtacgtcctgccatcgatgctggttcttcagtttctcgggttggtggtgctgcacagatcaaagccatgaagaaagttgctggtactttgcgtcttgaccttgcgtcattccgtgaacttgaagcctttactcaatttggttctgatcttgatgaagcgactcaagcaaaattgaatcgtggtcgtcgtaccgttgaagttttgaagcaaccattgcacaaaccattggctgttgaaaaacaagttttaattctttatgcattgactcatggtcatcttgatgatgttccagttgatgacgttcttgattttgaaacaaaaatgttcgatttcttcgatgcaaattatgcagaactcttgaacgtgattactgaaactaaagatttgccagaagaagcaaaactcgacgaagcaattaaagcattcaaaaatacaacgaattattaa

SEQ ID NO: 42176 - DNA, 1149 bp, Lactococcus lactis
atgagctttaaaaatcccgtcggtatcatagcagcaaaccgtttacctataggaaaaatcaatggtttttataaaaaaatttctcctgaaactttatatcaaaatctaattaaacaacaatttaataaaaatctacttctcaaaaaagctgatattgactatattattttgggaaatgtgactaatcaaggaggaaatttagctcgacgttgtgccttaaaagcaggattttctagccaggtcccagcttttacaattgaccagcagtgcggttctggactgacagctatgattagctctgcaaactacattatttctggtgaagcttccgttatttgtacaggaggggtagaaagcacatctcaagccaatattgtgcttgattcagagagttatcagccgattaaccgatttaaaatggctcctgaaccctatgaagatttcgacatgggaacaattgccgatatgacagccctaaaatacaatattcctcgtagtgttcaagacctttacgctctaaatagtcataaaaaagcgactcaagctattgaaggaaaacttttagaaaatgaagtttttccctatcaagatgaaggatttacaataagtagcgatcaaactgttcgtcctaaatcctcaatggaagctttgagcaaattaacccctgcttttaccactaacggaacagccactgctggaaactcttgcccaataaacgatggtgcttcttcaatcatattgtcatccactaataatccttttgattttcaaggctattatttaggacaaacaactattgctttatctccatcagatttcttattaggcccaataaaagcaactgaaaaacttttacagaaatttaaccttaaacttaatgatattgaggctatcgaattaaatgaagcctttgccagtcaggccattttattccaaaattattttaagcttgatgatataaaattaaatgcttatggtggttcccttgcatttggtcatccttacggtgcaactggtggcattctaatttctcgactcttaaatcgcctaaaccaagtgcaaaaaccatgtcttggcatcgcaactttgtgcgtagctggaggtatgggaatcagtgtactgataggtaatcaatggtatcaaaaatga

SEQ ID NO: 42177 - DNA, 747 bp, Lactococcus lactis
atgaacaaacgaacaattttgattaccggtgcaacaaggggaatcggctgggcaattgctcagaaagctgctcaagccaatcacaaagtcattttaactggccgtgacccacttagtttaaaaagtagagctgaagaattgaaaaaaaaatttcccaaaacagaaatccaagctattccactagatgtttctaatcgctctagcgttgctaatgcagccaaattaataaaggatattgatattctaattaataatgctggaattactgctgatagtacttttaagaaaatgagcccagaaatttgggatgaagtcatttctgtcaatttgactggtgtatttaatagtactcacgctttgcttgataaaatcaatcaaggtggacaaatcattacactaacttcaaaatcagctttatttggtaactttgggcaagcaaactacgcggcgtccaaagccggcatcattgcttttacgaaaacactagctaaagaattgcaaaaaagtatgatacgagtaaattctgtttctcctgctgccgtaactgatatgactctaccagtattaaaaagtttaaaagaaacttatggtcagaatatccctgatgaatggaaaatgggttcaagctctgatgtcgctaattttattattaatgatttaattgaaagcgaaatgacaggcaaaattttttccattaacggctctgagattggctattggcaagaacctacatttcataaactttaa

SEQ ID NO: 42178 - DNA, 3591 bp, Lactococcus lactis
ttggcaggacatgacgtaaaatacggtaaacaccgtacaagacgcagtttttcacgtattaaagaagtaatcggtttgccaaacctcatcgaagttcaaacattaagttataaaaacttcctcgatgaaggtcttgcaaatgtcttcaaagaaatgtttccaatcgacaactttgcgggtacaatggaactcgaatttgttggttatgaaatgaaaaccccaaaatacactgttgaagaagctcgcgcacatgacgcaaactattcagcacctatctatgtaaccttccgtcttgtaaataaagaaactggtgaattaaaaacacaagaagtcttctttggtgacttcccactcatgactgaaatggggacatttatcaataacggttcagaacgtttgatcgttagccaattggtacgtagtcctggttcatacttccatcttaaagctgataaaaacggtcttgaaagttttggacatacaaccattcctaaccgtggagcttggtttgagttagatacagatgctaaaggcattggttatgttcgtattgaccgtacacgtaaattaacttttacaactatgcttcgtgcgcttggatttggttcagatgaagaaatccttgaattgttgggcgaaactcaacttttaacagacactattgcaaaagatgttcataaaaacccagctgacacgcgtgtagaagaagcgctcaaagacatctatgaccgcttgcgtccaggagaacctaaaacagcagatagctcacgtggcttgcttgttgctcgtttcttcgatccaaaacgttatgacttcgcacctgttggacgttacaaatttaacaagaaattagcgcttaaaaatcgtttgcttggtttgactttggctgaaccaattgttgacccagaaactggtgaaattcttgttaatacagatactcttgttactcgtgatgtgcttgatttaatcgaaccattgcttgataacggtcttggaaactttgttgttgaaccatctgacgacgctgtaattccagaaccaattactttgcaaagtatcaaagtttattcacctaaagatccagaacgtgttgttacattgctctcaaatggtaatcctgatgcagaatgccgtgtcttgacaccagccgatgtgatttcaaatatcagctactggcttggtcttgctgaaggaattggtaaagtggacgatattgaccacttaggtaaccgtcgtatccgttcagtaggtgaattgcttcaaaaccaagtacgtatcggactttcacgtatggaacgtgttattcgcgaacgtatgtcatcttcagaaaatgaaaacatcacaccgcaaggtttgattaacattcgtcctgtaacagcttcaattaaagaattctttggttcatcacaattgtcacaatttatggaccaacacaatcctttatctgagctttcacacaaacgtcgtttttctgccttaggacctggtggtatctcacgtgaccgtgcttcatatgaagtacgtgacgttcactatactcactatggccgtatgtgtcctattgaaacacctgaaggaccaaacatcggtttgattaacaacttgtcatcatatgccaaagtaaacgaatatggtttcatcatgtcaccataccgtcgtgttgaccgtgtgaatggtgtggttactgacgaagttgaatatttaactgccgatgaagaagacaactatactgttgcccaagcaaactcaccattgactgaagatagccgctttgctaacgaaacagttatggctcgtcatactggtaacaatattgaagttgaagcttcaacagcagactatatggacgtttcacctaaacaggttatcgccgttgctgctgcatgtattccattcttggaaaacgatgactccaaccgtgccctcatgggtgccaacatgcaacgtcaagcagttccattgattgacccacatgcaccttggattggtactggtatggaacatcaaactgctcgtgactcaggtgctgcgcttattgcaaaacatgctggtgttgttgagtatgttgatggtaatgaaattcgtgttcgtcgtacttctggtgaactagatatttacaatattacaaaatatcgtcgttcaaactcaggaacttcttataaccaacgtccattggctcgacttggagaaaaagttgagaaaggggacatcattgctgatggaccttctatggaaaatggagaaatggcccttggtcaaaatccacttgttgcctatatgacttgggaaggttataacttcgaggatgcggtaatcatgtcagaacgtttgattaaagacgacgtttatacatcaattgccatcgaagaatatgaatcagaaacacgcgatacaaaacttggccctgaagaaattactcgtgaaattccaaacgttggggatgaagcactcaaaaaccttgatgaatcaggaattatccgtattggtgctgaagttaaagatggcgacttgcttgttggtaaagtaacccctaaaggtgaaactgatccaacaccagaagaacgtttgcttcgtgcaatctttggtgaaaaagctcgtgaagttcgtgatacatcacttcgtgttcctcacggaggtggcggtattgttcatgacgttcgtgtatttacacgcgaaaatggtgatgaattgccatcaggtgtgaataaacttgttcgcgtcttcattgctcaaaaacgtaagattcacgttggggataaaatggccggacgtcatggtaataaaggggttgtttcaaatatcgttccaatggaagatatgccttacttaccagatggtacacctattgatatcatgttgaacccacttggggtaccatcacgtatgaatatcggacaagttatggagctccatttaggtatggctgctcgtacacttggaattcacattgcaactccagtgtttgatggagcatctgatgaagatatctgggataccgttaaagaagctggaatggctgatgatgcgaaaacagtcctttatgacggacgtactggtgaaccatttgataaccgaatttcagtcggtgtcatgtacatgattaaacttcaccacatggttgatgataaactccatgctcgttcagttggtccttactcactcgttacacaacaaccgctcggtggtaaagcgcagttcggtggacaacgttttggggaaatggaagtttgggcacttgaagcctatggtgctgccaatgttcttcaagaaatcttgacttacaaatcagatgacgtgattggacgtacgcgcgcttatgaagctattgttaaaggtgaacgtattcctaaaccaggtcttcctgaatcattccgcgtattggttaaagagttacaatcacttggtcttgatatgaaagtccttgatgctgaccgtaatgttcttgacttacgtgaattggatgaagatgaagtaatgactcgtccagataatacagaaattactcctgaaatgcttgaagcacaggaagctattgttgcacaagcagaagctgaagaagaagctttgattaacgctgatactgaaaaataa

SEQ ID NO: 42179 - DNA, 1884 bp, Lactococcus lactis
atgacaaggattcaagatgatttattcgctactgttaatgctgaatggttagaaaatgcagaaattcctgcagacaaaccaagaatttcagcttttgatgaattagtactaaaaaatgagaaaaatttggctaaagatttagctgatttatcacaaaacctacctactgataatccagagttgcttgaagcaatcaaattttataataaagcaggagattggcaaaccagagaaaaagcggacttttctgccgtaaaaaatgaacttgctaaagttgaaactttaaatacttttgaagattttaaaaataatttgactcaactcgttttccattcacaggcacctcttccgttttcttttagtgttgaacctgatatgaaagatgctattcactattctcttggattctctggcccgggtttgattttacctgataccacttattataatgatgaacaccctagaaaaaaagaattacttgatttttgggctaaaaatacaagcgaaattttaaagacatttgatgttgaaaatgcagaagagattgcaaagtctgcccttaaattcgatgctcttttagttccatcagcaaatacttctgaagagtgggcaaaatatgctgaactttatcatccaatttctactgacagctttgtcagtaaagttaaaaacctggatttaaaatctttaattaaagatttagtaaaaactgaacctgataaagtcattgtttacgaagatcgtttttatgaatcatttgattcacttatcaatgaagaaaattggtcactcattaaagcttggatgctgacaaaaattgcacgtggcgctacttctttcttcaatgaagaccttagaattcttggtggagcttatggacgtttcctttcaaatgttcaagaagcaagaagtcaagaaaaacatcaacttgatttgactgagtcttattttagccaagtgattggtttattctatggtaaaaaatattttggtgaagctgctaaggccgatgtcaaacggatggtcactgcaatgattaaagtttaccaagcgcgtttgtctaaaaatgagtggctcagtcaagaaacagctgaaaaagccattgaaaaattggatgctattactcctttcattggtttcccagataaattgcctgaaatttatagtcgtttaaaaacaacttctggctctctctatgaagatgcccttaaattcgatgaaattttgactgctcgaacttttgaaaaattctcagaagatgttgataaaacaagctggcatatgcctgctcatatggtcaatgcttattatagtcctgatagtaatacaattgtttttccagcagcaattttgcaagctcctttttactctcttgaacaatcttcatcacaaaattacggtggaatcggcacagttattgctcacgaaatttctcacgcttttgataacaacggtgcccaattcgataaagaaggaaatttgaacaaatggtggttagatgaagattatgaagcttttgaagaaaagcaaaaagaaatgattgcactctttgacggcgtagaaaccgaagctggtccagcaaacggaaaactcattgtgtcagaaaatattgctgaccaaggaggaattacagcggcactgacagcagctaaagatgagaaagacgttgatttgaaggctttctttagtcagtgggctaagatttggcgcatgaaagcaagtaaagaattccaacaaatgcttttgtcaatggatgttcatgcacccgctaaacttcgtgccaatattcctccaacaaatctcgaagagttttacgaaacttttgatgttaaagaaactgataagatgtatcgtgcaccagaaaatcgtcttaaaatttggtaa

SEQ ID NO: 42180 - DNA, 1023 bp, Lactococcus lactis
atgaaagcagcagtagtaagacacaatccagatggttatgcggaccttgttgaaaaggaacttcgagcaatcaaacctaatgaagctttgcttgacatggagtattgtggagtctgtcataccgatttgcacgttgcagcaggtgattatggcaacaaagcagggactgttcttggtcatgaaggaattggaattgtcaaagaaattggaactgatgtaagctcgcttcaagttggtgatcgggtttcagtggcttggttctttgaaggatgtggtcactgtgaatactgtgtatctggtaatgaaactttttgtcgagaagttaaaaatgcaggatattcagttgatggcggaatggctgaagaagcaattgttgttgccgattatgctgtcaaagttcctgacggacttgacccaattgaagctagctcaattacttgtgctggagtaacaacttacaaagcaatcaaagtatcaggagtaaaacctggtgattggcaagtaatttttggtgctggaggacttggaaatttagcaattcaatatgctaaaaatgtttttggagcaaaagtaattgctgttgatattaatcaagataaattaaatttagctaaaaaaattggagctgatgtgattatcaattctggtgatgtaaatccagttgatgaaattaaaaaaataactggcggcttaggagcacaaagtgcaatagtttgtgctgttgcaaggattgcttttgaacaagcggttgcttctttgaaacctatgggcaaaatggttgctgtggcacttcccaatactgagatgactttatcagttccaacagttgtttttgacggagtggaggttgcaggttcacttgtcggaacaagacttgacttggcagaagcttttcaatttggagcagagggtaaggtaaaaccaattgttgcgacacgcaaactggaagaaatcaatgatattattgatgaaatgaaggcaggaaaaattgaaggccgaatggtcattgattttactaaataa

SEQ ID NO: 42181 - DNA, 1350 bp, Lactococcus lactis
atggaaaattctacaggcttgaagtcttctttaaagactcgccacattgttatgctctcacttgggggagcgattggttcaggactatttttaggttctggaaaagtcattgcacaggctgggccaagtgtattactctcatacatcttagctggactgacactttatgttgtcatgtatggtgttgggaaaatggtcatccatcaagatgaacataaggctggaatggccggagttgttgctccttttattggggaccactgggcgcattttgcggactgggtttactgggcaacttggatggccgtcctaattgcagaagaagcaggggtatcaactttccttgccatgctaattcctggagtgccattatgggttttcgccctgattgtagcagttcttggaacagcaatcaatctctggtcagttagagcttttgccgaaacggaatattggcttgcatttattaaagtcgctgttattttaattttaattgcactcggaatttatttattagttattaatgatgctcatcttggttttgttgctgataccgctcaaaaagtatcgactaaaagtacagcaccaagctttgctcctaatggcttttcaggatttttaacttcattattggttgttattttctcatttggtggttctgaattggcagcaattacagttgctgaaacggaaaatccaaaagtagcgattccgagagctattcgaggtgttttaattcggattattagtttttatgttattccaatctttttattcttgcatttattaccatggagcgaagttttaaatccagatgcagcaagtccatttgctacaatttttgctcgagtaggaattccacacgctgataaaatcgttctcgtaattattgttattgcaattttctcagcggttaactcagcaatttatgccacttcacgctcactctattcacgcattcaaggttcaaattcttatgtgggtcaaagattgggcaaattatctaaaaatcaagtcccaacgaatgcgattttagtttcatcatttgttttgtttattggtgtacttttgtcagcaattttgggtgatggattctggcaatttgtggctggttcgatttcatttacgatttcaatcgtttggattctccttttagttgctgctcttgttttatattttaaacataaagaagtaacgaattggtttgttaaattggcaacactcgttgtgcttatcgctttaacgattatcttcatcatgcaaattgtcactaatccatggactttgtcagtctttgctctagtgatttgcctcctttcttactttacttaccgaaagaaaaaagcataa

SEQ ID NO: 42182 - DNA, 966 bp, Lactococcus lactis
gtggtttactctgattcacacttaaagctttttgccttaaactcaaaccctggtcttgctgagaaaattagccagtttacaggagttcctctaggaaaactttcttcaaaacagttttccgacggtgaaattatgattaacatggaagaaagtgtccgtagtcaagacatctttattgttcaatcaacaagctgccctgttaacgatcacctttgggaattactaatcatgattgacgcatgtaaacgtgcttctgctcgtacaattaatgttgttatcccatactttggatatgctcgtcaagaccgtactgcgacttctcgtgaaccaatcacagctaaattagttgctgatatgattgttaaagctggagctgaccgcttattaaccctcgatattcacgctgtccaagtacaaggtttctttgatatccctgtagacaacttgtttactgtcccactttttgctgactactaccgtaagagtggattatttggtgatgacgtgattgttgttgcaccaaaaaattctgggattaaacgtgcacgctcacttgctgaatacttagagtcagcaattgccattgttgactatgaagatgatgacaaaaaccgtgaaaacggatatgttatcggtaatgtttcaggtaaaaaagttattcttatcgatgatattttgaacaccggggtcacttttgccaacgctgcaaatgttgtacgcgaagcaggagcaagtgaaatttatgcagttgccagccacggattatttactagcggagccgctgatgttcttgaaaaagtagatatcaaagaaattttggtcacagattctgttgtgacaaaccatcgcaaacctttaaatgtaaaatatttgagtgcagctgaatacttagccagtgctattcttcgtatccacgaaggacgtccagtttctccactttttgaacatgaaaaacctcaagattaa

SEQ ID NO: 42183 - DNA, 1188 bp, Lactococcus lactis
atggctaaagaagtatacgaccgtagcaaaccacacgttaatattggtactatcggacacgttgaccatggtaaaactaccctctcagctgcaatctctaaagtattgtctgacaaaggttactctaaagcgactgatttcgcatctatcgatgctgctccagaagaacgcgaacgtggtatcacaatcaacactgctcacatcgagtacgaaactgaaaaacgtcactatgcccacatcgacgctccaggtcacgcggactacgttaaaaatatgatcactggtgctgcccaaatggacggtgcaatcctcgttgttgctgcaactgatggaccaatgccacaaactcgtgaacacatcttgctttcacgtcaagttggtgttaaataccttatcgtcttccttaacaaggctgaccttgttgatgatgaagaattgatggaactcgttgaaatggaagttcgtgacctcttgagcgaatacgacttcccaggtgacgatattcctgtaatcgctggttcagcacttggtgctttgaacggtgaaccacaatgggttgctaaagttgaagaattgatggacatcgttgatgaatacatcccaactccagaacgcgacactgacaaaccactccttcttccagtcgaagacgtattctctatcactggtcgtggtacagttgcttcaggacgtatcgaacgtggtactgttaaagttggtgacgaagttgaaatcgttggtatcaaagaagaaactaaaaaagctgttgttactggtatcgaaatgttccgtaaaacacttactgaaggtcttgctggtgataacgtcggtgcacttctccgtggtattcaacgtgacgaaatcgaacgtggtcaagttattgctaaaccaggttcaatcactccacacaaacttttcgaaggtgaagtttacgtattgagcaaagaagaaggcggacgtcacactccattcttcgacaactaccgtcctcaattctacttccacacaactgacgttactggttcagttaaacttccagaaggaactgaaatggtaatgcctggtgacaacgtgcatatcgacgttgaattgatccacccagttgcgatcgaacaaggtactactttctctatccgtgaaggtggacgtactgttggttcaggtatcgttgctgaaatcaaagcttaa

SEQ ID NO: 42184 - DNA, 846 bp, Lactococcus lactis
atgcaaagaaaattaacattaaatgatggcaatgtcattccccaattcggtttgggactttatcagcttccagaaggaacagaaacgcaaaatattgtaaaaactgccttggaattaggttatcgtcatctggatacgtcacacgcttatcaaaatgaaacttctgtcggtcaagcaattcaagactcagaaatttcaaattctgaaatctggattacaagcaagctttggccttctgattatgagcaagcgccagaagcaattgagcgaatgctaaaacgcctaaaagttaaacaaattgatttactcttattgcatcaacaggttggaaattatcgaaaagcatggattgctttagaaaatgctgtaaaagagggaaaggtgaaatcaattggaatttcaaattttgatggagaaagattagttgatttatttaattttgctgatatcaaaccgagtgtcattcaagtagaaactcatccttatcatcaacaagtagaattacaggaatttttgaaaccttatggtacaaaaattgaaagttggtatcctctgggacatggcgataaaaacttacttgaagaaaaaatatttaaaaaaatggctaaaaaatataataaaacagtcgcacaaatcattttgcgttggcatattcaagagggaattattgtttttccacgctcaacgcaaaaagaacatttagcagaaaatataaatatttttgattttgaattatcctgctccgaaataaaagaaattcgtaaattaaataaaaaacaaccttattttacgatgacctatgaggagcaagaaaaaaactttttgtcatggaaactagaagactaa

SEQ ID NO: 42185 - DNA, 789 bp, Lactococcus lactis
atgaaaacaataggttttattggagttggaaaaatggcaacagctattatttctggacttgacaaaaataaattcaaaatcatcatttccggacacaatttaacaaaaactcaaaaacaagcggaaacccttaatgttacggctacaagtaatcatgaagaactcgttcaagaatctgattttatcattctatcagttaaacctcaagtacttccctctgttttaagtaaattaatcaatcatttaactaaagacaaaacattaatttcaattgcagcgggactcactttatctgacttgaaacatctggctgattcagaaaatcaaccaatcatccgagtgatgccaaatatcaatgcacaaatcggtcagtcaacatcggccattgtcaaaaatgaatttgttgatgattctgcttatgctacagttcaagaaatttttaaatcaactggttctgtccatgaaattgctgaaaaagatttttcaacatttgcagcaattgccggttcaagccctgcttttatttatatgttcattgatgccatggcacgtgccggtgtattgcatggtattcctaaagatcaagccacagcaattgttgccgaaacggttcgtgcttcagctgaaatgattctccaaagtggtgaaaatccttggtcattagtcgataaagtctcaagtcctggtggaactactgtcgctggtgtggtaagtttagaacaaaaccattttatcggaacagttattgatgctattagcgctactatcgaaaaagaaaaaaatctttaa

SEQ ID NO: 42186 - DNA, 1884 bp, Lactococcus lactis
atgattcaaatcggtaaaatctttgccgatcgttatcggattatcaaagaaatcggacgtggcggaatggcgaacgtttatcaaggtgaagatacttttcttggtgaccgcttagttgcaataaaagtgctacgttcaaattttgaaaacgatgatatcgcgattgctcgttttcagcgagaagcattcgccatggcagaactttcacatccaaatatcgtaggtatttctgatgttggtgaatttgaaagtcaacaatacattgtcatggaatttgttgacggcatgacacttaaacaatacatcaatcaaaatgcacctttagccaatgatgaagctattgaaattattactgaaattttatcagcaatggacatggcccattcacatggtattattcaccgggatttaaaaccacaaaatgttttagtttccagtagtggaactgtaaaagtaacggattttggaattgcgaaagcactctctgaaacttcacttactcaaacaaatacaatgtttggttcggttcattatttatcaccagagcaagcgcgtggttcaaatgcaactgttcaatcagatatttatgcgattggaattattttatttgagcttttaacaggtcaaattccatttgatggagattctgcagttgctatcgctctaaaacatttccaagagagtattccaagcatcattaatctcaatccagaagttccgcaagctttggaaaatgttgtcattaaagctacagcgaaagatattaaaaatcgctatactgatgtagaagaaatgatgactgatgtggcaacttcaacgagtcttgaccgtcgtggggaagaaaaattagttttcaataaggatcatgatgaaacaaaaattatgcctgccaatctaattaatccttatgacaccaagcctctgattgataaaaaagaagataatgattcacaaacagatgaaaaagctgcaagctcagaagtaggaaataaaaacaaaaaatctaaaaaaggcttgattattggtcttattatccttcttttagttgttggcggtgctactttggcttgggttgtctcaacaccaactaatgttaagatacctaatgtgacaaactcgacacttagccaagcaaaaagcaaaattaaagatgcaaaacttaaagtgggaacagttcataaacaacaaagttcaacgattgctgaaggaaaagttatcaagactgatccaactagtggaacaaccgtgagatctaatagctccgttgatatctatgtttctacgggaaatgaagatatcatcaaaatgaaggactttgtcggtgaaaagattgatgaggcgatggcaacattacttaaggattatggtattgatgaaagccaagtcactcaaacttccgttcctagtgattcttacccagcaggtacaatcattaaacaaagccctaaaaaaggttctagttttgataccaaagggagtgaaaaaattacctttgaagtttcaagtggaaaacaagttgaagttccggattataaaccgaacggtcaatatatgacttattcacagtatcaagctgccttaaaagctgcaggattcactaatattacactagaccctcaagcaacaacgaatcaacaagctgatggttatgtttactcagtctatccaaatgtagggacatctgttgatccaactcaagaaattgtagtcacttatagcgtctatactgctccaagttcaagttcaacaacttctgaatcaactacgacgtctgaaacttcatcaagtacaacttcaagtacttcaagctctacaacaagtcagccgtcaacagataacaacaatagcagcaaagaatcttcaacaacgtcatcaagtagttga

SEQ ID NO: 42187 - DNA, 1200 bp, Lactococcus lactis
atgtcagaaaaacatttatttacatcagaatcagtatcagaaggccatccagataaggttgcagaccaaatctcagatgccattcttgatgccattctcgcacaagacccacatgcacacgttgcttgtgaaacggtcgtatatacagggacggtcaatgtctttggtgaaatctcaacatcagcttatgttgatattgctcatgtcgttcgtgaaacaatcaaaaaaattggctatacagatagcgaaaatggatttgattataaatcagtgggcgttcacgtctcacttgttgagcaatcaagcgatattgcacaaggggtaaatgaagccgaagaagttcgcgataaaaatggccaattagttgacccgcttgatttgattggtgctggtgaccaaggaatgatgttcggttttgcgactaacgaaactgccgaatatatgccactcgccatctcactttcacataaattagttaaaaaattagctgatttacgtaaatcaggtgaaatttcatacttgcgtcctgatgcaaaatcacaagtaactgtagaatatgatgataatggcaaagcaaaacgcattgacacagtcgttatttctactcaacatgctgcgtcagcaagaaacgaagaaattcacgatgatgtgattaataaagtcatcaaggctgttattccagctgaacttttagatgatgaaactaaatacttcatcaatccaacaggacgttttgttattggtggtcctcaaggggattcaggcttgactggacgtaaaattattgttgatacttatggtgggtatgctccccacggtggtggagctttctctggtaaggatgcaacaaaagttgaccgttcagcttcttacgcagcacgttatgtagccaaaaatattgtggcagctggacttgcagaaaaagcgcaaattcaactttcatacgctattggtgttgcgacaccaacgtcaatcaatgttgatacttttggcacaggtaaagtctcagatgatgaacttttagcagcaattcgtaaagtatttgatcttcgcccagcaggaattattcaaatgcttgacttactccgtcctatttacggacaaacagcagcttacgggcatttcggccgtacagatgtagaattaccatgggaacaaacagataaggttgaagaacttaaatccgttttaggtaaataa

SEQ ID NO: 42188 - DNA, 897 bp, Lactococcus lactis
atggcaatcgtttcagcagaaaaattcgtacaagccgctcgtgataacggatacgctatcggtggtttcaacacaaacaaccttgaatggactcaagctatcttgcgtgcagcagaagctaaaaagactccagtattgatccaaacttctatgggtgcggctaaatacatgggtggttacaaaatgtgtaaactcctcattgaaactcttgtagaatcaatgggaatcacagttccagttgctattcaccttgaccacggtcattttgatgatgctttggaatgtatcgaagttggttactcatcattgatgtttgatggttcacatcttccaatcgaagaaaaccttaaacttgctgaagaagtaatcgctaaagctcatgctaaaggcatctcagttgaatgtgaagttggttcaattggtggtgaagaagacggtatcgttggtgaaggtgaacttgctcctatcgatgatgcagttgcaatggctaaacttggtgttgacttccttgcagcaggtatcggtaacattcacggtccttacccagaaaactggaaaggtcttcacatcgatcaccttgaaaaattgaacaaagcacttgttgaagctatgggacacaatgtgccaatcgtacttcacggtggttctggtatccctgatgatcaaatcagagaagctatcgctaatggtgtagctaaagttaacgttaatactgaatgccaacttgctttcgcagctgctactcgtaaattcgttaatgaatttgatgctaatgaagcagaatacatgaagaaaaaacttttcgacccacgtaaattcttgaaacctggtttcgatgcaattactgcgtctgttgaagaacgtatcgatgtattcggttcagctaacaaagcttaa

SEQ ID NO: 42189 - DNA, 1089 bp, Lactococcus lactis
atggataaaagattagatactttattggcgcaagtcggaattcatcaagatgaggcaacgggagctttagttagtcctttgcatttttcaacgacctatcaacatccagaatttggccaatcgactggctttgattacaccagaaccaaaaatccaacaagagcaaccttggaagaagcacttgcttcaattgaatcaggacaatttgctctagcaacttcgtcaggaatggctgcaattgtcttggccttttcagttttcccaatcggttcaaaaattgttgccagtcgagatttgtatggaggttcatttcgctggttcgatgaacaagaaaaagagggacgattttacttttcctatgctaaaactgaaaaagaaatgcttgagctaatagatgaaaatactgatattgtttatattgaaacaccgacaaatccaatgatggttaaatataatattgaaaaaatcgccaataaagcacaggcatatcatgcaaaagtgattgttgtcaatactttttataccccaatttatcaaaaaccattagaattgggtgcggatttagtgattcattcggcaacaaaatatttatcaggacataatgacgtcttggctggagcggtcattgtttatgatgaagaactttatgaaagattattatatcagctcaatactactggagcagttctttctccatttgacagttatcttgtcatgcgaggtttgaaaactttaagcctcagaatggagagggcaactaaaaatgcccaaaaaattgtgactttcctaaaaaaacttccatcagtaaaagaagtactttactcaggattaggtggcatgatttctctaaaagttactgacaaaaccaaaattcctgctattttaaatcacttgggcgtttttacctttgctgaaagcttgggaggtgttgaatctttaatcacttatccaacagcgcaaactcaccatgatattccacttgagattagagaaagttatggtttaacagatgatttgcttcgcctttcgattgggatagaagatgttcgcgatttaatagaagatctcaaagaagctttagaaaattaa

SEQ ID NO: 42190 - DNA, 1479 bp, Lactococcus lactis
atgatttcagtgaaaaaacgtagagaaattaaggtttttttggtaacagcatctataggaattgttgtgttaggagggcaacaagtcttagcagatgcagctagtgaaatggtcaatccaaaagataaagtgcttgtaggttattggcacaattggaaatcaacaggaaaagatggttataaaggaggaagttctgctgacttcaatctttcaagtacacaagaaggctacaatgtaattaatgtttcctttatgaaaacacctgaaggacaaacccttcccactttcaagccttataacaaaaccgatactgaattcagagccgaaatttcaaaattaaatgccgaaggtaagagcgtcttaatcgctttaggaggagctgacgctcatattgaattaaagaaaagtcaggaaagtgattttgttaatgaaatcattcgtcttatagatacttacggctttgatggattagatattgatttagaacaggctgcaattgaagcagcagataatcaaactgttatcccatccgctttaaaaaaagttaaagaccattatcgaaaagatggtaaaaactttatgattacgatggctccagaatttccttatttaacaagttcaggaaaatatgcaccatatatcaacaatttagattcgtactatgatttcatcaatcctcaatactataatcaaggaggagatggtttctgggatagtgatttaaatatgtggatttctcaatcaaatgacgaaaaaaaagaagattttctctatggtttaactcaacgtctcgtaacaggatcagatgggtttattaaaatcccagccagtaaattcgttattggtctaccatctaataatgacgctgctgcaacaggttatgtgaaagaccccaatgccgtaaaaaatgcattgaatcgcttaaaagcttctggtaatgaaataaaaggtttaatgacttggtcagtaaattgggatgctggaaccaattcaaatggcgaaaaatataataatacttttgtaaatacatacgccccaatgctctttaacaatcaaccgattgaagatactgaaaaaccaaccttgcccacaatttcaattagtaatgtgactgcttctactgccacgattcaaggaaaatctacagacaatgttcgcattgatcactatgaaattaagattggtactcaatcatttaaaagtacttccggcttacaagatgtgactggattatccaaaaaaactgaatacaatgttgaaattgtagcagttgacccttcaggtaatcgttctgatacggccagagctacatttatgacactggacacatcagcggaaaataatacttggcaaaaggataaagtttatgttcaaggtgatcgtgttacttttaatggagtaaattatgaagcaaaatggtggaatactggccaactacctgaccaatcaggagattttggtccatggaaaaagctataa

SEQ ID NO: 42191 - DNA, 1293 bp, Lactococcus lactis
atgccatcagtagtagttgtcggaacgcaatggggagacgaaggaaaaggtaaaattacagatttcctaagctcaaatgcagaagttattgcccgttatcaagggggagacaatgcaggtcataccatcgtcatcgacggcaaaaagttcaaacttcaccttattccatcaggaattttcttccctgaaaagatttccgttattgggaatggtgtcgttgttaacccaaaatcactgattgaagaaatcgcttatctcgctgaaaatggagtttctgcagagagcttacgtatttcagaccgtgcacatgttatcttgccttaccataaaaaattagacttccttcaagaagaagccaaaggcgataagaagattgggacaaccattaaagggattggcccagcctatatggataaagcagcccgtgtcggaattcgtgttgcagacttacttgacaaagaaatcttcgaggaacgtttacgtacaaaccttgaagctaaaaaccgtgaatttgtaaaaatgtatgattcagaaccaatcgaatttgaagaaatttttgaagaatactatgaatacggtcaacaacttaaaaaatatgtgacagatacttcagttatcttgaatgatgcccttgatgcaggaaaacgtgtcctttttgaaggtgcgcaaggggtaatgcttgatattgaccaaggaacatatccatttgtaacttcatcaaacccagtagctggtggggtaacgattggctctggtgtgggtccatcaaaaatttcaaaagttgttggtgtttgtaaagcctatacttcacgtgtgggtgatggtccattcccaacagaactttttgatgaagttggacatcaaattcgtgaagtaggacatgaatatggaacaacaacaggacgtccacgtcgtgttggttggtttgactcagtcgtaatgcgtcatgcaaaacgtgtttctggcttgacaaatcttagcttgaattcaattgacgttctctcaggacttgaaacagtaaaaatttgtgttgcttacgaacgtagtaatggtgaacaaattactcattatccagcatcacttaaggaattagcagattgcaaaccaatctatgaagaattgccaggatggtctgaagatattacttcatgccgaactttagaagagttaccagaagctgctcgtaactatgttcgtcgtgttggtgaactagttggcgtacgtatctcgactttctcagtaggtcctggtcgtgaacaaactaatgttttagaatcagtttggggcgtataa

SEQ ID NO: 42192 - DNA, 2991 bp, Lactococcus lactis
atgatgacaatgattgatgtactagagcgtaaagattgggaaaatccagtagtttcaaattggaataggttgccaatgcatacacctatggacttgttagaaaagcaatcactgaatggtctttggaattttgatcatttttctagaatttcagatgtacctaaaaattggttagaactgacggagagtaaaacggaaattatcgttccaagtaattggcaaatagaatttaaggataaaagcgatgttccaatttatacaaatgtgacttatcctattccaattcagcctccttatgtaccagaggctaacccagttggagcttatagtcgctattttgatatcacaaaagaatggcttgagagcggtcatgttcaccttacatttgaaggggttggatcagcttttcatttttggttgaatggggaatacggaggttattcagaagatagccgcttgcctgctgaattcgatatcagcaacctggccaaagaaggtcaaaattgtttaaaagttctagtttttcgttggtcaaaagtcacctattttgaagatcaagatatgtggcgaatgtcaggtatttttcgttcggtgaacttacaatggcttccagataactacttgttagacttttctataaaaacagatttggatgaggatttagattttgcaaatgtaaaacttcaagcatatgctaaaaacatcgatgatgcttgtttagaatttaagctttatgatgacgaacaattaattggagagtgtcatggttttgatgcagaaattggagtagtcaatccaaaattatggtcagatgaaattccctatctttatcgtttagaattaactttaatggaccggagtggggcggtatttcataaagaaacaaaaaaaattggtattcgaaaaattgctattgaaaaaggacagctaaaaataaacgggaaagcacttcttgttcgtggagtgaataagcacgaatttacccctgagcatggttatgtcgtttctgaagaagtgatgattaaagacatcaaattgatgaaagaacataattttaatgcggtccgctgctctcattatcctaatgattcacgctggtatgaattgtgtgatgaatatggattgtatgttatggatgaagcaaatatcgaaacgcatggaatgactccgatgaatcgtttgacaaatgatccgacttatttaccattaatgagtgaacgtgttacacgaatggttatgcgtgaccgtaatcatccatcaattattatttggtctcttgggaatgagtcaggttatggaagtaaccatcaagctttatatgattggtgtaaatcatttgattctagccgccctgttcattatgaggggggagatgacgcaagtagaggagcaacagatgccactgatatcatttgtccgatgtatgctagagtagatagtccaagtattaatgcgccttattcattaaaaacctggatgggggtagctggagagaatagaccactaattctttgtgaatatgctcatgatatggggaattcattaggaggatttgggaagtactggcaagcttttcgagaaattgaccgattgcaaggtggattcatctgggattgggtggatcaaggtttattaaaagatggaaattatgcttatggaggtgactttggggacaagccaaatgatcgtcagtttagccttaatggtcttgtttttccaaatcgtcaagcaaaaccagctcttcgtgaagcaaaatattggcaacaatattatcagtttgaattggagaaaactccactaggtcaagtttttgcctttacagttacaaatgagtatctatttcgaagtactgacaatgaaaaattatgttaccaactgatcaatggcttagaagtattatgggaaaatgagcttatattgaatatgcctgctggagggtctatgagaatagacctgtctgagttgcctattgatggaacagataatttatttttgaacattcaagttaaaacaattgagaaatgtaatcttcttgagtctgattttgaagttgctcatcaacaatttgttctacaagaaaaaattaattttactgacagaatagatagtaatgaagaaattacactttttgaggatgaagagctactgaccgtacgatcagcaaaacagaaatttatttttaataaaagcaatggtaatctctcgcgctggcttgatgagaaaggcaatgaaaagttactgcatgagctctcagaacaatttacaagggctccattagataatgatattggtgttagtgaagttgaacatattgatcctaatgcttggttagaacgttggaagggtattggcttttatgagttaaaaacgcttttgaaaactatgataatacaagcaacagagaatgaagtaattatttctgtccaaacagactatgaagcaaaaggaaaaattgcattttcaaccattcgagaatatcatatttttagaaacggtgaacttcttttaaaagttgattttaaaagaaatatagagtttccagaaccagctcgaattggcttgagtcttcaactagctgaaaaagcagaaaatgttacatattttggacttggcccagatgaaaattatcctgaccgaagaggggcaagtttatttggccagtggaatttaaggattactgatatgacaaccccttatatttttcctagtgaaaatgggttgaggatggaaaccagagagttaaattatgatcgtttaaaagttcgggcaatgggtcaatcttttgcttttaatctaagtccgtatagtcaaaaccagcttgctaaaaagggacattggcatctacttgaagaagaagcaggaacatggttaaatattgacggattccatatgggtgtaggtggagatgattcatggagtccaagtgtcgctcaggaatatttattgacaaagggaaattatcattatgaagttagttttaaattaacgtga

SEQ ID NO: 42193 - DNA, 1200 bp, Lactococcus lactis
atgtctatagttgtagaaaatagtactgtattatcagcattaacagaaaaatttgcagaagtttttggagatacaaaagaagttgaatacttttttagcccaggacgaattaatttgattggtgaacataccgattacaatgggggatatgttttcccagcatcaattacaattggaacaacaggactagctcgtctgagagaagataaaaaagtcaaactttactcagaaaattttcctaaattaggcgtcattgaatttgatttagatgaagttgaaaagaaagatggtgagctttggtctaattatgttaaaggaatgattgtcatgcttaaaggagcaggatatgaaattgacaaaggttttgaattgttgataaaaggagaaattcctacagcatctggcctttcatcatcagcatcacttgagcttttagtcggcgttgttttggatgatttatttaacttaaatgttccacgtcttgaattggttcaattaggacaaaaaacagaaaatgattatattggtgttaattctggaattttagaccaattcgctattggttttggtgaagtcaaaaaagcaatcctattggactgtaacactctaaaatatgagatggttcctgttgaacttcgtgattatgatattgttatcatgaatactaacaaaccgcgggctttgacagaatcaaaatacaacgaacgttttgctgaaacacgtgaggcgctcaaaagaatgcaaacgagattggacattcaatcacttggagaattatcaaatgaagaatttgatgccaatactgatttgattggggatgaaacattaattaaacgtgcacgtcatgccgtttatgaaaataatcgaactaaaattgctcaaaaagcatttgttgcaggtaatttgacaaaatttggagaacttcttaatgcttcacatgcttctttgaaagatgattatgaagtcacaggacttgaacttgataccttagcagagactgctcaaaaacaagccggtgtcttgggggccagaatgactggagccggatttggcggttgtgcaatcgctcttgttgctcatgacaatgtttcagcctttgaaaaagccgtcggccaagtttacgaagaagttgtcggttatccagcaagcttttacgtcgctcaaattggttctggttcaacaaagttggatgttgaataa

SEQ ID NO: 42194 - DNA, 771 bp, Lactococcus lactis
atgttaaaagtaacaaatctaacaggtggctatttggggcatcctgtcttaaaagaccttaattttgaaattaaagaaggagagttagttggactcattggtttaaatggtgcaggaaaatcgacgacaattcaagaaattattggacttttgactccttattctggacaaattgaattagacggcttaactttacaacaagatttagaaggctatcgtagaaaaattggtttcattccagaaacaccaagtttgtatgaagaattgactttgcgtgaacatattgaagtgacagctttagcttacgggatttctgttgacttggcttttgaacgtgctgaaaaattattagaaactttccgcttgagtgataaattagattggttccctgtgaatttttcaaaagggatgaaacaaaaagtgatgattatctgcgcattcttagtggaaccttcgctctatattgttgatgaaccttttatgggacttgatccgcttgcgattcaggatttgattgacttgatgattgacatgaaaaaatcaggaagttcgattttaatgagtacacatatcttgtccacagctgaaaaattctgtgataaatttattgttttgcatgaaggtcaagttgttgcttttggaacagtagaagaattacggactcaatttaatcagcctaaggcaagtttagatgaaatttatcttgccttaacaaaaggaaatattccaaactctaaagaagttgtagaggcaggaaagtcaaatgaatga

SEQ ID NO: 42195 - DNA, 1131 bp, Lactococcus lactis
atggaacttgtacaatttggttgtgaagactggctcaatgtttgggaaaaatctgcaacgattgatattgctcagtcaaccattgattcgttatctttggaagaagttttggcctttgaagaagataatggcgaagcttttatgtcacagatgatgaaagaaaaattcagttatggttggattgagggttcaccagcctttaaatcagaagtggcaaaactttataaaagagtgccagaggataatattttatctacaaatggagctaccggagcaaatttccttacaattttaggattaattggtcaaggcgatcatgtgattgctcaatatccttcttatcaacaactgtatgattggcctaaaacattaggtgcccaagttgattattggcatattaaagaagaaaataattggttgccacaaattgaagaattacgtcgtttagttaaaagtaatacaaaacttatttgtttaaacaatgcggcccaacccactggagcaatcatgagtcctaaatttttgtcagaagtggttgaaattgcacgcagtgttgatgcttatattctttgtgatgaagtttatcttccactagatgaagaaacgccttattcacctattgctgatttatacgaaaaaggaatatcaactaactctatttctaaaacttactctgtaccaggaattcgtgtgggttgggtagccactcaagaccgtgacctttgtaatgaatttagaaaaatccgggattataccttgatttgtaccggggtatttgatgacgccgtagcggctttagtattgaaacataaagataaagtacttgaacgcgctcgtaaaattgtcaaaggtaatttatcaattttgaaagaatgggtggaaaatgaacctttagtctcaatggtttatcccaatgcagtctctgtaagttttgttaaatttgaagaacttgatccgacaaaaactgaagattttgcaatccaacttcttcgtgaaaaaggtgtcctaattattcctggaaatcgttttgatttatcaggctatgctaggattgggtattgtacagatgaaacaaccttacgtcaaggccttaaactcttatctgaatttttgagagaatatcaggtttga

SEQ ID NO: 42196 - DNA, 945 bp, Lactococcus lactis
atggtaaaacgtattgttgtagcccttggtgggaatgctattctgtcgaaagacccatcagcgaaggctcaaaaagaagcacttgaagttacagctgaacaattgatgccattaattaaagataatgaccggcaaatggttgtgactcatggaaatggaccacaggttggaaacttacttttacaacaactaggttcagatagtgaaaaaaatccagctatgccattggatacagttggagcaatgacccaaggtgagattggtttttggaccgttcaagcatttacaagagcaatggcaaataatggcttggagcattatccagttatttcagcagtgactcaaacattggttgatgaaaatgatccagcttttaaaaatgctagtaaaccaattggtcctttttacacagaagaacaattgccagaaattaagaagcaatttcctgattgggaattaatggaagacgctggtcgcggatatcgccgagtagttccaagtcctaaaccacttgaaattattgaagccaaagcttttggaccaatcttagaatctggtagtctattgattgcttctggcggtggtggaattcccgtcattaaagatggtaagggttatcaaggtgttgaagccgtaattgataaagatttctctgcagctaaactggctgagatggttggagcagacgagcttttgattttaacaagcggtggtgacgtatatttgaactatgggaaagaaaaccaagttcatttggaaacagtcaaagtttctgaaatgcgcaaatatgttgacgaagaacgctttgcaaaaggttcaatgggaccaaaagtcgaagcagctgtcagttttgttgaacgaacaggtaagactgctacaattactagccttgacaatgttgaaaattttgtcaaatctggtagtggaacaagaattgttccttaa

SEQ ID NO: 42197 - DNA, 1065 bp, Lactococcus lactis
atgacatcaccacttattacaaaagcagaagtaaactcagtattccaaggtcgcagcttacttgctgaaaaagatttcacaccagctgaaattaactaccttgttgattttggtcttcatttgaaagcattgaaacaacaaaacattcctcaccactaccttgaaggtaaaaatattgccttgctctttgcaaaaacttcaactcgtacacgtgctgcctttacaactgctgcaattgaccttggtgctcatccagaataccttggagctaacgatattcaattgggaattaaagaatcaacagaagatacagctcgcgtgcttggttcaatgtttgatgctatcgaacgtcgtggattttctcaaaaagaagttgaagatttggcaaaatactctggtgttccagtttggaatggtttgacagatgattggcatccaacacaaatgattgcagactttatgactgttaaagaaaactttggacatcttaaaggtttgacattagtctacgtaggtgatggtcgtaacaacatggcaaactcacttatcgtaactggttctatgcttggtgtgaatgttcatattgttgctccagattcacttcatcctactaaagaagttatggatattgcaaataaatttgctgaaaaatcaggtgctaaacctcttgcaacttcaaatattgaagaaggtgttaaaggcgcaaacattatttactcagacgtttgggtatcaatgggagaatctaactgggaagaacgtgttaaacttttgactccataccgtatcacaatggatatgcttaaaatgactggaaatgctgacaatggtcaattgatctttatgcactgcttaccagcattccatgatactgaaactgaatatggtaaagaaatcaaagaaaaatatggtttgacagaaatggaagtgactgacgaagtattccgttctaaatatgctcgccaatttgaagaagcagaaaatcgtatgcactctatcaaagcaatcatggctgcaactttgggtaatttatttatcccagcagttcctgaagattttaaataa

SEQ ID NO: 42198 - DNA, 1233 bp, Lactococcus lactis
atgaacaatggaattaatgttaactcagaaattgggaaattaaaatcagtcctcctccaccgcccaggtgcggaagttgaaaatattaccccagacacaatgaaacaacttttatttgatgatattccatatctcaaaattgctcaaaaagagcatgatttctttgctcaaactttgcgtgataatggtgcagaaactgtttatatcgaaaatcttgcaacagaagtttttgaaaaatcatctgaaacaaaagaagaattcttaagtcacttattacacgaagcgggttaccgtccaggacgcacatatgatggtttgactgaatatttgacttcaatgtcaacaaaagatatggtcgaaaaaatctatgctggtgttcgtaaaaatgaattggatatcaaacgtacagcacttagcgatatggcaggatctgatgcagaaaattatttctacctcaacccattaccaaatgcctacttcacacgtgacccacaagcttcaatgggtgtcggaatgaccattaataaaatgaccttcccagctcgtcaacctgaaagcttgattacagagtatgttatggctaatcacccacgtttcaaagatactccaatctggcgtgatcgtaaccataccactcgtatcgaaggtggtgatgaattaattcttaacaaaacaacagtagctatcggggtttcagaacgtacttcatctaaaacaattcaaaatcttgctaaagagttatttgcaaacccactttcaacatttgacactgtacttgcggttgaaattcctcataaccatgcaatgatgcatttggatacagtatttacaatgattaaccatgatcaatttactgtcttcccaggaattatggatggtgctggtaatatcaatgtcttcattcttcgccctggtaaagatgacgaagttgaaattgaacatttgactgaccttaaagcagcactcaagaaagtcttgaatctttcagaacttgacttaattgaatgtggtgcaggtgatccaattgccgctcctcgcgaacaatggaatgatggatcaaatacacttgctatcgcacccggtgaaatcgttacttacgaccgtaactatgtaactgttgagttattgaaagagcatggaatcaaagttcatgaaattctttcaagcgaacttggtcgtggccgtggtggtgcccgttgtatgtcacaaccactttggcgtgaagatttgtaa

SEQ ID NO: 42199 - DNA, 1704 bp, Lactococcus lactis
atgacaaaaataaatgcatcagatgcaatgttaaaagttattgaagattggggtgtcaaaaatatttacggtttacccggtgggtcaattgattcgacaatgaacgcattatataaccgaagagacacattaaattacattcaagttcgtcacgaagaagtgggtgctttagcagccgttggggaagcaaaagtaaccggagaaatcggagtaacctttggttcagcaggaccaggagccgttcacttgttaaatggattatatgatgctcaatatgaccatgttccagtacttgccttggttggtcaagttccaacgagtgcaatgaatactaattatttccaagaattaaatgaaaatccaatgtttgctgacgttagtgtctataacagaacagtaatgaccgcagaacaaatgccagcagtagttgatgaagcgattcgtcaagcctatgccaaacgtggtgttgccgtcattaccattcccaaagatttaggttggcaagaaattgaagataattatgtctctagcgctaatctatatcaaaaacctttgccactagaacctgcggctgaaaaaatccaagaagcatggaaaatactaaaagaagcaaaacgccctttgatttatattggtcaaggaacaagaggagcccgcaaggaaatcttagaactttctaaaatgcttcatgctccaattttgagttctgccttaggaaaaggaattattcctgacaatgcccctgcttacatggggtcagctggtcgagtggcctctaaacctggggtagaaattgcttctaacacagatgctgttttgttcttaggttcagacatgccattccaaagtttctttattcctaaagatgctaaatacgtacaagttgatattgacggaactaaatttggacgtcgtcatcaagtagatttagctattttggcagatgccaaactgacaattaagaaattaatggaagtgggagaacaacttccagaaacaaattggtatcgcgcagcactagcagacaaagaaaattgggtagagtggcttgaaaaacgttcagtcattgacagctcacctttggaagtagaacctgtctttaaagccattaatgacatggccactgatgacgccattttccaagttgatgtaggaaatgtcacaattgatggaatgagacttctcgatacaagtaaggatcaaaaattcacaacaagtggctggtatgcgacaatgggttatgctctacctgcagcaattggtgcgaaagcgcaatatccagaccgtcaagtttggtcaatttctggtgacggagcttgggcaatggtgatgcctgatattcttactcaggtcaaatataacttaccaattatcaatgttgttttgaccaataagagccttggatttatcgaagcagaacaagatgatgccaaacaaccaaactcaggaattgatttgataggtgctaattttggcgcttctgcagcggctttgggagctttaggttttgatgttaataatttgtcagaattaaatgaagcttttgcaaaagctaaagaagcgaatcgtccaatggtcatcaatgtcaacatctttgaccatcgtccattacctgttgaacaattgcaacttgattctgctgaatttgaaaaagaatatcaaactcaaggattgattccatttagcaaattgattcaagaataa

SEQ ID NO: 42200 - DNA, 1134 bp, Lactococcus lactis
atgaacttttcagaagcaatggctactaaatacaaggttcgtgaaattttacacaatggagcctatcacggggcagctgacgaaccattggtttatgttatggatggaattgcgcgttttattaatcaagaaacccttgaggtcgttaatggtgacaagataagcaaagtgattggagaacgcattttcatcaatacgggagcaactccagtgattcccgaaatttcaggaattcaagaatccaaaaatgtaattacatctgaaggagcgatggaactttctgaacttccaaagaaattagttatcatcggcgcgggctatattggtttagaatttgccggaatgtttaataaatttgggtctaaggtcacaattttagaacctcattcaacatttttacccaaagaagacgatgatatttcaagggaaatttttaaagatttaaaggcttcaggagttgaaattcatcttggggttaaagttgaaaaaattactgacagcgaagttttggcaggaggtcagacctattcagctgacaagatattagtggcaacaggtcgcaggcctaatattactgacttaaatttggaaaaagctggtgttgaactttcagaaagtggttatattaaagttgatgatgatttaaaaacaagtacagaaaatatctgggcacttggtgacgttcggggaggtggacaattctactatctgtcaacagatgattttcggattgtcaataatcaattgtttggtgatcactcgcgtaaattaagtgacagaacactcgtgccctattctgtttttattagtccaacattatctcgaattggcttggatgaaaaacaagcgaaaaaagctggggttaattatcatttatttaagatggctgcggcaccaattgttaagtctaaagttgttcaagatactcgcggaattcttaaagctcttgttgacccaaaaacagatgaaattctcggtgcaactttatatcatgaagattctcatgaggtcatcaatcttgtaagtttggctatgaaaatgcatacgccctatcaaattttacgcgaccaaattttcactcatccaacaatgggcgaaggtctgaatgatttatttcaaaatgaagtgaaataa

SEQ ID NO: 42201 - DNA, 1452 bp, Lactococcus lactis
atgaataaaaaaatccgcgtccgttacgcaccatcaccaacaggacttttgcatatcgggaatgctcgtacagccctttttaactatctttttgcccgtcatcacgggggagattttatcatccgtattgaagatacagaccgtgaacgtcacgtagaagatggtgagcgttcacaacttgaaaaccttcgttggttgggaatggattgggatgaaagtcctgaaacacatgaaaactaccgtcaatcagaacgtttgcctttatatcaaaaatatattgaccaattgttgactgaaggaaaagcttattattcttataaaacgccagaagaacttgaagctgaccatgcgaaacaagaagcggcaggaattgctccacactatattaacgaatatgctggcatgagtgatgatgaaaaagcagcttatatcgcggagcgtaaagcgcaaaatattgaaccggttgttcgtatttctgttgatgaaaaagcaatttataaatggaatgatattgttaaaggcgacattgaatttgaaggtaaaaacatcggtggagattgggtaatccaaaaacgtgatggttacccaacttacaattttgctgttgttgttgatgaccatgatatgcaaatctcacatgttatccgtggcgatgaccatattgccaatacaccaaaacaattagttgtttacgatgctttgggttgggaagcaccacaatttggtcacatgactttgattattaattctgaaactgggaaaaaattatcaaaacgtgacacaaatacacttcagtttattgaagactaccgtaaaaaaggttacatgtctgatgccattttcaactttattgcacttttgggctggaatcctggtggagaaaaagaaattttctctcgtgaagaattaattgaactttttgatgaacatcgtttgtctaaatcaccagcagcctttgaccaaaagaaattggactggttggataatgaatacatcaaaaatgctgattttgctaaagtatttgaattgacaaaaccattccttgttgctgctaatcgctttgatgaacgtgctgaggaactggttaaactttatcaaccacaaatgaaatcagcagatgaaattgttgaattaacagaccttttctatggagatttcccagaattgactgatgaagctcgtgaaatgttggctgctgaaacaacaccattagctttgagtactttccgtgcaaaattggctgagcttcctgaaaatgattttacagtggaaaatattttcccactctttaaagcgactcaaaaagaaactggcgtaaaaggtaaaatgctttggatgccaattcgtattgcagcttcaggttcaatgcatggtccagaattaccagaaacaattgcacttcttggaaaagaaaaagtattggctcatttggacgctgctttaaataaataa

SEQ ID NO: 42202 - DNA, 831 bp, Lactococcus lactis
gtgggaattaaagtttacaaacctaccacaaacggtcgccgtaacatgactggtagcgacttcgctgaaatcactacaagtactcctgaaaagagcttgcttgtaagcatgagcaaaacagctggtcgtaataacactggtcgtatcacagttcgtcaccacggtggtggtcacaaacgtaaatatcgtgtaatcgacttcaaacgtacaactgacaacgttgttgctaaagttgctacaattgaatacgatccaaaccgtactgcaaacatcgcattgatcgtttactctaacggtgttaaatcatacatcttggctcctaaaggccttgaagttggaatgacagttgtatctggacctgaagccgacatcaaagttggtaacgcattgccacttgctaacattccagttggtacattgatccacaacattgaattgaaacctggtaaaggcggacaattggttcgttcagctggtgcttcagctcaagtactcggttcagaaggtaaatatacactcgttcgtcttcaatcaggcgaagttcgtatgattctttcaacttgccgtgctacaatcggtgttgtaggtaatgaacaacaaagcttaatcaaccttggtaaagcaggacgtacacgtcacatgggtatccgcccaacagtacgtggttctgtaatgaaccctaacgatcacccacacggtggtggtgaaggtcgtcaaccagttggtcgcaagtctccaatgactccatggggtaaaccagctcttggtctcaagactcgcaacaagaaagcaaaatcaagcaaacttatcgttcgtcgtatcaacgactaa

SEQ ID NO: 42203 - DNA, 1341 bp, Lactococcus lactis
atgagagttggactttttacagatagttactttccacaaatcagtggagtagcaacaagtattcgcactttggccctagagcttgaaaaattagggcatgaggttttcatttttacaacaacagatccaaatgctgatgtggaccacgaacgaaatattattcggctgcaatccattccttttgtgagcttagcagaacgtaaaattgtcctcaaaggtgtttttgctgcttatttaattgctaaagaatatgatttagatatcatccatacgcaaactgaatttggaatgggaattttaggtaaaatggttgctgctcaattacgcatccctgtcattcataccttacatactaagtatgaagattatgtttactacatcgccaaaggacgcttaatccgtccaagtatggttaaatacattattcgtaatttcctgcgtggaactgaagcgattatttgtccaagcgaaatggttttggaaactgtcaatagttacggtgtcactcttcctaaacgtgtcattccaacaggaattgaaattgaccgttttaaacgtgatgacattgaacctgaagaaacagcaaaattaagagtcgagcttggtcttgcagaaaatgaaatcatgttgctcagtctctcacggattgcggctgaaaaaaatatccaagcagtgattcatgcattaccagatattttagaagagtttcccgtgaaacttgtaatcgttggtcatggtccatatgccgaaaatctaaaagaattagttaaagaacttgaacttactgataaagttgtcttcacaggcccagttgaaaatgagaaaacagcctattattataaagctgctgacttcttcatttctgcttctacttcagaaacccaaggcttgacttatcttgaagcaatggcagcagggaccagagtcctagctgctaaaaatccttatttgtctgaattaattaatgacgatgaattcggacaactcttcattggtgatgatgatttagctgaagttaccaaaaaggcaattcgtgatttacatcccattgataaagataaatttgaaaagaaactttatgaaatttcagcggaaaattttgctaaaaaagtttatctcttctatattgacaccattattgaatacaataaccttaagtctattgaggcggaacgttttccaatgaaaatggaagataccattcgtcaaatgccagttactgttaaacgttcacttaaaagagaacaaattcgagcaaaatattttgccagaaaagccagtaaacttgccaaaaatctacaaagttatgttaaaatagataaggacaaagaacaggactaa

SEQ ID NO: 42204 - DNA, 1560 bp, Lactococcus lactis
atgcaatatttaataggcgtcgatttaggaaccacagcaactaaggcagtgctttttgagaaaaatggaaaaatagttgcaagtagtagccaagcctatcccctctatcgtgatgctagtgggatggcagaagaatctcttgaagaaatttttgaagcagttttagtgacaatcagggaagtttcaattaatttagaagatgaagatgaacttttagccgtttcatttagtacacaaatgcactcgctaattgcttttgacgaaaattggcagccacttacaagattaatcacttgggctgatacaagagcagtaaaatacaccgaacaaattaaggcctctaaaaatggttttgatatttatcgaagaaccgaaacgcctcttcatccaatggctcctttatctaaatttatctggttagaagctgaacatccagatatttatcaaaaagcagcccactatttggaacttaaaggatacattttccaaagactttttggaacaaataaaatggatttatcaaccgcaacaggtacaggtatcttcaatatatttgaacttcattgggataaagaagcgctagagttgactggaatcaaagaaagtcaattgcctaaagtagttgaaccctatgagatagaagaaaaccttcctcacgaatatgccaagaaaatgggaattcaaagcagcaccaaatttatttggggtgcagccgatggtccgttgtcaaatttgggagtaaatgcgattaaaccgggtgttgcagccatcacaattggaacatctggtgcgattcgagtagttactgacaaacctaaaacagatgaaaaaggacgcacatttacctatgcattagacaaagagcattgggtagtcggtggtcccgtaaactctggtggagatgttttccgttgggctcgtgaccaaatttttgatggaaaaatttcttttgatgaagtcacggaacttgcagcaaacatttccccgggcgctgatggattgcttttccacccctatcttggaggcgagcgagcaccgatttgggatgccaatgccagaggttcattttttggcctaaactacggacataatcgtagtcatatggccagatctgttcttgaaggggttatcttcaatatttatatggttgcgcttagccttgttgaagtagtaggtgacctaaatatgattcaagcgacaggaggatttacaagctctgaactctggacacaaattctagcagatatttttgaacaaccaatcaatgtgccagagagccgagaagctggctgtttagctgccattattatggctgaaaaagcccttggcttaattgaagatatcagcgaaatcgaaacgatggtaggaacaaacgaaacctaccaacccaatccaaaaaatttcgaaatttaccgagaaattagtccaatatttatccgactttctcgctctctcttggcagaatatgaaaatattgccaatttccaaagaaaatttgaagaagaaaacgcaaattgtaaaatgaagttagccaccttgagtcaagcaaaaaacatctga

SEQ ID NO: 42205 - DNA, 909 bp, Lactococcus lactis
atgatgaaatttggtatgattggtttagggaaaatgggaatgaatcttgtgaaaaatgccgttgaccatgagattgaagttgttgcttacgatctaaatacaaaagcggtagaggaagctaaggattactcagacaaaattaccgctgtcagcacaattgaaaatttactgacagaattgccagcaagcaaaattgtttggttgatgcttccggcaggaactcctacaaattcaacgattgaaatgctttctgaaaagttgtcagctggagatattctgatagacggtggaaattctaattacaaagataatttagaacaaaataaattactgacagaaaaaggaattaaattttttgatgttggaacctctggtggaatggctggagctcgtcaaggcgggaattttatgattggtggagatgatgaaaaatcttggacaatcatagaaccaatcttcaaagcaatctcaatggaagagggctacctctatacagggaaacttggcagtggtcattacttgaaaatgattcataatggaattgaatatgggatgatgcaagcgatcgctgaaggatttgaaattttggaagagtcaccatttgattatgactatgaagccgttgcaaaattatggaatcacggctcagtaatccgaagctggttgatggagcttgctcaagaacaattttcaaaagaccctaaactagaccaaattatcggtcatgttcaatcttcaggagaaggaaaatggaccgttgaagaaagcttggacttaggtgttcctgccccagttattgccttgtcactaatgatgcgtcaacgctcattacaagaagataccatgaccggaaaagtagttgccgctttgcgcaatggctttggcggacatgacgtagaacaaaaataa

SEQ ID NO: 42206 - DNA, 1521 bp, Lactococcus lactis
ttgagtctgagtcaaacaagtcggtgtagaataaattttattagggagagaattttggaaaattcttcaaactcaactactgagacgcaagtaaaacgcggcttaaaatcacgtcatgtttccatgattgcccttggcggaacaatcggaactggattgtttctgacttcaggcgatgtcattcacacggcaggaccatttggtgcactgactgcctatgttcttatcggagcaatggtttacttcctcatgacatcacttggtgaaatggccacttatttacccacttctggttctttttcagactatggaacacgttatgttgacccagcttttggttttgctctaggttggaattactggttaaactgggcaattaccgtagcggttgatttaacagccgttgccctttgtatcaaattctggttaccagatgttccaagttggattttttcactgattgccttaattattgtctttgcaatcaatgccttatcagttaaaacttttggcgaaactgaatattggttgtcagccattaaaattactgttgttgttttattcttgattattggtttcttatctatttttggaattatgggcggtcatattgacgtcgctaaaaatctttcagttggtaatcatggttttgtcggaggacttggtagtttcactaccggcggagggattctcggcgtactcttagtcgctggtttctctttccaaggaacagaattgctcggaattacagctggcgaagctgaaaatcctgaaaaatcaattcctaaagctatgaactctatcttctggcgtattcttgtcttttatatcttatctatcttcgtgatggcggctatcattccatttaccgacccacacttagttggaggaaattcagctgctcaaagccctttcacaattgtatttgaacgtgttggtctctctattgcagcttctatcatgaacgccgttgttttaacttctgtcgtttcagcagcaaattctggaatgtatgcctctactcggatgctttattcactagctaaagatggtggcgcaccaaagattttctcaaaaacttcaaaaaacgggatccctttcattgctttattagctacaactgctattgctttactcacattcttgacatcaatttacggagttagcttctttacattcctcgtctcagcctctggtttaacaggatttattgcttggattgggattgcaattagccacttccgcttccgccgcgcctatgttgctcaaggaaaagatgttaaaaaattaccttatcatgcaaaactattcccatttggtccaatcttagccttaattatgaccgttttagtcacactcggccaagacccaatgcttctttttggtaaaacttgggtgcaaggtgtcatcatgtatgccgcaattccactcttcttcatcctttacttgggttataaatttaaaaacaaaacgaaacttatcccccttaaagaggttgatttaagtcgtcataaagattaa

SEQ ID NO: 42207 - DNA, 2088 bp, Lactococcus lactis
atgatagacaattttcatcttgtctatcattttttgtcagtaaaaaatgaaaagcgagcccttgctttttgtgttataattagaattaatttaaaaaaacaagagagcgagattattgtgggaaaaattattgaactaaatgaagcgctcgccaatcaaattgctgctggagaggtggttgagcggcctgctagtgttgtcaaagaattagtcgaaaactcaattgatgctggaagcagtaaaattattatcaatgttgaagaagctggtttgcggttaattgaagtcattgataatggtttgggtttggaaaaagaagatgtggctttggctttacgtcgtcatgcaacaagtaaaatcaaggattcggcagatttgtttcggattagaacacttggttttcggggggaggctctgccatcaatcgcttctgtcagccagatgaccattgaaacaagtacggctgaggaagaatcaggaacaaaactagttgctaaaggtggaaatatcgaaactttagaaccacttgctaagcgagtggggacgaaaatttctgttgctaatcttttttataatacaccagcaagactcaagtatatcaagtccttgcaggctgaactttctcatatcacagacatcatcaaccgattgagtctggctcatccagagatttcctttactttagttaatgagggtaaagaatttttgaaaacggctggaaatggtgatttacgccaggttattgctgcaatttatggcatagggacagcgaaaaaaatgcgtcaaatcaagggctcagacttagattttgaactaacaggttatgtcagcttaccagagctgacaagggctaatcgtaattatattacgattttaataaatggtcgatttatcaaaaactttttattgaatcgggcaattttagaaggatatggcaatcgattgatggtgggacggttcccttttgctattttatcgattaaaattgacccaacacttgctgatgttaatgttcatccgacaaaacaagaggtgcgtttgtctaaagagcgtgaattgatggctttaatttctaaagcaattgatgaagctttatcagaaggtgttttgattccagaagctttggaaaatttgcaaggaagagctaaagaaaaggagagtctttctgttcaaacggaacttcctttgcaaaataatcctttatattatgataatgttcgccaagatttttatgtcagagaagaggcaacttttaaaatcaataaaaatcaagcttcaaatgattcgtctgaacaaacttttgataattttacagaaaatcaacttaatacagatgctgtcagtgaaaaaatgactgacagaactgttgaaagtactactgaaattactgacaacagtctagaaaatactgtcagcaactttgaaattgattttgataatgaagcaaagataagtcagtcatcaacttttccgcagcttgaatacttggcacaattgcatgcgacttatttactttgtcagtccaaagaaggactttatttggttgaccaacatgcggctcaagagcgaataaaatatgagtattggaaagataaaattggtgaggtcagtatggagcaacaaattttacttgcaccatatttgttcactttagccaaaaatgattttattgttttagccgagaagaaagatttgttgcatgaagccggtgttttcttagaagaatacggagaaaatcaattcattttaagagaacatccaatctggttaaaagaaaccgagatagagaaatcaattaatgaaatgattgatattattctctcatcaaaagaattttcactcaaaaaatatcgtcatgatttagctgcaatggttgcttgtaaaagttcaattaaagctaatcatccccttgacgccgagtcagctagagctttactcgcagaattagcaacttgtaaaaatccttatagttgtgcgcatggacggccaacgattgttcatttttcaggggatgacattcaaaaaatgttccggagaatccaagaaacgcatcgttcaaaagcagcttcgtggaaagattttgagtaa

SEQ ID NO: 42208 - DNA, 2523 bp, Lactococcus lactis
atggctgaaaaaatttcaccaggaatgcaacaatatttagacatcaaacaagattatcccgatgctttcttgctctttcggatgggtgatttttatgagcttttctatgatgatgcagtgaatgctgcccaaatattagaattaaccctgacttcaagaaataaaaattcagaaaatccaattccaatggctggtgttcctcaccatgcagcagctgaatacattgataaattggttgatttaggctacaaagtggctgttgctgaacaaatggaagacccgaaaaaagcggtcggaattgttaaacgggcagtaacacaggtgattaccccagggacaacgattgacactgcaaattcggttgataataatttcttagtggcaattgacttcaaagataaacattatgctctttcctatatggacttatcaactggggaattcaaggtgacagagctcagcgaattttcagcggtggtgggagaaattgcttcactcaaggcgcgggaaattgtagctggttttactttagatgaaagtcagttaaaagtttttgaaagacaaatgaatcttttgatttcagaacaacttgaaattcctgaaaatttactgatagatttgtcaggattgaccgccttagaaaatcaagtcgcttcaaaattgttggcttatgtcaaagaaacacaaatgcgtgatttgagtcacttacaagaagttgaacattatgaaattaaagactttttgcaaatggactttgcgacaaaatcatctttagagctgacggcaaataaaagagaaaataaaaaacatggcacactttattggttgcttgatgagacgaaaacagcgatgggaaccagaatgttacggtcgtggattgaccgtcctttgatttcaaattcagccattcaaaaacgaatggaaattgttcaaattttcttagaccatttctttgagcgttccgatttgatagaagccttaaaaggggtctatgatttagaacgtttggcttcacgtgtttcttttggtaaggctgttccggttgattttttgcagctggctaattctttatcaaatgttcctgctatcaaatatattttaggaatgcttaatgaagctccattagaagagttaaaaagccaattagacgaaattccagaattatctggtttaattaattcagctattagtgagaatgcctcaagaacgattactgaagggggcattattaaaaaaggctacaatgctcaattagataaatatcgggaggcgcttgaaaatgggacttcttggattgcaaaattggaagcagatgaaaaagccaagacaggaatttccacactacgaattgattataatcgtaaggatggttattattttcatattactcaaagtcagttgaatagtgttcctgaacatttttatcggaaggcaactttgaaaaattctgagcgttttggttctcaggaattaactgaaattgaagaaattatgttggaagcgcgtgaaaaatcatcatctctagaatatgatttattcatgggccttcggactgaaacggagcaatatattggcagactacaagctctagccaaaacaattgctgaaattgattgtttacaaagtctatctgtcgttgccgaaaaacaaggatatatccgtccgacgcttacagacggttcaagaattgttgaaattaaaggcggtcgtcatgcggtcgttgaagcggtcatgggtgctcaagaatatgtgccaaatgatattgaactgcctgaacaaacagatattcaactcatcacaggaccgaatatgtcaggtaaatcaacctacatgcgtcaatttgctttgacggtgattatggctcaaattggatcttttgttccagcagaaacagccaatttaccaatttttgatgccatctttacacggattggtgccagtgataacttgatttcaggggaatcgacctttatggttgaaatgtctgaggccaatcatgccattcaaaaggcaagcagtcgcagcctgattatttttgatgaattagggcgaggaacggcaacttatgatgggatggctctagctcaagcaattattgaatatgttcatgaccatattggggcaaagaccttgtttgctacgcattatcatgaattgacagacttagatgaagcgctcgatcatcttgataatgtccatgttgctaccttggagcaaaatgggaatgtgacttttttgcataaaataacagaggggccagctgataaatcctatgggattcatgtggcgaaaattgcaggtttaccacagcctttgttagagcgagcagatttgattttgcagaagttagaaaataaacctttgcctgctaaaaaagttgctgatgaacaagaacaacttagtttatttgattttaccgaaaattcttcagaaattattgaaaagataaaaaggcaaaatgttgataatatgactgcaagagaggcattgaatttcttgtgggaacttaaagattcactttga

SEQ ID NO: 42209 - DNA, 1512 bp, Lactococcus lactis
atgaccgaacaaaaacaagcacttttcaccatcttcggagcaactggtgacctcgctaaaagaaagctctacccttcactctttcgcctcttcaaaaaaggtgaactagctgacaattttgcagtcatcggtaccgctcgccgtccatggacaaacgagtattatcgtgaagttgttttagagtctatcaaagatttaatgaactcaaaaacggaagccgaaaatttcgccagccatttttattatcaaagtcacgatgttagcgacagctcacattacgttaacttaaaagatttgggtgaaaaattgcgtaaacagtataaaactgctggcaatcaagtcttctttttagcaatggctcctcaattttttggcactatctctgaacaccttaaatcagaaaatattttgacaggtgagggttttgagagaatcgtcattgaaaaaccatttggaacaagctacgatacggcaaaatcacttaatgacagcctcgcaaaagtatttagtgaagaacaaattttccgaatcgaccactaccttggaaaagaaatgatccaggccgtttctgccgttcgttttgccaatccaatctttgaatcgctttggaataatcaacacattgataacgttcagattacttttgccgaatttatcggtgttgaagaccgtggcggttactacgaaacttctggtgctttaaaagatatgattcaaaaccatgtcttacaagtactcagcctcattgccatggaaaaacctgaaaaatttgatgaatcttatattgtaaaagaaaaagttaaagcccttaatgcaatccgtcaatattcttctgaggaagctttagaaaacttcgttcgtggtcaatatatcgcaggacgttttgacggtgaagattacctaggctatcgcgaagaagattctgttgcaacagacagtcgaactgaaactttcgccgctggaaaatttgtcattgataatgagcgttggtcaggcgtccctttctatgttcgctcaggaaaacgtatgactgaaaaaggaactcgtattaatatcgttttcaaaaaagataaagacaatctctttgcagaaaattgcgatgaccaatccgttcaaaatgttttgaccatttatattcaaccaactgaagggttttcactttcagtaaatggaaaagcggctggtcaaggcttccatttagagcctttgcggttaaatttccgacacgatagtgaatttcttggaaattctcctgaagcatatgaaaaacttttcctagatgtccttaatggagacggaacaaatttctcacattgggaagaagcggctcgcgcctgggaacttattgatgttattcgagaagcttgggataaagaaacttctgagcttccaacttatgcggctcgcacaatgggacctaaggctgcatttgacttactagaaaaaaatggtcacgaatgggcttggcaacctgatttatggtatcaagaacgtggttactacaataaataa

SEQ ID NO: 42210 - DNA, 1140 bp, Lactococcus lactis
atgaataatactgaatattatgaacgactaggtgtcgataaaaatgccagtcaagatgaaataaaaaaagcttatcgtaaaatgtccaaaaaatatcaccccgatttaaataaagaagagggtgctgaagaaaaatataaagaagttcaagaagcatacgaaacgctttcggatgaacaaaagcgtgctgcttatgaccaatatggtgaagctggagccaatggcggctttggtggcggtggcttcggcggagcttctggtttctctggtttcggcggtggctcaggtggctttggtggttttgaagatatattctcaagtttctttggaggaggtggtgcacaagttaaccctaatgcaccccgtcaaggagatgacttacagtatcggataaacttaaaatttgaagaagctatttttggcgtggaaaaacaagtcaaatataatcgtgaagaactctgtcacacttgtggaggttctggagcgaaagctggcacacatccagaaacttgtcataaatgtggtggtcgtggacaaattaatgtcgttcgtgatacaccacttggacggatgcaaacacaagtaacatgtgatgtttgtaacggaacaggtaaagaaatcaaagagaaatgtgaaacttgtcatggttcaggtcatgaaaaagtggcacatactgttaaggttactgtacctgctggtgttgaaactggacaaaaaatgcgtttgcaaggacaaggtgatgctggtgtaaatggtggaccttatggtgatttgtatgttgttttccaagtggaagcttcagacaaatttgagcgtgatggtgcagaaatttactacaagatgccaatggactttgttcaagctgctttaggtgatgaaattgaagttccgactgttcatgggaatgtgaagttgaaaattcctgctggaacacaaacaggggctaatttccgtctaaaaggtaaaggtgcgccaaaactccgtggttctggtaatggtgaccaatatgttattatcaatattgtcactcctaagaatttgaatcaagctcaaaaagaagcgctccaagcttttgctaaagcaagtggtgttgaagtttctggttcaggaaaaaaaggtttctttgataagtttaaataa

SEQ ID NO: 42211 - DNA, 1011 bp, Lactococcus lactis
atggtagttaaagttggtattaacggtttcggtcgtatcggtcgtcttgctttccgtcgtattcaaaatgttgaaggtgttgaagttgttgcaatcaacgacttgacagatccagcaatgcttgctcacttgcttaaatacgatacaactcaaggtcgttttgatggtaaagttgaagttaaagatggtggttttgaagttaacggtaaattcgttaaagttactgctgaatctaacccagctaacatcaactgggctgaagttggtgcagaaatcgttcttgaagcaactggtttcttcgcaactaaagaaaaagctgaacaacacttgcacgctaacggtgctaaaaaagttgttatcactgcacctggtggatctgatgttaaaacaatcgttttcaacactaaccacgaagtacttgatggaactgaaacagtaatttcagctggttcatgtacaactaactgtcttgctccaatggctgatactttgaacaaacaattcggtatcaaagttggtacaatgactacagttcacggttacactggtgaccaaatgactcttgatggcccacaccgtggtggagacttccgtcgcgcacgtgctgcagctgaaaacatcgtacctaactcaacaggtgctgctaaagctatcggtcttgtattgccagaacttcaaggtaaacttcaaggacatgctcaacgtgtaccagttccaactggttcattgactgaacttgttactatccttaacaaagaagttacagttgacgaaatcaacgcagctatgaaagctgcttcaaatgaatcatttggttacaacgaagaccaaatcgtttcatctgatatcgttggtatctcaaactcttcactctttgatgctactcaaactgaagttacttcagctgatggagctcaacttgttaaaactgtatcttggtacgataacgaaatgtcatacacttcaaaccttgttcgtacacttgcatacttcgctaaaatcgctaaataa

SEQ ID NO: 42212 - DNA, 2694 bp, Lactococcus lactis
atgaaatataaaacagaatccattgataatataaaaaaattctatgatattaatagtaaaactggtctcactccaactcaagtcacaaattcacgaataaaatacggtcataataactttgaagaacaaagtggcccaaatatttttcaaaaacttcttcatcacctcttagaagtcatgaatatcattcttattttagttggtgttctctcagcctatttggcttatatcagtaatggaaactatactaaaacaattgttgttttacttatcgttgccatcaacgttttcgtttcaatcttccaagaaaacagggcggaaaatgcactcgctgcactaaaagagctttcctcaccaacatcaactgttcttcgttctggaaaacgccaaactattccttcaagtgaattagtctgcggtgacctcattgagctgacagccggcgtacaagttggagctgatattcgcttactcacaagtaatagcctgcaagttgatgaatcttcactgacaggtgaatcagaacccattgacaagaatgctgaccttgatattactgacgaagttcctcttggagatcaactgaacatggttttctcaggaacaaatatccttaacggaacagccgaaggaatcgttgtcgcagttggttccgagtctcaaatgggacaaattgccacacttattggcgaacaaataaaaggaaaaactcctcttcaaaaaagaatcgataaacttgccaaacgcttagcaatcattgcctttgccgctggaatcttaatctttgtcattaatcttttgtatggaaacgttccttttgttgataatttaatgaccgccgttgttttaggagtagctgccgttccagaaacacttccagttattgttaccctcagtctgatttacggtgtagaaaatatggctcagaaaaaagccattatccgaaatgtccctgccgttgaaactcttggaaacgcaacagtcattgcttctgacaaaaccggaacactcacacaaaatcagatgaccattcaaaaactttggctatctggacaagatagttggtcaggaggtcaattatcaagctctgaagtttccttaatacaaaattttgcttatgcctcaaacgctagtgcacaactcattgacggtgattgggaaatccatggtgacccaaccgaagcagcaatcattcgcttcttaattactcatgacctctatgaacccgaaaaaaatccaaaacgacttgccgaactcccttttgatagttcacgcaaaaaaatgaccgttgtcattccacatccgcaagataatgaaaaatatcttgtactgaccaagggcgcttttgatagacttgcaccaagcagtcaacatcaagcacagcatccacagctcctttcttcaaataacgaggagacttccactcacttatcaaatgatttattgagtcaagcccaaaaaatacatgatatttttgctgaccaagccctacgtgttcttgctctttcttacaaaatcatcgataaagtcccagaagatttaactgaattagaaaataatcttacctttcttggaatcgtgggaatgattgaccctccacgattagaatcaaaagccgctgttcaagaagcaagggctgctggtattaaaccaatcatgattacaggggaccacgcgcttacagcaaaagcaatcgctcaacaaattgacatctatcgtgacggagataaagttattgacggcttaacgctcaaatcaatgacagatgatgaacttagccaaatgattgaacaaatttcggtctatgcccgagtaagtcctgaagacaaacttcgtattgtaaaaatctggcaagaaaaagaacaaatcgtcgccatgacaggagacggggtcaatgacgcacctagcttaagagcagccgatgtcggaactgcaatgggaatagctggaacagaagttgcaaaatccgcttctgatatcattcttgctgacgacaattttgcgaccatcgtcgctgccattcgcgaaggccgtcgcgtttacaccaatatcaaaaaaacaatttattaccttctctcagcaaacgtagctgaaattctaacaatgctcattggagcaattgtcggttggggaatgccttttacaggaattcaactcctttacatcaatgtccttgctgatggaattcccggatttggactttcacgtgaaaaagccgacagtcatatcatggaacagccacctgttggagtcaaagaaagtatcttctcaagaggagtcagctggcgtatcgccatttgttctacagcattcatcattactgctctagttggtttttatcttggtaggtttattgaaatcgctggattgacacccaaccatcaactcggacaaacaatggcctttgtgatattaacccttgcttctacgattaatgtctataatgctagaagtaatgaatctctcttcacaagaggaattaccactaataaaatgatttttggtaccaccttattatcactaggaataaccgttctctttacaaatgttcctattttgatgaacatcttagaagttgctcctttatcaatgacacactggctgatagctatcatcttggctttaatcccaacccttgtcattgaaattacaaaagtgattcttaataaacaagggaaaaaatttattggctaa

SEQ ID NO: 42213 - DNA, 1020 bp, Lactococcus lactis
atgtcaaatcaagaaccaatagcaaactacaaatttaattataaaacaacagcaaataaagttatgaaaaatattaatctttcaggaaaaacaatcatcatcactggtgggtattctggtattggtttagagatgaccaaacaactttcacgtgctggagcaaaaattattatccccgcccgaagaatggaggtagccaagaaaaatttatctaaaataaaaaatattgacattcttccccttgacctcaccaatccagaaagcattcatcaatttgccgaaagttttttgcaaaataattcaaaactagatattcttattaattccgctggattaatgtaccttcctttaaaaagagattcccgaggaatagaatatcactttgccacaaaccatctaggccactatcaattaacactggaacttttacccgctttaaaaaatgcaaaaatctcaagagttataaatttatccagtcgtgctcaacaaatgacaccattactagaagattggaattttgaaaaaatagaaaactataatccccaaataggctaccaacaatctaaaactgccaacgttttattttcaataaaactagatgaactaggaaaaaaatatggaattagaagttttgccgtccaccctggtatgattccaatgacaaatattggtcgtcaaaattcaccaattaccccttggctccgctacctagccgactattttaaattaattcatatccccgtattttttaatgcacttaaatccggctttgaccgaagtaaatatcgctatttaaaaacaatcgctcaaggtgccgcaacacctctttgggcctcaacaagccctgatttagaaggtaagggtggtctttattgtgaagaccttaatattgccagacttatgacatcagaagaagctaataatttttctggaggcttacgtccgcatgcaatagaccacaatgacgcagatagactttggcagatttcaaaaaatataacaggtctggattttgaataa

SEQ ID NO: 42214 - DNA, 1806 bp, Halobacterium sp. NRC-1
atgtgtggaatcacgggctacatcggcaccgatccgacgggacgcatcgtccacgagggactgcagaacctcgaataccgcggctatgactccgccggcatcgcgctcgccggcggcggctcgctgtcggtgcacaagaccggcggcgaggtcggcgacctcccagtgccgtcccgcgaggacgggacgcgtggcatcgggcacacgcgctggagcacccacggcgagccgacgcgggagaacgcccacccgcatacggactgcacgggcgacgtggccgtggtgcacaacggcatcatcgagaactacgccgcgctcgccgacgaactgcgggccgaccacgtcttccacagtgacactgacaccgaggtcgtcccacacctcatcgaaacccatctcgccgacggcgtgtcgctgctgacggccgtgcagcgcacgaccgagcgcctcaccgggagttacgcgctcgcgatcaccgccgccggccacgacggcatcgtggtggcgcggtcggacagcccgctgttgctcgggcacggcgacaccggcacgttcgtcgccagcgacgccaccgcgttcatcgagcacaccaaccgggtcacgtacctccggaacggcgacatcgcacacctcaccgagaccgagtggacggtgtacaacgacggcgcgcgcgtctcacgggacatcgaagcgctcgactggagcgccgacgcggcggggaaaagcggctacgaccactacatgctcaaggagatccacgagcagccacgtgcgctccggcaggcgatctccggccgcatcagcgatctcgggacggacgtgacactcgacatggagctgtccacggagacactgcagaacgtcgcggagctccagatcgttgcctgcggcacgtcgtatcacgccggcttgtacgccaaagagctcctggagacccacgccgacctgccggtgaccgtgcacgtggcaagtgagtacgagcttcggggcggccgcagccccgaggacacgctcgtggtggcgatcacccaaagcggggagacagcggacacgctggccgcgctccggagcgcggcccagaagggagcacccacgctcgcgttgacgaacacgctcggcagcacggtcacgcgggaggccgacgacgcgctgttcattcgcgccggccccgagatcggcgtcgctgccacgaagacgttcgtctcacaggtggcgaccgccgcactgctgaccatgcacatcgggcgcgcccgcaacgccatcagcacgggcgacgccgccgcgctccgggacgcgatccgcgacctgccgggggcggtccagcaggtcctcgatcaagcccccgagatcgcgtcgatcggccgcgagtacgccgacagcgacgcgttcttctacgtcgggcggcgggccggccgaccagtggccttggagagcgcgctcaagctcaaggagatctcctacgaccacgccgaggggttcagtgcgggcgagctcaaacacggcccgctcgcgctcgtcacggacaacacgcccgtggtggcggtgttgaccgagtacgcggcaccggagagaaccgcgaacaacgtcaaagaggtgcagtcccggggcgcggacgtcatcgggctcgcgagcgacgccgggaccgcgcgccacgccgacgtcacgatcacgctcccggcgtgtggtcccctggagccggtcgtggcgaacgttgcactccagttgttcgcgtaccacatcgccaacgagaagggccgccccatcgacaagccccggaacctcgcgaagagcgtgaccgtcgagtag

SEQ ID NO: 42215 - DNA, 1188 bp, Halobacterium sp. NRC-1
atgcaggctgttgtgctggcggcggggaagggagagcggctctggccgctgacggagaaccggccgaagccgatggtgccggttgccaaccagcccatcctggagcatatcgtggacgcgttggtgtcggcgggcgtcacgagggtgatgttggtcgtggggtcgaaccgggagcgcgtccagcggcacttcgaggacggctcgcggtgggggatcgagatctcctacgtggtccaggaccgacagctcggcacgggccacgcgctcgcgcaggcggagtccgtggtgggggagtcgtttgtcgcgctgaacggcgaccgcgtcatcgacgcgtcgctggtcgaggacgtttgggagtgccaccgtgagagcggcgactccgcgatgggcgtgacccaagtcgagacgccgagcgcgtacggcgtggtcgatctcgacggcgggaccgtcaccgacatcgacgagcagccggtgcccgagctggtggcgtcggagtacatcaacgccggcgtgtacgcgttcggcccgagcgtgttcgcggcgatccggcggaccgacagctacggcgagctggcgctcacggacgccctcgacgaacagctcgcggaccacgagctgcgggccgtgcggtacgacggccggtggctcgacgtctccgagccgtgggatctggttgcggccaacagcgcgctcatcacggaccggcgcttcgacccgccggtggagcggcgcaagccccgagggagcgtgccgggcgacgatcagcaggcaccggttggcggagggaccgtctgtggcgagggcgttatcgtgcacccgcaggcagtggtccggaacggcgttgcgctcggcgacaacgtgaccgtcggtgcgaacgcagtgatcgaacagtcgatactgttacctgactcgacggtcaacccaggcgcagtagtgaacgacagcatcgtcggcgcgaacgcgaccatcggcccgaacacgaccgtggagggcggtcaaacagacgtggtgcttggtgacacggtccaccagggggttcggttcggggcgttggtgggcgacaacgccgaggtcggcgcgggtgtgacggtcgcacccgggtcgatcgtcgggaacagcgcggtcgtcgacagcgccacggtcgtcaccgggcgcgtcgacgaccaggcgcacgttacgagaggctga

SEQ ID NO: 42216 - DNA, 1293 bp, Halobacterium sp. NRC-1
atgcgagtgagtatcgttggtagcggctacgtcggcacaacggttgccgcgtgtttcaccgacatgggccacgacgtcgtcaacgtcgacatcgaccaagacatcgtcgacgcaatcaacgccggcaaagcaccaattcacgaacctggcctcgatgacctacttgcgacccatggtggggatacactcgcggcgaccacagactacgaggatgtccttgagacggacgtcacgttcctcgcgctcccaacgccctccaaagaggacggcagcatcgacacgtcaattatcgaagcagccgccgaaaccctcggcgacacccttcgtgagaaggacggtgatcacgttgtcgtcacgaagagcacagtcatcccgaggacgaccacagagacactcgcgccgattctcgcggatgcttccggcaagcagctcggcgcggatctccacgtcgcgatgaacccggagttcctccgcgagggtacagccgtcgaggacttccaaaacccggacaaaattgttttcggcagcgacagcgagaccgccatcgacacgctccacgagatcttcaagcccctcatcgaagcgtccgacgcgactgtcgtcgagacgggcgttgaggaagcggagatgatcaagtacgcgaacaacgccttcctcgcgtcaaaagtcagcctcatcaacgatattggaaacatctgcaaggagttcggcgtcgacgcctacgaggtcgccgatgccatcggtctcgacgaccgcatcagcgagcgcttcctccgtagtggtcttggctggggtggtagctgcttcgggaaggacacgaacgccatcattcacgccgccacggaaaccggctacgagccggcgatgcttgaagcggccgtggcggtcaacgaccgccagccagagcgcctcctctcgctgctcgacgaccacggagacgtcgagagcgagcgcgtcgccgtgcttggacttgcgttcaagcccggcactgacgatgtccgggactccagggcgatccccgttattaatggccttcaagagcgtggtgcaaacgtcgctgcctacgacccagtcgccgccgagaacatgcgcacgcacttcccagacatcgagtatactgacgcaccacaggacgcactcgcggatgcaagcgcgtgcgtcgtctgtactgactgggacgagttcgctgtacttgacgatgaattcgatgccatggaaacacgagtcgtcgtcgacggccgacgcattatcgagcgccgcgacggactcacgtacgagggacttacctggtag

SEQ ID NO: 42217 - DNA, 657 bp, Halobacterium sp. NRC-1
atggtcgaggtcgacggcaagccgattctcacgcactgtttcgagcagctcgtcgaactgggcgctgacggactcgtcgtggtcgtcggctaccggaagcaggacatcatcgagcactacggcgacgagttcgagggagtcccaatcacgtacgcccaccagcgcgaacagaaggggctggcgcacgcgctcctgaacgtcgaggagcacgtcgacgaggacttcatgctgatgcttggcgacaacatcttccaggcgaatctcgaagacgtagttcgtcgtcagcaggaagaacgggctgacgcggcgttcctcgtggaggaggtcgactgggacgacgcgagccgctacggcgtgtgtgacacgaaccagtacggcgaagtgaccgacgtcgtggagaagcccgacgacccgccgtcgaatctcgtgatgacggggttctacacgttcagcccggccatctttcacgcctgtcatctcgtccaaccgtcgaaccgtggggaatacgagatttcggaggctatcgacttgctgattcagagcggccgaacgatagacgcgattgggttggaagggtggcgcgtcgacgtggggtatccagaagatcgggaggaagcagaggagcggctggctgaagcagaagacgctgtggcgtaa

SEQ ID NO: 42218 - DNA, 717 bp, Halobacterium sp. NRC-1
atgaaagcagtagtgctagcggcgggcgagggtacgcggcttcggccgagaaccgccgacctcccgaagcccctcgtcgaagtcaacggtaaaccgatactgacccattgcttcgagatactgcttgacctcggcatcgacgatgtcgtcgtcgttgtcgggtatgaaaaggacaaaatcatcgaccggtacggtgactcgttccgagcgatcgacatcgagtacgcccaccaatcagaacggctggggctagcccatgctgtcctaacggcggaaccctacgtcgactccgacttcgtcgtcctgaacggggacaacatctactcggcaaacttctccgaggtactggcccaccacaccgagtctggtgcagatatcacgttcccggtcgaagaggtgtcaaccgaggaggccacgagcggagcggtctgtgaacttgacgacgacagagccgtcacaggcctagtcgagaaaccggcagaacccccgtccaactacgccccaactgcattctacgtccttccaccggcaatcttccccgcgtgtcgcgttatccgcccctccgaacgtggcgagtatgaacttgctgatgcgattgatctcctgatctatagtggatacagcgtcgaaacgcagcccttcgagggctggaaagtgaacgtcaatactgaagccgacatcactcgagcagaacagttgctgcacagcggccagtaa

SEQ ID NO: 42219 - DNA, 1929 bp, Halobacterium sp. NRC-1
atgagtactgcaccggacaacgagggtgacgacgatcccttcgaggagcagcgcgcggacgtcgacaacgccatggtgcagttgttcgacgagtacgggcgcgatcacagctttcaggcagttgtcgccgttctggcgtcggtgtttgcgcgcgtgttggatctcgcgccgcccgtgttgctcgggttggccatcgactccgtcatccaggggaacaaggcgtttctgccgttcctcccgcagtcggtcgtgcctagcagcaagcccgaccggctgttgttcatggggggactgatcgcggggtcgttcctgttgggggcggcgttccactggatccgcaactgggggttcaactcgttcagccagcacatccagcaccgcgttcggaccgacacctacgacaagatgcagcgcctgaacatggatttcttcgccaccaagcagaccggcgagatgatgtccatcctctcgaacgacgtgaaccgcctggagcgattcctcaacgacggcttgaactcggcgttccggctgtccgtgatggtgctggcgatcggcgtctacctcttcgtcgtgaactggcaactcgccgttctcacgatgttgccggtgcccatcatcgcgctgttcacctaccggttcgtgaacgccatccagccgaagtacgccgacgtgcggtcgtcagtcgggcatctgaactcccgactggagaacaacctcggcgggatccaagtgatcaagacgtcgaacaccgagcgctacgagtcggaccgcgttgacgacgtttcacaggggtatttcgacgccaactggggggcgatcaccatccgcatcaagttcttcccggcgctgcgcatcatctccggcgtggggttcgtgttgacgttcgtgatcggcggcatctgggtcgccaccggcccgccgatgttcttctccggaacgctcgaccccggggagttcgtgacgttcatcctgctcagccagcagttcatctggccgatggcgcagttcggccagatcatcaacatgtaccagcgggcgcgcgcgtccagcgagcgcatcttcgggctgatgaacgagccctcccgcatcgaggagaacccggacgccgacgagctcgtcgttgacgacggcggcgtcgtctacgacgacgtgcgcttcggctacgacgacgacgacgccatcgtcgagcacatcgacttccaggttgacggcggggacacgctggcgctcgttggcccgacgggcgcggggaaatccacggtactgaaactcctgttgcggatgtacgacgtcgatgcgggcgcggtccgtgtcgatggccaggacatctccggggtgacgctgcccagcctgcgccggcacgtcggctacgtcagccaggacacgttcctgttctacggcaccgtcgaggagaacatcacgtacggcaccttcgacgccgaccgcgaggccgtcgtggacgccgcgaaggccgcggaagcccacgagttcatccagaacctcccggacggctacgacaccgaggtcggggagcgcggcgtgaagctctcgggggggcagcgccagcgcatcgacatcgcgcgggccatcctcaaagaccccgagatcctcgtgctcgacgaggccaccagcgacgtggacacggagacggagatgctcatccagcgcagcctcgaccgcctcacggaggaccgcacgacgttctcgatcgcccaccggctgtccacgatcaaggacgccgaccagatcgtcgtcctggaggacggcgagatcgtcgagcgcggaacccacgccgacctgctcggcgacgaggggttgtacgcgaacctctggggggtgcaggccggcgagatcgacgagctgcccgacgagttcatcgagcgcgcggccaaacgccaggcgaccgtcgacgaccaggacgacgactag

SEQ ID NO: 42220 - DNA, 2274 bp, Halobacterium sp. NRC-1
atgtcttcacgcgatcacccgcccggcgacggcctggtcgagttgcgcctcgacgtgcccgggatggactgctcgtcgtgcgccggcagcgtcgcggacgccctcgacgccaccgccggcgtcaccgcccacgaagaacagccgacgacgggctccgtcgtcgtcacgctcgacgaaagcacggccaccacgccggacgtcgtggccgccgttgaggccgccggctacgacgtcaccggaaccgacggcgaccgagacacctcccgggcggacgtctggaccagccctcgcgccctccaaaccgcggtcggcggcgtgttcctgctcgccggactggcgttgcggttcttcgtcggtgacgcgaacgtcgtgttgggggtggtcgccggcaccagcctgcacgccgccgacgtcgcgttcctcgtcgcggtcgcggccggtggcttcaagacgcttcgcaacggcgcgcgctcggcccgcgaccgccgcatggacatcgacttcctgatgtcgatcgccatcctcggcgcgctcaccgccagcttcgcgttcgggaagccgctgtacttcgaggccgcgacgctcgcggtcctgttcagcatcgcggaactgcttgaggggtacgccatggaccgcgcccgccagtcgctgcgcgagctcatggcgctgtctcccgatgaagcgacgatcatcgaccccgacggcaccgagacgacggtcccggccgacacggtttcgatcggcgaccgcgttgcggtgcggccgggcgaaaagatcccggccgacggcgtcgtcgttgacggggacagcgccgtcgaccagtcgcccgtgacgggtgaatccgtccccgaaagcaagcagccgggcgacgaggtgtacgccggcaccgtcaacgagacggggtatctcgaagtcgaggtcaccgccgccccgggcgacgacacgctgtcccgcatcgtcgaactcgtcgaggacgcccagtcgaatcagaccgaccgcgagcagttcgtcgaacgcttcgccgccaagtacacgcctgccgtcgtcgcgctcgcggtgctcacgacgcttggatcgccgttcgtgctcggcgtgtcctggccgactgcggtcgtccacgggctgacgctgctcgtgctcgcgtgcccgtgtgcgttcgtcatctcgacgccggtgtcagtcgtgtcggccatcacgagcgcggccaaccacggcgtgctcgtcaagggcggcacccacctcgaagccatggccgacgtcgacgtcgtcgccttcgataagaccggcacgctgaccgcgggcgaccttgcggtcaccgacgttcgcgggctcaacgggcaccgcgagcgcgacgtgctggcgtgcgctcgcggcctggaagcccgcagcgaacaccccatcgcggacgccatcgtggacgccgccgacgaagccggcgtcgacgcgccgtcggtcacggacttcgacagcgtcactggccagggggtgcgcgccacgctcgacggccaaccgcatttcgccgggaagcccgcgctgttcgaggaacacggcgtcgacctgtcccacgtgcatgcgaccactgacggcggcctgcgggcggcccagcccgactgcgagcacgccgactgcctggatctccgggccgacacgatccccgacctccaggccgccggcaagacggtggtgttggtgggcaccgcggacgcgttgctcggcgtgatcgcggtcggtgacacggtgcgggcgggcgcagccgacaccgtctccaggctccgcgagcacggcgtcgctcggaccgtgatgctgaccggggacaacgagcgcaccgcgcgcgccgtcggcgacgaggtcggcgtcgacgcggtgtacgccgactgcctccccgcggagaaagccagcgtcgttgcggacctccaggacgaacacggcgacgtggcgatggtcggcgacggcatcaacgacgcgcccgcgctggcggctgccacagtcggcatcgccatgggggcggcgggcaccgacaccgcgatcgagacggcggacgtggcgctgctgggggacgccatcacgacgctaccgtacctctacgagctggccggggacacgaacacggtcatccgccagaacatctgggcgagcctcggcctgaaagccgcgctcgcggtcggggtgccgttcggcctggtgccgatctggctggcggtgctcgccggcgacgccggcatgacgctcggggtcaccggcaacgccctccggctgggccgcatctcgccgtag

SEQ ID NO: 42221 - DNA, 1398 bp, Halobacterium sp. NRC-1
atgactaccgagcaaccacacgtcgtgatcgtcggcgcgtacggcagcgcgggcgtggctgccgccgaggaactggtcgacgaggacgtcaccttgacgctgatcgacgacggcgagccgggcggtgggctctgcatcctccgggggtgtatgccgtcgaaagaagtgctgtcggcgggcgcacaccgctaccaggcgcgccacgacgaccgcctcacgggtgcagtgccggacgtcgacttggacgcggtcgtggacaccaaagacgaccacgtgttggggttcgcggagcaccggcgggcggccgtccacgacatggccgagcgcgagcacgtcacgttccaccacgacaccgcgcggttcgtcgacgaccgcacgctggtcgtcgacggcgagcgcatcgaggccgactacgtcgtgctcggcacggggtcggcgctgaacgtgcccgatctgcccgggatcgcggacaccgactggatgggcagccgggacgtgctcgacgccaccgagttccctgattcgggcgtcgtcatggggttcgggtacgtgggcgtggagctggtgccgtacctctcggaggccgccgatatggacctcaccgtgatcgagcacgacgaccgccccctggactcgttccatccggtgttcggcgaggagatcctcgcccagtaccgcgaggagttcgacgtcgacatccgcaccgaggtcagggaggaggccgtcgaggagaccgacgacggcggcgtgcgggtccgcctcgacgacgggacgaccgccgagggcgagcagctgttcctgttcaccgggcggacgccgtcgtatccggcgggcatcgaggagacacgtctcacccccgatccggagtgggtggatccggcgacgatgcaggcccgcgacgacgaccacgtgttcgtggtgggtgacgccatgggcgagcgcatgctgctgcacaacgccaaagaggaggggtacgcggccggccggaacgcgctggccgtcgagcgtgggggtgacttggagacgtacgacccgttctcacaccaggtgatgttctcggggctgggcgtgttcccgttcgcgtcgctggggttgaccgccgaggcggcacgggccgccgggcacgacgtggtgacgagtcagcgcgacgcgtcaagcgacggcgtgttcaagaccaaagacgccgcgcgcggcgcggcgcgcctcgtggtcgacgccgacgacgggaccgtcctgggataccacggcctgcattatcacgccgacgtgatggcgaagaccatgcaggtggtgttggccgccgggatggacgtgcgtgagatcccggatcgcgcgtatcacccgacgacgccggaggtgctcgacgggctgttcggggacgccgcggccgagctgtag

SEQ ID NO: 42222 - DNA, 957 bp, Halobacterium sp. NRC-1
atggacgtggtgacgttcggggagacgatgctgcggctgtcgccgccgggccacgagcgcgtcgaggcggccgaccggatggacgtgcgcgtggcgggcgcggagagcaacgtcgccgtgaccgccggccgcctcggggcagagacggcgtggctgtcgaagctcccggcgtcgccgctcgggcggaaggtcgcggcgacgctgcgcgcgcagggcaccacgccggaggtcacgtggaccgaccgcgacgacctccgccaggggctgtacttcctcgaacagggcggggagccacgcgggacgaccgtacactacgaccgccaggacgccgccgtgacgacggcgaccgccgacgaactggcacccgcgttcgtcgagcgcgccggctacctccacacgtcgggcatcacgcccgcgctctccgaaacactcgcggcgacgaccgcggacctgctcgaactcgcccaggagacggggacgacggcaaccctcgacgtgaactaccggcgtgggctctggagccacgaggaagcccgcgacacactggaggcgctgttcccggacgtggacgtgctgttcgtcgccgagcgcgacgcccgcggcgtgctggacagaacgggggacgccgacgccatcgccagggggctggccgacgagttcgcgttcggcactgtcgtcctcacgcgcggcgaggccggcgcactggcggtgcgcaacgccaccacggtcacgcagcccgtcttcgagacggagacccacgacccgatcggcaccggggacgccttcgtcggcggctacctcgccgcgcgcgtcgacggcggggacgtcgaggacgcgctggcgtggggggctgcgacggccgcgctgaagcgcacgatccccggcgacgtggcgctcgtcacgcgcgcggacgtcgaatcggtgctggccgacgagcacagcggaatcgaccggtag

SEQ ID NO: 42223 - DNA, 1980 bp, Halobacterium sp. NRC-1
atgactgaccgcatccgagcgctcgacgacgcgacggtcgcgcggatcgcggccggcgaggtggtcgagcggccggccagcgtcgtcaaggagttggtggagaacagcctcgacgcgggcgcagcgagcgtggacgtgagcgtcgacgccggcggcaccgaccggatcgtggtggccgacgacggccgcgggatgaccggcgacgacctccggatggcggtccgccagcacacgacgagcaaactcgacgacgccagcgggctggacggcgtggggacgctggggttccggggggaggcgttgtacaccatcggctcggtggcggagctgaccgtgacgacgcgaccccggaacgccggcgatacgggcgcgcgcatcaccgtcgaccacggcgacgcgggaagcgtggcgccggccggccaccccgcaggcacgaccgtcgaggtgaccgacctgttcggggagacccccgctcgtcggaaatacctcaagcgcgccgcgaccgagttcgggcacgtgaaccgcgcggtcacccggtacgcgctggcgaacccggacgtggcggtgtcgctgacccacgacggccgggaggtgtttgcgaccacgggcaccggtgacgtgcaggacgccgcgctcgccgtctacggccgggaggtcgcgcagtcgctgcgcaccgtggacgccgatccagcggcggacagcgtcgagcgcgtccacggctacgtctcggaccccgaggtcacgcgctcgacccgggagtacctcgcgacgttcgtgaacgggcgcgcggtcacggacgccgtgctccgggaggcagtcctcgacggctacggcgaccagctcgcgcccgaccgttacccgtttgcggtgctgttcgtggactgcgagggcgtcgacgcgaacgtccacccccggaagctggaagtccgcttcgaggacgaggccggcgtgaaagccgccgtcgaggcgggggttcgggacgccctgttggacgcgggactcgtgcgggcgggcgcgccccggggcgcgtcgaagcccggcgacgccgagatttcgcccgaacactcgccgaccgacagagacgctggggccgccgggggtggggacgctgcgggtcagagcgacggaaacgggcagaggacagcggcgtccggtgcgaccagcgagtcgccggcgtccgcgttcgagaccggcggcggcgacgaggcggccgacagcgccgcgtcgacggacggcacacgcgagcgaccgggttccggcaccgagtcccggacggggcgcttcgacgcgcccgccgagaacgcgcggctgccgaccggagcaggcgggccggaggcggacgaccaggacacgacctcggagcgcgacagcctcccggacctgcgcgtgctcgggcagctccacgacacgtacgtcgtcgccgaggccggcgacggcctcgtcctcgtcgaccagcacgcggccgacgagcgcgtgcactacgagcgcctgcaggcccgcgttgacggcgcgtcgcaggcgctcgtcgcgccggccgagctggagctgacggccggcgaggcagccgtcttcgaggcggcgctcggcggcctccgcgaacttggcttcgacgccgagctcgccgggcggacggcgcgcgtgaccgcggtgccggcggtcctcgcggacgcgctcgacgccgagctcgcgcgggacgtgctctcgtcgttcctcgcggacgccgacgggacgccggtcgcggacgccgccgacgccgtgctggctgatctggcgtgctcgcccgcgatcaagggcaacacgtcactggccgaggggtcggtcgtggcgttgctggacgcgctggacgcctgcgagaacccctacgcgtgcccgcacggccggccgacgatcgtcgaggtcgacggcgacgagctcgccgcgcgcttcgagcgcgactaccccgggcacgccggccggcggcgcgaggacgccgggaactaa

SEQ ID NO: 42224 - DNA, 1290 bp, Halobacterium sp. NRC-1
atggcccagacaccaccgccggagtccgcgccctccaccgacagcgagcccgagaccgccctggagaccgcacgccgccagctgcaggcggctgccgagcacgtcgacatcgctgacggcgtgatcgagcgactcacccaccctacgcgcgtggtccaggtatcggtgccggtcgagcgcgacgacggcaccgtcacggtatacgacgggtaccgtgcccaacacgacgacgtacgcggtccatacaaaggtgggctccgctaccaccccggtgtgagcgccgaggaatgcgtcggcctctcgatgtggatgacttggaagtgtgccgtcatggacctgccgttcggcggcgcgaaaggcggcgtcgttgtcgatccgaagaccctcagcgccgacgaacacgagcgactgacacggcggttcgcggcggagctccgcgacgaggtcggtcccagccaggacatccccgcgccggacatgggaaccgacgcacagacgatggcctggttcatggacgcctacagcatgcaacagggcgagactgtcccgggcgtcgtcaccgggaagccgccagttgccggtgggagccacggccgcgcggaggcacccggccggagcgtcgccatcgccaccagggaagcgatcaactactacgacatccccatcgacgacgcgaccgtcgccgtccagggatacgggagcgtcggagcgaacgctgcactgctgctcgatgactggggggcacgcgtcgtcgccgtcagcgatgtcaacggtggcgtcctcgacactgatggcctcgatacacacgcgattccgtcgcacgggaaccagccggcggcggtgatgcgacacgacgcgccgaacacactcaccaacgaggagctcctcgaactagacgtcgatgtggtgatcccggctgctgtcggaaacgtaatcaccgctgccaacgccgaccgcattcaggccgacatcgtcgttgagggggccaacggcccgacgacatcggccgccgaccgaatcctcgaggagcgcgccgtgcccgtgatcccggacatcctcgcgaacgccggcggggttacggtgtcgtacttcgagtggctccaggacatcaaccgccggacgtggtcgccggagcgtgttcgcgacgaactcgaatccgagatgctgtccgcatggaacgccgtgcgcagcgaggtggacgacggagacctgagctggcgggacgctgcctacgttgtcgcgctgcaacgcatcggccgtgcgaaggaagcccgtgggctctggccctga

SEQ ID NO: 42225 - DNA, 1803 bp, Halobacterium sp. NRC-1
atggaacgccgtgcgcagcgaggtggacgacggagacctgagctggcgggacgctgcctacgttgtcgcgctgcaacgcatcggccgtgcgaaggaagcccgtgggctctggccctgatctgcacggcgttgggtgtgcccacaccccaaacaactatcacggacgtttgtgatggtggtggtgtcatgcatcgacccctcctcgtcaccgacttcatcgaccgcgcgcgcacctactacggcgacgaaaccgccgtcgtcgccaccaccggccggcggtacacgtacagcgagctcgccgaccgcgccgaccgcttttcggcggtcctccaggcggccggcatcgacagcggcgaccgcgtcgccgtcctcgacccgaacacccactaccacctcgaagccgcctacggcgcgatgcagctgggggccatccacacgccactgaactaccggctcacgcccgacgactacgcgtacatcctcgccgacgccggcgcggacgccatctacgccgacgccgcgtacgccgaccgcgtcgaggcggtccgcgaccagatcccgacgaccacgttcatcaccgacgaccccgccgccgtcgacggcgactggcaggacgccgacgccctgctggccgacgccgatcccgacgactacgaccgccccgatatggccgaggacgacgtgatcaccatcaactacacgtccggcaccaccggggaccccaagggcgtctgtcgcacccaccgcaacgaagtggtgcacgcgctgttgttgtccacccaccacaccatcacggacaccgacacctacctctggacgctgccgatgttccacgccaacggctgggggcacatcttcgccatcacgggcgctggtgccacccacgtctgcacgcggggcgtcgacgccgccagcgtcttcgacaccatccaggccgaagccgtgtcgtacctgtgtgccgccccgaccgtcctgaacatgctcctggactaccacgaggcccacgacgtcgcggccactggcgacgccgacgtgcgggtcgccaccgccggcagcgcgcccccggaggcgacgatccgcgccgtcgaatcggcgctcgactggtcgctcatgcacgtctacggggccaccgaaaccggccccctgatcgccacctccgacgccgaccgactgctcgccgccgggggcggcagccgcgccgcgatgcagaaacgccagggcatcggcctgttgggcaccgaactgcgcgtcgtcgacgagcacggcaacgacgtcccccgcgacaacgagaccatcggcgagatcgtcgtctccggcaaccaggtgatggaccgctactggaacaagcccgacgccaccgagcgggcgttcaccgaccgcgtcgacggctacttccacatgggtgatttcgcggtggtcgacgacaccggcttcgtctcgatcctggaccgcaaaaaggacatcatcatctccggcggcgagaacatctcctccatcgaactggaggacacgctcttcgagcacgacgccgtcggcgaggtcgccgtcgtgccctccccccacgacgactggggtgaaacaccgaaggcgttcgtcgtccctgcctccggggaccccaacaaccccggcgtcacgaccaccgcgctcgtcgagtacacccgggcggagctggcgtcgttcaagacggtgcggcgggtcgagttcgtcgacgaactccccaccacggccaccggcaaagtccagaagtacgagctgcgtgccgcggagttcgccgacgaggagtcgctggtcggccaggggtaa

SEQ ID NO: 42226 - DNA, 2616 bp, Halobacterium sp. NRC-1
atggggatcgtagacgagttccaggcgttgaaagccgagaccgacgcggacctgctggcgatgcaggtgggtgatttctacgagttcttcgcggcggacgcgcgaacggtcgcgtcggtgcttgacctgcaggtgtcggagaagtccaaccacgggtcgtcgtatccgatggcgggcgtgcccgtcgacgacctgacgccgtatctggcggcgctcgtggaacggggctaccgggtcgcggtcgccgagcagtccgagaccgacgcgggcgacatcgagcgcgagatcgagcgcgtagtgacgcccggcaccctgctggcgtcgacggacgccgacccccggtatctggcggcggtcgtgcgcgaggccggcggcgactgggggctggcgttcgtggacgtgacgaccgggcagttccgcgtgacccgtggcgccgaccgcgcggacgcggtcacggagctgtaccggttcgcgcccgcggaggtgttgcccgggccggcgctgcgcggcgacgacgacttcctgggcgtgctccgggagcgcacggacgcgacgctgacgctgcacgacgccggcgcgttcgacgccgggcgggcgacacaccgggtgcgcgagcagttcggcgacggcgtgatcgagagcctgggcgtggccgccgacgggccggtggtgcgggcggcgggcgcggcggtgggctacatcgcggccgccgacgagggcgtgctggcgtcggtgtcccgcatccagccgttcggcggcggcgaccacgtggagctggatgcgacgacccagcgcaacctcgaactgaccgagacgatgaccggcggcagcgacggctcgctgctggcgaccatcgaccacaccgcgtcggcggcggggggccgccggctcgcggcgtgggtgacacgccccacccgggaccgcgcggagctggaccgccggcaggccgcggtgggcgcgctggcggacgccgcgctcgcgcgagacgcgctgggtgacgtgctgggtgagatctacgatctcgaacggctggccagtcgcgccgccagcgggcgcgccgacgccaccgatctgctgcgggtgcgggacacgctggcggcgctgccggacgtggcggacgcgctcacgacgacccccgagttggcggagtcgccggcccgagacgtgctggcgcgggtcgaccgggcggccgccgccgacgtgcgagcggagcttgcggacgcactggcggacgatccaccgaagacgctctcggagggcggcctgctccaggcggggtacgacgaggcgctcgacgagctgctggcggcccacgacgagcaccgggcgtggctggacgggcttgccgaccgggagaaagaccgcctgggtatcacccacctgcaggtcgaccggaacaagaccgacggctactacatccaggtggggaacagcgaaaccgacgccgtgccagacggcgaggacggcgcgtaccgtcggatcaagcagttgaagaacgccacccggtacaccatggcggagctcgacagccacgagcgcgaggtgttgcgcatcgaggccgagcgcgcggagctcgaacgggagttgttcgcggcgcttcgcgaacgggtgggggagcgcgcggcggtgctgcaggacgtggggcgggcgctcgcggaggtggacgcgctcgtgagtttggccgagcacgccgccgcgaaccagtgggtgcgccccgagttggtggccggcgacggcctcgacatcgacgcgggccgccatccggtggtcgagcagacgacgtcgttcgtcccgaacgacgcacggttcgatgcgagccggcgcttccaggtcgtcaccgggccgaacatgagcgggaagtcgacgtacatgcgccaggtcgcggtgatcgtgttgctcgcgcaggtcgggagcttcgtgccggcggacgccgcccgcatcgggctggtggacgggatttacacgcgggtgggcgcgctcgacgagctggctggcgggcggtcgacgttcatggtcgagatggaagagctgtcccgcatcctgcacgccgccaccagcgactcgctggtggtcttagacgaggtggggcggggaacggcgacctacgacggcatctccatcgcgtgggcggcgaccgagtacctccacaacgaggtgcgcgccaccaccctgttcgccacccactaccacgagctgacggcgcttgccgaccacctggacgcggtcgtgaacgtccacgtggccgccgaggagcgcgacggcgcggtgacgttcctgcggacggttcgggacggcgcgaccgaccgatcgtacggcgtgcacgtggcagccctcgcgggcgtcccggagccggtcgtggaccgcgcgcgcggcgtgctcgatcggctccgggaggagaacgcggtggaagccaaggggtcggccggcgagtcggtgcaggccgtcttcgacgtggacagcggcgggttcgtcgacgacgcgggcgacgacggcgaggcggacgaccccgaggcggcggccgtcctggacgagctccggaccgtggagctggccgaaacgtcgccggtcgagctgctcgggacggtgcaggcctggcaggaccgactggaggactga

SEQ ID NO: 42227 - DNA, 762 bp, Halobacterium sp. NRC-1
atgcagggtcagaaccagcagcaggcctacgaccggggaatcaccattttctcccctgacggccggctctatcaggtggaatacgcgcgggaagcagtgaaacgagggacggccagcatcggcgtgcgcacccccgagggtgtcgttctcgtcgtcgacaagcagacccgttcgccgctgctcgaaggctccagcgtcgagaaactccacaagatcgacgaccacgtgggcgctgccagcgccggccacgtcgccgacgcccgccagctcgtggacttcgcacgccagcagtcccaggtcgagcgcgtgcgctacgacgagcccatcggcgtgcgcacgctcacgaagagcgtcaccgaccacatccagcagtacacccaggtcggcggcgcgcgcccgttcggcgttgcgctcctcatcgctggcgtcgagggcggcgaaccccgcctcttcgagaccgatccgtccggcacgtccaacgagtggaaggccgtcgccatcggctccaaccgcggggacatccaggagttcctcgaagacgaatacgacgccggcctctcggtcgacgacggcatcgacctcgcgctgcgcgccctcaacgagggccgcgaggacgccctcagcggtgacggcgtgggtgtcgggatcgtggacgccgacaccgggacctaccgcgagctcgcggccgacgagtcccagtcgtacatcgacgacatcgaggacgccgccgacgacagcgacgacgacgacgacgaggagtaa

SEQ ID NO: 42228 - DNA, 2592 bp, Halobacterium sp. NRC-1
atggacgcggcgcttggaccccccgacgcgatggctgccagcgagggcgacctgacgccgatgatgagccagtatttcgagctcacgcggcgctacgacgacgcgctggtgttgttccaggtcggggatttctacgagttgttctgtgcggccgcggagacggcggcccgcatctgtgaggtgacgctgacggcgcgcgaggactccacgggccagtatccgatggcgggcgtgcccatcgacaccgccgagccgtacatcgaggcgctgctggacgccggctatcgggtggcggttgccgaccaggtccaggacccggacgaggtgagcggcgtggtggatcgggccgtgactcgggtggtgacgccgggcaccgtcaccgaggacgaactgctcgggggcgcggacaacaacttcgtggcggcgctggccggcggccgggacgccgacgccgggttcgggctcgcgctgctcgacgtgtcgaccggcgactgttatgccacacggctcggcgacgaggcgcgcgtgcgtgacgaactggggcggttcacgcccgccgaactcgtcgtcggaccgggggtcgacgccgaccggttcgccgacgaggcgttcgtcgccgcgtacgacgacgacgccttcgagcccgcggccgcccgggagcgggtggccgactacttcggcggcgaggacgtgctgccgacgaccgccgaactgcgggcgtgtggggcgttgttgtcgtacgccgagtacacgcggggcggagccggcgacagccagcgtctcacgtacttgaaccacgtgacgcggtacagtcccacggagcacctccagatggacgccgtggcgttgcgcagcctcgaactgttcgagcagcgcagcgtccacgggaccgacggcacggcgctggtggacgtgctcgacgagacggcgtgcgcgctgggccgccggaagctcaccgactggctgcgccggccgctggtggattcggacgccatcgcggcgcgccacgacgccgtcggggagctcgtcgcggaccccctgtctcgggaggaactccacgagcacctgcgggacgtctacgacatcgagcggttggtgtcccgggtgtcccgggggcgggcgaacgcccgggatctgcgggcgcttgcggacaccctggcggtggtgccggaggtccgggggttgctggcggacgccgacgcccggaagctgcagtcgcttcgggaagccctcgatgacctccccgagatccgggggctgctcgaccgcgcgatcgtggcggatccgccacaggagctgaccgacgggggcgtgatccgggacggctacgacgagcgcctcgatgacctgcgggcgaccgagcgcgcgggcaaacagtgggtcgacgacctcgaagcaagcgagcgcgagcgcaccggcgtcgactcgctgaaggtgggccagaactccgtgcacggctactacatcgaggtgacgaaagcgaacatggacgcggtgcccgaggactaccagcgccgccagacgctgaaaaacgccgagcgctacgtcacgccggagctgaaagaacgcgaggaggagatcgtgcgcgccgagcagcgcgcccaggacctggagtacgagctgttcgtcgggatccgggagcgggtggcggaggcggccgagcggatgcaggccgtggcgcgcgcgctcgcggcggtggacgcgctggcgtcgtttgcggccgtggcggccgcccacgactacaccaagccggtgatgggcggcgacggcatccacatcgaggggggtcgccatccggtggtcgagcgcaccgagtccgggttcgtgccgaacgacacgaccctgaacgacgaccgccgggttgcggtcatcaccgggccgaacatgagcgggaaatcgacgtacatgcgccaggtcgcggtgatcgtggtgttggcgcaggcgggctgtttcgtgccggcggcggccgccgagttgcgggtggtggatcgcgtgttcacgcgggtcggtgccagcgacgacatcgcgggcgggcggtcgacgttcatggtggagatgaccgagttggcgtcgatcctgcgcgcggcgaccgacgagtcgctggtgttgctcgacgaggtgggccgcgggaccgcgacgaccgacgggctcgcgatcgcgcgcgcggtgaccgagcacatccacgacgccgtgggggcgacgacgctgttcgcgacccaccaccacgaactcacggcggacgccgaccgcctgccggacgcgctgaacctgcatttcgcggcgacccggggggacgacggggtcgccttcgagcacgcggtgcgggcgggcgctgcgaccgcctcctacggggtggaggtcgcgcgcaccgccggcgtccccgagccagtcgtggaccgcgcccgggagctgctcgatgcgcctgcgacggccgacgggggcgacggcgggacgacccccacagcggacgcgaacggccagcgcggggcggccgccgggatcgtcgcggagctgcgtgacgtgagtgtcgcggagctgacgcccatcgaggcgttgaacgtgctcaacgatctcgcgagccgggtggactga

SEQ ID NO: 42229 - DNA, 972 bp, Halobacterium sp. NRC-1
atgacacggtccacccgccagcgggagcgagaaacggcggcaaagcaggaggaggaggaggactccgaggagggggtgcgggagtgcccggagtgtggctcggataacctcgtgaagagttcggaccgcgcggaattggtctgcaacgactgtggcctcgtcgtcgaagaagagcagatcgatcccggtccggagtggcgggcgttcaaccaccaggagcgacaggagaagtcccgcgtcggcgcgccgacgacccagacgatgcacgacaagggactgaccacgacgatcgactggaaggacaaggacgcctacggccgctctatctcctcgaagaaacgttcgcagatgcaccgactgcggaaatggcaggaacgaatccgaacgaaagacgccggcgagcgcaacctccagttcgcgctctcggagatcgaccggatggcgtcggcgctcggcgtgccccggtcggtgcgggaagtcgcatcagtcatctaccggcgcgcgctcaaagaggacctgatccggggtcgatccatcgagggcgtcgccacgagcgcgctgtacgcggcctgccggaaggaaggcattccgcgcagcctcgaagagatctcggaggtatcccgggtcgagcgcaaggagatcgggcgcacgtatcggtatatctcccaggagctcggcctggagatgaagccggtcgatccgaagaagtacgtgccgcggttctgttctgaactcgaactcaccgaggaggtccaatcgaaagccaacgagatcatcgagacgaccgccgaggagggactgctctcggggaagtcacccaccggatacgcggccgcagccatctacgccgcgagcctgctgtgcaacgagaagaagacccaacgcgaggtcgccgacgtcgcgcaggtgacggaggtcaccatccggaaccgctaccaggagcagatcgaagcgatgggtattcacggctga

SEQ ID NO: 42230 - DNA, 960 bp, Halobacterium sp. NRC-1
atgacagacgcacgaatgcgttcccgagagcaggagcgcacggacgagacggaatcggaatcgacggacggctgcccagagtgcggtggcctcgtggtcaacgacgaggagcacggcgagtcggtgtgtgccgactgtgggctggtcgtcgaggaggacggcatcgaccgcggccccgagtggcgcgcgttcgactccaaggagaaagacgagaaatcccgcgtcggtgccccgaccacgaacacgatgcacgacaaggggctgtccacgaacatcgactggcgggacaaggacgcctacgggaacagtctctccagcaaccagcgccagaagatgcagcgcctgcgcaagtggaacgagcgcttccgcacccgagacgccaaagagcgcaacctcaagcaggcgctcggcgagatcgaccggatggcctccgcgctcgggctgccggacaacgtccgggagaccgcctcggtgatctaccgccgcgcgcttgaggacgacctgctgcccgggcgctccatcgagggcgtcgccacgtcctgcgtgtacgccgccgcgcgccaggccggcgttccccgcagcctcgacgagatcgccgacgtgtcccgcgtcgagaaggcggagatcgcgcgcacgtaccgctacgtcgtccgcgagctcggcctggaggtcgcgcccgccgaccccgagagctacgtgccgcggttcgcaagcgacctcgggctcagcgacgaggcctcccaccgcgcccgcgagctcctgaagacggccaaagacaagggcgtccactccggcaagtcgccggtcgggctcgcggccgcagcggtgtacgccgcggcgctgctgacgaacgagaagacgacgcaggcgaaagtctcggaggtcgcggacatctccgaggtcaccatccgcaaccgctaccacgagctgctggaggccgaagacactattccggtgtag

SEQ ID NO: 42231 - DNA, 1740 bp, Halobacterium sp. NRC-1
atgagaaacgcgaagatcgtctgtacgctcggccccgcgaccaacgacgacgcgtcggtgcgggcgctcgcggacgccggcatgacggtagcacggatcaacgccagccacggcgacgcggccgcgcgccgggagctcatcgagaccacgcgggccgtcgacgcccagaccgacaagccgcttgcggtgatgctcgacacccaaggcccggaggtcaggaccgcaccgatcgacgacgacggcaccatccacatcgaaaccggcagcgacgtggcgttcgtcgagggcgacaccgcgacccccgatcggatcgggatctccaccagcatcgcggccgccgaacccggtgacacggtgttgctcgacgacggccgcatcgaggccgacgtcgaccgcgtcgccggcgacacggtgcacgccaccgtggtgtccggcgggagcctcggcagccggaagggcgtcaacgtgccgggcgtcgagctggacgtggacgtcgtcaccgagaaggaccgccgcgatctggcgttggccgccgagctggacgtcgattacgtggcggcgagcttcgtccgggacgccgacgacgtgttggccgtcaaccgcgtcctggagtcccacggtgccgacatccccatcgtggcgaagatcgagcgggcgggtgccgtggagaacctggacggcatcatcgacgccgcccagggcgtgatggtggcgcgcggcgatctcggcgtggagtgtccgatggaggacgtgccgatgatccaaaagcgcatcatcgcgcagtgccgggacgcgggggtgccggtgatcaccgcgaccgagatgctggactcgatggtgcacgcccggcgtccgacgcgcgcggaggccagcgacgtggccaacgcggtcctggacggcaccgacggcgtgatgttgtccgcggagaccgcggtgggggacaaccccacgcgggttgtcgagacgatggaccgcatcgtgcgggaggtcgaaggcagcgcggagtacagcgagcgccaggagcaggcggtgccgacggccgacgggacggcgaagacggacgcgctggcgcggtcggcgcggtatctggcccgcgacatcgacgccagcgcggtggtggtggcctccgagtcggggtacaccgcccggaaggccgcgaagttccggcccagcgtcccggtggtctgtgcgacgccgtcccacgacgtgcgccggcagctcgcgctcaactggggggtccacgccaactacgcggcggtcgcggagggcgacgcgacgacggtcgtcgagcgcgcggtgcaggcggccgtcgactccggcgtggtggcgagcggcgacaccgtggtggtgctcgtgggcatgatgacggagcttgagggcgcatcgacgacgaacacgctgaaagtgcacgtggccgcggagacgctctcgaccgggcgggcggtcgtcgacgggcggacgaccggccggacgtaccgtgccgacagcggggatctcagcgacgccccggagaacgcggtggtgctgttggcgcacgggttcgacggcgagttcgacggcgatctctcgaagatcggggcgatcgtgagcgcggacgccgggctgaccgggtatccggcggtgatcgcgcgcgaactcgacgtgccgatggtcggcgatgtcgacgtggacgcggtgccggctggcgatctggtgaccgtggacggcgagcgcggcgtcgtctacgaggccgatcagtga

SEQ ID NO: 42232 - DNA, 2259 bp, Halobacterium sp. NRC-1
atggctgtacgctggctggaagacgtacgcgccgacgacatcgacagtgtcggcggcaaaggggcatcactcggcgaactcacggatgccgggctcccagtcccaccgggcttcgtcgtgaccgccggcacctaccggacgttcatcgaggaggcagggatcgaccaggagctgttcgacgcggtgggcgtcgacgccgaggactccgacgcgctcgccgacgccgcggcgcgcgcgagcgacctcatcctgaacaccgacttcccggcgagtctccgcgaggacatcctctcgtcgtacgacgccctcgacgacggggcggcgttcgtcgcggtccggtcctcggcgaccgccgaagacctcccggacgcgagcttcgccggccaacaggagacgtttctcaacatcacgcgtgaggcgctgctcgaccacgtgaaacgctgctgggcgagcctgttcacggagcgcgcgatctactaccgacaggaacagggcttcgatcacgaccgcgtgaacatcgccgtcgtcgtccagcgcatggtcgacgcggagaaatccggggtgttgttcaccagccacccctcgaccggcgcacacgaggccatcgtcgaggccgcctgggggctcggcgaagcggtcgtctccggggcggtgtcgccggacaactacgtcgtcgaccgtgacacggacaccgtcgaggaggcgacggtcgccgacaagaaggtgatgcacgtcaaggacgacgacaccggcgagaccgtgtcccgcgacgtgcccgaccggaagcgcacccagcgcgtcctcgacgacggcgagatcagcgacctggtcaccatcggggagcgcgtcgaagcccactacgacgccccacaggacgtggagtgggcgatcgtcgacggcgacgtgtacatgctgcagtcccggccgatcacgaccatcgaggacgacaccgacggggcggtagcgaacaccgacggtggtggcggcgacgccgtcgtcaccggactgggcgcgagcccgggtgtcgcgtcggggccggcacgcgtcgtcacgagcctcgacgagctcgacaagatcggcgagggcgacatcatcgccaccgagatgacgacccccgacatggtgccggcgatgaagcgggcggcgggcatcgtcaccgacgagggcgggatgaccagtcacgccgccatcgtctcccgcgaactcggctgtccggcggtcgtcggcgcgacggacgccacgaccacgctgtgcgacgatcaggcggtcacgctcgacggtgaccgtggcgtcgtccgcgacggccgcgaggagaccaccaccgagcacgaccccatcgaggacgcgcgaccgacgacgccggtgaagccgatgaccgccaccgaggtcaaggtcaacgtctccatcccggaggccgccgagcgcgccgccgcgaccggtgccgacggggtcgggctgctccgcatggagcacatgatcctgtccacgaacaagacgcccaagcggtatatcgacgaccacggcgaggacgcctacgtccaggagctcgtcgacggcatccggggcgtcgccgaggagttctacccgcggccggtgcgggttcgcacgctcgacgcaccgaccgacgagttccggcaactcgaaggcggcaacgacgagccccacgagcacaacccgatgctcggctaccgcggggttcggcgcagcctcgaccgcccggacgtgttcaaacacgagctgtcggcgttccggcggctctacgagatggggtacgacaacgtggaagtgatgttccccctggtcaacgacgcccaggacgttgcgcgggcacgagacctgatggcggacgccggcatcgacgtcgagaagcgatcgtggggcgtcatgatcgagacgccggcggccgcgctcgccatcgaggagatcgcacaggagggcgtggacttcgcgagcttcggtacgaacgacttgacccagtacacgctggccgtcgaccgcaacaacggcagcgtcgccgaccggttcgacgaactccacccgtcggtgttgacgctcatcgaacgcaccatcgacgcctgccgcgagcacgacgtcgccaccagcatctgcgggcaggccggctcgaaacccgagatggtggatttcctggtggagaccggcgtgtcctcgatctccgcgaacatcgacgccgttcgcgacgtccaacacgaggtcaagcgcgtcgagcagcgactcctgctcgagtcggcccgtgagtga

SEQ ID NO: 42233 - DNA, 3573 bp, Halobacterium sp. NRC-1
atgtacatagaggaactcgtcgttgagaacttcaagagcttcgcagggaccacccgaatcccgttctacgaggacttcacgacgatcagtggtcccaacggctccgggaagtcgaacatcatcgacgccatactgttcgcgcttgggttggcccgcaccaccgggatgcgcgccgaaacgctcactgatctcatctacaaccccgctcacgagggcgctgatggagccgcggggccgacggaggccagcgtcgaagtcgtgttgaacaacgacgcgggcgtggtctcccggtcgcaggtgaccaccgccgccggctccgagaacgtcggcagcgtggacaccatcacgatcaagcgccgcgtcaagcgcaccgacgacagccactactcgtactactacctgaacgaccggtcggtgaacctcgcggacatccaagagctgctcgcgcaggccgggatcgccccggagggatacaacgtggtgatgcagggtgacgtcactggcatcatcaacatgaccgccggcgagcgccgcgagatcatcgacgagatcgcgggtgtcgcggagttcgacgcgaagaagcgcgacgcgttcgaggagttggacgtcgtcgaggagcgcatcggggaggcggagctgaagatcgacgagaagcgcgaccgcctcgaccgcctcgccgacgagcgcgagaccgccctcgaataccaggacctgcaggaggaaaaacaggagtacgaggggtacgccaaggccgccgagttggaggagacgcgcgccgacctgtcggcaacgcgggcggacatcgacgaacaggaacgcgagttggaggggctcaccgccgagttggacgagcgccgcgacaccgtgggccgcatcgaagcggatttggcggcgttgaacgccgagatcgagcgcaagggtgaggacgaacagctcgcgatcaagcgcgagatcgaggagatcaaaggcgaggtgtcgcggctcgaagacacggtcgcggcctgcgaggatcgcgtccaggacgcggacgccgagcgccgagaggcggtcgtcgagatcgaccgcaaacgcgagcggatcgacgcccttgagaccgacatcagggaagtgaaagtccagaaggcgtcggtgaccgcggagatccaggagcgccgcgacgagctcgccgacatcgaagccgagatcgagtccgtggacaccgagttcgacgagctgaaagccgcgctcgcggacgagaagaccgccctggaggacgccaaacgcgagcgcaacgaccaccagcgggagcaagaccgactgctggacgaggccaaacgccgcagcgaggagctggccgacgccgaggccgacttggaggatgcccgggccgagctccccgaggtggacgccacgctggacgagctcgcggacgaactggagaaggcaacgcggaaccgcgagcagatcgtcgacgtggtcgaggacctcaaacaggagaagcgccagcgccaagaggacctcgcggcggtcgaggacgagctgtcggcggcccaagaggagtacgcgcgcctggaggcgcaggccgaccagtcgggagactcctcgtacgggaaggcggtgacgacggtgctgaacgacgaccgggacggcgtgcacggcactgtcggccagttgggtggcgtgcgcgagcagtacgcgaccgcctgcgagacggctgcgggcgggcggctggcgaacgtggtggtggacgacgacggcgtcgggcagcgctgcatcgagtacctcaagcagcgcaacgccggccgcgcgacgttcctcccgatcaccgagatgcagcagcggtcgctgccgagcgcgccggcgatgcccggcgtggtggacttcgcgtacgacctcgtggacttcgacgagcggtacgcgccggtgttctcgtacgtgttggggagtacgctggtcgtggagaacatggagaccgcacgcgacctgatgggcgagttccggctcgtgacgctggcgggcgatctcgtcgagaaatccggtgcgatgaccggggggagtcggtcggggtcgcggtattcgttttcgaaatccgggaaggggcaactcgaacgggtcgccgagcgcatccagggtctcgaagacgaccgcgaggactgccgccaggaggtccgcgagatcgaccagcgcctggattcggcgcgggaccgccgccaggacgccaccgagcaggtgcggacgatccaggccgacatcgaggccgccgaggccgaccgggaggccgccgtggagcgcatcgcggatctcgaaacgcgcatcgaggagctgcaggacgagcgcgaggccgtcgacgcggagatgcagaccgtcgacgcggagatcgacgcacagcaggagacgatcgcagccatcgaggccgagatcgagtcgttggaggcggagttggcggagtcgaggatccccgaactcaccgccgaaaaggaagacatcgaggcgaccgtcgtggacctagagggtcgtgtcgacgagctcgatggcgagctgaacagcctcacgctcgaaaaagagtacgccgaggacgccgtcgaggacctccaggctgacgtggccgacgccgagagccggaaagccgacgagcaggcgcgaatcgaggcgttgaacggcgacatcgaggccaagcaggcggagctcgctgagaaggaggcggcggttgaggacctcgaagccgagctggcggacctgaaacgcgaccgcgaggagcgcaaggccgacctcagtgaggccgaagacgcccgcgacgagcaggcggccgcggtcgaggacgcacgacaccgcctggagcgcctgcaggcggcagcgcagacgctcagcgaggaggtcgcggagctggacgacgccgtcggggagtacgatccggcggagattccggacgccgacgtggtcgcggagaacgtcgaacgcctcggcgcgcgcatggaggcgttggagccggtgaacatgctcgcgatcgacgagtacgagtcggtcgccgacaccctcgatagcctggaggcgcagcgagcgacgctcaccgaggaggccgacgggattcgggagcgcatcgcgcgctacgacgagcagaagaagtcgacgttcatggcggcgttcgaggcgatcaacgaccacttccaccgcatcttctcgcggttgtcagccggcaccggcgggctcgaactcgaaacccccgacgaccccttcgacggggggttgacgatgaaggcacagcccggggacaaacccgtccagcggttggacgcgatgagcggcggcgagaagtcgctgaccgcgctggcgttcattttcgccatccagcgccacacccccgcgccgttctacgcgctggatgaggtggacgcgttcctcgacgcggtgaacgcggatcgcgtcggcgagctcgtggacgagcttgcgggcgacgcgcagttcgtcgtggtcagccatcggtcggcgatgctcgaccgctccgagcgcgccatcggggtgacgatgcaggctgacaaccgcagcatcgtcaccggcatcgacctctcggcgcagggggcggtcacggatgactga

SEQ ID NO: 42234 - DNA, 1992 bp, Halobacterium sp. NRC-1
atgtggggggcgtcgctgacccggttcctgtcgctgtcggcgggccagatgggcgaggacttcatctccgtgggccgggtgcagtcgcccacgctgaagctcatcgtggacaaggaacgcgagatcgaggcgttcgatcccgacgactactgggagctgttcgcggacctccggaaagaccagaccaccttcgaggcgcagtacttctacgaggaccccgcggacggcaccgaggccgagcgcgtctggaacgagggcgacgccgacgccgcgttcgacgccctccggcaggccggcgaggcggtcgtcgactccgtgtcccgccggactcgcaccgacgatccgcccgcgccgttcaataccacgcagttcatccgcgccgcgggctcgcttggctactcggcgggccgcgcgatgagcatcgccgaggacctctacaccgcgggctacatcacgtacccccgcaccgacaacaccgtctaccccgacgacctcgacgagcgcgacctgctggaagccttccagcagacggtgttcggggacgacgccgattcgctgctcgaccaggaccgcctctcgccgaccagcggcgacgaggagaccaccgaccacccgccgatccatccgacgacggacttccccgaccgcaatcagctctccgaggacgaatgggcggtctacgaactcgtcgtgcggcggttcttcgcgacggtcgccgcgcccgccgagtgggcgcatctccgcgtcaccgcggacgccgacggcgagtccctgaaggccaacgggaaacgcctcgtcgaggcgggctaccacgcggtctacccgtactacgacagctccgagaaccacgtgccgcccgtcgaggagggcgacacgctcgccatcaccgacgcccgactggacgccaaacagacccagccaccgcgccggtacgggcagagccggctcatcgagacgatggagtcgatggacatcgggacgaagtcgacgcggcacaacaccatcgagaagctttacgaccgcggctacatcgagaacgaccccccgcggccgacgacgctcgcggaggcggtcgtggaggccgccgaggactacgccgatgtcgtggtcagcgaggagatgaccagccaactggaggcggacatgaccgccatcgccgacggcgaaacgacactcgacgacgtgaccacggagtcccgggagatgctcgaccgggtgttcgacgaactcaccgcttcccgggctgagatcggcgaccacctccgcacgtcactgaaagccgacaaatcactcggcccctgtccggagtgtggcgacacgctgttgctccggcagtcccgcaccggatcgcatttcgtgggctgcgatggctacccggagtgccagttcacactcccgctgccgtcgaccggcgacccactcgtcatggacgccgtctgtgaggaccacgacctccacgacgtgaagatgctcgccggccggaacacgttcgtccacggctgcccgctgtgcgcggccgaggcggccgacgagtccgaggaccgactcatcgggccgtgtccggactgcggcgaaccccacggcggcgaactcgccatcaagcagctccagtcgggcagccggctcgtcggctgcgaccgctatccggactgcgagtactcgctgccgctgccccgacgcggcgacatcgaggtcacggagacgtactgcgacgagcacgccctccccgaactcgtcgtccacgacggcgaggacgacgacccctgggagctcggctgccccatctgcaactacgaagagtaccaggcccgccagcgccagcagggactcgaagcactggacggcgtcggtccgaaaaccgctgcaaaactcgaatcggccggggtcgaggacgtcggcgcgctcgccgacgccgacccagaggggatcgccgacgcggtctcgggcgtcagtgccgacacgatccgagagtggcaagcgcaggcggactga

SEQ ID NO: 42235 - DNA, 1371 bp, Halobacterium sp. NRC-1
atgcggtgcgtacacgagcacgtcgatgtccgcggctttcgcgcgccgaatcaccgtgtcgttcagcactttcacgtgcaagtcaacccgagtcgtcggcacgcacacccgtttgcgtgcgcggtgttagccgctttcggtcgcggtgaacgcgttgcccgatgtcaggggttttatcgaacttatccggctgcagtccaaccgcggcgtatggacgtcgagttgctgtccgatgatgtcgtcccggagcacgcccgtgccgtgaaacaggacgcgcgtgcgttcgccgccgagcacatcgcgccccacgccgaggagtactacgcgtccggcgagtacccctgggaggtcctggaggccgccatggacgccgggctggtcgcccaagacatcggcgaggactacggcggccgggggttggatctcacgcagatgctggccatcgccgaggagttcttccgcgcggacgccggcatcgcgttgaccctccagctcgcgagcttcggggcggagctcgtcgaggagtacggcacccccgcgcagaaagaccggctgctcacgcccgtcgcgaacaacgaccagctcaccgggctggcggtctccgagccggaggtcggctcgaacctcgccggcatgcagacgaccgccgagcgggacggcgacgagtacgtgctcaacggcgagaagtactggatcggcaacggcgtcgaggccgactgggtgacggtgtacgccaaaaccggcgacaccgacgaccggtacatgaactactcgctgttcgccgtgccgaccgacaccgacggttacgaggccgaacacatccccgagaagatgggcatgcgcgcctccaagcaggcgcacatcgtgcttgacgactgccgcgttccggaggccaacctcatcggcaccgagggcggcgggttcatgatgttgaccgacttcttcaaccacggtcgggttgtcgtcgccggccacgggctgggacttgcggccgccgccttcgaggaggcctgggacttcgttcacgaccgcgcgggcttcgggcgcaccgtctcggatttccagtccgtccagcacagcctcgcggacatgcgcatcgagttcgagtcggcgcgcgcgctcgcctaccgggccgccgagaaggtggccgcccacgacgaaccggggctgtgggcggcgatggcgaaaaccaaagccaccgaggtcgcaaccgccaacgccgaacaggggatgcagttccacggcggccggtcgaatttcaccgaccgccgcatcgcccgcgtctaccgtgacgttcgcattcctgtcatttacgagggcgcaaacgagatccagcgcaacctcgtctaccggcagtccggcgaccagtaa

SEQ ID NO: 42236 - DNA, 801 bp, Halobacterium sp. NRC-1
atggacgtctacggactgatcgggaacccggtcgggcattcgctgtcgccgccgctgcacgcggccgcctacgacgagtgcgggctcgacgcccggtacgtgaccttcgagccggcaccggacgacgccgcggccgccatccgaggggctggcgcgctcggcgtggcggggttgaacgtcaccgcgccgttcaagcagtcggccgcgtcggcggtggcgaccgactcgatggccgcccgggtgggcgccgtcaacaccatcgacttctccggggccgcgccccgtggatacaacaccgacgttgcgggcgtgaagcgcgcgttcgcccaccacgacgtgtcgctgtcgggcgcgcaggctgtggtcgtcggcgcgggtggtgccggccgcgccgccgcgttcgcgctcgccgacgccggggcgaccgttcggatcgccaaccgaacacgggcggccgccgacgaactcgccgccgacgtgggtggcacggccgtcggcctcggtgacctgccgcggagcctcgccgacgcgacggtcctggtccacgccaccacggtggggatggacgacccggacacgtcgccggtgtccgccgacgccctccacgacgatctcgccgtcctggacgccgtgtactcgccggttgagacgcggctgctgcgggacgccgcggccgccggcgcaaccacgatcgacggcgcgtggatgctgctctatcagggtgccgaggcgttcgagcgctggaccggcctggacgcccccgtggcggcgatgcgcgccgccctccgtgcacggctttaa

SEQ ID NO: 42237 - DNA, 1059 bp, Halobacterium sp. NRC-1
atgttcgagaagtcgacgtggatccggctcccgcggaacgttgtcgtcgggcacggcgtgctcgacgacgcggtggaggtcgtccgcgacacccacctgacggggcggccactcgtggtgacgagtccgacgccgaagacggtggccgcggagaacgtcgtcgcgcagttcgaagccgtcggcgacgacccggccgtcgtggtcgtcgaggaggcgacgtttaactccgtcgagcgggtgctcggtgaggccgaggccgtcgaccccggctacctcgtgggggtcggcggtgggaaagcgatcgacatcgcgaagctggccagcgaccacctgaacgtcgggttcgtgagcgtgccgacggcggcgagccacgacggcatcgtctccggtcgggggtcggtccccgagggcgacacccgccactcggtgtcggccgccccgccgctggcggtcatcgctgacaccggcgtcatcgccgacgcgccctgggagttgacgacggccggctgtgcggacatcatttcgaactacaccgcggtcaaagactggcggctggccaaccgcctccagcacgtcccgtacagcgagtacgccggcgcgctctcccagatgaccgccgagatgctcgtggacaacgccgccaacatcaagcccgaactcgaggagtcggcgtgggtcgtggtgaaggcactggtgtcctcgggcgttgcgatgtcgatcgcggactcctcgcggcccgcctcgggcagcgagcacctgttcagccaccaactcgaccgcatcgcgcccgggaaagccctccacggccaccaggtgggcgtcggctccatcctcgcggagtacctccactccggccaggaggggcagtggatggcggtccgggacgcgctggcgagcctggacgcgccgacgaccgccgacgagctcggcgtcgccgacgacgaggtactggcggcactcacctccgcccacgagatccgggaccgatacacgatcctcgggggcggcatcagcgaggtggccgcccgcgaggccgccagccgcacgggcgtcatctga

SEQ ID NO: 42238 - DNA, 315 bp, Halobacterium sp. NRC-1
atggagttctgcgacgactgcggctcgatgatgaaagccgacgacgagctgtgggtatgcagcagctgcgggcacaagcaacccaaggacccgtcggcgagtttcgtcgtcaccgaaggccaggaggagaccgaggtcgtcgacgtcagcgacgcccaggaccgcggcctgccgacgacgagcgtcgtctgcccggactgtgacaacgacgaagcccactggtatatgcagcagatccggtcggccgacgagtccgagacgcggtttttcatctgcacggagtgcgagcaccgctggcgcgaagacgacaactag

SEQ ID NO: 42239 - DNA, 942 bp, Halobacterium sp. NRC-1
atgctggtcgccgcacaccacacacgcatgccaacgcacgcgccggccccgggcagcggggacccactgggactgcatggcgtcgttccgccggttgtaaccgccttcgacgcggacgagagcctcgacgccgacaccaccgccgaccacgcccgcatggtcgtggatgcgggcgtacatggggtgttcccgctggggacgaacggcgagttcccgctgttgaccccgagtgagcgcgaccgcgtcgtgactgcggtcgtcgacgaggtcgggggcgaggtgccggtcatcgcgggcgtcggcgcgccgtccacgcgccagacggtcgcccacgccgagcacgccgcgtcggtcggtgccgacggggtcgtggtcgtgacgccgttctactatccgctggacggcacggccgccgtcgaacactaccggcgggtggcggcggccgtcgactgcccggtgtacgtctaccacatcccgtcgaagacgggcaacgagctgtccctggagacgctggcggcgctggcggagatcgacaccctggcgggggtcaaagactcctcgaaggacgtgccgtggctggggcaggccgtcgacgcccatcccgagttgacgttcctggcgggctcggactccctgcttgcgccgggcttggacgtgggctgtgcggggctggtgtcggccgtcgccaacgtcgccccggagctggtggtggggctgtacgaggcctacgacgagggcgaccgcgagcgcgccagggcgcgccagtccaccgtctacgaggtgcgggcagcgctcaagcgcggcccctacatggcgggcgtgaaggccgccctggggctgcgggggttcgacgccgggccgctgcggtcgccgctgcgcgggctggacgacgacgaccgggcggcgctcgaagcggacctcgccgacctggggctgctgtga

SEQ ID NO: 42240 - DNA, 1071 bp, Halobacterium sp. NRC-1
atggacgcaatcgtcgtctcgaaggccgaccgcacaccacggctggtcgaccggccccgtccggacccaacacccggctcggtgctcgtgcgcacgctccgcgtcggcgtcgacggcaccgaccacgaagtgatcgccggcacccacggcggcttccccgaggacgccgacgagctcgtgctcggccacgaagccatcggcgtcgtcgcggatccgaccgacacccggttctccgcgggccaactcgtcgcgccgaccgtgcgccgaccgcggggcgaccccaccccgcagttcgaccgcggccaacccgacatggcggcccccggtacgtacgtcgagcgcggcatcgacggcgccgacgggttcatggccgactacttcaccagccccgcggacgcgctcgtcgcgctccccgactcgcttgccgcccacggcttcctcacggaaccggtgtcggtcgccgagaaagcgatcgaactcgcgctcgcttcgcggtcggcgttcgactggcggccggactccgcgctcgtgttgggcaacggctcgctcggcctgctcacgctcgccatcctcgccgcccgcgacgacaccgagacgctctactgtctcggccgccgcagccgccccgacccgacgatcgacatcatcgagcgactcggcgcgacctacatcgactcccgcaccacgccggtcgccgacatccccgccgcccaccagcccgtcgacatggtgtacgaagccaccgggcacgcgaaacacgccttcgacgccatcgacgcgctcgcccccgccggcgtcgctgccctcctcggcgttcccgccgccggctggacgttcgaagtcccgggcagcgacctccaccgcagcctcgtcctggagaacaaagcggtggtcggcagcgtcaactccaacgcccgccacttccgcgccgccgccgacacgctggccgccctccccgactggctgtgtgacgccatcgtcaccggcgtccacgacaccgcagcgttcgcggacgcgttccgggacggcgaaacctccatcaagacggccgttcaattcgacacccgatga

SEQ ID NO: 42241 - DNA, 777 bp, Halobacterium sp. NRC-1
atggggcccaacggcaccgggaagacggtgttgctgtcgtgtctcgccggtggcaccgagccgtcggagggctccgtgtcggtgttcgggacgcccgtcagcgaagacggcggccggagcctctcgctgctgctgcagggcggcgcgagcgtcgacacgctctctggccgcgagacggccgcgttctactcccggcttcaccccgagttcacggaccgctggcggacgtacgtcgacgacctcggtatcgacggcgacctcgacaaacgcatcaagtactactcggagggcatgaaacgcaagctcgaactctcgctggcgctgtccgtcgacgcgccgctgtacctcctcgacgaaccgacggcgggcgtcgacctctcgatggtgcagtcgtttcaccgcgtcatccgcgaccgcgtcgcggacggcgggaccgtcgtcgccacgagccaccggcccgtcgacgccgacctcgccgaccgcgtcgcgttcgtgaacggcggcggcgtgctcgccgtcgacacccccgaggcgctgttggacggcgtcccgaccgtcgtgcgagtggtcggccaggccaccgccggcgacgccctcgccccgcacgtcgtcggcgacccgttctaccacggcgacgaacgccgcggattcctccgcgagcacgcgactctcgcggacatccgcgagcacgccggcgacgccaccgtcgagaccgtggagccgagctacaccgacgcgttcaactactacgtccacgcagccgccgacaatgagtga

SEQ ID NO: 42242 - DNA, 834 bp, Halobacterium sp. NRC-1
atgcgtatggcacaggacacacagcagcgcgcggcggtcgtcgaggagatgcccgagttcggactgggaacctgggagaacgaggatcccagtgcgtgcgcggacagcgtacgaaccgccctcgaaatggggtatcggcacatcgacacggcacagatctacgagaacgaggacgccgtcggcgacggcatcgcggccgccgacgtcgaccgcgaggacgtcttcctcgcgacgaaggtgtggacgagcgagctcggtgacggcgacgttgcgcccgcgaccgaacagagcctggagaagctcggcgtcgactacgtcgacctcctgtacgtgcactggccggcaaaccagtacgatgccacggagacgctggctgcgctggccgacctgcaggccgacggcgtgaccgagcgcatcggcgtgagcaacttcgagccccggcacctcgacgaagccgaagacgtcctgggcgagttgccgttcgccaaccaggtggagttccacccgctcctccaacaggaggagctgcgcgagtacgccgacggcgaggacatcgagctggtggcgtactcgccgctggcccgcggtgaggtcttcgacgtgcccgagatccaggccgtcgcggagaagcacggcgtcagcgaggcgcaggtgagcctggcgtgggtgcgccggaagggcgtcaccgccatcccgaaggcgaccggcgaggaccacatcgccgacaactgggcgagcctcgatctcgaactcgacgacgaggacgtcgcgaagatcgacggcatcgaccgccgcgagcgacaggtcgacccggagttcgggccctggaactga

SEQ ID NO: 42243 - DNA, 1233 bp, Halobacterium sp. NRC-1
atgtcagacaagcacgacgttattgtcgccggtgccggcccagcaggagcacagtgcgcgcgcgacctcgcggagcggggctacgacgtggtcgtcctcgaagccgaacccgaggacgagttcccccgccagtcgaacaagtccactgcgggcacgttcgcgtccatgatgggcgcgttcggcgtgcccgacgacgtggtcatgcagtacaccgacgacgttgtgttggaatccccccacgagtatttcgtccaggatcagcccggcgcggtcctggagttcgcggagttcaaacagtggctggtcgccgccggcgaacaacagggtgccgagtaccggttcgaggcgcgcgtgaacaacccgatcacggaaggcggggagattgtcggcgtgaagtacgacggcgacgaggaggtgtacggcgacatcatcatcgacgccaccgggccggcggcgccgcttgcgaagaaactcggcgtgacggacctccggcgcagcaatcaggccatcggcatcgagtgggagatggagaacgtcgccgtcgaccacgaggggtacgccgacctgagcgacgcgatgatgctgcgcctggatcacgacctcgcgcccggcggctactcgtggatcttccacacgggcgctgacaccgcaaaagtcggcatctgttacatccagaacgagagctaccagcggttcggtgacgcctcgaagagcatcgacgaccacctcgactactggatggagaccgatccgcgcctcgccgacgccacgaaactggcgggcaaacagcaccgcgggtcggcgcacatccagttgccggcgaacttctcgacggacaacttcatggccatcggggacaccgtgccgacggtcgacccgctgtggggggaggggatccacaagtgcatggagtcggcgcgcgcggccgcgatcaccgccgaccggtgtttcatgggcgacgaccgcgatacgtccgcggacgcgctgtcgatctacgacgacctctggcacaagcgtgtcgcgccgaacgcgcggatgcggctgaccatgacccagctgctgtatctcgcgtccaacgagcgctacgaccgcctcatgagcgacctgcagacggccgacgtcgggacgctgtccggcgcgaacgagggcgggctgcggtcgctgctcgagttcgtgcacaccgaagacgtccccctgctcgcgcggttcgcccgcgaccggctgcgcgcgtga

SEQ ID NO: 42244 - DNA, 759 bp, Halobacterium sp. NRC-1
atgaccgacctcgccatccgcgcagacggcctgacgaagcgttacggcgacgaagctgcggtcgacgacctcgacctcgccgtgcccgcgggcagcgtctacggcttcctcggaccgaacggtgccgggaagacgacgacaatgcgcctgctcacctccctcaccgatcccaccgcggggaccgccgaggtcgccggcgttccagtcaccgaccgggcggcgctcaccccgcgaatcggttacctacccgccgatccaccggtcttcgacgagctgacgggctgggagcagctccggcacgtcgcccgactccacgggctcgacgacggcgaggcggacacccgcatcgagtcgctgctggagcggttcgacctgctcgcggacgccgaccgccgcatcgagtcgtactccacaggcatgacgaagaaggtcggcgtggtcgccgcgatgctccacgacccggacgtcctgttcctcgacgaacccacgtcggggctggacccccgggccgcccgcaccgtcagggacaccgtcgcggacctctcggcgggggacgcgactgtccttctctccacgcacgtcctccccgtcgtcgacgaactcgcggacaccatcggcgtcatcgacgacggcgtcctcgtcgccgacggtgacccagagaacctcaaatcgaccgcccgcgagggcagcgcggccgacctggagaccgtcttcatggaggtgactgcggatgccgacgccccgctcccggattcgtga

SEQ ID NO: 42245 - DNA, 951 bp, Halobacterium sp. NRC-1
atgagcagcgatgacgcgtggacggcggcagcgctccccgatcagtccggccggcgggtggtggtgacgggcgcgaacagcggcctcggcttcgaggccacgcgggcgttcgctcgggctggcgcgcacgtcgtcatggcgtgccggagcaccgaacgcggcgaggacgcccgcgacgacatcgtggcagagctcccgggggcgtcgctgacagtgcacgagctcgatctcgcggcgcttgattcggtggcggcgttcgccgactggttcaccgcggagttcgacagcctgcacgtgctcgcgaacaacgccggggtgatggcgatcccgcgctcggagaccgccgacggcttcgagacgcagttcggcgtcaaccacctggggcacgtcgcgctcaccgccgggttactgggcgtgctccggcggaccagcggcgagacgcgcgtggtcacgcagtcgtcgggcgcacaccggcgcggccggatcgacttcgaggacctccagcacgaggccgagtacggcaagtgggaggcctacagccagtcgaagctcgcgaacctcctgttcgcgtacgaactcgaccggcggctgcgggcggcgtcggcgagcgtgacgagcgttgcctgccatccggggtacgccgcgacgaacctccaactccgcggtccgcaggcggcggggtcgcggctgcggctgctcgcgatgcgggccgcgaacgcgctcgtcggccagagcgccgagcagggcgcgtggccgctgctgtacgccgcgactaacccgagcatcgacggcggtgagtacatcggacccggcggcgtcctgaacatgcgcggtcaccccgagcgccagcagccgagcgcccggtcgcgcgacgaggacaccgcgcgccgcctctggacggtctccgcggaccgcaccggcgtcgacttcgacctgccggaccccgcgtag

SEQ ID NO: 42246 - DNA, 1971 bp, Halobacterium sp. NRC-1
atggattcactcgacggagtcggcacggtcgtccacgaaccggaccctgcgctcgcgtcgtcgacgaacgtcgcccagttcatgaccgcccacgacatcgacgacgtggacgcgctccgcgagcgcagcaccactgatctcgactggttctggggggaactcccggagtatctcggcctggagttcttcgaagactacgacgccgtccgcgacgacgccgacgacccccagtccacggcgtggtatccgggcgccgaactgaacgtcgcgcacaacaccgtcgaccgccacgccagcgtcgacgccggcacccgcaaccacgtcgcctgcatctgggagggcgaggacggcacggtccgccaacagacctaccacgacctccaccagcaggccaaccgggtggccaacgcccttgctgagcgcggcatcggcgagggcgacacggtgggcctctacatgccgatggtcccggaagtccagagcatcctctacggcatcttcaagatcggcgcgatcgccgtccccatcttctccgggttcggcgtcgaggccaccgccacgcgcatcgccgacgccgagtgttcggtggtgttcacgggcgacggcttcctgcggcggggcgaccgcgtcacgctcatggacaccctcaacgacgccatcgagcgggccggccacgtcgaccacaccatcgtctacgaccgcctcggcatccccgcggactcgctgtcctggacgccccgcgacgagtggtgggacgacgccgtggccacccagtccccgacgttcgagacgcactcgatggccgccagcgatccgtgcatgctgttgtactcctcggggacgacgggaacaccgaaaggcatcgtccacacccacgccggcgcgctcgtccaacccgccaaggagatccacttcgggttcgaccagcggcccggcgaccggttctgctgggtgagcgacatcggctggatgatggggccgtggtcgctcatcgggaaccacgcgttcgccggcaccatcgtgatgtacgagggcgcccccgaccaccccgcccccgaccgcttctggcagctcatcgaggaccacggcatcacccagttcggcgtctccccgacggcgatccgtgcactgcgcgaccacggcgacgagcacgtcgccggccacgatctctcctcgctgcgcatcctggggtcgacgggcgagccctgggaccccgagtcctggcggtggttttacgaccacgtcggcggcggtgacaccccgatcatcaacatctccggcggcacggaagtgttcggctgcttcctcatgccgctgccgacggagtcgctgaaaccctgcacgctcggcggccccgggctcggcatggacatcgacatcgtcgacgacgacggcacctccgttcgggacgccaacgagcgcggctacctcgtcgcgcggtcgtccagcccgtcgatgacgcggcgcctctggagcggcgaggaccgctacctggaggcgtactggtcgcgcttcgaggacgtctggaaccacggcgactgggcgcagatggacgccgacggcgactggttcctccacgggcgcgccgacgacgccatcaacgtcgccggccgcaaagtcggcccggcggaggtcgagggcgcgctcatcgaccacgacgccgtcacacaggcggccgtcgtcggagtgcccgacgacaccaccggtgaggccgccatcgcgtacgtcatcctcgccgacgccgccaccccgagcgcggagctgcgcgcggaactgcgcgaccacgtcggcgacgcccacggcaaaccgttccggccccgggaggtggtgttcgtcgacgacctgccgaaaacccagtccgggaagctcgtgcgccgcgccgtcgccagcgcgtacaccggggcggacgtcacggaccgctccagcatcgagaaccctgcggtgctggacgcgctccgggacgcgacctag

SEQ ID NO: 42247 - DNA, 1176 bp, Halobacterium sp. NRC-1
atgagtgaggacttctacgacgtcctgggtgtgagccgggacgcgaccgaggacgagatcatgcaggcgtaccgggaccaggtttcggagtaccatcccgacgtcagcgacgacccggacgccgaggagaagttcaagaagattcagaaagccaaggacgtcctcaccgacgaggagacacgccagcagtacgaccagctcggccacgagcgcttcgaggaggccgagaagcgcggcgcaaccgggaacggtggcggcggcgctggcgggatgggcggtgcgggtggcccgttcggtggcggcatgggtggtggtgccggcggtggtatgggcgacatcttcgagcagttcttcggcggcgctggcggtggcggcggtcgcgggcggtccggcccggagcagggccgcgacctccggacggacctcacggtcacgctgtcggaagcctaccggggggtgtccaagcaggtgaccgtgcggcggcccgagagctgtgcggactgtgggggaagcggctacccggaggacgccgacgtgcgcacgtgcccgcagtgtgacgggcagggcgtcgtgacgcaggtgcgccagacgccgctgggccgcgtccagcagcgccaggagtgttcgcgctgtggcggcgagggggagttgcactcggagacgtgttcgacctgtggcgggcagggccagacccgagagcgcgcgacgctcacggtggacatcccggagggcatccggaccgggcagacgctgcgcatggacggcgagggcgcgccgggcgaaccgggcgcgcccaacggtgacctgctcgtcgacgtcaccgtcgaggagcatcccgacttcgagcgcgacggcgacgacctccatcaccgccacgccgtctcgttcccccaggcggtgttcggcgcggagatcgaggtaccgacgctcgacggcgctgcgacgttcgatctggacgccggcacgcaaagcggggagacgttccggctcaagggcaaggggatgccgcggctgcgccgccgcggcaacggggacctctacgtcaccgttcaggtggtcacgccggagtccctcagcgacgagcaacgcgacgccctcgaacagttcgcggaggcgggcggcgaggagatcgacgtcgagcaggggttcttcgagaagctcaaaaactccttttag

SEQ ID NO: 42248 - DNA, 1890 bp, Halobacterium sp. NRC-1
atggcgagcgagaagattctgggagtcgacctcggcaccacgaacagcgcgttcgctgtgatggaaggcagcgaccccgaaatcatcacgaacgaagaaggcgaccgcaccacgccgtcgatcgtcgcccacgacgacggcgagttgctggtcggcaaacccgcgaaaaaccaggcggtacagaatcccgatcagaccatcgcgtcgatcaagcgccacatgggcgaggaggactacacggttgccctcggcgacgacgagtacacgcccgaggagatctcggcgcgcatcctccagaagatcaaacgcgacgccgaggagtatctcggccaggacgtcgagaaagccgtcatcacggtgccggcgtacttcaacgaccgccagcgccaggcgaccaaggacgccggcgagatcgcgggcttcgacgtcgagcgcatcgtcaacgagccgacggccgcgtcgatggcgtacggcctcgacgaggaccgcgaccagaccgtgttggtctacgacctcggtggcgggacgttcgacgtgtcgatcctggacctgggcggcggcgtctacgaggtcgcagccacgaacggggacaacgacctcggtggcgacgactgggaccacgccatcatcgaccacctcgcggacaacttcgagaacgagcacgggatcgacctgcgggaggaccgccaggcgctccagcgactcacggaggccgccgaggaagccaaaatcgagctgtcgagccggaaggagacgacggtcaacctgccgttcgtcacggcgaccgactccgggccggtacacctcgaacaggacatcacgcgtgcgaccttcgagagcatcaccgaggacctcatcgagcgcacggtcggcccgacggagcaggccctcgaagacgccggcctctcgaaaagcgacatcgacgacgtgatcctcgtcggcgggtccacgagaatgccacaggtccaggcgcaggtcgaggacctcgtcggccaggagccgaagaagaacgtcaaccccgacgaggcggtggcgctcggcgcggccgtccagggtggcgtgctctccggggaggtcgacgacatcgtgttggtggacgtgacgccgctgagcctcggcatcgaggtcaaaggcgggctcttcgagcggctcatcgagaagaacaccgcgatcccgacgaccgcgtcgaaggtgttcacgacggccgccgacaaccagaccagcgtccagattcgagtgttccagggcgagcgcgagatcgccagcgagaacgagctgctgggggacttccatctcacgggcatcccgccggcgcccgcgggtacgccacagatcgaggtcaccttcgagatcgacgccgacggcatcgtcaacgtcgaagccgaagaccaggggtcgggcaacgccgagtccatcaccatcgagggtggggccgggctcagcgacgagcagatcgacgagatgcaggaggacgccgaggcgcacgccgaggaggacgagcagcgccgccgccgcatcgaggcgcgcaacgaggccgaaacggcgatccagcgcgccgagagcctcctcgaggagaacgaggagctcgtcgacgaggacctcgaagcggacgtgaacgacgccatcgacgacgtccaggcggtgctcgacgaggacgagccggagatcgacgccctcgaaacggccaccgaggagctcagtgacaccctccaggagatcggcaagcaggcctaccagcaacagcaggacgcccaggccggcgcggccggcggcgctggcggcatgggtggcatgggcggcatggccgacggccccggcggggcggccgacgccgacggcgacgacgaggagtacgtcgacgcggacttcgaggacgtcgacgaggagtaa

SEQ ID NO: 42249 - DNA, 1107 bp, Halobacterium sp. NRC-1
atgcgagaccggctgcttgatgccaacgcagagaacaacaaataccagcagaagctcgaacgcctctcacacgagaacaagaagctcaagcagtcgccgctgttcatcgcgactgtccaggagctcaccgacgagggggccgtgatcaaacagcacggcaacaaccaggaagcgctcactgaggtcacggacgagctgcgtgccaccctcgaaccgggctcgcgggtcgcggtcaacaactcgctgtccgtcgtccgccaactggacgacgaggcagacgtgcgggctcgtgtcatggaagtcgatgactcccccgacgtgggctacgaggacatcggcggcctcgacgaccagctccgggaagtccgggagacagtcgagcttccgatgaaagaccccggcctgttcgagaccgtgggcatcaacccgccgagcggcgtgttgttgcacgggccgcccggcacgggcaagacgctgatggcgaaggccgtcgccagccagacggacgccagcttcatcaagatggccggcagcgagctcgtgcacaagttcatcggcgagggcgcgaagctcgtgcgcgatctcttccaggtcgcccgcgaccacgagcccgccgtcgtgttcatcgacgagatcgacgccatcgcctcgaagcgcacggactcgaagaccagcggggacgccgaggtccagcgcacgatgatgcagttgctctcggagatggacggcttcgacgagcgcggcgacatccgcatcatcgccgccaccaaccgcttcgacatgctcgaccgcgcgatcctgcggcccggccgcttcgaccgcctcatcgaggtcccccacccgaacgtgggcggccgcgagaagatcttccgcatccacacgcgggcgatgaacgtcgccgacagcgtcgacttcggcgagctcgccgccgacaccggggatctctccggtgcggacgtgaaagcgatctgtacggaagccgggatgttcgccatccgcgacgaccgcacggaggtccggatgcaggacttccagtcggcacgcgagaaactcgatcaggactccgagcccgccgccgccacggacgtctcccggacgttcgcgtag

SEQ ID NO: 42250 - DNA, 2652 bp, Halobacterium sp. NRC-1
atgaggttcacgcgcctctccctgtcgaacttcaaatgctacgcggacgccgccgtctccctggaccccggcgtgaccgtcatccacgggctgaacggcagcggcaagtccagcctgctcgacgcctgctttttcgcgctgtacggcaccaccgccctcgacacgaccctcgctgacgccgtgacgatcggcgcggagacggccgagatcgacctccacttcgagcacgccggcggcgactaccacgtccaccgccggatccgtgcgtccggcgggcgcgcccagaccgccgcctgtgtgctggagactccgaccgaccggatcgacggcgtcaccgacgtcgaagcccacatctcggggctgttgcgcatggacgccgaggcgttcgtgaactgcgcgtacgtccgccagggcgaggtgaacaagctcatcaacgccgccccgagcacgcgccaggacatgatcgacgcgctcctccagttggggaaactcgaggagtaccgccagcgcgccggcgacgcccgcctcggcgtcgaggacgtcaagagcaacgtcgaggggcaactcgacaggctcgccgaccagatcgctgacaaggaggccgccgacccccacgaccggctggcgagccacaacaccgcgctcgccgaggtcaccgccgacatcgagcatttcgaggccgaacgcgagcaggccaggcagacccgcgacgacgccgcggacgtcctggagcgctacgaggagtcacgcacggcgctcgcggacgtcgaggagacgatcgccgacgtccgcgaggccgtcgccgaggccgaacgcgaacgggagacgctcgccgaccgcgtcagcgaccaccgcgagcgcgccagcgatctcgacgacgaggcagcggcgctcgcggccgatctcgggctcgacgatccggacgccgaggacgccagcgcggagcgcgacgccgttgccgaccagcgggaggcggtcgccgaacgggtgcgcgaggtcgcaccggctgtctcccggctcaccgagcaggccgacagcgccgccgacgacgccgccaccctcgacgagcgcgccgagacgctgcgcgaagaggccgcagccctcgacgccgaggccgacgacgcagcggcgaaacgcgacgacgccgccgcccgcatcgaggcgttggacgccgacatcgaggcggcgatggcggctttcgacgacgcgccggtcgcgttcggggccgccgaggcgttcctcgacgacgcgacggccgaacgcgacgaactgcgcgagcgggtggcgacgctccgcgccgaccggcagtccgctgccgaccgcgtcgccgaggctgaggcgctgctcgacgaggggaaatgccccgaatgcggacagccggtcgagggggcaccccacgtcgagcgtgtcaccgacgaccgcgagcgcgtcgccgagctcgacgccgagttggcggacgtcgaggacgaactcgacgcggtggcccagcgcgtcgaccgcggcgaatcactggtggccgccgaagaccgggtcgacgacctcgaacaacaacgcgagcgcgccgtcgagcgccgcgacgagcaggccgacatcgcggacgcgaaacgcgaccaggccgccgaaaagcgcgaccgcgccgcggacctcgacgccgaggccgaggacgcccgtgcggacgccgcggccaagcgtgatgcggccgacgagaagcgcgagacgctggcggcgctgaacgccgaccagaccgccctcaaggagcgactggacgcgcttgcggatctcgtcgaccgcctcgaagcggccgccgacgcccgcgaagccgcccagcggctggccgagaagcgcgcggcactggccgcccagaacgagcagcgccgggaccgcctctcggagctgcgcgagcgcaagcgcacgctggacagtgagttcgatgcggaccgcatcgagacagcgcgcgccgacaaggaccgcgccgaggactacctcgaacaggtcgaaccgaaactccaggcgctgcgcgaggaccgcgacgacctccaggcgaagatcggcgctgcggagaacgccatcgcggagctggagtcgctgcgcgaggagcacgagcgcgtgcagtcacgccaccaggacctccaggcggtccacgacgaggtgaccgcgctcgagacgatgtacggggagttgcgggcggagctgcgccaacagaacgtctcgaagctcgaacgcctcttgaacgagaccttcgagttggtctatcagaacgactcctacgcccgcatcgagctgtccggcgagtacgagctcaccgtctaccagaaggacggcgagcccctggagcccgcgcagctctcggggggcgagcgcgcgctgttcaacctcagcctgcgcactgccgtctaccggctgctggctgaggggatcgagggcgacgcccccctcccgccgctgatcctggacgaaccgactgtgttcctcgactccgggcacgtctcgcagctcgtggaactggtggagtcgatgcgacggctcggcgtcgagcagatcgtggtcgtgagccacgacgacgagctggtggcggccgctgacgacgtggtgcgggtcgcgaaagacgccacgtcgaaccggtcccgtgtgtccacccccgaacacatatga

SEQ ID NO: 42251 - DNA, 2706 bp, Halobacterium sp. NRC-1
atgggaaacaccgagctctccgagttcatgcacgagagcgacggggcagacgaccccggggaggacgcgatccaggaagaagccgcggtcgtcgccggcgacgccgaccccgtcgtcaacgaggtgctgacggcggaagcggacgcgctgcccgacgccaccggcgaggtcgaactgatggtcacacaggtcgattacacgatcgagggctcgggcgaccgcgagcgccccgtcctccacgtcttcggccgcacgaccgacgacgaggccgaacacgtccgcgtgcacggctttcggccgtacttctacgcaccgacggccacgctctccgaagacgacctcaccgacgacgtcatcaccggcaccgaggacggctacgaatccatccggggcgaagcgctgacgaagatcttcggccggacgccccgcgacgtcgggaacatccgtgacgcgttcgatcactacgaggccgacatcctgttcccgaaccgcctgctcatcgacaaggacatcaccgacggcgtcagggtgcccgcccggcgcgccgacgacggcgcgctctacgtccaccacgacgaaatcgcggcctgtgaggtcgccgccgacctgcgcgtgaacaccttcgacatcgaagtcaacgaccgcaacggcttccccgaggacggcgaggagcccgtggtctgtctgaccagccacgactcctaccgcgacgaatacgtcgcgtggctgtacgccgccccggacgcgacggtcgacgcccccacagcggtcccgggctacgacccactgaccgacgacgccgacatcgacgtgcgcgtgttcgacaccgaggaagccatgcacgacgcgttcctctcgtacatcgaggacaccaaccccgacgtgctcacgggctggaacttcgacgacttcgacgccccctacctcatcgaccggctggacgaactcgacccacgaaccgaccacgacctcgactccgaccgcctctcccgcgtcagcgaagtctggacgtccggctggggcggcccgaacgtgaaaggacgggtggtcttcgacctgctgtacgcctaccagcgcacgaaatactcggagctggactcctaccggctggacgccgtcggcgaacaggagctgggcgtcggcaaagagcgctaccccggggatatcggcgacctctgggaggacgaccccgagcgcctcctggagtacaacctccgggacgtcgagctctgcgtggaaatcgaccgcaagcagtccatcgtggcgttctgggacgaagcccgcaagctcgtgggctgcaagctggaggacgccacgacccccggggacgcggtggacatgtacgtcctgcacaaggcgttcgggaacttcgtgttgccgtcgaaaggccaacaggacgccgaggagttcgagggcggcgcggtcttcgaccccatcactggcgttcgggagaacgtctccgtgctggacctgaagagcctctacccgatgtcgatggtgaccatcaacgccagcccggagaccaaagtcgaccccgaggagttcgacggcgacacctaccggacgccgacgggcgtccacttccggaaggaacccgacggcatcatccgggagatggtcgatgaactcctcaccgagcgcgaggagaagaaagcacgccgcgacgaccacgagccggacagcgaggactacgagcgctacgaccgccagcaggccgccgtgaaggtcatcatgaacagcctctacggcgtgttcggctgggaccgcttccggctctacgaccgcgcgatgagcgcgggcgttacctccacgaaccgcgaggtcatcgacttcaccgagcaggccgccgaggagttcggctacgaggtcgcgtacggcgacaccgacagcgtcatgctcgaactcggcgacgacatgacgaaagcggaggccatcgcggagtcgttcgacatcgaggaccacatcaacgccgcctacgacgagttcgcccgcgagcaactgcacgccgacgaccaccgcttccagatcgagttcgagaagctctaccggcggttcttccaggccggcaagaagaagcgctacgccggccacatcgtctggaaggagggcaaggacgtcgacgacgtcgacatcacgggcttcgagtaccagcgctcggacatcgcgccgatcacgaagcgcgtccagaaggaggtcatcgacctcgtggtgcgggagggcgacgtggacgccgtcgaggagtacgtccacggcgtcatcgaggagttccaggagggggatgcggatctggacgacatcggcatcccgggcggcatcggcaaacgactggacaactacgagacggacaccgcccaggtgcgtggtgcgaagtacgccaacctgctgttgggcacgaacttcgaccgcgggtccaagcccaagcggctctacctcgcgaaagtgcatccggacttctggggtcacgtcgaagacgaacagggcatcgacacgagcacgagcgaccgctaccgcgagttccgccgggatcccgacgtgatctgttacgagtacgccgaccagatcccggacacgttcgtcgtcgactacgacaagatgctcgataagacgctcaaaggccccatcgagcgcatcctcgaggcgcttgatctctcctgggacgaggtgaaatccggccaaacgcagaccgggctgggccagttcacgtag

SEQ ID NO: 42252 - DNA, 744 bp, Halobacterium sp. NRC-1
atggaaacggctccgctcgacggcgacgtcgccgtcatcactggcgcatcgagtggcatcggggaagcaaccgcacacgcgctcgccgagaacggcgcgacggtcgtgctcgccgcgcgcagcgaagagacgctcaccgagatcgcggacacgatcacggcaacgtacgacactgccgcccacgccgtgcccaccgacgtcaccgaccgggcggccgtcgacgcgctcgtcgagacggccgtcgaggagtacggcagcctggatctcctcgtcaacaacgccgggctcgcgcgcggcgacgacgtcgcggccctcaccgacgacgagtaccgtcagatgatggccgtgaactgcgacggcatgttctacgccacccgggcggcgctcccgcacctcaccgacgccgacggcaccatcgttttcctgggtagtttcgcggggcagtacccccgccccagcaatcccgtctacgccgcgaccaaatggtggacgcgcgggttcgcccacagcgtcgaggcgcgctacggcgacgacggcctgggtgtcaccgtagtcaaccccacggaggtgcgaacccggttcaacgacgaagacggcaccgccttcgaggaggcctacgacgaagccgaggtgtcccggccgaccgacatcgccgacgccatcgcgttcgcggcgacccagagtgcgcccacggtggcgagcgagatcgacatgtaccgccaggacaagttctcggagttctag

SEQ ID NO: 42253 - DNA, 804 bp, Halobacterium sp. NRC-1
atgaaatacgagggctggcccgacgagggcgaactggtcgtcgggaaagtcgacgacatcgaggacttcggggttttcgtcgacctcgaacagtaccaggacaagcgtgggctggtccacgtcagtgaggtcgccagcggctggatcaagaacgtccgcgaccacgtcaacgaggaccagaccgtcgtcgcgaaggtgttgggcgtcgacgagtccgcccagcagatcgacctgtcgttgaaagacgtcaacgaccaccagcactcggacacgatccaggagtggaaaaacgaacagaaggccgacaagtggctgaccctggcgttcggcgaggacatggccgacgaccagttccgccgcatcgccaacggcctgctggcggacttcgggagcctctacgacggcttcgagcaggcggccatccacggccacgaggcgctggctgacaccgccctcgaagacgacgagatcgacgccatcgtcgagaccgcccgcgacaacgtctccgtgccgtacgtcacagtcacggggtacgtctcgctgcagtcgccggacggggacggcgtcgacacgatcaaggacgcgttacaggccgcggagggcaacggcgaggtgcccgacgaggtcgacctggacgtgacgtacgtcggtgcgccggagtaccggctgcgcgtgcaggcaccgaactacaagaccgcggagtccgcgctcgaggcggccggcgaccgcgccgtcgactcggtcacggcccacgacgggagcggcgcgttccaccgcgagcgccagctcgacgacgacgcgtaa

SEQ ID NO: 42254 - DNA, 567 bp, Halobacterium sp. NRC-1
atggatcggctcaagcagtccctgctcgatgcccccatcatcgagaaggacggttaccattatttcgtacatccgatcagtgacggcgtcccgatgctggagccggagttgctgcgggagatcgtcattcgcatcattcggaaggccgagctcgacgaggtcgacaagatcgtcacccccgcagcgatggggatccacatctccacggcggtctcgttgatgaccgacatcccgatcgtggtcattcggaagcgcgagtacgggctgcccggcgaggtcgcgctcagccaggagacgggctactcggagaacgagatgtacatcaacgacgttcacgagggcgaccgcgtgctcgtgctcgacgacgtgctgtcgaccggcgggacgctgcgcgcgatcacggacgccttggagcagaccggcgcggacgtcgcggacgtgctggcggtcatcaagaaggcggggccgaacgagctcgacgacacggacatggacgtgcggacgctgatcaacgtcgacgtggcggacggcgaggtcgtcgtcgtcgacgaccagggcgatcactga

SEQ ID NO: 42255 - DNA, 1005 bp, Halobacterium sp. NRC-1
atgcgcgcgacacccccgcatcgacgtatgaaagcaaccgcgcgcgcacaccccatccagggcctcgtgaaataccacgggatgcgcgacgagtcgcttcgcatgccgtaccacgactccatcagcgtctgcaccgcgcccagcaacaccacgacgaccgtcgagttcgatcccgaccgcgacgccgaccagtacgtcgtcgacggcgacacggtcaccggtcacggcgcggaccgcatccgcagtgtggtcgatgcggtccgcgaccgcgccgggttcgaccaccgcgtgcgcctggagagccagaacagcttccccacgaacatcggcctggggtcgtcgtcgtcggggttcgcggcggccgcgctggcgtgcgtccgcgccgccggcctggatctggacctcccgacggtgtcgacggtcgcgcgccgcggatcggcgtcggcggcccgcgccgtcacgggcgggttctcggatctgcacgcgggattgaacgacgccgactgccgcagcgaacgcctcgacgcccccgcggagttcgcgtccgatctgcgcatcgtcgtgggcgaagtgcccgcgtacaaggagacggagtctgcccacgccgaggccgccgacagccacatgttcgacgcgcggctggcacacgtccagggccaactcgcggagatgcgtgacgccgtccgcgcgggcgacttccagcgcgtcttcgagaccgccgaacacgactcgctgtcgctcgcggcgacgacgatgacggggccgtccgggtgggtgtactggaagcccgagacgctctcgatattcgagaccgtgcgggagctccgggcggacggcgtgccgacgtacttctcgacggataccggcgcgacagtgtacgtgaacaccactgcgagtcacgccgacgaggtcgaggctgcggtcgccgactgcggcgtcgacaccgccgtctgggaggtcggcgggcctgcccacgaactcgacgagcgcgacgcgatcttctga

SEQ ID NO: 42256 - DNA, 1119 bp, Halobacterium sp. NRC-1
atggacgacgggacgattgagacgttcaaagccttccgttcgcagttcaacggggaccgcggcccctacaagggcggcattcgctaccacccgggcgtcacccgcgacgaggtgaaagcgctctcgggatggatggtgtacaagaccgccgtcgcagacatcccgtacggcggcgggaagggcgggatcatcctcgacccagaggagtactccgacagcgagctcgaacgcatcacacgcgcgttcgccacggaactccgcccgttcatcggcgaggacaaagacgtgcccgcacccgacgtgaacacgggccagcgcgagatgaactggatcaaagacacctacgaaaccctcgaagacaccaccgcgcccggtgtcatcacggggaaggcgcttgagaacggcggcagcgagggccgggtgaacgccaccgggcgctccacgatgttcgccgcccgcgaggtgttcgactacctcgatcgggacctcagtgacgccaccgtcgccgtccaaggctacggcaacgccggcagcgtcgccgcgaagctcatcgccgaccagggcgcggacgtggtcgccgtctcggactcctcgggcgcggtccacaaccccgacgggctggacacgcgcgcggtcaaagcattcaagacggagaccggcagtgtctccggctacgagggtgccaccgaggagctctcgaacgaggccctgctcacgatggacgtcgatctcctcgtgcccgcggcgctagaaaacgccatcgacgaggacctcgcccacgacgtcgacgccgacgtcgtcgtcgaggcggccaacggcccgctcacccccgacgccgacgacgtgctcaccgagcgcggcgtcaccgtcgtcccggacatcctcgcgaacgcgggcggcgtcaccgtctcgtacttcgagtgggtgcagaaccgccagcgcttccagtggaccgaggaccgcgtcaacgaggagcttgaggccatcatcacggacgccttcgacgcgatgaccgacgcccacgaggacgccggcacgccgaacctccgcaccgccgcctacgtggtcgccgtccagcgcgtcgtcgacgcctacgagggcagcggtagctggccctga

SEQ ID NO: 42257 - DNA, 1143 bp, Halobacterium sp. NRC-1
atgaacttcagcaccagagtcacgagcgttgaaccgagcgcaaccctcgcggtgagcactctcgcgagcgaactggaagccgacggcgtcgacgtggtcgatctgtccgtgggcgaacccgacttcgacacgccggagagcatcgtggacgccgggaaggcggcgatggacgccggccacaccggctacgcgccgtccaacggcgtgcccgaactccgggacgcgatcgcggagaagctgcagggcgacggcctcgactacgaggcgggcaacgtcatcgtgaccccgggcgcgaagcaggcgctctacgagacgtttcaggcggtcgtcgacgagggcgacgaggtcgcgttgctggacccggcgtgggtgtcctacgaggcgatggcgaagctcgcgggcggcgagctgaaccgcgtcgacctcgcgccccacgacttccagttggagccggcactcgacgacctcgcggacgcggtctccgacgacaccgagttgctggtggtgaactccccgagcaacccgacgggtgcggtgtactcgcgggcggccatggagggcgttcgcgatctcgccgtcgaccacgacatcacggtgatctccgacgagatctaccagcgcgtcaactacggcccggcgcacgtgagcctcgcgggcctcgatggaatgttcgagcgcacggtcaccatcaacgggttctcgaaggcgtactcgatgaccgggtggcgactcggctacctcgccggccccgaggcgctcgtcgatcaggccgggaaggtgcagtcacactccgtctcgtcggccgcgaacttcatccagcgcgccggcgtcgaagccatccggcacaccgacgacgccatcgacgagatggtcgccgccttcgaatcgcggcgggacctgctcgtggacctgttcgccgagcacggcaccgacgtctcgacgcccgacggcgcgttctacctgatgctgccggtcgccgacgacgaccaggcgtggtgccaggacgcgctcaaagacgcccacgtcgcaaccgtgcccggatcggcgttcggcgcgcccggctacgcgcgactctcctacgcggcgagcaccgaccgcctcgaagcggcagtcgatcggctcgcggccgaaggctacctgtag

SEQ ID NO: 42258 - DNA, 897 bp, Halobacterium sp. NRC-1
atggactcggtactggttgccgacgacgtggccaagtcgtacggcgacgccgccgctcttcgtggcgtatcgttgtccgtctccgagggggaggtgttcgccctcgtcggcccgaacggtgcggggaagaccacactcgtgcggtgcctgaccggcacgacgacgcccgacggcgggcgcgtcgaactgctcggtgagccaccccaggacgcgcagaaacagcgcctggggctgctcccgcagtcgttttcgccaccggaccgcctgaccgccgccgagctcgtcgggtattacgcggggctgtacgccgacagccgcgcccccgacgccgtgctcgaatcggtcggcctcgaccccgacgacgcgacccggtacggtgatctctccggcggacagcgccgccgagcctgcgtcgccgccgcgctggtgaacgacccggacgtgttgttcctggacgaacccacgacgggcgtcgacccggcgggccgacacgccctctggtcggtgttcgaggggctcgcggccgacggcacgacgatcgtgttgacgacccacgacatggccgaggcgagcgcgctcgcggaccgcgtcggcctgctcgccgacggcgacatcgccgccaccggaacccccgcggacctcgtggcggcgcacgccggcagcccgcggctggtcgtcgacaccgacgccgacccagagcttgccggcttcgattgcacgcgcaccgatgcggggctcgtcttcgagggcgtcgaccccaccgcagtgggcgagatcgccgccgcgctcgacgacgcggacgtggccttcgacgcgctgtcgtggcgcgagcccagcctggaggacgcctacctggcgctcgccggtgacgccgagcgcggggaggtggtgcaatga

SEQ ID NO: 42259 - DNA, 1188 bp, Halobacterium sp. NRC-1
atgacagacgcgcgcgtagctggcgtggggttgacccacttcggtgtgcatcccgagcggacgagccgcgacctgttcgcggaagccgggctggcggcgctggacgacgccggcgtcgcccgcgaagacgtggccgccgtgcactacggcaacttcatgggggagttgagcgagcaccagggccaccaggggccgctggtcgcggaggcgctgggcctcgacgtgcccgcaacccggtacgagtcggcgtgcgcgtcgagcggcgtcgcgctccggcgcgccgtccgtgacgttcgcaacggcgaggctgacgtggtggttgtcggcggcgccgagcgcatgaacaacctcgaaaccgccgaatcgacggacgcgctggcgatcgcggccgacggcttgtacgaggtgcgcgcgggcatgacgttccccggcgcgtacgccctgatggcggcgtcgtacttcgagcagttcggcggcagccgggaggacctcgcgcacatcgccgtcaaaaaccacgccaacgcggtggacaacgaccgcgcgcagtaccagcaggcgatcaccgtcgcggacgccctggagtcgccgccggtcgcggaaccactgcatctgtacgacgcgtgccccgtcaccgacggcgcgagcgcgctcgtgctcgtgagcgagtcgtacgccgacacgcacgacgtcagcgcaccggtcgcggtgaccggcaccggccagggcggggacaagatggcgctccaggaccgccagaacatggcgacctcgccggccgcgaccgacgccgccaccgaagcctacgcggacgcaggggtgtccgccgacgacgtggacgtggcggaagtacacgactgtttcaccatcgcggaagtgatggcgacggagtcgctgggctttttcgaccccggagccggcatcactgccgcgcgcgagggtgtcacgaccaaagacgggcggctgccggtgaacctctcggggggcctgaaagccaagggccatccggtcggcgcgaccggcaccagccaggtcgcggagctcaccaggctgctgcgcggcgaccacgtcaacagcgagcacgtcgcggacgcacagaccgcggtcgcgcacaacgccgggggcacggtcgccagcgccgtcgtgcacgtgcttgagacggtcgcggacacggaggcggatgcggcatga

SEQ ID NO: 42260 - DNA, 1194 bp, Halobacterium sp. NRC-1
atggggttccgggatgccaacagtaaagggcagaccgacaaagcataccacatggatttcacgcgctccgccgaacacgaccagatcgcggagatggtcgcggagttcgtcgacgaagaggtcaaaccacgggccgctaccatcgataaggccgacgagttccccgccgacctggtcgcggagatgagcgatctgggactgatggggatgccgttccccgaggagtacgacggcgccggcctcgactaccacacgtacgccaccgcgctgtcggagatcgcgcgcggcagcggcgggctggggacggtcgtggccgcgcacacgagcctcgcggggaacatggtctacgagtacggcagcgacgaccagaaacacgactacctcgcgccgctcagtcgcggcgacgacatcggcgcgttcgcgctctcggaggccggcgcgggctccgacgtgccggccatggagaccaccgcacagcgcgacggcgacgcgtacgtcatctccggggagaagctctggatctccaacggcagcgtcgcggacacggtgacggtgttcgcgaagaccgaccccgacgccggccaccgcggcatctcgtcgttcatcgtgcggcccgccgaggacgacggcttcatcgtggcgggcaccgaggacaaactcggcgacaagggctgccccacggcggagctccggttcgacgacatgcgggtacccgccgaccgcctgctcggcgaggagggcgacgggttcaaacacgccctggagacgctgaacggcggccgcatcacgatcgcggcgcggtcggtgggcctggctcgcgcggcgctcgacgacgcccgggagtacgcacaggaccgcgaccagttcgggcaggcgatcagcgacttccagaccatccagcacaagctggcggacatggacaccaaactccaggccgcggagctgctgatgcacaaggccgcggacctgaagatccgcggggagtcgttcatcaaggaggccgcacaggcgaagctgtacgcctcggagatctcccgggaggtcgccaacgagggcatccagatccacggcggctacggctacaccaaggacttcgacgcggagcggtactaccgggacgcgaagctcaacgagatctacgagggaacgtcggagatcctccggaacacgatcgcgaacgagctcctcgaatag

SEQ ID NO: 42261 - DNA, 1173 bp, Halobacterium sp. NRC-1
atgctttgtcggtctgccctttactgttggcatcccggaaccccatcgcggggcgcgatgatcgcagtgggcgacgggtcgacgccccaacctcttttgtattcccccaccctagcccgaccacgagtgatggacggccgtcagtcccaccagccgaccgcgtcggaccgcgagtggtgccacagcgcggtacaggacgtttcacgtacgtttgcgctcaccatcgacgccctcgaagagccgatggcgacgcgcatctgcgttggctacctcctgtgccgggttgccgacaccgtcgaggacgccaccgcgatgccgcccaccgaacaagcacagctcttggagacgtatgacgccgcgctcgatcccgactgcgggacgaccgtcgcggagttccaggccgccgtcggcgaccacgtccccagcgagccgaacgccgattggcgcgtcgtcgccaacaccacccgcgtcgtctccgcgttcgagtccctggacgacgccgccaaggccgcgatccggccgacggtccgggagatggccaccgggatggcgtcgttcgtacagcggtacgccgacgccggcgggctccgcatccaatcaccaaccgagctcgaagagtactgctggtacgtcgccggcaccgtcggcgaactcgtcacggagctgctggcccgcgacgcgcccagcgacgccgccgccgccatgcgcgagaacgcgcggtcgttcgcgttgctgttgcagctcgtgaacgtcgccaaagacgtccgcccggactacgaggaggagaacaacgtctacctgccacaggagtggctcgacgaccacgacctcgccccggaagacgtcgccgaccccgaacacgcgggccgcgtggcctccgtcgtcgagcgcgtcaccgaccgcgcccgcggctacgtcgccgacgcccagcgctggcttgaggtcatgccgaccagccagggcaacacgctcgccgcgtgggcggtgccgttcctgcttgcggtcggcacgatgcgggagctcgggaaccggcccgccgacgtcgtccgcgagggggacgtgaaagtcgaccgcgaggaagtgcacgccgtcatcggcctggtcgccgacgatttcgaccgcagcgccatcgacagcgtgcgcgaacggatcgcgaccgagtcgctgtcctga

SEQ ID NO: 42262 - DNA, 861 bp, Halobacterium sp. NRC-1
atgcgatcactcgcagacacggagacgatcggcgttgttggcgcgggcaccatgggcgccggaatcgcgcaagtcgcggcgaccgccggctacacggtcgtgatgcgcgacatcgaacaggagtacgtcgacgccggcttcgacagcatcgaatcctcgctcgaccgcttcgtctcgaacgacgacctgagcgaggccgacgccgacgccatcgtcgaccgcatcacgggcacgaccgacctcgcggagctcgccgactgcgacgtcgtcatcgaggccgccgtcgaggacatggagatcaagcaggacatcttccgcgacctcgacgacgccctgcccgaggacgtggtgttggcgacgaacacgtccacgctgtcgatcaccaccatcgcgtcggtcaccgatcgggcgtcccgcgtcgttggcctgcacttcatgaacccggtcccgatcatgaccggcgtcgaggtcgtcgtcggcgagaaaaccgacgccgacgtggtggcgttcgcccacgccctcgccgaggacctcgacaaggagacctgggagtccgacgacaaacccggcttcgtcaccaaccgcatcctgatgccgtggatcaacgagggcgtccgggcgttcgacgaaggagtggccagcaaggacgacatcgacaccggaatgaaactcggcaccaacgtccccatgggacccctggagctcgccgaccacatcggcctcgacgtctgcctggacgccagcgaaacactccacgaggagctcggcgaccggtacaagcccgcgtacctgctgcagcgaaaggtcgacgccggcgacctcgggaagaagaccggtgcgggcttctacacgtacgactga

SEQ ID NO: 42263 - DNA, 864 bp, Halobacterium sp. NRC-1
atggccgacgtcatcgacgccgtcttcgatgcgatcgcggacgccgcccccgaggtccgcgcggggctgcccgaccaccgcgcgacccgtgacgaccagaacgcctccggagacacccaactggaggccgacgtgtgggccgacgacctgctgttcgaccgcaccgagtccatcgagggcgtgaactggtacgccagcgaggagcgcgacgccgtcgtcacggtgggcgacgccgaaggcgggtacgccgtcgcactcgacccccttgacggctcctcgaacgtgaaatccaacaacccctgtggcaccgtcgtcggcatctacgaccagccgctgcccgcgcccggctccagcctcgtcgccgccgggttcgtcctctacggacccacgaccaccatggtcgtcgcgcgcgacgacaccgtccgggagtcactcgtctccgagacgggggccacaaccgacctcggccccgtcgagttgccggccgaccccaccgtctacgggttcggcggccgggtccccgactggacgccggcgttcgagtcgttcgtccgggacgtcgaagacgacctgaagctgcgctacggcggcgcgatgatcgccgacgtgaaccaggtgctggtctacggcggcgtgttcggctaccccggcatggagtccgcgcccgacggaaagctccgcgcgcagttcgaggcactgccgatcgcgtacatcgtcgaaacagccggcggcgcgtcctcggatggcacccagtcgctgctggacgtggcaccgacacgcctccacgagcgcacgcccacgttcgtcggcaccgacgacgtgatcgcggccctcgacgcggcgcttcccgaccacacgaattaa

SEQ ID NO: 42264 - DNA, 864 bp, Halobacterium sp. NRC-1
atgatctccgtgcaacgcctagaaaaacggtacggcggcgtcaccgccgtggacggcgtctccttcgacgtcggtgccggggaagtcttcggactcgtcggccccaacggtgccggcaagacctccacgctgaagatgctctgtgggctcgttgagccgtccgccggcgacatcaccgtcaacgggttcgacgccggcgacacggcgatgcgccgcaccctcgggttcctgccagaggagtcgccgctgtacgacgaaatgacgccccggagctatctgcggtttttcgcggatctctacgacgtggaccgggcgaccgcaaacgagcgcatcgaggccgccctcgatcgcctcgacctcgacgcccgtgaccgtcccgtcggcgacttctcgaagggcatgacccggaaggtcgcgatcgcgcgctcgctggtcaacgaccccgacgtgctggtgtacgacgaacccgcaagcggactcgatccgctcacgacgaacaccgtcatcgagttcacccgcgaactcgccgccgacggcaagacgatcgtgttcagcgcccacgacctccaccacgtcgaaagcgtctgtgaccgcgtcgccatcatgcgggacggacagttcgccgccaccggcacgctggccgacatccgcgacgaacacggcgaggtctcctatcgggtgttcaccgacgtcgacgtcgacgacgcccggccgtctaatggccgctacgtcaccaccgtcgattcgatggccgacgtcgacgcgatccgggctgcggccgccgacgccggcggcggcgtggtcgacatccgaaccgacgagtccacactcgaagacgtcttcctcgacgtgaccggcgcatga

SEQ ID NO: 42265 - DNA, 2574 bp, Halobacterium sp. NRC-1
atgacgaccagaacagcgcggatcgatgtcggggggatgtcctgtgcgaactgctcgggcaccgtcgaggacgccgtgggcgcgctcgacggcgtcaccgacgcgaccgcgaacttcgccaccgacgccgccaccgtcacctacgatcccaccgccgccgacctggcgggcgtctgtgccgcgatctcggacgccggctacaccccgatcacggccgacaccacgatcccggtccacgggatgacctgtgcgaactgcgcgcagacgatcgaagacgccgtcgccgacgcccccggcgtcctggacgtgtccgcgaacttcgccaccgacgacgcacacctcacgtacgtccccgcagcgttcgaccgggacgccgtccacgccgccatcaccgacgccggctacgaccccatcgatgccgactccgacaccggtgccagcacccagaccgccgccgacgaggcccgggacgcggagcggcgacgacaacgcatccgcctggcgttcggcgcggtgctgtcggcgccgctcctgtttttcgtcgccgacaccttcctgttcgggggcgctgtcgttcccgacagcttcaccgttggcggcctcacgatcccgttcgggtgggcggagttcgcactggcgacccccgtctacgtcgtcctggggcggtcgtttctcagcaactcgtatgcggcgctcgtgcgcaacggcaccgcgaacatggacgtcctcgtggcgctggggtcgacgaccgcgtacgtgtactcgctcgcgtcgctgctcggcgtcctggccggcggcggcctctacttcgacacggcggcgctcatcctcgtgttcatcacgctcgggaactacctcgaagcccgctcgaagagccaagccagcgacgccctccgggagctcctggagatggaggccaacaccgcgcgcctcgtcgacgccgacggcgagacacgcgagatccccgccgacgacgttgaggtcggcgaccgcctgaaagtcaaaccgggcgagcagattccgaccgacggcgtcgtggtgtccggggagtccgcggtcgacgaatccatggtcaccggcgagtccgtgcccgtgtccaaggcccccggcgacgacgttgtcggcgccacgatcaacgagaacggcgtgctcgtcgtgcaggccacgaaggtgggggcggacaccgcgatccagcagatcgtcaccacggttcgggacgcccagtcccgccagccggacatccagcgcctggccgaccgcatcagcgcgtacttcgtccccgcggtcatcgccaacgccgtcttctggggggcggtatggtggttcgcccccgggctgctggctgacgtggtgtcggcgcttccgctgtgggggctcgtcagcggcggcccggcggccgtcggcaccggcgagttcgccgtcgtcgtgttcgcgtccgcagtcctcatcgcgtgcccgtgtgcgctcgggctcgcgacgccggccgcgacgatgatcggcacgagcatcggcgcgaaacacggcgtgctcttccagggcggcgatgtcctggagcgcgtgaccgagttggacgcggtcgtgttcgacaagaccggcactctgacgaccggcgcgatggagctcacggacgtcgaggccgtcgccgccgtccccgacggcggcaccgccacccggagcgacgccgctgtcgacgaggacgccgtgctccggctggccgccgccgccgagtccaacagcgagcacccgctcgggaccgccatcgtcgcgggcgccgaggaccgcggcctcgacgttcccgcagtcgatgccttcgagaacgtccccggcaaaggcatcgtcgcgaccgtcgacggtcgccgcgtccgcgtggggaaccgcgcgctcctcacgagcgcggacatcgacccggcgcccgccgccgacgccatggaacgcctcgaacgcgaggggaagaccgcgatgctggttgccgtcgacgaccgggttgccggtgtcgtcgcggacgccgacacggtcaagcccgaggcagccgccaccgtcgacgccctccaggatcgcggcctcgacgtgcacatgatcacgggcgacaacgaacgcaccgcgcgcgcggtcgccgccgacgtgggggtctcgcccgagcacgttcgggcgggcgtgctccccggggagaaagccgacgccgtcgacgccatccaggcgggcgacgccgacgccatgatggtcggggacggtgtcaacgacgcccccgcgctcgccaccgcgcacgtcggcgccgcgatcggatcgggcaccgatgtagcgatcgaggcggcggacgtgacgttgatgcgcgacgaccccgcggacgtgatccaagccatccgcatcggcgagggcacgctcgcgaagatcaaacagaacctcttctgggcgctgggctacaacaccgcgatgatcccgctggcctcgctggggctgcttcagccggtgttggcggccggcgcgatggcggtgtcgagtgtcagcgtgctcaccaacagcctgctcttcggcaggtacacgcccgacgaggattactcgctgctcggtcgctag

SEQ ID NO: 42266 - DNA, 978 bp, Halobacterium sp. NRC-1
atgagtgacagtacaatcagaacatacagcagcgaccagcgccagacagacaacgacgagacagtatcgacccccgacgaagacgtcctgacctgcccggagtgtggcgggcaggtcatcgacgacgaggagcacggcgagtcggtctgtgtcgactgcgggctcgtcgtcgaggagaacggcatcgaccgcggccccgagtggcgcgcgttcaactccacggagaaagacgagaaatcccgcgtgggcgccccgaccacgaacatgatgcacgacaaggggttgtccacgaacatcggctggcaggacaaggacgcctacgggaacagtctctccagcaaccagcgccagaagatgcagcgcctgcgcaagtggaacgagcgcttccgcacccgcaacagcaaggaacgcaacctcaagcaggcgctcggcgagatcgagcgcatggcctccgcactcgggctgcccaaggaggttcgggagaccgcgtcggtgatctaccgccgcgcgctcagcgaggacctgctgcccgggcgctccatcgagggcgtcgccaccgccgccctgtacgcgtccgcgcgccagctcagcacgccacgctccatcgacgaggtggcgaacgtcagccgcatcgacgagatggagttcaagcgcacgtaccgctacatcgtccgggagctcagcctcgaagtcgcgcccgccgaccccgcgcagtacgtgccgcggttcgcaagcgacctcgacctccccgacgaggtcgagcggcggtcccgagaactcatctccaacgcccaggccgacggcgtcaccagcggcaagtcgccggtcggactggccgccgcggcgatctacgcgtccagcctcctcaccaaccacaaggtcacccaaagcgaggtcagcgaggtgaccgacgtcagcgaggtcaccatccgcaaccgctaccaggagctgctggaagccaccgaagcagccgcctga

SEQ ID NO: 42267 - DNA, 1512 bp, Halobacterium sp. NRC-1
atgacgtaccaacattacatcaacggcgaatgggtcgacggcgacggcaccgagaccttcgacagcaggaaccccgcgaacggcgagacgctgggcacgttccagcgtggcacgacgaccgacgtcgaggcggcgatcgcggccgccgacgacgccgaggacgagtggcagtcgctgtcccgcatcgaccgcgcggagtacctctgggacatctaccacgagctcaaagaccgccaccaggagctcggtgaggtcgtcaccaaggagtgtggcaaggagatcagcgaggggaaagccgacgtaaccgaagcctggcagatggtcgagtgggcggccggcgacgcccgccacccgaaaggcgacgtggtcccctccgagatccccgagaaggacgcctacatgcgacgccagccgcgcggcgtcgtcggctgcatcacgccgtggaacttcccggtcgccatcccgttctggcacatggccgtcgcgctggtcgagggcaacaccgtcgtctggaagcccgccgagcagacgccgtggtgtggccagatcatcgccgagatgttcgcggacgccggcatccccgacggcgtcttcaacatggtgcagggcttcggcgacgccggcgcccgcatcgtcgaccacgacgacatcgacaccgtactgttcaccggctccgccgaggtcggcgaggaggtcgcacggacggtcgccgacgaccccggcaagctcgcagcctgcgagatgggcggcaagaacggcatcgtcgtcaccgagaaggcggacctcgacatcgccgttcacgccgcggtcatgagctcgttcaagacgaccggccagcgctgtgtgtccagcgagcgcctcatcgtccacgaggacctctacgacgagttcaaacagcggttcgtcgagatcgcggagtcggttgcagtcgacgaccccctcgacgaggagacgttcatggggccggccatcgagcccgcccacgtcgagaagatccagacgtacaacgacatcgcccgcgaggaagccgagaacgtgctcgtcgaccgcaccgagctcggcgacgacgagatccccgacggccacgaggacggcaactgggtggggccgttcgtctacgaggtggactacgatccggacctgcgctcgatcaccgaggaggtcttcggcccgcacgtcgcgctcatcgagtactccggtgacatcgagcgcgccgtcgagatccacaacgacacgccctacgggctcgctggcgcggtcatcagcgaggactaccgccagatcaactactaccgcgacaacgccgaagtcgggctggcgtacggcaacctgccgtgcatcggcgcggaagtccagttgccgttcggcggcatgaagaaatccgggaacggctaccccagcgcgcgcgaggtcatcgaagcggtcactgagcgcaccgcgtggacgctgaacaactccaaggacatcgagatggcgcaggggctctcagcggacatcaacactgacgagtaa

SEQ ID NO: 42268 - DNA, 1140 bp, Halobacterium sp. NRC-1
atgaaccacgagctgcccgacgagcacgcgctcatccaggagaccgtccgcgagttctgcgcggcggaaatcgagccgatcgccggcgacatcgaagccgagcatcgcttccccacggagatcttcgacgcgctcgcggacctcgacatgctcggggtgccgatcagcgacgagtacggcggcctcgggggcgaccagctcatgtacgccacggtcaccgaggagctcggccgcgtctcgggctcgatcgggctctcgtacgccgcccacgtctccctgggcgcgaaacccatcgaactgttcggcaccgccgaacagaaacgcgagtggctgcgcccgctggccgaaggcgactacctgggggcgtgggcgctcaccgaaccaacaagcggcagcgacgccagcgacatgtccaccacggccacgcgcgacggcgacgactacgtgctcaacggcaccaagcagttcatcacgaacgcctccgtcgccggcagcgtcgtcgtcaaagccgtcaccgacccggacgccggctacgacggcatctccacgttcatcgtcgaccccgccgacgacggcttcgaggtcacggccgaatgggacaagatggggctgaacgcctcacccacctgtgagatctccttcgacaactgccgcatccccgccgaccggctgctcggcgaggaaggcgacggctggacgcagaccaagaaaacactcgacggcggccgcatctcgatcgccgccctctcgaccgggctcgcacagggcgcgtacacggctgccagcgagtacgccaccgaccgcgagcagttcggccagccgatctcccggttcgacgccgtccgcaacacgctggtcgacatgcaccgcaagatcgagcgggcccggctcctgacacgccgcgccgccagcaaatacgacgccggcgagtcggtcacccgggagtccgcgctcgccaagctcgacgccagcgaggccgcccgcgaggtcgccgaggacgccgtccagacgctgggcggctacggctacaccacggacttcgccccccagcggttcttccgggacgccaagctgatggagatcggcgagggcaccagcgagatccagcacctcgtcatcggccgggagctcgggctgtga

SEQ ID NO: 42269 - DNA, 1218 bp, Halobacterium sp. NRC-1
atggacgacacacctgcgttcgaaaccctcgccgtcagccacggcgaatcaccgcgcgagacgcgccacggcgatgtcgtctcgcccatccacctcgcctcgacgtacgccgtccaggagttggacaccgacctcagcctggagggcgtcgaccccgacgacgggcagttcctgtactcgcgcctcaacaatccgaccagacacgccctcgaacggcgcctcgcagccctcgaaggcggcgaccacggcttcgcgtttggctccggcaccgccgccatcgccaccgccgccttcgccgccgtcgaacccggcgatcacgtcgtcgccttcgacgacctctacgccggcacacggcgcatgctcgaaaccctcttcgaggggaacctcggtgtcgccgtctcgttcgtggacgccaccgacccggacgccgtcgccgacgcgatccgtcccgaaaccgccttcgtctggatggagactcccacaaacccacgcatcaagctctgtgacatcgccgccatcgccgacatcactgacgacgccggcgtcctgttcggtgtcgacaacaccttcctcagcccctacttccaacagcccctggcgctcggcgcggacgtcgttgcccactccacgacgaaatacctcaacggccacagcgacgccgtcggcggcgcactcgtcaccaacaacgacgcgctcgccgacagcgtcgagttcctccagcaggtcggcctcgggaacatgctcgcgccgttcgacgcctacctcgtgttgcgcggcatcaaaaccctcgccccgcggatgcgcgaccacgaggccaacgccctcgccatcgccgaatacctcgccgaccacgaccgcgtgaccgcggttcactaccccggcctcgactcccacccgcaacacgacctcgcggacgcccagcagtccggctacggtggcatcctctcgttcgaactcgacggcgacctcgccgacgccaagcgcttcctcgacgcgctcgacgagttcaacctcgcggtcagcgtcggcggcgtcgaatcactggtggaactccccgccggcatgacccacgaacccatcccgaagcccgaccgcgaagccatgggcatcacggactcgctgatccgcgtgtccgtcggcatcgaagccatcgaggacctcatcgcggatctcgaccgcggcttcgaggcggtccgatcgaccaccccgacagcctaa

SEQ ID NO: 42270 - DNA, 1362 bp, Halobacterium sp. NRC-1
atggacgacatcaaccccgcaaccggggcccggatcgacacctacgagacggacactgctgccgacatcgaggccgcgctcgcccgcgctgcggacgccgccaacgactggcgggaccgcccgatccgggagcgcgagcgccacgtcgcggccgcaggggacgtgctccgggagaacacacagacgtacgccgagttgatcaccgcggagatggggaagccgatcacgcaggcccgcgcggagatcgagaagtgtgcggcggtctgtgaccattacgcgacgcacgccagcgcgtacctccagcccgacggccacccgagccccgccggcgcggacgtgcagaccgtctacgagcccctcgggccggtgctggcggtgatgccgtggaacttcccgttctggcaggtgttccggttcgccgcgccggcgctcgcggcgggcaacgtcgcgctcctgaaacacgcctcgaacgtgcccgggtgtgcggaagccatcgcggacgtcttcgaggcggcggggctgccggcgggcgtgttccagacgctgctcgtcggcgccgacgccgtcgaggacgtgattcgggacgaccgggtgcgcgccgcgacgctcaccgggagcgagcccgcaggcagcgcggtcgccgcgaccgccggcgagacactcaagaagaccgtgctcgaactcgggggcagtgacccgttcgtggtgctcgatgacgccgacgtggcggcggccgcggccagcggcgcgtgggcgcgcaccctcaacagcgggcagtcctgcatcgcggccaagcggttcatcgttcacacggacgtctacgaggcgttccgcgacgcgttcgtctccgagatcgactcactcactgtgggcgatccgacgcgcgaggagaccgatgtcggcccgcaagccagcgccgctgggctggacaccacccacgagcaggtgcgggcgtccgtggacgcgggcgcgaccgtggtgaccggcggccagcccagtgaccgcgagggcgcgttctacgagccgacggtgctcaccgacgtgccggcgggctgtcccgccgacaccgaggagctgttcgggccggtggcggcggtcttcgaggtgcccgacgaggcggcggcgatcgcgaaggccaacgccacggcgttcggactcggggccagcgtgtggacggccgaccgggatcgcggccgccgggtcgcccgcgccatggacgccggctgcgcgtacgtgaaccagccggtgacctccgacccccgggttccgttcggcgggatcggacgctccgggtacggccgcgagctggccggtgcgggcatccgggcgttcgtcaaccggaagacgctgtgggtggagtga

SEQ ID NO: 42271 - DNA, 1641 bp, Halobacterium sp. NRC-1
atgccccacgatagacgcagctacctccgcacgtcatcagcagtcatcgcatcgctgctcgcggcgagcacaccaacatcggccgccgacaccccacccgaatgggaccccgacaccgtctacactgacggcgaccaggcgaccttcgacggctacgtctgggaagccaaatggtggacgaaaggcgacaaacccggtgccgacgagtgggggccgtggaaccagcttcgccccgtcgacgacagccccaccgatcccggcgggccgaccgcgtcgttcaccaccagcgaatcagtgatcgagcccgaaaccaccgtgaccgtcgacgccagcaacaccgtcggcgacgtcgacaactacgagtgggcgttcggcgacggcaccaccgcgtccggcgtcacggcctctcatacctacgacgccgccggcgagtacaccatcgagctcactgtcaccaccggcgacggcaccaccgacacgacatcggcgacgctgctggtcgccgatggcggtgcgcccgctgacgggcgcgtcgtcggctactacatgcagtgggcacagtgggaccgcgactacttcccgggcgacatccccctggataaggtcacacacgtcaactacgcgttcctcaccgtccgcgaggacggggccgtggactacatccaggagaacgccgcgatgcgcgtgctcgaaccgaaatcctggcacgaccacactggcttcgacgacctcgtcgacgaccctgagacgtcgttcctgttctcgatcggcggctggaacgattcgacgtatttctcgaacgccgcccagtcgcaggccagccgcgagcggttcgcggacaccgccatcgagatcatgcgcacccacaacttcgacggcctggacatcgactgggagtaccccggcggcggcgggaactccggcaacgtcgttcgcgacggcgacaaacagcggtacacggaactcctccagaccgtccgcgagaagctcgacgtcgccgaggacgaggacggcaagcgctaccagctaacaaccgcgctgtccgccgacccggagaagaacaccgggctggaccacgcggccaacgccgaggcgcttgacttcctgaacgtcatgacctacgactaccacggcgcgttcaacgactacaccaaccaccaagcaccgctgtacggcaccgaagccgatccgtcgccgaacgccgacgagttctacgtggacgcgtcgatgtccttctggctggatacggccttcgaccccgcccagctgtcgcttggcctgccgttctacgggcgcagcttcgggaacgtcgccagcagcgacaacaacggcctctaccagcccttcgacggcacgccggacggaacgtgggggcaggacaacggcatcaaggagtactgggacatcacccagaacctcgccccgagcagcgactacgagacgttctgggacgacaccgcgaaggtgccgtggttgtactcgccgtcgaagaacgtgctcgtgagctacgacagcccccggtcggtcgaggccaaaaccgcctacgccgcccagcacgacatcggcgggatgatgttctggacgttctccggcgacaaaaacgaagtcctcctggacaccgtccgggacgcctggcagtag

SEQ ID NO: 42272 - DNA, 1719 bp, Halobacterium sp. NRC-1
atgccccacgatagacgcagctacctccgcacgtcatcagcagtcatcgcatcgctgctcgcggcgagcacaccaacatcggcggccgacaccccgcccgagtgggatcccgacaccgtctatacggacggcgataaggcgaccttcgacggctacgtctgggaagccaaatggtggacgaaaggcgacaaacccggtgccgacgagtgggggccgtggacccaacgccgccccgtcgacgggtcgccgggcggccccacggccgcgttcacggtcaccgacaccacggtggagccgggcaccgccgtgaccgtcgacgccggcgacaccaccgggagcgtcgacagctacgagtgggcgttcggcgacggcaccactgcagccggcgtcacggcctcccacacctacgacgccgccggcgagtacaccatcgagctcaccgtcaccaccggcgacggcaccacagacacggcgacacagcagatcaccgccaccacgtcgcccggcgacgacgagttcaaagtcgtcggctactaccccagctggaaggggaccgacgactacgacttttacccggccgacgtgcccttcgaccaggtcaccgacgtgctgtacgccttcctggacgtgcagcccgacggcaccgtggtgctccccgacagcgacgtggaccacgagtcgctgctggcgtcgttcgccagcctcaagcaggaccgggccgccgacaccaggctgaagctctcgatcggcggctgggggttgtccccgggcttcgaggacgccgccgccgaccaggccagcagggagcgcttcgccaccaccgccgtcgacctcatgcgcacctacgacttcgacggcatcgacgtcgactgggaacacccggggccgcgccgcgggaaatgcgagtgcggcagcgcccagggacccgcgaaccacgtcgcgctcctggagaccgttcgggaccggctcaacgacgccgaggtcgaggacggccgcacgtacgacctctcggtcgccaacggcgggtcggactggaacgccgcgctgatcaaccaccgcgaggtcgccgccgtggtcgacgacatctacatgatggcgtacgacttcacgggcgtctggcacggcaccgccgggctgaacgcgccgatctacgggacgcccccggactacccgccgtccggggacgcccaacagtacaccctggaaacgacactcacgatctggaaggagcaaggctactgggtggactggatggagtgggaggaccacggtgaccccgtcgacgatcccggcacgctcgtgttggggatgccgttctacggccgcggctgcaacgttgagaacggcatctgggacacgttctcgctgtcggagtggcagcaaggcgaccccaagtaccagaacgacgtgatcccgccgggcacgtggaacgacctccgcggccccgacgacgccaacacgggggcgttcgactacggcgacctcgccgcgaactacgagggcgccgacgcctggaccaaacagcgcaacgagcagggcggggttccctacctctggaacgacagcgagggcgtgttcatcagctacgacgacccgacttcgatcgctgcgaaggtcgagttggcggtcgccgaagacctcggcggcgtgatgatctgggagctctcgcaggactacgacggcacgctactcgaaacgatcaatcaacacacaccatga

SEQ ID NO: 42273 - DNA, 2514 bp, Halobacterium sp. NRC-1
atgagtgacaccgacctcaacgccacccggcgagacgtcctcaagtcgggcgcggtcgccgcagtcgggctgagcggcggcggtctgctgtcgacgctccaggaggccgacgactccgacacggctggggacgccgtcacgagcttcctcggcgaggaccaggtcgtcaaaaccgcctgctcgccgaactgccgggggaaatgcccgctcgacgtcttcgtccgggacggccaaatcaagaaggtcgaacagcaagtgccggcggcgaaaacgttcaaacgcggctgcacactggggatgacccatctccagcgggtctacaacgccgaccgcctgaaatacccgatgaagcgaacgagctggtccccggacgacccacagcccgatcagcgcggggcggacgcgcagttcgagcgcatcgcctgggacgacgcactggacctggttgccgacggaatccaacgcgcgaaacgcgagtacgggccacggagtctgctctggcactccggctccggcgacggcgggatcaccggctaccggcgactcaaggagctagtcggcggcctccaagacgacttcacgtacggcatcgacaccaacgtcggccagggattcaaccgcgtcaccggcgagggcggcgtgttcatgccgccgacgaacacggccgacgactgggtgaacgccgagaccatcatcatttgggggtccgacatcttcgccagccagttccagatggacgccgagtggatcctggacgccaagcgcaacggcgcaaagctggtggtcgtcgaccccgtctacaccaacaccgcggagaaagccgacctgtggctccccatcaaacccgggaaggatacgcatctcgcgctggcgatgatgcagtacatcttcgagcacgaccactacgacgaggcgttcttgcggtcgcggacgaacgcccccgccttggtccgtgccgacgacggcacgctgctcgacccggccagcgtcaccgcgacacctcccgaggacgggatcgtcgtcttcaacaccgaaaccggctccccggaggtcgtcccggctgaaacgaacggcccgttcgcgctgttcggcgagtggacgatcgacggcacgaccgttcataccgggctcacggcgctccgtgagcaggcgtcgtcgtacccaccacaagccgtcgctgacaccgcgggcctggccgccgccgacatcgaaaccgccgccgactggctcgccacccgtggccccggcgggatcatgccgagctacggggtcggccggtacctctacggccacgtcttcgggcagacgtacgcgacgctgctcgcgctcactggtgactacggtcggcacggcaacatccacgcccaacacccctcctacgacggatcgtacctcgaaaccggcgactggaacgaccccgacggcgcggccggcgtggacacctacggctacaaccgtgtgctcgacctgctggcgaacggcgacccggtccagacgaagttcatgtacggcatgaactcgaacatgctcgggaaccagttccccgagcgggaccggtggctggacgcgatgtcgaacttggacaccgtcgtctgggcggacatctatcacacgccgaccacgcggcaagcggacatcatcctcccagcagcacactggttcgagaccgaagacctcctcacgacgtacacgcacccgaacctcagctaccggacgaaagcccacgaccccctgtgggaggcccgcgatgactactacatcatggcggggctcgcacagcggctgggccacggcgacaagttccccgacgacaaacacgacgtcctcgaccgcttcgtcaagaacgacgaccggctctcctgggacgcgttgcgcgagaccggcactgtcgccaccgacgaaacgccgacggtagcgtacaccgacgagttcggcaccgaatcgggacgcatcacagtctacgacgacgacgcacccgtcgaggaggggccggcgctccccgacgacggcgtctcgcttgaagtcccgaaaccactggaagcccggacggccgacgactgggcgcacgccgacgagtacccgctgttgttcatgcagaaacactccaagtggcgcatccactcacagtgggcgaacgtgccgtggctccgggagatcaacacggagccccaactcgacatccaccccaaggacgccacacgccgcgggatcgacgacggcgagtacgtccgcgtacacaacgaccgggggagcgtggtcgtccgcgccaagtacaacgacggcatccaacccgggttggtcaacacagaccagggatggtgggcgcgcgacttcgtcgacgggcacctccaggacctgatctcggcggaaacggcgaaagtcgggcgcacgttcgcgttctacgactgccgcgtcgaggtgacgcgggccgccgacgagcaccaatcgaacgagtacacacaacacaacccccgcggttcgtccgggaccgccaccgacggtgattcgtcatga

SEQ ID NO: 42274 - DNA, 789 bp, Halobacterium sp. NRC-1
atgaccaactacggcctcgtcatcgatcaggaacgatgcatcggctgccagtcgtgttcgctcacgtgcaaacaggagaacaacgtcccgatggggcagttctggaaccgcgtgctcacgcagggcggcgaccacgttgacaccccgtcgggcgactaccccgagggcggcgacggtggcactctcgaaatgacctaccagccgacggcgtgccaacactgcgagaacgcgccctgtgtgaaggtctgcccggtgaacgccacgtacacccgggacgacggcatcgtggagatcgattacgacaaatgcatggggtgtcggtactgcatggcggcctgcccgtacaacgcccgtgtgttcaactgggacgagcccgagcaccgccccgaagacggcacgggagacgtggccgaacgaccacagggcgtcgtcgagaaatgcacgttctgcagccaccgcgtcgaggacggcctcgaccccgcctgcgtcgtgaactgtccggcggacgcccgcatcttcggtgacctggacgacgacgacagcaccgtctcgaagtacatcgcggagtacgacacccaccaactcctggacgagaagggaacggacccgagcacgtactacatcaacggcgagatgtcgcccggacgcccctggaagagcaagaagctcgaaagcgaactcgacgacgacgaggcagcgaaagcggcgcgacggcgcagcggcagcgtcgaaaacggatacgacgttaccccacacgtgccggcggagaccgcgggaggtgacgactga

SEQ ID NO: 42275 - DNA, 822 bp, Halobacterium sp. NRC-1
atgacactcaccaagcgcgtcatcccctgcatcgacgtggacctcgacgacgacggggagcccgcagtgtacaccggcgtcaacttcgaggagctggcgtacacgggcgaccccgtcgagatggcgaagcggtacaacgaagcgggcgccgacgagttcgtgttcctcgacatcacggccagcgccgagggccgggagacgatgctcgacaccgtttcggcggtcgccgacgaggtgttcatcccgctgaccgtcggcggcggcatccgggacaccgacgacatccgggagacgctgcgcgcgggcgccgacaaggtctcgatcaactcgggcgcgatcgccgacccgtcgctggtggaccgcggcgcgaaagccttcggcagccagtgcatcgtcatcagcgtcgacgcccggcggcgcttcgacgaacagggccaacactacacgcaggtcgacggcgagtcgtgctggttcgagtgcacggtccacggcggccgcgaaggcaccggcatggacgccatcgagtgggtccaggaggcacagcgacgcggcgcgggcgagctgttcgtgaactccatcgacgccgacggcacacaggacggctacgacgttccgctcacggcggcggtctgtgacgccgtttcgacgcccgtgatcgcgtcctcggggtgtggcgcgcccggcgacatggccgacgcctacgacgccggcgctgacgcggcgctggcggcgtcgatcttccacttcgacgagtacagcatcgcggagacgaaagagacgctcgctgacgccggctatccgatccgcgccccggacgcgtga

SEQ ID NO: 42276 - DNA, 987 bp, Halobacterium sp. NRC-1
atgacaaaccagcgcacaacacgagacgggagccacggcacggaatcagtacccacgcagcgcagccgtgagtccaccgacgaagaccacgggtgcccggagtgcaacggcgacctggtgaccgacgaggatcgcggggagaccacctgcggcgagtgcggcctcgtggtcgaggaggacggcatcgaccacggccccgagtggcgcgcgttcaacgcccaagaacaggacgagaaatcccgcgtgggcgctccgaccacgaacatgatgcacgacaaggggttgtccacgaacatcggctggcaggacaaagacgcctacggcaacaccctgtcggggcgccagcggcggaaaatgcagcgcctgcgcaagtggaacgagcgcttccgcacccgcaacagcaaggaacgcaacctcaagcaggcgctgggtgagatcgagcgcatggcctccgcgttcgggctgccggacagcgtccgggagaccgcgtcggtgatctaccgccgcgcgctcggcgaggacctgctgcccgggcgctccatcgagggcgtcgccaccagcgcactgtacgccgccgcgaggcaggcaaacacgccccgcagcctcgacgaggtcgcaagcgtcagccgcgtcgaccgcggcgaaatcgcgcgcacgtaccgctacgtggcccgcgagctcagcctcgaagtcgcgccgacggatcccgcgagttacgttccccggttttgctctgacctggagctgtccggcgacgtcgaacggcgcgcccgagacctgctggccgccgccgccgacgccggcatcacgtccgggaagtcgcccgtcggcctcgccgcggcgtccgtgtacgcggcggcgctgctcacgaacgagcgcgtcacgcaaaacgaggtcagcaccgtcgcgaacgtcagcgaggtcaccatccgcaaccgctaccacgagatcctggacgcgggcggtgaacccggcgtggaagcgtaa

SEQ ID NO: 42277 - DNA, 768 bp, Halobacterium sp. NRC-1
atgcttttatcagtcccgggctggtatcaagtggtaatgttcaacccgaacaacggctctgagttcgcccgcaatcgggcgcgactcgacgacacgcccaacccctacgagccggaggtcggctcgctccccgagggcgaccgctcgcaggccggctcggacaccgtcaacaagaccggcaccacgatcgtcggtctgaccacccaggacggcgtgctgatggcgtcggacatgcgcgcgagcctcggcggccgcgtcatctccaacaagaacgtccagaaagtcgaggagatccagcccaacgccgccctctcgatctcgggatcggtcggtggcgcccagagcttcattcggtcgctgcgcgctgaagccaacctctacgaggcgcggcgcggcgagtacatgtccatcgacgcgctctccacgatggcgtcgaacctcctgcgcggcgggccgttcttccgcgtcgtcccgatcctgggcggcgtcgacgacgacggcggtcacgtcttcagcctcgaccccgccggcagttcgatgtccgacacgtacaccgcacagggctcggggatgccgtacgccctgggtgtgctcgaacaggagtacagcgaggatctgacgatggcggacgccgaacaggtcgccgcccacgccgtgaagtccgcgagcgaacgcgacaccgcctcgggcaacggcatccacatcacgaagatcacccacgacggcctcacgaccgtcggccacaaggaattcgacgcgctcctgtaa

SEQ ID NO: 42278 - DNA, 1686 bp, Halobacterium sp. NRC-1
atgaagttcggctcgttcgccacgttcgctgccgacatcgaagccaccgacgccgacctcgacgtggtggcgctggtcgcggagctcttcgacgcggccgacagcgacctcgatgtcgtcgcgcggttcgtccagggacgcgtgttccccgcccactccgagacgaaactcgacatcgggccacagctctgttacacggcgctctcgcgggctgcgggccggaacgtcgacgcggacgacatcgaggcacgactggccgaaaccggcgacatcggggccgtcgccggcagcctggacctcggcggacagaccggactcgcggcgttcgggggcggcgacgaccacgccgacggactcactgtcagcggtgttgcggacgaactcgcggccctggcggccgccgccggcgacggcagtcagtccgagaaagtcacgctcctgttcgggctgttcaaccagtgcaccagccgggaagcccgatacctcgcgcggctggtgttgggtgagatgcgcatcggcgtcggcgagggggccgtccgggatgccatcgctgaggcgttcgacgtgccgactgcggccgtgcagcgcgccctccaggtgtcgaacgactacggcctcgtggccgaaaccgcacgcgacagcggcaccgacgcgctggacgcgatggggctggaggtgggccgccccgtgcaggcgatgctcgcgcaggccggcacggtcacggacgccctcgacgagtggcacgaggccgccgtcgaaacgaaattcgacggcgcacgcgtgcaggtgcactacgacggggacgacgtggtgctgtactcgcggaacatggagaacgtgacgggggcgctcccggagctcgtggagttcgtcgagaacaacgtcacggcccccgtgatcatagacggtgaggccgtcgcggccgacgaggacggcgacccactgccgttccaggagatcctcaagcggttccgccgcaagcacgacgtcgccgcgatgcgcgaggagatcagcgtggagctgcacgcgttcgactgcctgcacgcgccgagcgccgacggcggcgaggacctactggacgcgccgttttccgaccgccaccggcgactgcgctcggtggtcgacgacgcgtcggcggtctcggaggtgctcgtgaccgacgacgccgacgagatcgcggccttcgaggcgaccgcgctggagggcggccacgagggcatcatgctgaagaacccggccgccccgtacacgcccggcgaccgcgggaaagactggctgaagcgcaagcccgacgtggagacgctggatctggtcgtgaccggcgcggagtggggggaaggccgccgcgcgtcagtgctggggacgttcctgttgtccgcgcgggacgccgccggcgacggcttcgagaccatcgggaaggtcgccaccgggctgacagacgaggagcttgcggccctcagcgaccgcctggagccacacgtccgcagcgaggacggccagacggtcgacatcgagccggcggtggttctcgaagtcggctacgaggagatccaggcgtcgccgacgtactcctcggggtacgcgttgcggttcccgcggttcgtctccgtccgcgaggacaaaaccccgacgacggccgacaccatcgagcgcgtcgagcggctcgccgcccagcaacagcagtga

SEQ ID NO: 42279 - DNA, 1152 bp, Halobacterium sp. NRC-1
atggaccgcgtagcaatcatcggcgcgtcgatgaccgcgttcggcgaccgggacgcgtggctgctggcgctcctcgcggaggccggcgacgccgcgctcaccgacgccggcgtggacggcgacgacgtcgaccacctctacgtctcgaacatggcgagcggcgagttcgagggacagaccggtgtgccgaacgcgctggcccacgatctcgccgcgatgccggcgtacacggctcgcatcgaccagaccagttcctccggcggtgccggcatctacgccgcctggcagtccgtggcgtcgggcgcgagcgacctgacgctgctggtcggcggcgagaagatgacccaccgaacgaccggcgaggccacggacgtcatcgcgagtcttacccaccccgtggagtacaagcacggcgtcacgctcccgagcttcgcggggctgaccgcccggaaatacctcgcccagtacgacgcgccacgcgagagcctcggcaaagtcgcggtcaagaaccaccgcaacggcctcgacaacccccacgcgcagttccgcaaggaagtcgacttagagacggtcctggactcccccatggtcgcggacccgctgcggctgtacgacttctgccccatcacggacggcagcgccgcgctggtgctgtgcccggaatccgtcgccgcggagtacaccgacgactacgtcgtgatctcgggggttgcgggtgcgaccgacacccacgtcgtccacgagcgcgacgaccccacgacgatgcgcggggtcgtcgagtccgcggagcaggcctacgagatggcgggtcgtggccccgacgacatcgacgtggccgaactccacgacatgttcaccatcctggagttcctgcagagcgaggatctcgggttcttcgagaagggcgcgggctggaaagccgtccgggacggcgtcaccgaccgcgacggcgacctcccgatcaacacctcgggcggcctcaagtcgaagggccacccgttgggcgccagcggcgtcgcacaggcgtacgaactctaccagcagttgctcggaaccgcgggcgaccggcaggtcgacgccgaggtcggcctggcgtgcaacgtcggcgggttcggcaactgcgtgaccaccaccatcctcgaacagccatga

SEQ ID NO: 42280 - DNA, 1443 bp, Halobacterium sp. NRC-1
atggaacaaaacgcgattcagcggcgcgaacgcccgttcgtcgccggcgagtgggtctccgacggtgagccactgcccgtctcggacctcgcggacggcggcacgttcgcgtcggtcgccgccgcggacaccagcgacgcggagcgcgccctcagcgcggccactggcgtgcacgcggacctgcgggagaccaccgttcccgagcgcgtcgagtggctggagtcgatcgccgacggcatccgacgccgcgaagacgagctcgcggaggtcatcgtccgggaagccgggaagccgatctccagcgcgcgcggcgaggtccagagcgccgccgagcgcttcgaccgcgctgtgggcgagctccgccacctcaccggggagtaccgcaccggcacgaccgccggccacgaggactggcaggccatcgtgaaacacgaaccaatggggaccgtgctgtgcatcacaccgtacaactaccccctctccacgatggcgctgcaggtcgccccggcgatcgccgccggcaacgccgtcatcgtgaagccagccagcaaaactccgatcagcggcgcgatcctcgcggacatcgcggccgacgccggcctccccgacggcgcgtacaacttcgtccccggcgagtcgagtgtcatcggtgacccgctggcctcggacgcccgcgtcgacgccatcgcgatgaccggctcctcgggggccggcgaacacgtcgcgcgccaatccgggatcacccgccttcacatggaactgggcgggaacgcgcccgcaatcgtcttcgaggacgctgacctcgatgcggccgccgacgccgccaccgccgggtcgctcaaatacgccggccagcggtgctcggctgtctcccgggtgctcgcccacgaatccgtccacgacgagctggtgtcgcgcatcgacgacgcgatggccgagtggtcgatcggcgacctcttcgatacggacaccaccctcgggccgctcgtcagcgccgaccaggccgactgggtggccgaactcgtcgacgacgccgtcgaccgcggcgcgacagtcgtccgtggcggcgaacggcacgtcgaggacggcgtccactactacgagccgacgctgctggccgacgttccccgtgacgcgcgcatcgtcgacgaggagcagttcggaccggtgtgcgcggtcaccacggtcaccgacgaggacgacgccgttcggaccgccaacgggtcggagttggcgctcgacgccgccgtgttcacggccgaccacgaccgcgcgatgcgcgtcgccgagcgcgtgaacgcgggtgcggtccgcatcaacggcgcgccgagccacggcctcggcgacgtgcccttcggcgggaacgacgcctccggcatcggccgcgaggggctggactccaccatccacgagttcgtgcgcgagaagtccatcatcctctga

SEQ ID NO: 42281 - DNA, 2004 bp, Halobacterium sp. NRC-1
atgagcaacgacaccgacaccccggagctggaggcgcgactcaccgaccaggacgagttcacgccgcccgagtcgttcgtcgagcaggcgaacgtctccgacccgggtatctacgacgagttcgatgcgacctggcccgaatgctggactgacgcggccgacctgctggactgggagacgccgtacgatcaggtcctcgacgattcgaacccgccgttctacgagtggttcccgggcggcggcctgaacgcgagcgcgaactgtctggaccgccacctcgacgagcgcggcgacgaggccgccatcgagtgggtgggcgagccggccgacgaagccaaccgcacgtacacgtacgcccagctccaccgggaggtcaacgagttcgccgccgggctgcgcgagatgggtgtcggcgaggacgacatcgtcacgctgtacatgccgatggtgcccgagttgccgatcgcgatgctggcctgcgcgcgcctcggcgcgccacactcggtggtgttcgcgggcttctccgcggacgcgctcagcacgcgaatgaacgccgccgactcggagtatctcgtcacctgcgacggctactaccggcgcggcgaccccctcgatcactacgcgaaaacgctcgacggcctggatggggtgtcacacgcggtcagtgacgtggtcgtcgtcgaccgcctcggcgcgaacggcgacggcttcgaccacgaccgcccggccgcacaccacgactacgacgccgtcgtcgccgcccacgacggtgcaagcgtctcgccggtcgagcgcgacgccaccgacatgctgttcctgatgtacacgtcgggcaccaccggccagcccaaaggcgtcactcactccacgggcggctacctctcgtgggccgcctggacctcgcaggcggtcctggacatcaagccgtctgacacctacttctgctcggcggacatcggctggatcaccggccactcctacatcgtctacgggcccctggcgcttggcaccacgacgatgctctacgagggcgctccggaccaccccgacaaggaccgcctgtgggagctcgtcgagtcctacgaggcaacccaactgtacaccgcgccgacggcgatccggtcgttcatgaaatggggggtggagtaccccgacgcccacgacctctccagcctgcggctgctcggaaccgtcggggagccgatcaacccacgggcctggacgtggtattacacccacatcggcgacgagtcgtgcccgatcgtggacacgtggtggcagaccgagaccggcggcatgatggtcacggggctgcccggcgtctccacgatgaaaccggggtcggcgggccgcccactgccgggcgtcgacgcgcgcgtcatcgacaccgacggcgacgacgtggcgggcgggcgggcgggccacctgaccatccagaagccgtggccggggatgctccaaaccctctacgagaacgacgagcggttcatcgacgagtactggcgggtatactccgacaccgacagcggcgactccgcggactgggtgtacttcccggaggacggtgcgaaagtcgacgacgacggctacatcacggtcctggggcgcgtcgacgacgtggtgaacgtctccgggcaccgcctgggcacgatggagatcgaatcggccatcgtcgacgtgccgggggttgcggaggcggcggtcgtcggcggcgaccacgacctgaaaggcgaagccgtgtacgcgtacgtgctcaccacggacgaccacgacgccagcgacgccctccgtgagcgcatcgtggccagcgtggaggacgccatcggccccatcgcgcgcccggaggcggtcgtgttcgcgccggaactcccgaagacgcggtcggggaagatcatgcgccggctcctggaggacatcgcaaacgacgccgacctcggggacacctcgacgctccggaaccccgacgtggtggagacgattcaggaccagctggccggcgactga

SEQ ID NO: 42282 - DNA, 1584 bp, Halobacterium sp. NRC-1
atggtggtctcccccacctatctccgcccggtcacgttcgcccaatctcgcaacgcttttgcggtctcacaccgaccgtttgacatggcgaacgattcctcaacggacggcagattctccgagaagcttcgcgtcccggaagcgctcacgttcgacgacgtgctgttgcgcccggccgagagccgcgtcgaaccggacgacgccgacgtcgccacgcgcgtctccacgaacgtcgaactcgaagtccccgtactgtcggccgccatggacacggtcaccgagtcccggcttgcgatcgcgatggcacgcgagggcggcctgggcgtcctccaccagaacatggacacggaccgagtcgtcgcggaggtcgaacgcgtcaagcgcgccgacgaactcgtcatcgaccgcgagaacgtcgtcacggccgcccccgagcagaccgtcgaggccgtcgacgagatgatggaccgcagcgacgtctccggtgccccggtcgtcgacgacgacgacacggtacgcggcatcatctccgcgacggacatccggccgtatctcgaagtcggcgagtcggatgccgttcgggaggcgatgaccgacgaggtcatcaccgcccccgaagacatcaccgcacgcgacgcgctcgaactcatgtacgagcacaaaatcgagcgcgttccgatcgtcaacgacgagcagcacctcgtcggcctggtcaccatgcagggcatcctcgaacgccgcgaacacggcagcgccgcccgcgaccagaacggccgcctccgcgtcggcgtcgccgtcggtcccttcgacacggagcgcgcgaccgcggtcgacgaggcgggcgcggacgtgctgttcatcgactgtgcgcacgcacacaacctgaacgtcatcgactccgcccgcgagatcaaagccagcgtcgacgccgacgtggtcgtcggcaacgtcggcacccgcgaagccgccgaagcggtcgtggacttcgccgacggcatcaaggtcgggatcgggccggggtcgatctgcaccacccgcgtcgtcaccgggtccggcatgccacagatcacggccgtctcacaggtcgccgacgtcgccgcgccggccggcgtgcccgtgatcgccgacggcggaatccggtactccggcgacgccgcgaaagccatcgccgcgggtgccgacgccgtgatgctcggatcgtacttcgccggcaccgacgaggcacccggccgcgtcatcacgatgaacggcaagaagtacaagcagtaccgcggcatgggctcggtcggggcgatgcagtccggtggcagcgaccgctacctcaaagacgacgacgaggacgaggagtacgtccccgagggcgtcgaggctgcaaccccctacaaggggtcgctggcgtcggaactccaccagctcgtcggcggcatccagtccggcatggggtacgtcggggccgagtcgatcccggcgttcaaggctgacgccgagttcgtgcgcgtctccgcggcgggacagaccgagggccaccctcacgacgtgatgatcacggacgaagcgccgaactacagcccacaaggcgagtag

SEQ ID NO: 42283 - DNA, 1188 bp, Halobacterium sp. NRC-1
atgcggaccacacacctaaacccgatgatacccgagcgccggccgcgtgagggcatccttaaggatgggccggccgtcaccccgagcatggaactacgggacctctccgaccacgtcgaataccgcgctggtcggggtatcgaggaggtcgcccgggagctcggccgtgacccctcggagttcgtgaagctctcgtcgaacgagaacccccacgggccgagcccgaaggcaaccatcgccattcgggaggcggcaaccggggtccaccgctatccgaaagcggtgcacgccgacctgacgggcgcgctcgcggaccgctgggacgtgggcgacgaccaggtgtgggtggccaacggcggggatggcgcgctcgactacctggcgcgggcaaccctcgatcccggcgacagcgtgttggtgccgtcgccggggttcacctactacgggatgagcgcgcgcttccaccatgggaacgtcgcggagtacgacgtcgccgagggcgcggacggcttcgagatgaccgccgacgcggtggtagacgcctacgacggcgagcgcgtggtctacctgacgacgccgcacaacccgacgggcgcgcggttcacgctcgacgagatcgtggcggtggccgaccgcacggacgaggacacgctcgtgctcgttgacgaggcgtacggcgagttcacggagacgccgtcggcggtcacgctgttcgacggccagccggcgggcgggcacgcgccacgggacgacatcgcggtgttgcggacgttctcgaaggcgtacgggctggcgggcatccgcctggggtacgccgtcgtgccggactcgtgggcggacgcctacgcccgggttcagacgccgttcgccgccagcgtcatcgcgtgtcaggccggggttgcggcgctggacgacgacgaccacgtcgaggccaccaccgacagcgtcgcgtggggccgcgactacatccacgacgagctcgcggcccgcacctacgagagccacgggaatttcgtgctcgcgaacgtgggcgacgccggccgggtcgccgaggccgcgaagcgcgagggcgtgctggtgcgggactgcaccagcttcgggctgcccgaacacgtccgcatcacgatcggcacgcggtcggagaccgagcgcgcggtggcggtgctcaacgaggtgtgtgacacatga

SEQ ID NO: 42284 - DNA, 1590 bp, Halobacterium sp. NRC-1
atgagccggcgaccgtccccgaacgccgacgtgtgtgtcatcggggccgggccggccggagggctgatcgccgaccgccttgccagcgacggccacagcgtggtcgtcctggaagccggaccccggttcgacgccgccgaccgcgagcgccgcatggagcgctcgatccgccccgcacacggcccggcgtcggtgtgggaaatgggcggcccgcgggacgcctacgcgtccaccggcgaccgatactacccgctgaacgcggcgcgcgtgaaaggcgtcggtgggtcgacgctgcactggcagggcatggtgatgcgcctccacgagcaggacttccgcctggcgtcggccaccggcgtcggcgcggactggccgttcgactacgacaccctcaagccgtattacgccgccgcggagtcagcgctgggggtgtcgggggcgagcgacaaccccttcgcgccgccccgcgagcagccacaccctcagccggcgttcccgccgagctactctgattcgctgttcgccgacgcctgtgagtccctgggcatcgcgacgcattcggtgccgaacgcgcgactgtccgccggccgcgagacgcggcgcgcgtgtgtcgggtacgggacctgccagccggtctgcccgtcgggcgcgaaatacgatgcgaccgttcacgtcgaccgtgccaccgacgccggcgcgcgcgtcatcgacgaggcaccggtccagcgcctcgaacacgacgccgctggggatcgcgtgactggggccgtgtacgcgacccccgacggcaccacccaccgccagtctgccaccgagttcgtgctcgcggcgggcgggatcgagacgccgcggctgttgttgctgtccgacagcgaccgctaccccgacgggttggcgaactcctcggggctggtcggccggtacttcatggaccacctgttcgcgggcgccggcggcaccctcgacgagccgactcgccagaaccacgtgggcttcaacacgaccgagagccaccagtactacgaccggccggacggctcgcggggcgcgatcaaactggagttcctgaactacgccggccccagcccggccgagatggcgctgtcgggcgacgactggggggacgcgatgtgcgaccgcatccgggacgcctccggcacgcacatcgcggtcggcggactcgtcgaacagcaacccaggccggagaaccgggttcgactccaccccgagcgcactgacgtccacggcaacccggttccggacgtggtgtggtcgctgtcggcgtacgagcgccgcaccatcgagcgcgccaacgagatccagcgcgagatcctcaccgaactcggggccgacatcgagtggacggtcggccccgaggacaccgggccggcgttccaccacatgggcacgacgcggatgggcaccgaccccgccgagagcgtggtggacccgcggttgcgcacgcacgacctttcgaatctcagcgtggcgtcgtccagcgtgttcccgacggcgggcgcgatgaacccgacgctgacgatcgcggcgctggcgttgaaggctgccgatcacatcgccgcccgcctgtga

SEQ ID NO: 42285 - DNA, 1281 bp, Halobacterium sp. NRC-1
atggacgtgagcatcgttgggagtgggtacgtcggcacgacgatcgcggcgtgtttcgccgagctcggacacaccgtcgtgaacgtcgacgtggacgcggacgtcgtcgcggcgatcaacgacggcgacgcaccgatccacgagcccgggctcgccgagcggatcgacgcacacgctgggacgcgactgcgcgccaccacggactacgaggcggttcgtgacacggacgtgacgttcctcgcgctccccacgccggcgcgtgaggacgggagcatcgacacgtccatcatggaatccggggcggcgtcgctcggcgaggcgctggccggagccgacgaccacatggtcgtggtcaagagcacggttgttcccgggacgaccgaggacgtggttgaatccgcgctcgtgagcgccggattcgacgacccgttgctcgcgatgaatccggagttcctgcggatggggtctgctgtggacgatttccgccacccggataaggtggtgttcggcgcgcgccgtgacgccgcctacgaccagttgcacgcggtcttcgagccactgctcgcggacgccggcgatgcgaccgtggtggagacggggctgcgggaggccgagatgatcaagtacgccaacaacgcgtttctggcgtcgaaggtgagcctcatcaacgatctggggaacatctgcaaggagctcggggtcgacgcctacgaggttgccgacgcgatcgccgaggacgaccgcatcagcggccggttcctccggtccggggtcggctgggggggaagctgcttcccgaaagacgttgcggccatcacggcggctgccaaggacgcgggctacgagccggcgatgttggaggccgccgtcgaggtcaacgaccgccagcccgaacgcctgctttcgcttttggacggtcacgtcgacgttgccggcgagcgcgtcgccgtcctggggctgtcgttcaagccgggcaccgacgacatccgcggcacgcgcgcggtcccggtcatcgacgggctccaggaccgggaggccgacgtggtcgcgtacgaccccgtggcggccgagaagatggccgagcagcgccccgaggtcacgtacgccgacagcgcggcgggcgcgctcgccgacgcggtcggggccgtcgtggtcaccgactgggacgagttcgcggccctcgacgacgagttcgacgccatggccgagcgcgtcgtcgtcgacggccggcgcgtcgtggacccgcaggcggacctgacctacgacgggctcacctggtag

SEQ ID NO: 42286 - DNA, 723 bp, Halobacterium sp. NRC-1
atgcaagcagtcgtgctcgcggcaggcgaaggaacccgactccgtccgctgacagaagacaaaccgaaggggatggtagagatagccgggaaaccgatcctcacgcactgtttcgaacagctcgttgcgttgggtgctgagaagatcgtcgccatcgttggctatcggaagcagaacatcatcagccattacggcgacgagttcgacggggttccgatcacctacgcgcaccagcgcgagcagaacggactagcgcacgccctgctcaaagccgaagaacacgtcaacgaggacttcatgctgatgctcggggacaacatcttcagggcgaacctggaggacgttgtgaaccgccaacaggaggagcgggcggacgcagcgttccttgtcgaggaagtcgactgggacgaggccagccgatacggcgtgtgtgacaccaacgattacggtgaaatccaggaagtcgtcgagaagccagacgacccgccgtcaaacctcgtgatgacggggttctacacgttctctccggcgatctttcaggcgtgtaagctcgtgcagccgtcggatcgagcggagtacgagctctcagacgcgatcgatctgctgatcaaaagcgggcggaccatcgacgcgatcccgatggaaggctggcggatcgacgtcggttaccccgaggacagggacgaagcggaggaacgcatcgacgcagtgagcaacgagtga

SEQ ID NO: 42287 - DNA, 1482 bp, Halobacterium sp. NRC-1
atgcgtgacgaggtcacgctccaggcgaccaccaaccccgaccggcccgcgctcgtggacgctgcgaccgaccgaacgtggacgtacgatgccctcgacagtgccgtcgatgcgaccgccggcagcctggccgcgctcggcgttacgcccggcgaccgggtcgccgtgttgctcgaaacccggccggcgttcgccaccctcgtgttcgccgccgcgcggctcggagccgtcctcgtgccgctgaacgcgcgcctctcgcagccggagctcgccacacaggccgacgccgtcgcccccgtcgccgtgatctgcggccgcgacacggcgaccgccgccgaccgcctcgacgcgcccgccgtgcgcgtcgccgacgacgccaccgtgcgcccgctgtccggcaccgacccggacgccgtcacccccgtcgactcggcgtgggacgacacccggctgctgttgttcacctcgggcaccaccggcgaccccacggccgtccggctgacgtaccgcaatctcgccgccagcgccgccgcgtcggcggcccgcctgggcgtgctccccgacgaccgctggctgtgcccgctgtcgatgtaccacaccggcggcgtctcggtcgtcctccggacggcgctctacggcaccactgcggtcctgacccggacgcccggcttcgacgccgccgcggtcggggacgccctggagacccacgactgcaccggtgtctcgctcgtcccgccgatgctcgaccggctcgttgaggccgacgccgtccccgactcgctgcggttcgcactggtcggtggcgcgcccacgccgcccgagctggtcgagcgtgcgtgtgcggccggggttccggtctgcccgacgtacggcgcgaccgaaaccgcctcgcaggcggcgaccctgcacgccagcgacgccccagcccaccccgagagcgtcggccgcccactgctcggcaccactgtcaccgtcgtcgagccggacacccacacgccggtgccggacggacaggccgggctgctcgccgtgtcagggccgacggtcacgcccggctacgccggcgaggggaccgcgccgcgctgcgagcacgggctcctcacgggcgaccgcggctggatcgacgccgacggcttcctgcacgtcggcggccgggccagcgacgagatcatcaccggcggcgagaacgtccgtcccgaagcggtcgccgcggtgctccgcgagcatcccgccatcgaggctgtcgccgtcgtcggtgtgccggacgacgcgtggggcgaccgcgtcggcgcgctcgtggtgcccgccgacgacaccgcggacgtctccgtcgcctcactgcgcgcgttctgtgacgggcggctggcgggctacaaacacccccgcgtggttgcggccgtcgacgcgctcccacggaccgcgtcgggcaccgtcgaccggcaggctgcagtcgccgaactccgcgacgacgccgcgccgtag

SEQ ID NO: 42288 - DNA, 1323 bp, Halobacterium sp. NRC-1
atgaccgtcaccatcgtcggcgcccagctcggggacgaaggcaaagggggggtcgtcgacctcttcggagacgccacagacgtcgtcgttcgctaccagggcggcgacaacgccggccacacggttgtcgccggcggcgaagagtacaaactctcgctggttccgtccggggtcgtgcgcgggaagaccggcgtcctcgggaacggctgcgtgatcaaccccgaaacgctgttcgaggaagtcgacgcgctccgggagcgcggcctcgaccccgacgttcggttggccaagcgcgcacacgtcatcctgccgttccaccgcgagctcgacggcgcagaggaggccgcgaaagccgactccgacagcgagatcggcaccaccggccgcggcatcggcccgacctacgaggacaagatcggtcgccgcggcgtccgcgtcggcgacctcctcaacgaggacgcgctccgtgaccgcctcgaatacctcgtcgacgccaagcgcgccatctacgaggacgtctacggcttcgacgccagcgagaccgacggcgcgttcgacatcgacgcgatccacgagcagtgtctggcgtacgccgaccgcatccgcgacgaagacctcgccgtgaacgccggcgactacctcgccgaccgcatcgccgacggcgacaacgtgatgctggagggcgcacagggcaccagcctcgacatcgaccacggcaacttcccgtacgtcacgtcctcgaacccgacggcgggctacgccgccacggggtcgggtctcggcccgaccaccgtcggccagggtgagatcgtcggcatcatcaaagcctacctctcccgcgtcggcagcggcccgatgcccaccgagctggacggcgaccaggccgaatacatccgcgaggagggcggcgaatacggcaccgtcacgggccgcccgcgccgcgtcggctggctggacatgccgatgctccgccacgccgcccgcgccaacggcttcaccggcatcgccatcaaccacctcgacgtgctcgccgagctcgacgaggtgaacgtcgggcacgcctacgagcgtgacggcgagcgcatccacacgctcccggcgaccacggaagcatggcgcgactgcgaccccgtcatgaagtccttcgacggctggtcggcgttcgatccggcggtcgtcgccgacgccggctacagcgcgctgcccgacaacgcccaggcgtacgtcgagtacgtcgaagccgaactcgacacgccagcgtacgtgctcggtgtcggtcccggccgcgaggaatccgtcatccggcagaaccccttcgaataa

SEQ ID NO: 42289 - DNA, 1113 bp, Halobacterium sp. NRC-1
atggggctcgaggaggacatcgaatcgctcgaagaagaaatcgcgaacacgccgtacaacaagtcgacagaagcccacatcggccgcttgaaggcgaagctcgcggagcaaaaggagaagctcgaagcccagcagtccggcagcggcggtggcggcgggtacgcagtcgaacagcacggcgacgcgaccgtggccctggttggattccccagcgtggggaagtcgtcgctgatcaacgcgatgaccaacgccgacagcgaggtcggcgcctacgagttcaccaccctcaacgtgaacccggggatgttggagtaccgcggcgcgaacatccaactcctggacgtgccggggctcatcgagggtgcggcggggggacgcggcggcgggaaagagatcctctcggtgatccgtggggcggatctggtgatcttcgtgctgtcggcgttcgagatcgagcagtacgaccgtctcgccgaggagctgtacaacgtcaacatccgggtcgacgccgagccaccgtcggtgaccgtgcgccggaaaggcaaggacggcatcgacgtgaacacgtccggggagctggagttggacagcgacacggtcaagggaatcctgcgcgagcgcgggttcatcaacgccaacgtgacgatccgtggcaacccgtctgtcgaccggctgatcgacggggtgatggacaaccgcgtctacatgccgtcgctggtcaccgtcaacaaggtcgacctcatcgagccgtcgtacgcggggacaatgaaggacgccctccgcgatcacggcgtcagccccgacgacgcgatcttcatttcggccgccgaggagaagggattggacgtgctgaaagagcggatgtggcgggcgctcgggctcatccggatctacatggacaagccggggcggggcgtcgaccgcgaggagccgctcatcatccggcgcggcgagaccgtggacgacgccgtgcagaagctgggcggcaccctcgacgagcggttccggttcgcgcgggtcaccgggccgtcggcccaacacgacgaccagcaggtgggccgcgatcacgtcctcgaagacgaggacgtcctgcgcgtggttgcgcggcgctag

SEQ ID NO: 42290 - DNA, 1176 bp, Halobacterium sp. NRC-1
atgagggatggccgcgatcctgctggcatgccttcggagcgcgcggctgcggtcacgccgttcgccgcgatggatgtcctcgaacgcgccgccgaccgtgcggacgtgatccacatggaagtgggcgaacccgacttcgcacccccagccgcggccaccgaggcagcagtcgacgcgctgcgcgccggcgacgacgattacacgacctcgcgcggcaggcggtcgcttcgtgacgcgatcagcggctactacgccgccgaatacggcgtttcggtcccggccgagcgcatcgtcgtcacgccaggctcctcgccggcgctcctgaccgtgctgttggccactgtcgaccccggctcggcggtcgttctcagtgacccacattacgcctgctacccgaacttcgtgcggctcgccgacggggtcgtgcgcaccgttggtctcgcgcccgacgccggcttccagcccgccgtcagtgactacgacgcggcgatcggcgatgacaccgccgccatgctcctgaactcccccggcaaccccaccggagccgtgatcgacggggagagcctgtcggcgctcgtggccctcgccgaccgcaccgacaccgccgtcgtctccgacgagatctaccacgggctggcgttcgacgccgccgcgcactcggtgctggagtacaccgacgacgcgttcgtgatcgacggcgtctccaagcgctacggcatgacggggtggcggctgggctgggtggtgtgcccgcgccggtacgtcgatacgatcaacgcgatcgcccaaaacacactcatctgcgcgccgtcgttcgttcaggccggcgctgaggcggccatccgacacgggaccgactggctcgacggcgtgcgggccgactaccggacgcgccgcgacatcctgtgtgctgccgccgagcgctgggggttcgaccccggatacacgccggcgggcgcgtactacatgctgttggatgtgtcgcggctgggtgctgcgcccgctgttgccgacgcgctcctcgaaaccgcgggcgtcgcggtgacgcccggcccggatttcggtgcgaacgcaaccgagtacgtgcgggcgtcgtttgcggtgagtaccgacgctgtgcgcgaagccgtcgctcgcatcgatgctgtgctcgccagcgccacgacgctcacttga

SEQ ID NO: 42291 - DNA, 1197 bp, Halobacterium sp. NRC-1
atgacgcgcatcgaggctgtccgataccgtccgatcctggattcacgcgggaacaagaccgtcgaggcggaggtgaccaccgacgacggtgggttcggtcgtgcggccgcgccgtcgggcgcaagcaccggcgagcacgaggccgtcgagcttcccgtcggggaggcgatcgcggccggccgcgagcgtatcgcgccccgattggaggggcgtgagttcgcgggcgatcagcgcggcgtcgacgcggcgctgcacgccgccgacgacaccactgacttctcggcggtcggcgcgaacgtcgccgttgcgaccagcatggctgctgcgaaggcagcggcggacgtcctcggtgtgcacacctaccagcatttgggtggggcgcttcgcggccggaacttcccggttccgttggggaacgtcctcggcggcggcgcgcatgccgcggacgcgaccgcgatccaggagttcctggtcgcggcgaccggcgcgccgagcgttcggcaggccgtgttcgcgaacgcggccgtccatcagcgcgtcaaagaccgcctggacgacgacggtgtgccggcggcgaaaggcgacgagggcgcgtgggcgccgtcgatcgacgacgccaccgccttcgacgtggtggcaggtgccgccgcggaggtcgccgatgagttcgggttcgatgtccggttgggccttgatctcgcggccgccgagcgatacgacggagacgagtacgtgttcggtgacgaccgccggtcgacggcggcacagatcgaatacgtcgcaggactggtttccgagtacgacctcgcgtacgtcgaggaccccctcgacgagaacgacttcgaggcgttcgcggagctcaccgatcgcgtgggcgacgagacgctcgtgtgtggtgacgacctgttcgtgacgaacaccgagcgcctgcagcgcggcatcgacgcgggggctgccaacagcatcctcgtgaagcccaatcagatcgggacgctgaccgacgccgtcgacgcaatcgagctcgccacgcgcaacgggtacgacgcggtcgtatcccaccgcagcggcgagaccgaggacacgaccatcgcacacctcgccgttgcaaccgacgcgccgttcatcaagaccggcgcggtcggcggcgagcgaaccgccaagctaaacgaactcatccgcatcgcggacgaagcatga

SEQ ID NO: 42292 - DNA, 993 bp, Halobacterium sp. NRC-1
atgaccacgacttcgagtgcgccggggaaggtctacctgttcggcgagcacgccgtcgtgtacggggagccggcggttccgtgcgcgatcgagcgccgcgcacacgtgacggtctccgagcgcgaggacagccgccttcgggtgtgttcgggcgatctgtccatcgacgggttcaccgtggagtacagcggcgaccgcgacgccggcggcacgccggacgtggacgtgcccgcgccgatcgttgacgcggcgatggggtacgtcgacgccgccgtcgagcaggcgcgggcggccgcggacgcgccgacggccggcttcgacgtgaccatcgacagcgagatccccctgggggcggggctcgggtcgtcggccgcagtggtcgtggccgggatcgacgcggcaacccgagagctcggcgtggaactggacgcccgcgaggtcgccgaccgggcgtaccaggtcgagcacaccgtccaggacggcgaggcgtcgcgcgcggacaccttctgttcggcgatgggcggggtagtgcgcgtgtccggcgacgactgcaccacgcttgacgcgccggcgttgccgttcgtgatcggctacgacggcaccagccacgacacgggcgaactcgtggcgggggtgcgcgcgctccgcgaggagttcgggttcgtcgcggacacggtcaccgcgatcggcgacctcgtgcgccgtggggaggcggcgctggcggacggcgacgtggcgacactggggcggttgatggatatcaaccacgggctgctgtccggactcggcgtctccggtcgcacacttgatgcgatggtgtgggcggccagggacggcggcgccgacggggcgaagctcacgggcgccggcggcggcgggtcgatcgttgccctcgacgcgggcagcggtgctgaaacggcgctgtcgctgacgccggactgcgaggcggcgtttcgcgcggacctcgcgcgggagggcgtgcgcgtcgaatga

SEQ ID NO: 42293 - DNA, 1044 bp, Halobacterium sp. NRC-1
atgtcccaggaagcgcgcgaacgggcagtgctcgcggcggtccgtgagcgccgccagcaggtcaacgacgcgatcgacgacgacctcccggttgcggagcccgagcgcctctacgaggcgtcccggtatatcctcgaagccggcgggaagcggctgcggccggcggtcctgttgttgaccgcggaggcgctcgccgacacgagcgacacgcccccctaccgggagttcccggactgcatcggcggccacgtcgacgtgatgtcggcggcggtctcgatcgaggtgatccagtcgttcacgctcatccacgacgacatcatggacgacgacgacctgcgccgagggtcgccggctgtccaccgtgagtacgacaccgagaccgcgattctcgccggggacacgctgtactcgaaggcgttcgagatcatgctggagaccggcgcaccgcccgagcgtgggcttcgcgcgatgcggacgctggcggagacgtgcacccacatctgtgaggggcaggcgatggacatcgacttcgagactcggggtgacgtggtcaccgatgagtacttggagatggtggagctgaagaccgccgtcctgtacgcggccgccgcgaccctgccggggttgttgctctccgccgacgaggagacggttgaggcgctgtacaactacgggctgcgcgtcgggcaggccttccagatccaggacgacgtgttggatctcacggtgccgtcggcggaactcggcaagcaacgcgggtccgacctggttgaggacaagacgacgatcatcacgctgcacgccgccgagcacggcgtcgacgtcgatgggctgctcgacgccgaggacccggcggatgtcaccgaggcggcggtgcaagcggccgtccaagcgctccaggacgccgggagcatccagtacgcgagcgatctcgccgaggacctcgtcgaagaggggaaagcccacctcgaggtgctccccgagaacgaggcccgccaccggctggagcagatcgcggactacctcatcgagcgcgggtactag

SEQ ID NO: 42294 - DNA, 1761 bp, Halobacterium sp. NRC-1
atggacgacgaactccgcgagcgggtccgccgggcggcagagcgggccgcgctgttcaacgcgctgaaacacggcagcgacgcacaggtcggagccatcatgggaccgatgatgggcgagcaccccgatttcagagcgcacggcgacgagattcccggcgtcatcgcgcccgtcatcgaggacgtcaacgggatgagcgacgacgagcagcgcgcgcgcctcgcggaacttgcccccgaggacgtcgaggagttggacagcgaagacgagggcgacgaccacgcactgccggccctgccgaacgccgaggcgtacgacgaggtgcggatgcggtgtgcgccgaaccccaacggcccgtggcacgtcggccacgcccggatgccgtcagtcatcgggacgtacaagcagcgatacgacggctcgttcgtcgttcggttcgacgacacggaccccgagacgaagcgcccggacctcgacgcgtacgaccagatcctcgaggacctttcgtatctcgggttcgaggccgacgaggtgctgacggccagcgaccgcgtggagacgtactacgagcacgcccgccggctcatcggcatgggcggcgcgtacacgtgtagctgcccgggcgcggagttctccgatctgaaaaacagcggtgaggcgtgtccccaccgggacaaagaccccgaaaccgtcgccgacgagttcgaggcgatggtcgacggcgagtacaactccggggagatggtgttgcgcgtgaaaaccgacatcacgcacaagaaccccgcgctccgggactgggttgcgttccgcatggtcgacaccccccatccccgggacgcggccagcgggtaccgctgctggccgatgctggacttccagtcgggcgttgacgaccaccgcacgggcgtcacgcacatcattcgcggcatcgacctccaggactccgcgaagcgccagcggttcctctacgagtatttcggctgggagtaccccgaggtcgtgcactgggggcacgtgcagttggacgcctacgacgtggcgatgtccacatcgacgatcaaagagcgcatcgccgcgggcgagcttgaggggtgggatgacccgcgcgcgccgaccatgcagagcatccgccgccggggcatccgcggggcggccgtcgtggacgcgatggtggagttgggcacgtcgtcgtcggacgtcgagttggcgatgtcggcggtgtacgcgaacaaccgtgatctcgtggacgacacggccccccggcagttcctggttcgtgacggcttcgaggcgcgcggcgagggacccgaggagtcacacgaggctgtcgaggtccccgtcgacgacgggccggacgaggcgacaccacaggtccaccccgagcaccccgaccggggtgaccgcgagatccccgtcggggagcgcgtgctcgtggaggccaccgatctgcccgcggccggcgaccgcgtctggctgaagggctacgggccggttcgatacgacggcgagcgcttcgcgttcctcgacgccgacatcgacatcgtgcgcgaggagggcgtcgacgtggtgcagtgggtgcccgccgagcacaacgtcgacgtccggctgcggaccatggacggcgacgtgacggggtacgccgagcccgggttcgcggatcgagacgccgacgagatcgtgcagttcgtgcgcgtcgggttcgcgcgcgtcgacgcccaccgcgacggcggggcgtcggtcgcgtacttcacgcatccctga

SEQ ID NO: 42295 - DNA, 486 bp, Halobacterium sp. NRC-1
atgaccgatcacgacgagcgcacgttcgtgatggtcaagcccgacggcgtccagcgcgggctcatcggcgacatcgtcacccgactggaaacgaaggggctgaagatggtgggcgggaagttcatgcggatcgacgaggagctcgcccacgagcattacgccgagcacgaggacaagccgttcttcgacggcctggtgtcgttcatcacgtccgggcccgtgttcgcgatggtgtgggagggcgctgacgccacccgccaggtccgccagctgatgggagccacggacgcccaggacgccgcgccgggcacgatccgcggcgactacggcaacgacctcgggcacaacctcatccacggcagcgaccacgaggacgagggcgcaaacgagcgcgagatcgcgttgttcttcgacgacgacgagctcgtggactgggaccgcgatgcgtcggcgtgggtctacgaggacctcgcagaccacgactga

SEQ ID NO: 42296 - DNA, 1182 bp, Halobacterium sp. NRC-1
atgagcggcaacgacgacgccgatgacgcagccgaccggttccagacacgcgcgatccacgcgggccaagcgccggactcggagacgggcgcgctgatgacgccgatcttcgcgaactcgacgtacgtccaggacggccccggcgatcaccgcggctacgagtactcccggacgggcaacccgacgcgcacggatctggaagccaacctcgcgagcctggaaggcggcgagcacgggcgcgcgttcgcctccggaatggccgcgatcaacaccgtgttgaacctcctggcggccggcgaccacgtggtggcgggcgacgacgtgtacggcggcacccaccgcatcttcacgcaggtctacgaggactacgacatcgacttcgacttcgtcgacaccaccgaccacgacgccgtccgggaggccatgggggaggcgacggaactcctctgggtggagaccccgacgaacccgttgttgaacgtcaacgacatcggcgcgctcgcggacatcgcccacgagcacgacgcgctgtgtgcggtggacaacacgttcgcgacgccgtacctccagcgccccctggagttcggtgccgacatcgtctcgcacagcctcacgaagtacctcggcgggcacagcgacctcgttgcgggcgcgctgatcaccgacgacgacgacctcgacgagcagttcgggttctaccagaactccgtcggcgcgacgcccagtccgttcgactgcttcctggtgttgcgcggcacgaaaaccctgggcgtgcgcatggaccgccactgtgagacggccatggagcttgcggcgtggcttgcggatcacgagcacgtcagccaggtccactacccgggcctggagagccaccccgaccacgagctggccgccgcgcagatggacggcttcggcggcatggtctccttcgagttggacgccaccctcgaagcggccagcgcgttcgtcgaggagaccgacgtgttcacgctcgcggagtcactgggcggcgtggagtcactgatcgagcagcccgcggcgatgactcacgccgccatcccgaaggccgaacgggaggccgcggggctcaccgacgggctgatccgggcgagcatcggcgtcgagcacgtcgacgacctcaaggcggacctccagcaggccatcgaggccgccctgcagtag

SEQ ID NO: 42297 - DNA, 534 bp, Halobacterium sp. NRC-1
atgggcactgagacggcgacactcggcggcggatgcttttggtgcacggaagcggcgatggaggaactcgccggggtgacggacgtgacctcggggtacgctggcggggacaccgccgacccgtcctatcgagacgtgtgttcggggacgaccggccacgcggaagtcgtgcaggtggagtacgacaccgcggagctcgcgtacgaggacgtcctggaggtctttttcacggtccacgatccgaccacggtggaccgcgaggggcccgacgttggcagccagtatcggtcgatcgtgctcccccacgacgaccagcaacacgagcgcgccacggcgttcgtcgatgagctcgccgccgcggacgccttcgacggctcgatcgtcaccgagatcgagcccctggagacgttctatcccgccgcggagaaacaccagaactacttcgagaagaacccggacgcggcgtactgcacggtgaacgtcgcgccgaaggtctcgaaggtccgcgagcagttcggcgctcgtaccgagtaa

SEQ ID NO: 42298 - DNA, 1023 bp, Halobacterium sp. NRC-1
atggacaaggccgccgacgccggcctcctggggccgggcatccccatggcgtacggcggtgccggctactcaccggtggaggtcgccatcatcgtcgaggagctgttcgccgccgaccccggcatcgggctgtgcgtcgccagcgccgggttcggtgccgaagcgatcacggcgttcgggaccgacgaccagaagcggcggttcctcgaacccgtcaccgccggcgacgccatcatggggtcggcgatctccgagcccgacaccggctcggacgtggcaagcgtctccgcaaccgccgagaaagacggcgacgagtggatcatcgacggcaacaagatgtggatcacgaacggctccgtgggcgactatttcgtcgtcctgtgccggaccgatcccgacgccagcgggcgctacgaggggttcagtcagatcgtcgtcgaaagcgaccgcgacgggttcaccgccgagaagatcacgggcaaactcggcatccgggcgtccgacaccgccgaactcgtgctcgacgccgtgcgcgttcccgaggagaacctcatcggcacgcgcgggggcgggttcctccaactgatgcagttcttcgacgaaacccgcaccaccgtcgccgcacagggtgtgggcatcgcgcgcggtgccaccgaacgcgcgctcgcgtacgctcaggagcgcgagcagttcggccagcccgtcgccgacttccaagccatccagcacaagctcgcggagatgcagacgaaaacggaggccgcgcgcacgctcacgcggaagtccgcgtggagcgtcgaccaccgcgacgaccaactcaccgcgctggcgtcgatggcgaaatcgttcgcgtcccggatcgccgtggaggtcgccgacgaggcggtccagatccacggcggcgcgggctacgtcaacgacttcgacgtggagcggttctaccgggacgccaagatcacgcagctctacgagggcaccacggagatccaaaagaacgtgatcgcccgcgagatgatggactga

SEQ ID NO: 42299 - DNA, 1251 bp, Halobacterium sp. NRC-1
atgaccgagagtggtccgctggagaatatgctcgcgcagatggagcaggcgcgcgagtacgttgacatcgacgacggcatctacgagcgactgaagtcccccgagcgaacgctgtccgtcagtctcccggtgcgcatggacgacggcagcgtggaagtgttcgacgcctaccgctgccagttcgacagcgcacgcggcccctacaagggcggcatccgctaccacccgaccgtctccgaggaagaggtgtccgcgctggccggctggatgacctggaagaccgcgctcgtcgacctgccgttcggcggcgcgaaggggggcatcgtctgcaaccccaaggagctctcggacaacgagatcgagcagctcacccgccgctacaccgagggcatccgccggatgatcggcccggagacggacatccccgcgcccgacatgaacaccgacccccgcacgatggcgtgggtcatggacacctactccgtctaccaggggtacgcggttccggaagtcgtcaccggcaaacccccggagatcggcggcaccgacggccgcgtggaggccaccggccgcggcgtctccatcatcaccgaggagaccttcgaatacttcgacaccgacatccaggacgccgacgtggcgatccagggcttcggaaacgtcggcagcgtcacggccgatctgctctccgagcgcggcgcgaacatcgtcgccgtctcggacgtgaccggcgcgatccacgacccaaccgggctcgatatcgccgacgtgcaggcgtacgctgacgccaacggcggccgcctggaggggtacgacgccgaacccatctccaacgacgacctcctcacgctggacgtcgacgccctgatccccgccgcgatcgaggacgtcatcaccgtcgacgtggccgaacgcctcgcggccgacgtgatcgtggaagccgccaacggcccgacgaccttcgacgccgcccaagtcctcagcgaccgcggcgtccccgtcgtcccggacatcctcgcgaacgccggcggcgtcatcgtctcgtacctcgaatgggtgcagaacagccagcagtactcctgggacgtcgaggaggtcaaccgcgacctccgacagcggctcacgggtgccttcgacgagatgctggtggcctacgaggaccgcaacatcccgacactgcgcaccgccgcctacaccatcgccttggagcgcagcgcggacgcccacgagttccgcgggctgttcccgtaa

SEQ ID NO: 42300 - DNA, 1386 bp, Halobacterium sp. NRC-1
atgagcgacacccgcatcgacgccgccgaccgggaagccctacaggcgaacctcgtgcgcagccacgccgccggtgccggcagcgagctcgacacggcggcagtgcgcgcgctcctggtgacgcggctgaacgcgctcgcgaaggggtattcgggcatccgcgagcgcgtcctggacgtgctcgtggggctgctgaacgagggcgtccatcccgtggtgccgtcacggggcagtctcggtgcgagcggcgacctcgcgccgctggcacacatgagccgcgtgctcatcggcgaggggcaggccgacgtggcgggcgaacgcatgcccgccgccgaggcgctcgcggcggccgacctggagccggtgacgctgcaggccaaagaggggctcgcgctgatcaacggcacgcaactgaccaccggggtggctgcgctggcgctcgtggacgccgagcgcgtgctccgcagtgcggacaccgcgggcgcgctcacgacggaggtgacgatgtccacgacggcgagctgtgcccccgcgatccacgaggtccgcccccacgacgggcaggcggtgagcgcgcgacacatcaggaacctgaccgccggcagcgaggttctcgaccaccaccgggactgcgaccgcgtgcaggacgcctactcgattcggtgcctgccacaggtccacggggccgttcgggacgcgctggaccacctccgagcggccgtggcgacggagctcaacagcgcgaccgacaacccgctggtgttcgccggcgaccgcgtggggccgcgggccagtggcaccgaccgggcggcggtcgtctccggggggaatttccacggcgaggtgttggcgctgcgcctcggatacgccgccagcgcgctcgccgagctcgccgcgatcagcgagcgccgcaccgaccgcctgctcaaccccgaaacccaggagccacacctggagccgttcctcgccccggacagcgggctgcactcggggctgatgatcccgcagtacacggccgcgtcgcttgtcaacgacctgcggtcgctcggccagccaacactcgacaacgcgtcggtgtcgggcgcacaggaggaccacgtgagcatgagcgcgggggcggcgtacaacttccgggaggccgtcgagaaggccgccaccgtggttggcgtggagctgctgtgtggcgcgcaaggccgggagttcctcgatccggatctcgcgctcggtgcgggcacagccgcggcgtacgacctcgtgcgcgaggtgtctgaaccggtcgccggcgaccgggcgctggctgatgacatggctgctgtcggcgatctcgtccgtgcagggctggtcgaggacgcagttgcgcgtgcgctcgacgcgcccctcgcgtaa

SEQ ID NO: 42301 - DNA, 1197 bp, Halobacterium sp. NRC-1
atggcgatacggaccctcgacgacctggcggcggccaaccgcgcgatcggggtgcgcgtcgacatcaacagcccgctgacggccgccggcgggctggccgacgacgctcgcctgcgcgcgcacgtcgacacgctcgccgaactgctggctgcggacgcgcgcgtcgccgtgctcgcccaccagggccgaccgggcggcgacgagttcgcgcgcctcgaacgccatgccgaccgcctcgacgcgcttctcgatgcgcccgtctcctactgcgacgcgacgttctccacgggggcacgcgacgccgtcgccgacctcgcacccggcgaggcggtcgtgcttgagaacacccgcttctacagcgaggagtacatggcgttcgcccccgagcgcgcggccgacaccgcgctcgtcgatggcctcgcgccggcgctggacgcgtacgtgaacgacgcgttcgccgccgcccaccgctcacaaccctccctggtcgggttcccggaagtcctcccgtcctacgcggggcgcgtgatggaggccgaactggacgcactcagcggcgtcgccgacacgccaacgccacgcacgtacgtcgtcggtggcgcgaaagtgccggactccgtggaagtcgcggcacacgccctctcccacgggctcgccgacaacgtactcgtgaccggcgtggtggcgaacgtcttcctggcggccaccggtgtcgatctcggccgggcgtcgaccgacttcatccacgagcgcgactacgggacggagatcgcgcgcgcagccgacctgctcgcggcgcacaacgacgccctccacctgcccgtcgacgtggccgtcgagcgcgacggcgcgcggtgtgaactctccaccgacgccttgcccccggccggcgacgaagccgtctgtgacatcggcagtgacaccgtcgacgcgtacgccgacgtgctggcggactccgaaaccgtcgtggtaaacgggccggccggcgtcttcgaggacgacctgttcgccgacgggacgcgtggcgtcttcgacgcggcgtcggaagtcgagcacagcatcgtgggtggcggcgacaccgcggccgcgatccggcgcttcgacatcaccggcttcgaccacgtgagcacgggcggcggtgccgcgatcaacctcctgaccgacgccgacctgcccgcggtggcggcgctgcgatga

SEQ ID NO: 42302 - DNA, 1185 bp, Halobacterium sp. NRC-1
atgaacggcaaccggttcgggcggctgttcgaggtgacgacctacggcgagagccacggtccggggatgggcgtcgtggtgtcggggtgtccggctggcgtggcactcgacgaacggatgatccaggacgaactcgaccgccggaagcccgggcagtcgatgatcacgacctcccgtggggagcccgatgaggtctcgatccagtccgggctccaggacggctacaccactggcacgcccatcgggatgaccatcgagaacaaggacgccgagtccgggaagtacgaaccgttcgtgaccgcaccccgcccgtcccacggcgactacacgtactccgcgaagttcgggacgcgaaactggggcggcggcggccggtcgtccgcccgcgagaccgtcaactgggtggcggcgggcgcagtggcgaaggccgtgctggcgcagtctgaccacgacgtgcgggtgaaagcccacgtcaaccagatcggggagatcgaagcgccggacgtgtccttcgaggacatccgcgaacacagcgaggacaacgaggtgcggtgtgcggaccccgagaccgctgaacggatgcgggcgctgatcgacgactaccaggagcgcggcgactccatcggcgggtcgatctacttcgaggcgaggggtgtcccgcgagggctgggcgcgccgcgcttcgacagcgtgcccgcgcgcctcgggcaggcgctgttcgcgatccccgcgacgaccagcgtggagttcggcctcgggcgggacgcccgctcggtggcgggcaagcagcgcaacgaggactggacggtcgccgacggcgacgaggaccacgtcgtcgccgacgagggcgacccgatccccgcgggcaacgaccacggcggcctccagggcggcatcacgaccggcgaaccgatctacggcgaggcgtcctggcacgcgccgacgtcgatcccgaaaacccaggcgaccgtcgactgggagaccggcgaggagaaggcggtcaccgtgaccggccgccacgacccctcgctgccgccgcgtgcggtgccggtcgtcgaagcgatgctgtactgcacgatcctggatttcatgctgctgggcggccgcatcaaccccgaccggctggacggccaccccggccagtacgacaccgactaccacccgagcagtccgcgcaacgagtga

SEQ ID NO: 42303 - DNA, 1320 bp, Halobacterium sp. NRC-1
atgccgtgggccgccctcctcgccggtatgcacgcgacagtctcgccgtcccgggtacgggggcgggcgcgcgcgccgccatcgaagagttacacacaccgcgcgctgctcgcggcggggtacgcggacggggagacggtcgtccgcgacccgctggtgagcgcggacacccgcgcgacggcgcgggccgttgagctgctgggcggggcggcggcacgcgagaacggcgactgggtcgtgaccgggttcgggagccggcccgcaatcccggacgccgtcatcgactgcgcgaactcggggacgacgatgcgactcgtgacggcggcggccgcgctcgccgacggcacaaccgtcctgaccggcgacgagtcgctgcgcgctcgcccacacgggccgctgctggacgcgctctcggggctcggcgggacggcacgctcgacgcgcgggaacggccaggcaccgctcgtcgttgacggcccggtttccggcggcagcgtggcgctacccggtgatgtctcctcgcagttcgtcaccgcgctgctgatggcgggggccgtgaccgagaccggcatcgaaaccgacctgacgaccgaactgaagtccgcgccgtacgtcgacatcacgctggacgtgctggacgcgttcggcgtcggcgcgagcgagacggccgctggctaccgtgtgcggggcgggcaggcctacgccccgtcgggcgccgagtacgccgtccccggggacttctcgtcggcgtcgtacctcctggcagcgggcgcgctcgccgccgcggacggagcggcggtcgtggtggaggggatgcacccgagcgcgcaaggcgacgccgccatcgtcgacgtgctcgaacgcatgggtgccgacatcgactgggacactgagtcgggtgtgataacggtacagcggtccgagctgtccggcgtcgaggtcggcgtcgcggacacgccggacctcctgccgacgattgcggtgttgggtgccgccgcggacggcacgacgcgcatcacggacgccgagcacgtccggtacaaggagaccgaccgcgtggcggcgatggccgaatccctgtcgaagctgggcgcgagcgtcgaggagcgaccggacgaactcgtcgttcgcggcggcgacaccgaactctcgggcgcgagcgtcgacggccgcggcgaccaccggctcgtgatggcgctcgccgtcgccggactcgtcgccgacggcgagaccaccatcgcgggcagcgagcacgtcgacgtttccttccccgacttcttcgaggtactggcggggctcggcgcggacacggacggctga

SEQ ID NO: 42304 - DNA, 1848 bp, Halobacterium sp. NRC-1
atgtacgagcacgacgtcatcgtggtcggcggcggcggcgcgggactccgcgcagccatcgccgcccaagaggaaggcgcagacgtagcgatcgtcacgaagctccacccggtgcgcagccacaccggggccgcggagggcggcatcaacgccgcgctccgtgacggagactcgtgggaggaccacgcgtacgacacgatgaaggggtcggactacctcggggacgccccggccatcgacaccttcgcgaagaccgcgcccgacgaggtcattcaactggagcattgggggatgccgttctcccgggaggacgacgggcgcgtgagccagcggccgttcggcgggctgtcgttcccgcggaccacgtacgccggggccgagaccggccaccacatgctgcacacgctctacgagcaggtggtgaaacgcggcatcgaggtgtacgacgagtggtacgtctcggagctggcggtcaccgacgaggacaaccccaacgaccgcgaatgccacggcgtcgtggcgtgggacgtgcagtccggcgagatcgcggggttcaaagccagtgacagcgtcatcctggcgaccggcgggatcgggcaggcgttcgatcacacgaccaacgccgtcgcgaacaccggcgacggcgtggcgatggcgtaccgcgccggcgtccccgtcgaggacatggagatgatccagttccatccgacgacgctgccgtcgacgggcgtcctcatcagcgagggcgtgcgtggcgagggcggcatcctctacaacggcgagggcgagcggttcatgttcgagcacggctacgccaccaacgacggcgagctggcgtcccgagacgtggtgtcgcgggcggagctcacggagatcaacgagggccgtggcgtcgacgacgaacacatctacctcgacatgcgccacctcggcgaggagcgcatcaccgaccgcctggagaacatcctccacttggccgaggacttcgagggcgtcaacgggctcgaggagccgatgcccgtcaagcccggccagcattacgccatgggcggcatcgaaaccaacgagttcggggagacgtgtgtcagcgggctgtacgccgccggcgagtgtgcgtgcgtgagcctccacggcgcgaaccgcctcggcgggaacgcgctgccggagctcatcgtgttcggcgcgctcgcgggccgccacgccgccggcaaggagatggccgacccgctcatcgagaccgggcccagtgacgccctcgaacacgacgagctcagcgtgccgacgggcgcgcccgacggcgacgcgggcgtcgcggagccggccaccgacggcggcgcacagggcgcggtggacacccgcgcaccgaccgacgtggtcgcggacacggcgaccaccgaagaggagcgcatcgaggcgctgctgggccgcgaggacggcgtcaaccacgccgacgtgcgcgccgacctccagcagtcgatgaccgagaacgtcaacgtgttccgcaccgaggacggcctcaagcaggcgctcgcggacatccaggacgcgcgcaagcgttaccaggacgtctacgtcgccgacaagtcgcggacgttcaacacggacctgcaacacacgatcgagacgcgcaacctcctggacgtcgcggagatgatcaccatcggggcgttggcccgcgacgagttccggggcgcacactggcgcaaggaacaccaggagcgcaaggacgacgagtggctcaaacacacgatggtgtcgtggaacgacggcgaccccgacctgtggtaccgcccggtgctgcttgaggggcacgacgacacctacgagccgaagacgcgctcctactga

SEQ ID NO: 42305 - DNA, 879 bp, Halobacterium sp. NRC-1
atgagcacgaaaccatcacaatcagagaccgagaccgagaccgacacggagccggcgaccaccggccaccagcagcgccgcctcgacgacaagcgtgcgcgggccgacgaccgcgacgaggccgccgcgcaggccgagaccgagttcgacggcgagacggtcgagctgaaggtgttccggtacgatccggagatcgcgggcaaagaggagccgcgcttcgacacgttcaccgtccccttcgagacggggatgaccgtcctggacgcgctcatcttcgcgcgggacagctacgactccagtctgacgttccggcattcctgccggcaggccgtctgtgggtccgacgcgttcttcgtcaacggcagccagcggttgggctgccagacccagatcgaggatctggagtggccggttcgtgtcgagccgctgccccactcggacgtcgtcaaggacctggtcgtggagatggatcacttctacgaccagatggagtccgtcgacccgttcttcgacccggacgacctgcccgacggcgaactcgaagagcagcgccagagccgacagaaccgcgagaacatcaagctctcgacgcgctgcatctggtgtggcgcgtgcatgtcctcgtgcaacatcgccgccggggacaacaagtatctcggcccggcagcaatcaataaggcctaccggttctatatggacgaccgtgagggatcggagaagcgacaggagcgcctggagatcatcgaacaggagcacggcgtgtggcgctgccagacgcagttctcctgtacggatgtgtgccccaaggacatcccgctgaccgagcacattcaggagctcaagcgcgaagcagtcaaagagaacctgaagttctggtaa

SEQ ID NO: 42306 - DNA, 1980 bp, Halobacterium sp. NRC-1
atggacgtcgatgacatccacagcatcgcggtgcttggcgccggaaacatgggccacgggatcgcggaagtggccgcgatggccggatacacagtgcggctccgggacatctccgcggagctcgtccaggacggctacgaccagatcgagtggtcgctggggaagctcgcggaatccgaccagctcaccgaggccgcggccgacgccgcactcgaccgcatcagcacgcacgtcgaggtgagcgacgccgtcgacgacgtggacgtcgtcatcgaggcggtccccgagaagatggagatcaaaaccgacgtgtacaccgaggtcgaggcgcacgcccccgccgacgcggtgttcgccaccaacacctccagtctctccatcacggacctctcggaggtcaccgagcgccccgcgcggttctgcggcatgcacttcttcaatccgcccgtcaggatggagctggtggaagtcatctccggggcgcacaccgacgacgcggtgctcgaatgcatcgagtcgctggccgcggacttcgggaagacgccggtgcgggtgcgcaaggactcccccgggttcgtggtcaaccgcatcctcgtgccgttgctgaacgaggccgcgtggctcgtccacgacgacgaggcgaccatcgccgaggtcgactccacgaccaaatacgacatggggctgccgatgggggcgttcgagctcgccgaccaggtgggcatcgacgtctcccacgacgtcctcgattacatgcaggacgtgttgggcacggcctacgagccgtgtccggtgctcgtcgaccacgtcgaggccggcgacctcgggcggaagagcggcgctggcttctacgactacggcgatgacgcggccggcgcggacgtgccgaccgacgcgatccgggccgacatcgccgaccggctcaccgccgtgatggccaacgaggtcgcgaagctcgtcggcggcggcgtcgccgaccccgcggagatcgacgaggctgtgatgctgggcgcgggctaccccgaaggccccgcgaagatggccgacgcagcgggcatcacgtacctccacgagacgctggttgcggcccacgaggcgaccgggcaggcgcgctacgagcccgccgacaccctcgccgagatggcggcggccggcgagtcgttccacgggcgcggcgacgaggacgcggacggccgccgggagttcgacgccgtcagcgtctccgtcgacggcaacgtcggccacatcgaactcgaccgcccgcaccgcatgaacaccatcagcggcgagttgctggccgatctgtcggacgcgatcgacgtgctcggcgacgacgacgacgtgcgcgccgtcctcctgaccggcgcgggtgagaaagcgttctcggccggcgcggacgtcacgtcgatggcgggcaacgccgaccccgtagaggcggtggagctctcccggatgggccagcagacgttcggcaagctcgaagccgccgacgagccggtggttgcggccatcgacggctactgtctcggcggcgggatggagctggcgacctgcgcggacatgcgcctcgccagcgagcgcagcgagctcggccagcccgaacacgatctcggcctcctcccgggctggggcggcacgcagcgcctcaagcacatcgtcggcgagggccgcgccaaggagatcatcttcaccgccgaccgcttcgcccccgagacactggccgactacggcttcatcaacgaggtcgtcaccaccgaggcgttcgaggagcgcgcctgggagctcgcccgcgacctcgccgccggcccgccgatcgccatgaagtacacgaagcgcgcgatgcgtgccggccgcgacgacaccgacgccggcctggagatcgaggcgcagtcgttcggccagctgatgaacacccaagacctgatggagggcgtcagcgcgttctccgcggaccgggagccggagttcaacggggagtag

SEQ ID NO: 42307 - DNA, 1566 bp, Halobacterium sp. NRC-1
atgtcgaatctcgttaccaacgtccaaacctcggcgaccgagcttccggatcaccccgcagtcgtgtacgacgaccacacccacacctacagcgacctctgggagcgaaccggacagttcgcggccgcgctccgcgaccacggcgtgaccccggacgaccgggtcgcgctgtacctcccgaacctcccacagtacgtgacggcgttccacggcgcgctccgcgccggctgcgtcgtggtgccgatgaacccacagtacaagacccgcgaaatcgagtacttgctgtccgattccggggcgtcagtggtggtggcgctggccgacggtgcgtccaccgtcgaggacgtgcgcgcggagaccgccgtcgacaccgtggtcacggtcggcggcgacgccgacgttggcacgccgttcgaggctttcctcgacaccggcagcgacgacacggttgcgccccgcgacgacgacgacctcgccgtgcagccgtacacctccggcaccaccggccagcccaaaggcgtccagctcacacaccacaacctcgcgtcgaacgccgagcagtccatggacatcgtgcccgacggcctccaacccgcggaccgcaagatcggggtgttgccgttgttccacatctacggcatgaccgtcggcatgaacgccgcgctgttcgccggcgcgacgttctacccgatgcccaggtgggacaccgaggacgcgatgtcgctggtcgcggacgccgaactcaccctcttcgacggcgtccccacgatgtacaacgacatcatcacacaccccaacgccgaggagttcgacctgtcgtcggtccggcgctgcaccgtcggcggctccggcatccccaccgaggtgttgcggaagttcgaggagctgtacaccgcaaagatcgacgaggggtacgggctcacggagaccagcccggtgacacacttcaacagccccaactgggggcgtcgcgtgggctcgatcgggaagccgctggcggggatcgacgcccgcatcgtcaccgacgacttcgaatcggtgccacccgtcgacgagggccccgtcgacgagtccgaccacgacatggacgacatcacgggcgagctggtggtgtcggggccgaacgtgatggcgggctatctcgacctcccggaggccaaccgcaaggcgttcaccgaggccgacgggaagcgctggttccacacgggtgatctgggctaccacgacgcggacggctacttctacatcgtcgaccgcaagacgcacatgatcaacaccgcggggtacaacgtctacccccgtgaggtcgaggagttgctgttcgagcacgacgccatcgcggacgccgccgtggtcggcgtgcccgacgagcgccgcggcgaaacggtcaaagcgtacgtggtgcgggcacccgacacggacgtgtccgccgacgagatccgggagttctgtctgacgaacctcgccgagtacaaacacccacgcacggtcgagttcgtcgagcagctgccccgcaccaccacggggaagatcaagaagcacgaactcgtccccgacgaggactga

SEQ ID NO: 42308 - DNA, 768 bp, Halobacterium sp. NRC-1
atgacagacagatctgtggtgtccgggacggcgatcgtcaccggcgcttccagcgggatcggccgggcgaccgccgagcgactggcggccgacggcgcacgcgtcgtgctctgctcgcgcgaccacgcggacgtcgacgcggttgccgacgccatccgaacggacggcggcaccgccctccccgtcgagtgcgacgtcaccgaccgcgacgccgtcgacgcgctcgtcgaagccaccgtccacgagttcggcggcctggacgtgctcgtgaacaacgccggcgcgagcttcgtcgcgccgttcgacgacatctcgcggaacggctgggaccgcatcatcgacgtgaacctcggcggcacctacaactgcacgcaggccgccgccgaacagctgaaacgcgacggcggcggggccgtggtgaacgtcgccagcgtcgccggccaggaggggtcgccacacatgagccactacgccgccgcgaaggccggcatcatcacgctcacgcggacgctggccgccgagtgggcacccgcgggtgtacgcgtgaactgcatcgcccccgggttcgtcgcgacccccggactggacgcacagatgggcgtcagtgcggccgacatcgaccgacgggaggtcgcccggcgcatcggcaccagcgccgagatcgccgacgcgatccggtttctcgccagccccgcggcgtcgttcgtggtcggtgagacgctcaccgccgccggcgtcccgcagggcgaggaggtgccgtcgccgtga

SEQ ID NO: 42309 - DNA, 1413 bp, Halobacterium sp. NRC-1
atgagcgaggattaccgcacggagcaggacagcctcggcgagatgcaggttcccgctgacgcctactggggggcacagacccagcgcgcgatcgagaacttcccgatctcggggatcgcgttcgggcggcggttcgtgcgcgcgctcggcgtcgtcaagaaggccgccgcgcaggcgaaccgcgacctcggcctcgttgacgacgagcgcgccgacgccatcgtcgcggccgccgacgaggtcatcgccggcgagcacgacgaccagttcccggtcgacgtcttccagaccgggtccgggacgtcctcgaacatgaacgccaacgaggtcatcgcgaaccgcgccgcggagctcctcggcgaggagatcggggatcgcgtcgtgcaccccaacgaccacgtgaactatggccagtccagcaacgacgtgatcccgaccgcgatgcacgtggcgagcctcgacgcgctcgtcaacgacgtcaaacccggcctggagacgctggcagcggaactcgacgacaaagcggacgcgttcgacggcgtcgtgaagaccgggcgcacgcacttgcaggacgccacgccggtgcggttgggccaggagttcggcggctaccgcacccaagtcgagaagggcatcgaccgcatcgaggccgttgccccgcgcctctcggagctcgcgctcggcggcaccgccgtcggcaccgggctgaacacccaccccgagttcccggagacggcggccggctacatcagcgaggagaccggcgttacgttccgtgaggcggacaaccacttcgaggcgcaggccgcccacgacgccatgaacgaggcccacggcgcgctgcgcacggtcgcggggtcgctgaacaagatcgccaacgacctccggctgcttgcctccggcccccgcaacgggctgggggagatcgagcagcccgagaaccagcccggctcctcgatcatgcccgggaagatcaaccccgtggtggcggaggcggtcaaccaggtccacaagcaggtcgtgggcaacgacgccgccatcgccgcgggggccgcggaggggcagatcgacttgaacctctacaagcccgtgctggcgcacaacttcctgcagtccgcggacatgctcgccaacgcgagcgctgccttcggcgagaagttcgtcgccaagctcgaagccaacgaggccgcctgcgaggcgcaggtcgagcgctcgatggcgctggcgaccgcgctcaaccccacgatcggctacgacaaggccagcgaggtcgcgaaggccgcgctgaaggaggggaaaacagtcacggaggtcgtcgtcgagaagggatacctctcggaggcggaggccgctgacgtgctcgaccccgaggggatgacccaccggggcatcctctccggcgacgacacgtag

SEQ ID NO: 42310 - DNA, 984 bp, Halobacterium sp. NRC-1
atggggaacgcggacctccggcagctcgcggccatcgaggagactcccttcgcggacctcgaagggagtgtggtggccgtcgacgcccacaactggctgtacaagtacctcaccacgaccgtccagtggaccggcgcggacgtctacaccaccagcgacggcaccgaagtggcgaacctcgtcggcgcggtgcagggcctgccgaagttcttcgaacacggcctcacgcccgtgttcgtctgggacggcggggtcaccgagctcaaagacgacgagatcgccgaccgccgcgagcaacgcgagcgctacgaggaacagctcgacgacgcccgcgaggcgggcgacgccgccgaggcggcgcgcctggacgcgcgcacgcagcgactcacgcccaccatccacgagaccacccgggagctgttcgacctgttggacatcccgcaagtcgaagcccccgcggagggcgaagcacaggccgcatacatgacgcggacggacgacgccgtcgactacgcgggcagcgacgactacgactgcctgctgcttgggtcgccggtgacgctgcgccagctcacgagctccggccacccggagctgatggacttcgacgcgacgctcgccgaacacgacctgacgtgggagcaactcgtcgacgtcggaatcctctgtgggacggatttcaaccccgggatcgacgggttcggaccgacaacggccctggacgcgatcggcgagcacggcgacctctgggacgtgctggcggccgaaggcgagcacgtcgcccacggcgaccgcatccgggagctgttcttgaaccccgacgtgaccgacgactacgtgatcgaccccgacgtgtcgccggccatcgacgcggcccgcgcgttcgtcaccgacgagtgggaggtcgacgccgacgcggtcgcccgggggttcgagcgcatcgacgccgcggccgcacagaccggcctcgaccggtggacgtga

SEQ ID NO: 42311 - DNA, 2403 bp, Halobacterium sp. NRC-1
atgggcgacgccgacgagccgtggcgcgagttcttcgggttcgaggcaccgtacgaccagcaggccgacgccatcggggcggccatcgaagccggtgacagcgacggcttcctcgcgatggaggggccttgcgggacgggcaagacgatggcggcgctgaccgcgggcgcgcacctcgtgcgcaacaccgacagctacgagcgcgtgttggtggtgacgccggtcaaacagcaactggagcagttcgtcgcggacctccgaacgatgaacgcgggcctcgatgaccccttggacggcgtggcgctcgtcggaaagcgggatctctgcccgtacgagcgcgaggacaagttccccgacgacgccggcgtccacgagcgctgcgaggacctccgggagtcgactgccggcctcgtggagggcgacgacggcggcgagttcgacgggcaggacgcacgcgacctcaccgaactgccggcggcagagactcccgacgagccgtggtgggatcccgcagcgggtcgggcgctggcgcggtcggcgcgcgccgacgccagccagacgctctcgcagaccccgctgcggacggctggcacggacgcaccgtacgtcccccaccagccgaccgcccccgaggacatggccgacggcgacccgccgctgatgtgtccgttcgaggccgactggtacggccgcgacaagggctcgccggtcggcttcgagaccggtcagcacaacgtcgtcacgagcgcggacgtgttacccgcaggcgtcgaccacggaacgtgcccccaccgcgtccagcaggtgctgttggaccacgcggaggtcgtcgtcgggaactacaaccacctcttcgacccccagacccgggggctcaccgaccacctcatcgacgactcgacgttcgtcgtggtcgacgaagcccaccgtctagaggagcgcgttcgagacctgctctcggaccgcctggggcggcacacgctcactcgcgcccgcaacgactgccggacgctgctcacgcgggccaaccagagccgggagaaccgccagcaggtcaccgaccacctcgccagccacgactgctcgctcgacgccgtcgaggcgatggtcgggttcctcgacgacgtgctggagtggctcgacgaccgcgtggcgcgatacctcgccgcggaggggttcgaccccgaccgcccggggtcgctgcccgaacgcgaccacgagatcccgctgcgggaccccgaaagcgagcagcccgacgcgctcacgcagtgggccgaacagcacggccacaccggggacgcgtggcggtcgctggcggcaaccggcaccgcggtgcaggcgatcctcgacgacgacggcgaccgatcggcggtggcgggccccgtgggcgtcacgctccagcggtggtgggaacgcgaccacgcgacgtacttccgggaggtggagctagagcacgtgcccaaggagtcggggcgggccggcgcggcgtgggccgaatcctacacccccgcgctcgtgatgttcaactgcatgcccgcccgcgcgctccgggagacgctgtcggaggtcggcggcggcgtgttgatgagcgccaccctggaaccgctggacgtgttccgggaggtcgccggcctggaccgcctggcggcgggcgcgggcgacagcgacccccgccccgtcgtggagcgccgctacgatctgcggttccccgaatcgaaccgcgcgagcttcctcgtcgacgccacgccgttcacggcgcacaaccgcggcgaccccgagccgggcaccgacaacccgacgcgcgacgaataccgctacgtgctgcggacggtcgcccgccagcccggcaacgttctcgtctgcatgccgaactaccgggaggcggcgtgggcggccgcctatctcagcgacggcgtcgtcgagaaggacgtgctcgtcgacgaatcgtcgtcgaacgccgcgactgacgacctcaaagcgacgtttttcgctggcgacggcaaggtgctggtgacgagcacacggggcacgctcaccgagggcgtcgactacgacggcgcgaaactcggggcgtgtctcgtcgtcggcgtgccactggtgaacgtcgggtcgccacggattcgggcggtcaggcgcgcgtacgccgacgccttcggcgacgaccacgccttcgagtacgccctgacggtgcccgcggttcggcgcgccagacaagccatcgggcgcgtgatccgcggccccgaggaggtcggggtgcgcgtgttcgccggcggccggtacgtcgaggacgcacgccactccgtcttcgagtatctcggcccgggtgagcgcgccgagttcacgacgctcacgccgtcgttcctcgggagccagctggacgcgttccgctcggagtcggactga

SEQ ID NO: 42312 - DNA, 894 bp, Halobacterium sp. NRC-1
atgaccgagatcatcgacggcgacgccgtcgccgcgcaactgcgcgcggacctcaccggggccgtcgaaacactcgaaaccgcgggtgtcacgccacggctggcgaccgtactgatgaacgacaagcaggccagcgagacgtacgtctcgatgaaacaacaggactgcgaggaggtcgggatcgccgccgaggacgtccgcatcgaccccgaagcgtccgccgacacgctgttcgacaccgtcgccgagttgaacgcccgggaagacgtccacggcatcctcgtccaggacccgacccccgatcacgtcccggacgagcgcgtgctctccgcggtcgaccccgcgaaggacgtcgacggcttccacccggagaacgtcgggaagctggtcggcggcaccccgcgcttcaagccctgtacgccccacggcgtccagaagctcctcgcacaccagggcgttgaccccgacggcgcggaggtcgttgtcgtcggccggtcgaacatcgtcgggaagccgctggcgaacctcctcgcacagaaggccgccggcggcaacgccaccgtgacgatctgccacagccacaccgacgacctcgccgcgcacacccggcgagctgacgtcgtggtcgcggcctgcggggttcccgagctgatcgacggcgacatgctctccggagacccggttgtcatcgacgttggcatcaaccgcgtcgacgcggacaccgagaagggctacgaactcgtcggcgacgtggactacgactcggcggaggcggccgccagcgccatcacaccggtccctggcggtgtcggcccgatgacgcgggcgatgttgctgtacaacaccctggcggccgccagcgagcagaccggcgttgcggtcgcgctcccctga

SEQ ID NO: 42313 - DNA, 1032 bp, Halobacterium sp. NRC-1
atgaccacagttggcgtactcggtgcgaccggcgcggttggacagcgcttcgtacagttgctcgccgggcacgagaccttcgagttgtccgtcgtgactgccagccccgacagcgccggtgaaacgtaccgtgacgccgcgaactgggggctcgacacgccggttccggagtccatcgcggagttgcccgtgcagccgaccacgccggctgcgatcccagacgacacggccctcctgttctcggcgctgcccagcgacgtgggggcggaggttgagccggccctctgcgaggctgggttcgtcgtctcctcgaacgcgagcaacgagcgccgcgccggcgacgtgcccctcgtggtgccggaggtgaacgccgaccatctggggttgatcgacgtgcaacgcgacgcgcgcgggtgggacggcgcgctcgtgaagaacccgaactgttcgaccatcacgatggtccccacgctggcggccctcaccgagttcggcctggatcgcgtgcacgtcgcgaccctgcaggccgtctccggggcgggctactcgggggtcacgtcgatggagatcctggacaacgtcgtgccccacatcggcggcgaggagcggaagatggagaccgaatcccggaagctcctcggggagttcacgggggccgaagtccaacaccacgacgccgtcgtgtccgcctcctgcaaccgcgtccccaccttggacgggcacttggagaacgtcttcgtcgaaaccagcgaccaccccgcgcccgcggacgtggcggccgcctttgaggacgcgccgacactcgacctcccgagcgcgcccgacccgctcatcgagaccttcaccgcccccgagcgcccgcagccccgcctcgaccggatgcgcggcgacggcatggcgatcgccgccggcggcatccagaccaccgacaccggcatccagtacaactgcctcgcgcacaacaccatccggggcgcggccggcgcgagcatcctgaacggcgaactgctcgcccgcgagggctgggtctga

SEQ ID NO: 42314 - DNA, 1278 bp, Halobacterium sp. NRC-1
atggagtacgaagccgtcgccgacctcgcgccggatcgccgggtggcgttgttcgaacgggacgccggcgtcgacgccgtgcgctcggacgtggcggaaatcctcgaccgcgtggagagcgagggcgacgttgcgctgcgggcgctcgccagcgagttcgacgacgtcgaggtcgggaacctggacgtcaccgacgagatggagcgcgccgctgacgcggtgcccgacgacgtgtacgacgccatcgaggacgccgcggcgaacatccgggcgttccacgaggcccagttgcccgacgactggcgggagtcgttcgctgcggggcgggagctggggcggcgcttccggcccgtgcggcgggtgggcgtgtacgcacccggcggcacggcagcatacccgtcgtcggtgttgatgggggtgatcccggcggtagtggcgggcgtcgaacaggtggccgtggcgacgccgcccgccgagacgatcaaccccgtcaccctggcggcggcgcacgccgccggcgcggaccgcgtctaccaggtcgggggcgcgcaggccatcggcgcgttcgcgtacggcaccgagacggttgacaccgtccagacggtcgtcggccccggcaacaagtgggtgacggcggccaaagccgaggtgcggggcgacgtggagatcgacttcctggcgggcccctccgagttgctcgtggtcgcggacgaaaccgcggagccggcgttcgtcgccgccgacctgctcgcgcaggccgaacacgacccgaacgcgagcgtggttgccgtcaccgacgacgaggcgaccgccgccgcgatcaccgacgcggttgcggcccgcctcgacgaccgcgaacgcgccgacaccattcgggccgccctcgacaacgaggccagcggcgtgttcgtcgcgcggtcgatgagcgaggccgtgatgttcgccgaggagtacgccgccgaacacctctcgatccaggccagcgacgacgaggcactgctggaccgcatcgacagcgccggctcggtgttcctcggcgggtacgcgcccgtcgccgccggcgattacgccgccggcaccaatcacgtgttgcccaccaacgggactgcacgggtcaccggcggcctgagcgtcgacacgttcctgcggtcgacgacggtccagcgcctcgaccgcgaggggctggcggcgctccgggagacggtgaccacgctggccgacgccgagggacttgaggggcacgcggccagcgtcgacgctcggttcgaggacgagtaa

SEQ ID NO: 42315 - DNA, 2076 bp, Halobacterium sp. NRC-1
atgacgcgggtgcgtgtcaccctcagagacgccgccgacaggacagccgacgcgccggctgtcggtccgggccagctcagtttcaccgccgaaacccgccagcagatcggggtggcggagggcgacgccgtcaccgtcaccggcagcgaggacaccgttgcgactgtcggccccgacaccacggccatcgcggccagcagcgggctcgcgggcgcggatgtgctgcggaacgtcggcccgacggacacggtcacggttgcgcccgccgatcccagtccggcagccgagctcaccgtggcaccggccacgtcgtcgaccctggagggcgacgccgacgcgcttgcacgcgcgctcgccgggcgtcacctggtcgcggacgaccgcatcgccgtgccgctgttcagcggcaccgtcgtggtgactctcgacgtcgaggacacgacgccgggcggtcccgtcaccgtcaccgccgacacggcgatcacgctcacgggccacgccgccgacagcgggcacgcggacgcggagcacgcgacgccggccgacaccagggtcggcgggctcgacgacgaacgcggtgcgctccggcggctcgtcgtcgcgccgctggtcgccgattcgtacgccgccatcggcgtgcggccgccggccggcgtgctcgtccacgggccggcaggcaccgggaagacaacgctcgtgcgtgcggtggcggcggccgccgacctggcggtcgagtcggtggcccccgaggacgccggcgaccgggacgcgctggcggcggtgttggacgccgcccgggacgccgagccgggctgcgtggtgttcgtggagtcgctggccgcggccgcccccgacccgacggcggacggcgccagcggtcgcgggtcgccgtcggcgctcgggtggctgctcgaccgcgtccggggccacgacacagtcgtggtggtcggggagaccaccgatcccgacgccgttgatccggcgctccggcggggcgggcgtttcgacgcggaggtgcgcgtcggcgtgcctgatccggccgctcggcgcgccatcctcgacgtacacacggacggcgttcggctcgccgacgcggtgtcgctggacgcggtggccgaccgaacccacgggtacaccggcgcggacctgaccgccgtactcgtcgacgccgcgaccagggctgccggcagcgcggccggcccgccggtgatccgccagcgcgacctcgaagccgccctggacgccgtgggtccgtccacgctccgcgacgcgtcggtgcagacgccgacgaccacctaccaggacatcggcgggctcgaccgcgcgaaacgcgaggtggtgcggaccgtcgagtggccccagcggtatccggcgttgttcgagcgcttggacgcggccgcgccgaccggcgtgttgttacacgggccgcccggaaccgggaaaacgatgctcgcgaaggccgtggcggcgtccacggacgcgaacttcctgtccgtcgacggcccggagttgatgaaccgctacgtgggcgagagcgagcgcggcgttcgggacctgttcgagcgcgcgcggcggctcgcgcccgccgtggtgttcctcgacgaggttgattcgctcgcgccggcccgccacgacaccgacacgggggcgtccgagcgcgtcgtctcccagctgctgaccgagctagacgggctgtcgccccgcggttcggttgcggtgttggcggcgacgaaccgtcgggagtcggtggaccctgcgctgcttcgcccggggcggatcgaaacccaggtcgcggttccgatcccggaccaggacgcccgggccgcgatcttcgaggtgcaactcgacggcgtggcgaccggacgcatcgacaccaccgcgctggccgccgccacgaccggctacacgggcagcgacatcgcgggtgtcgtccgcgagggtgcgctgttggcgatggaggaccacctccgcgagacggagttcgacgccaccgacgccagcgggctggtcgttacccagcgccacctgcgccgcgccatcgagacgacggccccgtcggtcgacggcgcggggtga

SEQ ID NO: 42316 - DNA, 2280 bp, Halobacterium sp. NRC-1
atgaaactcacggtcaaaccactcaaacagaaggacgcaggtcgcggtctcgccgccgtcgaccgcgactccatggacgagctggcgctcgaaaacggcgactacgtggttatcgacgggcagggcgaccacgggcgcgcggtcgcccgcgtctggccgggctaccccgaagacgacggcgacggcgtcgtccgcatcgacggacggctgcgcaaggaggccgacgtcgggatcgacgatcaagtcaccgtcgaacccgcggacatcaagcccgccggcggcgtcaccgttgccctcccgcagaaccttcgcgtgcgcggcaacatcgcgccgatggttcgtgaccggctcaacggccgcccggtcaccgccgggcaaaccatccccatctcgttcgggttcggcggcatgagcaccatctccggccaacagatcccggtcaagatcgccgaaaccgagcccagcggcacggtcgtcgtcagcaacgacaccgaaatccagctctccgagcgccccgccgaagagatcgcgccgggggccggtgaggcagccgagaccggcgaccccacgccgaacgtcacctacgaggacatcggcggcctcgacggcgaactcgaacaggtgcgggagatgatcgagttgccgatgcgtcaccccgaactcttccagcaactcggcatcgacccgccgaaaggcgtgctcctccacggcccgcccggcaccggcaaaacgctcatcgcgaaagccgtcgccaacgagatcgacgcgcacttcgagacgatctccggcccggagatcatgagcaaatactacggcgaaagcgaggagaagctccgcgaggtcttcgacgaggccgaggagaacgcccccgcgatcgtcttcgtcgacgagctcgactccatcgcgcccaagcgaggcgaaacccagggcgacgtcgagcgccgcgtggtcgcccagctgttgagcctcatggacggcctggaggaccgcggcgacgtcacggtcatcgcggcgaccaaccgcgtcgacgccatcgaccccgcgctccgccggggcgggcgtttcgaccgcgagatcgagatcggcgtccccgaccaggacggccgcaaggagatcctgcaggtgcacacgcgtggcatgccgctggtcgaggacatcgacctcgacgactacgccgagagcacgcacggcttcgtcggcgcggacatcgagagcctcgccaaggaagccgcgatgaacgcactgcgccgggtgcgcccggacatcgacctggaatccgacgagatcgacgccgaactcctggaatccatctcgatcacggaagccgacttcaagcgcgcgctgaacggcatcgagccgtccgcgctccgcgaagtgttcgtggaggtgccggacaccacgtgggcggacgtcggcggcctcacggacaccaaagaacgcctccgggagaccatccagtggcccctggactacccggacgtgttctccgagatggatctccagtccgccaaaggcgtcttgctgtacggcccgccgggcaccggcaagacgctgttggcgaaagccgtcgccaacgaggcgaactcaaatttcatctccgtgaaaggcccggagctgctgaacaagtacgtcggcgagtccgagaagggcgtccgtgaggtgttcgagaaggcgcggtcgaacgccccgacagtggtgttcttcgacgagatcgacgccatcgcgggccagcgcgggcgcgcaaccagcgactcgggcgtgggcgagcgcgtcgtctcccagctgctcaccgaactggacggcatcgaggccctcgaagacgtggtcgtggttgcgacctcgaaccggccggacctcatcgacgacgcgctgctgcggccgggccgcctcgaccgccacatccacgtgccggtgcccgacgccgacgcgcgccgcgcgatcctcgacgtgcacacgcgcgacaaacccctcgcggacgacgtcgatctcgacgtcgtggcccagcggatggacgggttcgtcggcgcggacgtggaggcgctcgtccgggaggccacgatgaacgccacccgcgagttcatcaactccgtcgaccccgccgacgccagcgactccgtggggaacgtccgcgtaacgatggcgcacttcgaggccgcgctcggggaggtcacggccagcgtcgacgcggacgtcaaggagaactacgaggagatcgaacagcggttcaacaccgcggacacgccgaccgacgacgaacccgcgtccggagcgttccgctga

SEQ ID NO: 42317 - DNA, 1125 bp, Halobacterium sp. NRC-1
atggacttgtccgccgagcagcgtcggatgcgcgaatccgtccgcgagttcgccgtcgaggagatccgtccggtggccgccgaagcagaccgcacacagtcgttccccgaagaggtctgggacgacctcggggagctcggcgtcaccgcgatgacgacgccggcgtcgtacggcggcctggacgtggactcgctgacctacagcgtcgtcaacgaacagctcgcgtacggcgcgctgtccgtcgcaaccgcgctgtcggtgcactgcctggcgacctcctgcatcgcggagttcggcgacgacgaccaacaggagcggtggctgccggagatggccgacggccgcccggtcggcgcgttcgcgctgtccgagcccgacgccggttcgaaccccgcacagatgtccaccacggcgcgccgcgacggcgacgagttcgtgctcaacgggaaaaagcagtggatcacgaacgggaagcgttcgggcgtcgtcatcgtgttcgcgaagatcgacggggacgacgacaagatcacgcagttcctcgtgcccaaggacgccgacggcctcacggtcggccccaaggaggacaaactcgggctgcgcgccagcgacaccacgtcgttgctgttcgacgactgccgcattccggccagcaaccagctcacagaggcgggccgcgggctgtcggccgcgctccacatcctcacgggcggccggatcgggatcgcctcccaggctgtgggcctgagccaggccgccctcgacgcggcgctcgcgtacgccgacgaccgcgagcagttcgaccagccgatctccgagatccagaccatccggcacaagctcgcggacatggaaacccaagtgcaggccgcccgcctgctctcccgggacgccgcacggatggccgacgccggcgaggaccaccagaccgcggccgcaaaagcgaagtatttcgccagcgaggcggccgtcgacgtgaccaacgaggcggtccagatccacggcggctacggctacaccaaggacttcgacgtggagcggttctaccgcgactcgaagatcacgaccatctacgaggggacctccgagatccagaaggaagtcatcgcgcgcggcctgatcgactga

SEQ ID NO: 42318 - DNA, 2466 bp, Halobacterium sp. NRC-1
atggagcttgcggtgcacgacgccaccgaggacggggcggggtacgcaaccgcggcgtcgtcgtgggtggtcgtcgaaccggagttcgtcgtggacgtgaccgacatccggtcgttcgtgcagtgcccgcggctctactacttgaacaagctctccgggctgccgttgaagtatccggtgacgaaaggaacgatcgtccacgaggtgttcggggatctgcttcggggccgcgatctggaggcgtcggtcgcccaacgggtcgacgaagccggcctggaactcgggctgctgggtcggagccgcgcggaagtcgaggccgacgtgcgggacaacgccagcgccatcgagggctggctccagcagggccggctgaccgacgaggacgagtggcgctcggagtacacgctggtttccgagcgcttcggcatcaaaggccggtgtgacgccatccggcgcgggatgcccgtggagctgaaaacggggaagaacacgaaccgcgagccccgattccacgacaaagtgcaggcggcctgttacgcgctgatgttggacgagcacggcgtccccgcggacacggggacgctgctgtacacgaagaacgcggccgtcgaccgcagcgaggcgtccggcgacctctcgcccgccaaggagttctccatcggccgggggttcctggagttcgtcgtgcgggagcgcaaccacctcgccgccctcgaagcgagcgacggcccgccgacgggctacgaggccgacgccaaatgcgactactgcttcgagcaggacacctgcatggtggtctcgggccgcctcgatcaggagtccaaggccggccggatcggcgatccggtgcccgccgaggagcgcgcgtacttcgacgagctgtacgacgccatcgaggccgagcgcggcgcgatccacgacgaataccgcaagctctgggagcagtcccccgacgagcgcgcggcggacgaccgcgccgtcgtcggcctcagcccggccgagcagacggagcttccggacggccgctggcggctgaccgccacccgccccggcagcgccgcctcgaagatccgggagggcgaccgcgtgctcgcctcggacggcgaccccgtggcggggcgcgcggagatggcgcgcgtcgagcgattggacgccgaccgcgtcgaggtcaccaccgacgaacccgtctcgctctgccggctagacgtctacccctcggagctctccgtcgaccggatgctgaccgcgctccacgacgccgtgctgaaaagcgaccagcgccgcacggacctcttattcgaccgggccagcccccgtttcgaaggcggagaccacgacctgatcccgaacaacgacgcccagaacgcggccgtgaaccgcgcgctgaacgccgaggacttcgcgctcgtccacgggccgcccggcacggggaagacgtacaccatcgccaccctggtgcaggcgttcgtggcgcgcggcgaccgcgtgctcgtctcggcgttcacgaaccgcgcggtggacaacgccctcgacgcgctccgccagcagggccacgaggacatcgtgcgggtcggcacggaaaccggcgttcgggcggacatgcaggacctccggctggatcggtccggtgaccccggcgagcgcgcggccgccctgcggtcggcgcccgtcgtcgccgccaccacggccacgtgtggctcccgcatcctccgggagttggagttcgacgtggtgctcgtcgacgaggccagccagctcaccgagccggacacgctggccgcgatcaaccggggcgcgcggttcgtgctcgtcggcgaccacgagcagctcccgccggtggtgcgttccggcggccggctctcgaaatccctcttcgaacgcctccacgagacgtacccggaggcgtcggtgatgctcgaccagcagtaccggatgagccagcgcattcaggcgttctccagccgcgagttctacgacggccagctgcggccggcatcgagcgaggttgctggccagcggctcaccgatgttggggtcgaccccggtggtgccgtccacggcggggtcacgttctacgacgtgcccggcacggacgacgcccacgtcgaccccgcggaagccgatcgtgtcgcagacgtcgtcaccgcgtacgtcgacgccgggctggatcccggtgagatcggcgtcatcgcgccgttccgcgcacaagtcgcggagatcgggcggcgcaccccggcgggcgtcgccgtcgacaccgtcgaccgcttccagggctcctcgaaggaggtcatcgtcgtctcgttcgtcgcccgcggcacgcttgagggccccatcttcgaggaccaccggcgggtgaacgtcgcgctctcccgcgcgaaaaagagcctcgtgctcgtcggcgacgagcgggcgctgcgctcggagccgctgtacgaccgcatgatcgactgggcggacatggagtga

SEQ ID NO: 42319 - DNA, 1377 bp, Halobacterium sp. NRC-1
atggaccgtgaaacagccgagcctgacgtccggagcatgcccggcgagaaggccgcggaatgggtgaacttccaccacaatcacgccgccccctccacgtacgtctacgacttcgtgtgggacatcaccgaggacgccatcgggccgttctgcacggacgtcgacggcaacgtcctcatggacttcaccagccacgttgccgccgcgccgttcggctacaacaaccccaagatcatggaccgcctggagtcgttcgacctcgtcgaccccctcaagatggcgggccaggacttctacgctggcggcggcaccgatcccgagtcgcccgagatcccgaccgcgacacagctgctcgaccggctcaccgacatcaccgcacactacgatctggacacggtgttcctctcgaacacgggcgctgaagccgtcgagaacgccatcaagatctgttacaacaacggcggccaccgcgcgctcacgttcgacggcgcgttccacgggcgcacgctcggcgcgctgtcgctgaaccgatcgaaagccatccaccggaagggcttccccgagatcgggggcgtcgtctcggtgccgtactgcacctgcgagggcgagtgctcgtgtggctggaagaccaacggccccggcgggaacgtggccgctgacaagctccaccacgaccgcggcgtcatcgaccccgaagaggtggcgtacctcatcatggaaccccagcagggcgagggcggctaccgggtccccaacgacgacttcatcgccgacatcgccgacatccagcggacccacgacatccccgtcatcagcgacgagatccaggcgggactgggccgcaccggcgaactctgggggatcgaccacaccgagatcgaaccggatgtcatcacctccgcgaaggggctgcgcgtcggcgcaacggtcgccaacgaggacctcttccccagcgagaccggccgcctctcctcgacgtggggcgccggggacattgtcgccgccgcgcagggcgttgcgaccatcgacgccatcaccagcgacggcctcctcgatcacgtcgtggcccgcggcgagcagaccaccgaccgactccacgacgccgatcccgacttcgtcacggacgtgcgcggccgcggcctgatgctggccgtcgagttcgacaccaagaagcgccgcgaagcggtcgtgaacgcctgcgtcaagcgtggcctcctcgtgttgggctgtggccacaagacggtgcgactactgccgccgctcgacgtcaccgagcgcgagatcgacatcgcggtcgacatcctcctggaggcgctcgacgaccccgacgttcgccacgccggcacctcgaaggtcgaaggcgaacccactgcgtaa

SEQ ID NO: 42320 - DNA, 1434 bp, Halobacterium sp. NRC-1
atggcacgagatgtgtggcactcccggctcggattcatcatggccgccgtcggctccgcggtcggcctggggaacctctggcggttcccgtggatgacgagcgaaaacggcggcgcggcgttcctcctggtgtatctcggcgttgtactgtgtgttggcgtgcccggcctgctggcggagttcgtgatcgggcggcggagccgtcgaagccccgtcggcgcgttctcctcgctgtcggactccacgctgtggcgggtgttcggacacctctcggtcgtcatcgcggtcgtgttgctctccttttacagcgttgtcggcgggtggatcctgcggtacttcggggccagcctgaccggcgcgtacttctcgaaccccggccagtacttcgccacggtgagctacgggcttgacgccgttggcttccatctgttgttcctcgcgatcaccgggctcatcgtagtacgcgggatcaaacgcgggatcgagaacgcaaccaagctcatgatgccggctgtggtggtgcttttgatcgtgctcgccgcctgggcgagcacgctcgacggcgcgggtgccggtctcgcgttctacctgtcgccggacgtcgaactgcttgaagccgacctgcttgggatcctgcctgccgccgccggccaggcgctgttcacgctctcgcttggctccggaacgatgatcacctacgcgtcgtacctcgacgaggagcggtcgctggccgccgacggcgcggcgatcgccgttctcaacacctgcatcggtgtgctcgctggactcgtggtgttcccgctgttgttcgcgctcgtcggcgacgccggcactggcggtcccggcgcgctgttcgttggcctcgccaacgcgttcgttgcggtcccctacgggcgggccgtcggcgcggtgtttttcgcggtcgtctccctggccgccatctcctcgtcgatctcgatgctcgaactcccggtgtcgttcctggtcgacgagtacggcgtctcacgccgccgcgcgaccgcgctgttcgtgggcgtgttcaccgtcactgggagcgcaaccgcgctctcgcccgggctctttgacttcgtcgcgggcaccctggtggacctcctgatgaccgccggcctcatcgggttcctgctgttcaccgggtgggtcgtcgggcagaacgccgtcaccgagtacgagctcggcgcgggcgctgtcgcgtccgcgttgtcgacgccgtggctgtacgcggtcggcgtggtgatcccggtgttcctgattttcacgctcgtctccgggatcgccgccgcgctcggcgtctcgatcacggccgtcgagctgtggggggtcaccatcagccagccgcgactgttcgcgggactgagcgtcgtcatcgcggtggtgtcgtttctggggctgcggcggccggcgtccgtcgcctga

SEQ ID NO: 42321 - DNA, 1833 bp, Halobacterium sp. NRC-1
atgttcgagaaggtactcgttgccaaccgcggcgagatcgcggtgcgtgtgatgcgggcgtgtgacgacctcggggtcgacacggtcgctgtgtacagcgatgccgacgcgcacgccggacacgtgcggtacgccgacgaggcgtacaacgtcgggccggcgcgcgcggcggactcctatctcgaccacgacgccatcatcgacgcggccacgcgggccggggccgacgccatccaccccggctacggcttcctcgccgagaacgccgagttcgcgggcaaagtcgaggacaccgacggcgtcacgtgggtcggcccgtccgcggactcgatgcgccagctcggcgagaagaccagcgcccggaagacgatgcgggaggccgacgtgcccatcgtccccggtaccaccgaccccgtggagtccgtcgccgacatccacgagttcggcgaggaacacggctaccccatcgctatcaaggccgagggcggtggtggcggccgcggcatgaagatcgtgcgcagcgccgacgaggccgaagaccaactggagtcggcggagcgtgagggtgaggcgtacttcgacaacgcgaacgtctatctggagcgctacttggagaacccccgccacatcgaggtccagatccttgcggaccaccacgggaacgtccggcacctcggcgagcgggactgttcgctgcagcgccgccaccagaaagtcatcgaagaaggcccgagccccgcgctcacggacgagcttcgcgaggagatcgggacggcggcccggcgtggagccgacgccgcgggctactacaacgcaggcaccttcgagttcctcgtcgaggaagacaccgagcgggagcccggtgacctcctcgggccggagacggagttctacttcctcgaagtgaacacccggattcaggtcgagcacaccgtcacggaggcgctcacgggcgtcgacattgtgaagtggcagctcaagatcgcatccgacgacgagctcaccttcgagcaggacgacgtggcactggacggccacgccgtcgagtaccgcatcaacgcggagaacgcggccgacgacttcgcgcccgccacgggcggcgagttggagacctacgacccgccgggcggcatcggcgtgcgcgtcgacgacggcctccggcagggcgacgatctcgtcaccgactacgactcgatggtcgcgaagctcatcgtgcacggcagcgaccgcgaggagtgtctggcgcggtcccggcgcgcgctcgccgagtacgacatcgagggcatcccgacgatcatcccgttccatcggctgatgctgaccgacgacgcgttcgtcgggggcacgcacacgacgaagtatctcgaccgcgacatcgaggagtcgcggatcagtgacgcccaggcggagtgggggacgacgacggcctccgagagcagtgccgatgagaacgtggtggagcgggatttcacggtggaagtcaacggcaagcgcttcgaggtcaacctggaggagcgcggcgcggcgcagttcgctgcccccgaagcggacaccggcggcggcgggccgccggagcccgcgggcggagccgacgacggcgagacggtcgttgagggcgacggcgagacggtcacggcggagatgcaggggacgatcctggacgtggccgtgtccgagggcgatgcggtcgacgcaggagacgtgctggttgtgctggaagcgatgaaaatggagaacgacgtcgtggcgtcccacggtggcacggtcacgcaggtcgccgtcagcgaggacgacagcgtcgacatggacgacgtgctggtggtcatcgactag

SEQ ID NO: 42322 - DNA, 1272 bp, Halobacterium sp. NRC-1
atgcatacacaccacatggatggcgcgcgttgtaaacgtatgcaccccgtgtcgaagcggcagcacgcgccggattcggagaccgatggggtttatgctgagcgaggttcgcgttcagactgcatgaagcttcacgagtaccaggcgaaggaggtcttcgccgatgcgggcattccgaccccggagtcggcgctcgcaacgtccgtcgacgaggccgtcgaggtcgcagacgccctcgactaccccgtcgcggtgaaggcccaggtacacgtcggtggccgcggaaaggccggcggcatcaaactcgcggagaacacggccgaggctcgcgaggccgccgagtcgattctcggcatggacctcaaaggctacacggttgatcgcgttctcgtcgaggaggccgtcgacttcaccaacgagttgtacgtcggcgtgaccatggaccgcagcgagggcgcgccggtcgtgatggtctccgagcgcggcggcgtcgacatcgaatccgtcgccgaggaagcccccgaggacatcgtgcgcgagcacgtcgatccctcgttcggtctgcaggcctatcaggcccgcaacgccgtctacgacgcgggcatcgagcaggacgtcgccggggacgtcgcgaagatcgtgcagggcgtctacgatctgtgggcggacagcgacgccacggaggtcgagatcaatcccgtgatggtgaccagcgagcgcgacgttgtcgccgccgacgccgtgatgaaactcgacgaggacgcgttgttccgccagccggcgttcgccgacatggaagaggacgccgccgaggacgacctcgaagccaaggccaacgagtacggcttcgactacgtccgcctggacggcaacacgggcatcatcggcaacggggccgggctcgtgatgacgacgcttgacctcgtggactactacggcgggcagcccgcgaacttcctggacatcggcggcggcgcgaaagccgaccgcgtcgccaacgccctggacatggtgttcagcgacgagaacgtcgacagcgtcgtgttcaacattttcggcggcatcactcgcggcgacgaggtcgcgaagggcatcaacagcgcgctcgaacagttcgacgagatcccgacgccggtcgtcgtccggctcgcgggcacgaacgccgctgaaggccgcgagatcctcaacgacgacctcgtgaccgtcgaagaaacgcttgagggcgctgtccagcgcgccgtcgagtacgccgacgaggaggacatccaatga

SEQ ID NO: 42323 - DNA, 870 bp, Halobacterium sp. NRC-1
atgagcattctagtcgatgacgacacccgcgtcgtggtgcagggcatcacgggcggggaggggaagttccacgccgaacagatgatcgagtacggcaccaacgtcgtcgcgggcgcggtgcccgggaagggcggccaggaggtcgccggcgtccccgtctacgacaccgtcaatcaggccgtcgtggccgagaacgcggacgcctcggtggtcctcgtgccgccggcgttcgccgcggacgcggtcttcgaggcgctcgatacgcccctcgatctcgtggtcgcgatcaccgagggtattccgagccaggacatggcgaaagtgtacaagcgcctctcggaagtcgacacccgccttctcgggccgaactgtccgggcatcatcacgccgggcgaggcgaaactcggtatcctgccgggcaacatcttcgaggcgggcaacgtcggcctcgtctcccggtcgggcacgctcacctaccaggtcgtggattcgctgaccgcgcgcggcgtcggccagacgaccgccatcggcatcggcggcgacccgatcatcgggacggacttcatcgacgccctcgaactgttcgaggccgatccggagacggaggcggtcgtgatgtgcggcgagatcggcggcgaggacgaggaggcagcggccgcgtacatcgacgagcacatggacacgccggtcgccgggttcatcgccggccgcaccgcaccgccgggcaagcgcatgggccacgccggcgcgatcgtctccggcagcggcaccggcaccgcggactccaagatcagcgcgctcaacgacgcgggcgttcccgtcggcgacacccccgaggaggtcgccgacgacatcgaggagctgctgtag

SEQ ID NO: 42324 - DNA, 3705 bp, Halobacterium sp. NRC-1
atgccggggtacgaccgcgcgaccgcccggctggccgacgccggcgtcccgctggtggtgaaatccaccggcgacgcctacgccgtcgaggacaccaccgtcgccgccgaggaccgcgacaccgtctacgaatacctcgaccgtggggggtcggcgaacgtcgccaactgcctgcggttcctcggtgaccgctactcggggacggagttcgcgtacgacgaccccgttgcgctcccgacggagggcgtctatcaccccgaccaccccggcatcgactacgacggcctgcgtgcgaccttcgaccccgacgccccgacggtggcggtgtggttctacgagtcccactggacccacgagaacacccgctacgtcgacggcgtcgtgcacgccctggagtcccagggtgcgaacgcgctcccggtgttctgcaacccggcgaccgacaccgacgagcaggaagacgccgagtgggtcaccgaccagtggctgcttgccgacggcgagccggtcgtcgacgccgtcgtgtcctcgttcatgttctcgctgtcgatggacgagcgcggccggtcggcaagcgacgagggcgacgccgccgaggacgtgttcctcgaccgcctcggggtgccagtcctccagacggtcacgacgatgcgctcgcggtcccggtacgagtcggcggacaccggcgtgatgggcttcgaactcgcgctctcggtcgcactgcccgagttcgacggcaacgtcatcacccaccccatctcgggcaaggagcgcaccgacgacgacgccggcatcggcaccgcgccgaaacaacacttccccatcgcggaccgcgtcgagcacgccgccagcctcgccgtgaactgggcgcggctgcgccacctcgacaacgacgagaaacgggtcgccgtcgtcctccacaactacccgcccagcgacgacggcatcgggacggcgttcggcctggacacccccgagagcacggtcaacctgctggacgagctggacgcacgcgggtacagcctcggtgggaagacgccgcccgagggccaggcgctgatcgagcagctgaccagccagctcaccctcgacgaccgctgggtcgcccccgaggacgtccgcgagcgcagcgtcgacgtggtgtcgaccgacgagtacgcggcgtggtgggccgacaccgaccccgagttccgggcgaacgtcgtcgcggagtggggggagccgcccgagcggccgttcgcgatcccgggcgtcgagtacggcaacgtgctcgtgaccgtccagccgccccgcggcttcggcatggacccggagaaagtctaccacgacagcgacctccagccgccccacgactactacgcgttctacgcgtggctccgcgaggagttcggcgcggacgccgtcgtgcatctcggcacgcacggcagcctggagtggctgcccgggaaaaccgtcggcctcgacgccgagagcgcgccagacgcgctgctgggggatctgccgaacgtctacccctacatcgtcaacaaccccggggagggcacgcaggccaagcgccggtcgtacgccgcggtcgtcgactacctcacgcccgtgatgagcaacgccggcacctacgacgagctcgccgagttggaggagctggcgtcgcgctaccgggaggccggcgccggagccggcgcggacgccgagtcccacatcgcggaccgcatccgcgagcaggtggccgacctcgatctcgccgtcgaactcggcatcgagggcgagatatccgagaaagccgacgttcgcggccccgacgcggccggcagctcgctcgcggagggcgccgtggacggcgacaccgtgggcatcgaggcgctggtcgagcgcgtccacgagtacgtcacggacgtgaagacgacccagatccggctgggcctgcacacgatgggcgagccacccgcggacgaccgcctggtggagtatctcgtggcgctcacgcgcctggagaacccgggcgcgccgtcgctgcgggagtccgtcgcgggcgtgctcggcgtcgactacgggacgatgctcgactccccgggcgagtacagcgaggccctggggatgacgtacgccgaggccgccgacgaggtgtacgagacgagcgtcgacctcgtggagacgctcgccgccgaggggttcgacgtgccggcgtcgaacgtcgcggccggccccgacgacgaggtgaacatgaaccttctcgtggtcgacatcgacaccatcggtgacgcccgcgcgaagtcgggcgcacacgacgacctgcgtgcggtgttggcgttcatctgcgaggaggccgccccgcgcgtgttcggggcggaatcggagatcccgcagacggcggacgccctcgacggcgagtacgtcgaacccggcgggagcggcgcgcccacccggggcggcgtcgatctgctgccgacgggccggaacttctacacgctggacccgcggaaagtcccggccagaacggcgtgggacgtgggcaaggaggtcgccgacggcgtcgcccagcgccaccaggaagacgagggcgaataccccgaggaggtcggcgtggtcgcgtgggggaccccgacggtccgcacgcgcggggagaccatcgcgcaagtactcggcctgatgggcgtccggccggtctggacggacgccggccgggtcgacgacgtggagccgattccccttggggacctcggccgcccgcggatcgacgtgaccacccgggtgtcggggctgttccgggacgcgttcccgcaggccgccggcgtcgtccacgacgccgtggacgccgtcgtcgacctcgacgagccacacgacatgaactacgtcaaaaagcacgtcgaggcggaggcggccgaactcgaagccgagggcgtcgagaaccccgaacaggccgcgaagcgccgcgtgttcaccacgcggccgggcggctacggcgcggggacgaacaaggccgtcgacgagggcgagtgggacgaccgctcggacctcgccgacgtctacgtccagtggggcggctacgcgatggggtcgcggggccgcgtcagcgaggcccacgacgccttcgagcgccgcctcgggaacgtcgacgcgacggtgaaaatcgaggacacgatggagcaagacgagttcgactcctcggactggtacgcgttccacggcgggttcatcaccgccgtcgccgaggagagcggcgcggagccggcctcgtacgtgggggactcaagcgacccggacaacgtcgacgtctacaccaacgaggagaaagtgcgcaaggcgatgcgcgcccgcgtgctcaaccccgagtggctggactccatggaggaccacggctacaagggtgccggcgacctctcctcgacggtcgacgtgacgctcggctgggacgcgacgacgggcgtcgtttcggacacgctctgggcggacgtggccgagaagtacgccttcgacgaggaccgccaggagtggctgcgggacgtgaacccgtgggcgctgtcctcgatcacggacacgctgcttgaggcgatcgagcgcgacctctggggggccgacgacgagaccgccgagcgcctgcgtgacctccacctgcaggtatcgggcgacctggaggcgcgcgcgtcgggcgagcacgacacgccagccgacggcgacgaacgcgagacaccactacatgacgactga

SEQ ID NO: 42325 - DNA, 375 bp, Halobacterium sp. NRC-1
atgagcttcgacgttcctgacgacctgcagtatctcgaatcacacgaatggatcgaccctgcgaccggccgcgtcggcatcagcgagttcgcccaagacgaactcggcgatgtcgtgttcgtggagctgccgagcgtcggcgacgcgctcgaccagcacgacgagctcggcgtcgtcgagtctatcaaggcggtttcggacctgtacgcgcccgtttcgggcgaggtgacggcggtcaacgacgccctgacgaacgagccggagttggtcaacgaggcccccttcggcgacggctggctggtcgagatcgacttcgacagcgacgacctcgaagcgacgcttgactccgacgactaccgcgcacagatcgcgtga

SEQ ID NO: 42326 - DNA, 1338 bp, Halobacterium sp. NRC-1
atgacaagcgtcggcatcgacgccatcgagatccacacggggaagctgaaactcgacctcgcggagacgttcgcccccgagatgggcgacgatcccgagaaatacacgaagggcctggggctgcacgcgtcgtcgttcccggacgcctacgaggacatcgtgaccatgggcgcgaacgccgcgcaccgactgctggagcgcaagggcctcgaacccgccgacgtcggccgcatcgacgtggccacggagtccgcgttcgacaactccaagccggtgtcgacgtacatcgcgggctgcctcgaacaggtgtacgacggcgacttccatcacgccaacaagggcgagcgcaagttcgcgtgcatcgctggcacccagagcctcgacgacgccgtgaactggatcctcgccgggcgcaaccgcggccggggcgcgctcgtcatcgccaccgacaccgcgctgtacgcccgggactcctcgggcgaagccacgcagggcgcgggcgcggtcgcgatgtggatcaccgaggaccccgacatcgtggagctgtcgaccgagcagggctacggctccgccgacgaaaccgacttcctgaagcccaaccagcagttcccgagcgtcgacggcaagcgctcgatgcaggtctacctcgcgcggatgcgcgaatccctccaggatttcgaacgcgcgacgggcgcgtcacaccccgacgactacgcgttcatcccgttccacacgccgttcccggggatggtgcggaaggccgccgtcctgggctaccgccacatgatccgtggcaccgacatcgaggaggaactcgccgccgacatcggccgccagccccgccgcgagcgcttcgactccgacgacgccttcgaggacgcgatcagcgagtacgtcgacgggctcactgacaccgacgcctaccgcgagtggtacgacgcggccatccagccgacgctgtcgatctccagccaggtcggaaactggtacaccggctccgtgcatctcgcgcggttcagcgcgctcaaacacgccgccgagaacggcatcgacctcgcgggcaagcgcctcctggtggcgtcgtatggctccggcgcacaagccgagatccacagcgaaaccgtccaggacggcttcacggaggccgtcgcggcgtcgacgattgacgagcagatcgagcagcgctacgacatcagcttcgccgaatacgagcaggtccacgaccgccacaaccacgagaaaagcgtggagcttgagccgttcacgcagcccgacgccgagttcgtcttcgacggctgggggccgatgaacgagcgcaagtacacgtacgtcgagtga

SEQ ID NO: 42327 - DNA, 3156 bp, Halobacterium sp. NRC-1
atgagctccgaggacctctccgcggacgatctcaccctgccggtcaagcgtgtcaccggtgacagcctcgaagaccggctcactgcgaacgcctaccacaacatcctcccggcgcggtatctccggaaagacaccgacggcgagcacgtcgaatcccaggaggacctcttcgagcgcgtcgcgaagaacatcgcgctcgcggaggtcgtcttcgagtcagacgacccagtcacggccacgcccagccagctcaaacccgaccacccacgccgcgatgaactcgccgccgaggtgttcgggtccgacgtcgatcccgacagcgagacggcgaccgtcgagctcaccgacagcaacatcaacaagttcgcctacgacacggtcgttccggaactcgacgatcccgaggtgcgcgagcacgttgagggcgtcgccgcggagttccaggatctgatggcgtcgctgtcgttcatgccgaactcgccgacgctgatgaacgccggcgacgagctccagcagctgtcggcgtgtttcgtcgactcgccggacgacgacatcacggacatccaccagaccgccaaggaggccgccgaggtcttccagtccggcggcggcatggggtacgcgttctggcagctccggccgtacggcgacaccgtcggctccaccggcggcatcgcctcggggcccctgacgttcatggagacgttcgaccagatgtgcgaaaccatcgcgcagggcggcgcgcggcggggcgcacagatggccgttatgcgcgtcagccaccccgacgtcgtggagttcatccacgccaagaacaaggacgtctcgctggcccagacgctgaagctcaacgaccccgacgactacacgtacaccgagttctcggaggccctcgaagaggcccgcgacctcatcgacgaggacggccgcgtccccgaacacctccggaacgccgtcgaggggcacctctcgaatttcaacatctcggtgggcgtcaccgacggcttcatggaggcgcttgaggccggcgaggagtacacgttcacgaacccgcgcacgggcgaggcccacatcgccaccgaagagaccaaggagatgtactcccggtacgggctgggccactacgtcacgcccggcgaggaactcacgctgcccgccgaggagctctggagccgcatcgttgagggtgcccacgagaacggcgaacccggcgtgatctacctcgaacgcgtcaacgacgagcactccttcgacgtcgaggagcaccccgaccaccgcatcctcgcgaccaacccctgcggcgagcagcccctcgaagagtacgaggcctgcaacctcgggcacatcaacctctcgacgctcgccgcccaggacgcccccgactggcgggtctggagccagacccacgacttcgacacgctcgaagcgggcgtcagtcggttcctcgacgaggccatggacaccgacgccttccagcgccgcatcgagatgggcacgcggttcctggagaacgtcgtcacgatgtccgacttccccgtcccggagatcgagcagaaggtctcggagatgcggaagatcggcctgggcgtcatggggctggcccagctgtacatccaactcggcgtgaagtacggcagcgaggagggcaacgagatcgccagccagctgatgcagacgatcaaccacgactccaagaccgcgagccacgagctcgccttggagcgcgggagcttcgacgagtgggacaactccaagttcgcggcccccacggagtacgccgactggttcgaacaccacaccggcgaggacgccgccgactgggcggacggctacccgatccgcaaccacaacacgacgaccatcgcgcccaccggcaccacctcgatggtgggcaacaccaccggtggctgtgagcccatctacaacgtcgcctactacaagaacgtcagcgacgacgtgcagggcgacgagatgctcgtggagttcgacgactacttcctgcgcaccctggaggacaacgacatcgacgtacaggccgtcaaagaggaggcccaaacgcagatggcgaacaacgacttcgacggcgtcgacgggctgacgacggtgcccgacgccatcggtgagctgttcgtggtcaccagcgacctctccgggaaggaccacgcggccgtccagaccgcctgccagaacggcgtcgactcggccatctcgaagacgtgtaacttcccgaacgacgcctccgtcgaggacatggacgaggtgtaccgctacatctacgacaacggcgggaaaggcgtcaccgtctaccgcgacggcacccgcagcaagcaggtgttgacgacgcgcgcggacaacaccgagttctccgggctggacgaagaggaggccgccgccgcgatggtcgacaccatccaggagacgttcggcggcatcgagggcttcctggagaacgacgacatccaggacgcgttcggcgcggacctccgcgagctgttcgcgaccggcgacgacgccgccttcgacgaggaggacttcgccgagaagcagccccggccggacctcctgcacggcgtcacgcagcgcgtcgacaccgggtacgggaagctctacgtcaccatcaacgagaaccccgagcgcgaacgccccttcgagctgttcgcgaacacgggcaactccggtggcttcaccggctcgttcaccgaggcgctggcgaagaccatttccgtggcgctgcggtccggcgtcgaccccgacgagatcgcggacaaactccaagggatccggtcgccgaaagtggcctgggacaaaggcgaacaggtcaactccatccccgacgccttcggaacggcgctgcggcggtacctcaacggcgacgtcgaccgtgcggcctacccccagcaacaacacctcaccgagatcgacgccgacgacgccgcccaccacgagaccgacggcggcgctgccgagtcgctgggcggtccccagggaccgaccggtgccggcgagagcgccgacgcacagcagcagtcccaggacgcgacccagtcgctgatcgacgccggcgagagcccggagtgccccgagtgtggggcgatgacgctgtactacagcgagggctgcaagacgtgtgaatcgtgtggctggagcgagtgctga

SEQ ID NO: 42328 - DNA, 1185 bp, Halobacterium sp. NRC-1
atggatgttcattttgcaactgttagatcgacaaactcctctgaaggcacattagatgttctaatagacggccaggcggtcacaatagaagacaatactgagggcgatagatctgttggagatcttgtggaagtttggatcgataaaggcggaagagtggcggtggaagaggttggccgagcatcgccctccgttggggtcattcgggaggcgattggcggaaacgaatatcttgttgagcgaaatggtcgagttgaggtatgtgaatctctcgacgctgagaatccagaggaaggtgcgacagttaagatatacggaggcaaggtcacggcaacgatttctgatgaagtaatcgctccgaaagggatagaagatcggtttggagaacagaatcgatcaaaagcgtatctaaaagaccctgaggagattagcgaggtagattcagggtatgatgatgtgggcggattaacagacacgatagaggaagtgaaagatgtggtggagattccacttcgagagtcagataaggaaacaaatagattcaacaaacacggagttgaaccggatacgggaatccttttccacgggccaccgggaactggaaagactctgcttgcgaaggctgtagcaaaggaaaccggttccagcatctatcttgtcaacgggcccgaaataataagcaaatggtatggggagacggaagatataattagagaaatattttctaatgcaaagaagaaaaagcgtgcaatcattttcattgatgaagtagacagtattgcccctgaccgcggtgatacaaaacaatttcagcgaaaaatagttgctcagcttctcactgaactagatgggtttgaaccgttgaatgatgttgtcgtgattggcgcgaccaacgccctcaatgaagtcgattctgcaatcatccgtccaggacgctttgaccgaaaaatcaagttctcgaagcccactcaaaccgagagaatggagatcatagaaaagatcacaaaagacgttgacttcggagagtcagttgacctacaattgtttgctgaatctactgatggatggacgggagctgacctatcaggcgttattagccgtgctgtcacgatatcgataaggcgagagggggatcttgtaacgcaagatgacctctttcgggctatcaaaggggctggtgagtaa

SEQ ID NO: 42329 - DNA, 711 bp, Halobacterium sp. NRC-1
gtgcgcgaggacgacacccacctcccgaccggctgtggcgcactcgacgagctgctcggcggcggtgtcgagcgcggcaccgtcacgcagctgtacgggccacccgccgccggcaagacgaacgtcgcgctcacaaccgccgtgaccaccgccgccgccggcggcctcgccgtctacgtcgacaccgaaggcctctcgctcgcgcgcttccagcagctactggaggcgcgcgccaccgaccccgaggcggcgtccgcgaacgtcatcgtctccgacgcccacgacttcgacgaacaggcccaagccgtccgcgacaccgccgacttcgccgaccgcgcggacctcatcgtggtggactccgtgaccgggttctaccggctggcccgcggcggcgacgacaccacgggcgacgcgctccgccaggtcgccgaccagatcacacacctgctgtcgctggcgcgcaaacacgacctcgcggtcgtcgtcacgaaccaggtgttcaccgacgtcgacaacgacagcgaccgcgcccgcccgctgggcggccacacgctcgcacactggacgggcaccgtcctccggctcgaccggttccgcggcggcacccggcgcgcgacgctggagaaacaccgcgccaagcccgacggcgaacacgcccagttccagatcactgacgggggcatcgacgccgccagtgccgacgactactga

SEQ ID NO: 42330 - DNA, 2229 bp, Halobacterium sp. NRC-1
atgaacgaagtccaactggaggtcgcgaaagcctaccccaacgattcgggacgggggatcgcgcgcctcgatccagacacgctgttgcatctcaaactcagcccgggagacatcatcgaaatcgagggggccgaaaccacggccgcgaaggtctggcgagccgaccgccaagactggaacacggacaccatccggatcgacgggttcacgcgccagaacgccgaggtcggcatcggggagcgcgtgaagatccggaaagccgacgcggaaaaagcggacacgctcgtcctcgcaccccccgaggaagcgagcgtgcagttcggcagtgacgccgccggcatggtcaaacgccagatcctcaagcggccggtcgtcgcccgcgacatcgttcccgtgatgtcctcgacgaaccacccgttcatgcgatccccaggccaggcgatcccattgatcgccgtcgaaacggagcctgagggcgtctgcctggtgaccgaggacaccgacgtcgagctgcgcgaggagccgatcagcggcttcgagcgcaccggcggcggcatcacgtacgaggacatcggcggcctcgaaaacgagattcagcgcgtccgggagatggtcgaactcccgatgaaacacccccagatcttccagaagctcggcatcgaaccgccacagggggtgttgctgcacgggccgccgggcaccgggaagaccctgctggcgaaagccgtcgccaacgagacgtcggcgagtttcttctcgatcgccggtcccgagatcatctcgaagtattacggcgaatccgagcagcagctccgggagatcttcgaggacgccaaagacgactcgccgtcgatcatcttcatcgacgagctggactccatcgcgcccaagcgcgaggacgtcaccggcgaggtcgagcgccgtgtggtcgcccagctgttgacgatgatggacggcctggagggccgcgggcaggtcatcgtcatcgcggcgaccaaccgcgtcgacgccgtcgaccccgcgctgcggcggccggggcgtttcgaccgcgagatcgagatcggcgtccccgacgagatcgggcgcgaggagatcctgaagatccacacccgggggatgccgctgtccgacgacgtgaacctctcgacgctggccgacgacacccacgggttcgtcggcgcggacatcgagagcctcagcaaggaggccgcgatgcgggcgctgcgccggtacctcccggagatcgatctcgacgaggaggacatcccgccgagcctgatcgaccgcatgatcgtcaagcgcgaggacttcaagggcgcgctcagcgaggtggagccgtccgcgatgcgggaggtcctcgtggagctgccgaagatcacgtgggacgacgtcggcgggctcacggaggcgaaaaacaacgtcaaggagtccgttgagtggccgctgaaccagcccgagaagttcacgcggatgggcgtcgagccgcccgccggcgtgttgctgtacgggccgccgggcaccgggaagacgctgatggcgaaggccgtcgccaacgagacgaacgccaacttcatctcggtgcgggggccacagctgctgtcgaagtgggtcggcgaaagcgagaaggcgatccgccagacgttccggaaggcccgccaggtcgcgccgaccgtgatcttcttcgacgagctggacagcctcgcgcccggccgcgggcagaccggcgggaacaacgtcagcgagcgcgtcgtcaaccagctgttgaccgagctggacggcctcgaggagatggaggaagtgatggtgatcgcggcgaccaaccgcccggacatcatcgacccggcgttgatccgcagcgggcgcttcgaccgcctcgtacaggtcggccagccggggatcgagggccgcgagcagatcctgaagatccacacccaggacacgccgctggcggcggacgtctcgcttcgggagctcgccgagcgcgcggacggctacgtgggcagcgacctcgcgaacatcgcccgggaggcagccatcgaggcgctccgggacgacgaggacgccgacgacgtcggcatggcgcatttccgggcggccatggagaacgtccggccgacgatcaccgacgacctcatggagtattacgaccaggtcgaagaccagttcaagggcagccagggccccaacgtgaacagccgccagggcagcgagcacatcggcttccagtag

SEQ ID NO: 42331 - DNA, 1539 bp, Halobacterium sp. NRC-1
atggacgaactcgcggggacatcggtggcggtcatcggtgccggcttcggggggctctcgacggcctgctatctcgccgacgccggcgcggacgtgaccgtcgtggagaaaaccgaccagatcggcggccgtgcgagcaccctggaacgcgacgggttccggttcgacatggggccgtcgtggtatctgatgccggacgtcttcgaggagttcttcgcgtcgttcgacagccaccccagcgactactacgggttgacgcgcctcgacccccactaccgcatcttcttcaaggacaacgaggggcggcggccgggccgggacgcccccggcctgaacgtggacaccgacggcgacaccatcgacgtgacgcccgaccgcgagcaggtcaagcaggtgttcgacgcctacgagccgggcgctggggacgtgctcgacgactacctcgcgcaggccaaggagaactacgaggtcggcatggagcacttcgtgaagaccgaccgcccccgggtccgggactggatggacccgaagctcgcggagtacgcccgcggcctcacgctgctggggtcgatgcaggaccacgtcgagcagtacttcgaccacccgaagctccagcaggtgatgcagtacacgctggtgttcctcggcggctccccggacaccacgccggcgctctacaacctcatgagccacgtggacttcgggctcggcgtctactatccggagggcggcatggggggtgtcgtcgacgggatcacggccctcgcgcgcgaactcggcgtcgagttccgcaccggccacccggtgtcggcgatcaagggccgccgggggggcttcaagctggacaccgaacccggtgacgccgtgctcgcggacgtcgtcgtctccgacgccgactacgcccacaccgaacaggcgttgctccccgcgcaaaagcgccagtacgacgccgactactgggacgcccggacgtacgcgccgtcggcgttcctgctgtacctcggcgtcgagggcgacgtggagccactcgcccaccacaccctcgtgttgccgtccgactgggacacgcatttcgcgcagatcttcgacgaccccgcgtggcccgacgaccccgcgtactacctctgcgtgccctcgaagaccgacgacaccgttgcgcccgacgggcacagcaacctcttcgcgctcgttcccgtcgccccggggctggacgacaccccggccgtccgtgagtcctaccgcgacctcgtgctcgacgacatcgccgagaacacgggcgtcgatctgcgggaccgcatcgtcgtcgaggagcggttctcggtttcggagttcgccgaccggtacaacagccaccagggcaccgcgctcgggctggcgcacacgctgcgacagaccgcgctgttccgcccgccacaccggtcgaccgcccttgacggcctctacttcacgggcgcgaacacgacccccggtatcggcgtcccgatgtgtctgatcagcggcgaagtgaccgccaacaacgtgctcgccgacgcgcgctga

SEQ ID NO: 42332 - DNA, 579 bp, Halobacterium sp. NRC-1
atgttggtcacaatctccggaccgccggggagcgggaaaagcaccgtcgcgtcgacgctcgccgatcacctcagttacgaacacatctccggtggtgacatctttcgcggactcgcggaggaccgggacctgacgctcgcggagttcaacgagctcgccgaggaggacccccagatcgataaggacctggaccgccgcctccgggagaccgcccgcgggcgcgacgacatcgtcctggagtcccggctggccggctggatggccggcgagtacgccgacatcaagatctggctggacgccccgatgagcgtgcgggcgcgccgcatcgccgagcgcgaggacaagacgccggcggcggcccgcgccgagacggaggcccgcgaggagtccgagacccagcgctacgaggagtattacgccatcgacttcgacgacatcaccatctacgacctgtcggtgaacaccgcccgctgggggcccgacgccgtcacggacatcgttttggacgccgtcgacgcctaccaggccgagcgcgacgaaggcccaacacccattgagaacgtccgctatcagttctaa

SEQ ID NO: 42333 - DNA, 1611 bp, Halobacterium sp. NRC-1
atgccccatcagtcacaacccggctttttgttgccggcgatccaacaccactccatgcaggggagcctacccggtgagcgtgacgtgactgtcgtgggcggcggcttcggcgggctcgccgcggcggcctacctcgcccgcgccggtgccagcgtcacactactcgaacaacacgacaccgtcggcggccgcgccggcgtcctcgaacgcgacgggttccggttcgacaccgggccgtcctggtatctgatgcccgacgtcttcgagcggttcttcgaccacttcgaccacgacccacacgacttctacgagctcacccgcctcgacccccagtaccgggtgttctggacggacggcgacagcgcgacgatcgaacccaaccggcgcaacgcccacgagctgttcgagtcctacgaagagggcgccggcgacgcgctcgcgacgtacctcgaccgcgccgccaccaactacgatctcgcgatgaaccgcgtcgtctaccccgaccggacggcgttccgggattacgcgagcaccgacatgctcccgctggcgtcccggctgcggctgttcgggaacatggacgactacgtctcgcggttcttcgaccaccccaagctccgccagctcctcgaatacacgctggtgttcctgggtggtgcaccgcacaacacgcccgcactgtactccatcatgagccacgtcgacctcaacggcaacgtcttctaccccgagggcggcatcgccggggtcgtcgacgcgctcgccgagcttgccgtcgagcagggcgcaacgatcgaaaccggagtcggcgtcaacgccatcagcggccgccgcggcgagttcacgctcgccaccgacgacggcacacgaaccacggacctcgtggtgaacaacgccaaccccgcgtacgccgagcgcgaactcctcgacaccggcggccgcgaccacgcccccgactactgggacgaccagacgtacgcgccgtcggcgctcatgttctacctcggcgtcgagggcgacgtggagccactcgcgcaccactcgctggtgttgcccccggactgggacggccacttcgcccagctcttcgacgacccggggtggcccgatgatccggcgttctacctctcggtggcgtcgaagaccgacgacaccgtcgcgcccgacggccacgaagcggtggtcatcctgctcccgatcgcgcccggcctcgacgacacccccgagatccgggcgcagtaccgcgaccgcctgctggggacgctggcggcccagaccggcgtcgacctccgggaccgcatcgtcgtcgaggagtccgcctgcgtctcggagttcagcgagcagttcggcgaccccggcgggacggcgcttggcctggcgcacacgctgttccaaaccgggccgttgcgcccgggaaagcgcgacggccccgacggccactactacgtcggcgcgtacacgaaccccgggatcggcatgcccatgtgtctcatcagcggcgagcacgtcaccaaagccgttatcgacgacgatcccgcggcgtcgggctcgaccgacccgctggccgtccccggggagttcaacttcgacacgccgaccacggccgactga

SEQ ID NO: 42334 - DNA, 819 bp, Halobacterium sp. NRC-1
atgttccctggcgccagcaccgccgacgagtcgaaccccggagccgacgccgactacgtcgtcgttggggcgcccctcgacgtgtcgacgtcgttccagccgggcacccgtttcggccccggtgaactccggacgtacgccgcgaccttcgaggactaccaccaccggacgggcacgcacttctccgccctctcggtcactgactacggcgacgtgcgcgcgtggaacgacgtgccggcgtacctcgaatacctcaacggcgtcgtcaccgacatctcgtggaacgacgccacgccgctgctcgtcggcggcgaacacacggtgaccgtggcggcggttcgcgccctgaacccggacgtgttcgtggccctggacgcccacctcgatctgcgcgctgccctcgacggtgatccgctgagccactcgacggtgacgcgccacgccctcgacgtggccgacgaagcgatcgtcgtgggcgcacgcgccggctccgaggaggagtgggagcgcgccgccgactctgacgtgaccgtgatcgagccgagcgccgtcgccgactggacgccggcgttcggcgacgcggacgtgtacctgagcgtggacatcgacgccgccgatccggggtacgcgccgggcaccgggacgccggagccgttcgggatgtcgccacgggagctccgggcggccgtgcgcgcagtcgccccgcacgctgtcgggttcgatgtcgtggaggtcaacgaccgggacgacggccaggcccccaccctcggcgcgaagctgctgcgcgagttcgtgcacacgcaccacgccgacgggtaa

SEQ ID NO: 42335 - DNA, 1311 bp, Halobacterium sp. NRC-1
atgaatgggaacactggtgtcgtctctggcgttcgcgtctcgcacgagacggcctcactagatgaactggctgccgccagcgccgcgtccacggaggcggcgttggacgcgctgctggagcagccaccagtcgaggaagcgttcgtgctccagacgtgccaccgcgtggaagcgtacgtcgtcaccgccgatcaggcgtcgggtcgccgtgcgctcggtggggccggattcaaccccgcggggggcggggcgatctcgatggggcatgaggacagcctccgccacctgcttcgcgtggcggcgggtctcgaatcgctcgtggtcggggaggaccagatcctgggacagctccgagacgcctacgacgccgccaaagacgcgggcggcatcgaccacgtgctccgggaagccgtgaccaaggcgatgcacgtcggggagcgcgcgcgcaccgaaaccgcgatcaacgagggcgcgacctcgctcggcacggcggccgtgcgcctcgccgagcggaagacgcagctggccgacgcccgggctgtcgtcgtcggtgccggcgagatgggcgcgctcgccgcgaaggcgttcgcgagcgcgaccgtcgcggagatcgtgatcgccaaccgcacgccggcccgcgccgtccgggtcgcggacatggtgtcggtgcccgccgaagccacgacgctggccgacgcccgcgggcgtctcgacgccgcggacgtcgtggtcaccgccaccggcagccccgagcacgtgctccccgccagcgcgttcgcggacgccggtgacaccgtggtggtcgatctcgcacagccccgcgatgtcgcgccgggcgctggcggccacgacggcgttgcggtccacgacctcgacgacctggaggcggtgacggcggcgacccgcgagcgccgcgaggacgccgcccgcgaggtcgaggcgatgatcgaaaccgagttcgagcggctgctcacccagtacaagcgcaagcgcgccgacgaggtgatcgcgcgcatgtacgagagcgccgaccgcctcaaaagccgggaggtacagaccgcggtccaccgcctggaggccgaatccgggtcgctgtccgccgacgagcgcgaggtcgtggagtcgatggcggacgcgctggtgagccagctgcttgcggccccgacgaagagcctccgggacgccgccgccgaggacgactggtcgacgatcgcgaccgcgctcgaactgttcaaccccgaattcgaggacggcatgccgttcgacgcgtcgcgcggcggggacgcggcgtccgccgaatccgaggactga

SEQ ID NO: 42336 - DNA, 3129 bp, Halobacterium sp. NRC-1
atgaccgaggacagccggacgatactgctcatcgggagcggccccatccagatcggccaggcagcggagttcgactactcgggcgcgcaggcttgtcgcgcgctccaggaggagggcgcgcgggttgtgctcgtgaactccaacccagcgaccatcatgaccgaccccgagatggccgacgcggtctacatcgagcccatcgagcccgacgccatcgccgaggtcatcgagcaggaggaccccgacggcgtcatcgccgggctgggcggccagaccggcctgaacgtcacggcagcgctggccgagcagggcgtcctcgacgaacacgacgtcgacgtgatggggacgccgttggacaccatctacgcgaccgaggaccgcgacctgttccgccagcgcatggcggacctcggccagccggtgccggcctcgacgaccatcgcgctcggcgacgacgagacggcaacggacatcgacgagggggcgctgcgagagcgcgtcgacgacgcggtcgaggcggtcggcgggctgccggtgatcgcgcggacgacgtacacgctgggcggcagcggctccggtgtcgtccacgacttcgaggcgctcgtggaccgggtgcgcacgggcctgcggctctcgcggaacgccgaggtgctggtcacggagtccatcaccgggtgggtcgaactggagtacgaggtgatgcgggacgccggcgactcctgcatcatcgtctgcaacatggagaacatcgacccgatgggcatccacaccggcgagtccacggtcgtcacgcccagccagatcatcccggacgacggccaccaggagatgcgcaacgccgccgtcgcggtcatccgcgagttgggcatccagggcggctgcaacatccagttcgcgtggcgcgacgacggcacgcccggcggcgagtaccgggtcgtcgaggtcaacccgcgcgtctcgcggtcctcggcgctggcgtcgaaggcgaccggctaccccatcgcgcgggtcaccgcgaaggtcgcgctcggcaagcgcctccacgagatcgacaacgagatcaccggccagaccacggcggccttcgagccggccatcgactacgtggtgacgaaagtgccccggtggccaaacgacaagttccccgaggtggacttcgagctgtcgacggcgatgaagtccacgggggaggcgatggccatcgggcgcaccttcgaggagagcctgctgaaggcgctgcgctccagcgagtacgatccgagcgtcgactgggcgaccgtcagcgacgacgaactcgccgccgactacctccaacgcccgagtcccgaccggccctacgccgtcttcgaggcgttcgagcgcgggttcactgtcggcgacgtgaacgaccacacgggcttccgggagtggtatctgcagcgcttccagaacgtcgccgcggcctccgcggccgcaagcgagggcgacgttgcgacgccggccgcgctcgggtacacgaacagcgcggtcgcggcgttggcgtcggatggcggtgacgtggccgtcgacgacgtggcggcgacagcccccgagcggacgttcaagcaggtcgacacctgtgcgggcgagttcgcggcctcgacgccgtactactactcggcgcgctcgcagggatcgacgggaagcgacgtgcgggccgaccgggacgcccacagcgtggtcatcgtcgggggcggccccatccgcatcgggcagggcgtggagttcgactactgtacggtgcacgccgtgcgcgcgctccgcgaggcgggcatcgacgcccacgtggtgaacaacaacccggagacggtgtcgacggactacgacacctccgacgggctgttcttcgagccgatcacggcggaggaggtcgcggacgtcgtggaggcgacgaacgccgacggcgtgatggtgcagttcggcggccagaccagcgtggacgtgggcgcgcccctcgaagccgagctggagcgccgcggcctcgactgtgagatcatggggacggacgtggacgcgatggatctcgcggaggaccgcgaccgcttcaatcggctgctcgacgagcgcgacatcagccagcccgacggggggtctgcgaccagtgtggcgggcgcgctggagctcgccgccgaggtcggatatccggtgttggttcgcccgagctacgtgctcggtgggcgcgcgatggagatcgtgcacgacgacgacgagctccgccgctacgtcgaggaggccgtccgggtcagccccgagaagccggttctcgtcgacgagttcctcgccgacgccgtcgagctcgacgtggacgccgtcagcgacggcgaggacgtgctggtgggcggcgtgatggagcacatcgagagcgcgggtgtccactccggggactcggcgtgcgtgattccgccacgagggctcggcgacgacatcctcgcgcgggttcgggaggtcaccaccgagatcgcgcgggcgctggacacggtgggactgttgaacgtccaactcgccgtccaggacggcgaagtgtacgtcctcgaagcgaacccgcggagctcgcgcaccgttccgttcgtctcgaaggcgaccggcgtcccgatcgcgaagctcgcggcgaaggtgatggccggcgagtcgctggccgacctcgacgcaagcgagggcgtacccgagcagtacagcgtcaaagaggtggtgttgccgttcgaccggcttccggggtcggatccgcgcctcggcccggagatgaagtccacgggcgaggtgatgggcaccgccagcgatccggggatggcctactggaaggcccaggtggcggcgtccaacgcacccgtacccgggtcgacggcggtcgtcgaccttctggtcgaggggcttggcgagcggttcgaggtcgtgacggtcaaagacgtgccggcggcgatccgtcgcggcgaggtcgagttcctcgtcagcgacgaccgcgacgcgctgaccgcggctgtcgaggccgagatcccgtacgtctccacggtggcggccgcggaggcgatgcgtgaggggatcgcggcggccgacggtgcccgtgaggccatgccggtcgccgaccggccggtcaacgacgagacgtgggggtga

SEQ ID NO: 42337 - DNA, 1062 bp, Halobacterium sp. NRC-1
atgtccgacgcgtacctcgcgctcgaaaccggcgacgtggtcgaagccacagcccgcgccccggggatggcgcgcggcgaactcgtcttcaccaccgcgtacaccggctacgaggagagcctcaccgacccgtcctacgaagcccaagtgctcacgttcgcctaccccctcatcggcaactacggcgtccgtcccgaacgcaccgaatccgaccgcgttcaccccagcgccgtcgtcgcccgcgagctcaccgacgacgtggccgactggctgcgcaccgagggcgtgcccgccgtcgacggcatcgacacccgcgacctcgtgttggacatccgcgacggcggcgcgatgcaggtcggcatcgccgccggccccgacgccagccccgccaccgcccgcgcccaactcgccgactgcccacggctctcggcccgcacggagatcggcgcccacgtcagcgtcgacaccgccgaaacccacggcaacggcgacaccaccgtcgcgctcgtcgactgcggcgcgaaacgctccatcatcgacgcgttcgtcgcccgcggcgcgaccgtccaccggctcccctacgacgccacgcccgccgacatcgctgccgtcgaccccgatctgctgttcatctccaacggccccggcgaccccgcgaacttcgacgcggccgaacacctcgtcgacgagtacatcggcaccgtccccatcgccggcatctgcctgggtcaacagatcgtcgcccgcgcgctcggcggcgacaccgagaaaatggacttcggccaccgtggcgtcaaccagccggtcctcgaccacgactccgggcgcgtcgtcatgaccacacagaaccacggctataccgtcgccgaccccggcgacctcaccgtcacgcaagtcaacgtcaacgacggcacgcccgaggcgcttgactccgcgcccctcgacgttctcacccgccagtaccaccccgaagccaaccccggcccccacgacacgcgcgggttcttcgacgacgtgctcgcgatggctgacgcgtcctacacgcccgccaccgctgactga

SEQ ID NO: 42338 - DNA, 642 bp, Halobacterium sp. NRC-1
atgcgtgacagcatgagcgaagccgaccgaagcagccccgggtcggggaagaccgaccgcgaggacgagaccgccgaaaacgccacgcaggacgtgatcgcagtcacccccgacgacgagcgcacggggctggccaaccgcctcgacgcgcacaccggcgacggcgtccggcatcgcgcgttcacgtgtctgctgttcgacgaggacggccgcgtgctgctggcccagcgcgccgaccgcaagcgcctctgggacacacactgggacggcacggtcgccagccatcccatcgaggggcagagccaggtggacgcgacccgccagcgcctcgccgaagagctcgggatcgaaccacaccagtacgacaagttggagatcaccgaccggttcgaatacaagcgccgctacctcgacgagggcctggaatgggaggtctgtgcggtcctgcaggcgacgctgcacgacaccagcttcgaccgcgaccccgaggaggtcggcggcgcgatgtgggtcgactacgaagacctctacgagaacccccggtattaccgccagctccggctgtgcccgtggttcgagatcgcaatgcggcgggacttcgagggcgacgccgaccccgtccccgacggcacccgggcgtaa

SEQ ID NO: 42339 - DNA, 888 bp, Halobacterium sp. NRC-1
atgagccgcgtcgtcgccgccggccacgtcaactgggatgtcacgctccgcgtggatgcgctccccgaacccgacggggaagccgagatcgtctcccagcggcgctcgggcggtggcagcgccgccaacgtcgcgtgcgcgctcgccggcttcgacatcgacgccggcctcgtcgggagcgtcggcgacgacgaacacggcctgctcgcgcagcgcgaactccaggccgccggcgtcgacctcgccggcctgcgcgtcgtcgacggcctcgaaacgagcgtcaaatacctcctggtggacagccgtggggaggtcatggtgctcggcaacgacggcgcaaacgaggccgtcgcgcccggtgacctcgaccccgcggtggtcggcgcggactgcgagcacgtccacctcacgagccagcgccccgccaccgccgcccgcctcacggccctcgcccgggagcacgacgccaccgtctccttcgatccggggcgtcggctccgcgaccgcgactacggcgacgcgctcgcccgcaccgacatcctgttcgtcaacgacaacgaagccggcgccgtcctcgacgacgacggcggcccgaccgcccccgacagcgaccgcgtcgtcgtcgtcaaacacggctccgagggcgcgaccgtccacacccccagcgggtcggtcacccaccccgggttcgcggtcgatcccgtggacacgaccggcgcaggcgacgcgttcgccgccgggttcgtcgccgtggtgcttgacggcggcgaccacgagcgcgccctggagttcggcaacgcctgcggcgcgctcgccgcccaacacgagggcgcgcgcaccgcgccgacgcgcgccgacgccgcgtcgtttctcgacagccagttctga

SEQ ID NO: 42340 - DNA, 1269 bp, Halobacterium sp. NRC-1
atgagctacgacaagatcgaagtccccgagggcggggcgaaagtcagctacgacgaggccgccgacgaactcgacgtccccgacaccccgatcatccccatcattcacggggacggcatcggcaaggacgtcggtcccatcgcccaggacgtgctgagcgcggccgccgaggccaccggccacgacatcgagtggatggaagtgtacgccggcgagtccgcccgggagatgtacgacgagaacctccccgaggagaccgtcgaggccatccgcgagcaccgcgtcgcgatcaaggggccgctcacgacgccggtcggtgccgggttccgcagcctcaacgtggcgctgcgccagacgcttgacctctacgcgaacgtgcggccgacctactacctggacggcgtcccgtcacccatgaaggcccccgaggagatggacatggtgaccttccgggagaacaccgaggacgtctacgcgggcatcgagtgggaggccggcaccgacgaggcggagcaggtgcgttcgttcgtcgaggacgagatggacttcgacgacgtgatgcacgacggcgacatcgggatcggcctcaagcccatctcggagaagggctccaagcgcttggtacgggaggccatcgactacgccatcgagaacgaccgtgacacggtcacgctcgtccacaagggcaacatcatgaagttcaccgaggggcagttcggtgactgggggatggaggtcgccgaggaggagtaccccgacgacgaggtgttcgccgcgcccgattcgctgtgggaggaacaggacgaggtcgacatcccggaggacgccgtcatggtcgaggagcgcctcgcggacgccatgctgcagtggatgcagctgcgcaccgacgagttcgacgtgctcgcgatgccgaacctcaacggcgactacctcagcgacgccgcgggcgcgcagatcggcggcctcggcatcgcgccgggcgcgaacttcggggcggggcggtgtctcgcggagccggtccacgggtccgcgccgaagcgcgccggccaggacaaggcgaacccgaccgcgctcatcctctcgggccgcctgctgttcgagtacatcggctgggacgacgccagcacgctcgtgcgcgacgccgtcgaggacaccatcgagtcgggcacggtcacctacgacctcgcgcgccagcgcgacgacgccgaggaagtgtccagcacgacgtacgccgaggccgtcatcgaccgcatcgaggacctcgcgtaa

SEQ ID NO: 42341 - DNA, 1218 bp, Halobacterium sp. NRC-1
atgcccgacgatgccagcgacctcgccgaccgcgtacaggccggggacctccggctgtacgaactcgacgacgagaccgacgccgacaccgccgcggcggcacgccgcgcggtcctcgaacgcgaaaccgacgccgacaccgacgcgctcggcgcgttcgccttcgacgccgatcaggcagccgacaccgccgtcgagaacctcaccggcggcgcgcaactcccgctcggcgtcgccggcccggtcgccctcagcggcggcgccgccgacggcgagtactacctcccgatggccaccaccgagggcgcgctggtcgcgtccgtgaaccgcggctgctcggcgatcaccgcggccggcggcgcgaacgcccgcgtcaccaaaaccgggatgacgcgcgccccggtgttccgcgtcgcggacgtgaccgagggcgcggaggtcgcccagtgggccgacgacaacaccgacgccctggcggcggccgccgaatcgacgaccagccacggcgaactcaccgacgtgacgccgtacgtcgtcggggacaacgtctacctccggttccggtacgacaccaaagacgccatggggatgaacatggccaccatcgccaccgaggccgcaagcgagctcgtggaggacgaaacccccgcggagctcgtcgcggtgtcgggcaacctctgcacggacaagaaaccggccgccatcaacgccgtcgagggccggggccgcacggtcacggccgacgtgaccatcccccaggacgtggtcgaggagcgcttcgacacgacgccggccgccatcgaggaggccaacacgcgcaagaacctcatcggctccgcgaaagccggcagcctcgggttcaacgcccacgccgcgaacgtcgtcgccgccgtcttcctcgcgaccggccaggacgccgcccaggtcgtcgagggcgcaaacgcaatcacgaccgtcgaagcccgcgacgacgccctctacgcgtcggtgaacctggcgagcctcgaagtcggcaccgtcggcggcggcaccacactcccgacccaacgcgaggcactggacgtgctcggcgtccgcggcggcggcgaccccgcgggcgcgaacgccgacgcgctcgcggagatcatcgcagtgggcgcgctcgccggcgagatcaacctcctggcggcgctggcctctcgccgcctctcggcggcccacgccgacctggggcgctag

SEQ ID NO: 42342 - DNA, 1530 bp, Halobacterium sp. NRC-1
atgaccgacgccaccaccaccgacgtactcgtacttggatcgggcatcgcggggtgtggggccgcgctggccgccgcccgcgagggcgcgagcgtgctcgtcgcgacgaaggcccaacagcccgctgacgccagcaccgactgggcacagggcggcatcgccaccacccgtgacgaccccgagtcgctgaaacgggacatcctggcggccggcgacggggaggccgaccccgaggccgtggacgcactcgtgggcgacgccgccgcggccgtcgaggacgtgctcgtggacacgctgggcgtgcccttcgatggcgaggaggggttcgactacgctcgggaggccgcccactcggcggcgcgcatcctgcacgtggacgccgccacgggccaccacatcctggggccgttcctccgacacctcgacgcccacgagaacgtcgacatgctggaggacgccgccgccctcgatctgatcaccgacgagggggcggtgaccggcgcgctgctcgaccgcaacccccgaacgggcgaccgcgccgagactggggtgccggtgttcgccggatcgacggtgctcgcgacgggcggcatcggcgacctctatcggcgctcgacgaacccgcgcggatcgacgggcgacggcgtcgcgatggccgcgctggccggggccgacgtcaccgacgccgagtacgtccagttccatccgaccgcctacgacgacgccgacccgttcctggtctcggaggcggtgcggggcgagggcgcgctcctgcggaacgccgacggcgagcggttcatgccggactaccacgaggacgccgagctcgcgccccgcgacgtggtcgcgcgtgccgtggcagccgaacgggacgccacgggcgaggtcaggctggacgtctccccgctcgcgttcgccgaggagttccccgggctggcggaggcctgcgcggaccgcggcgtcgactgggagaccggcatcccggttgcgccctgcgagcacttcctttgtggcggcgtggccgtcgacacggtgggacggacgagcctcgaccggctgttcgcggtcggcgagtgcgcccgcacgggcgtccacggcgcgaaccggctggcgtccacgagcctgctcgaaggcctcgtttgggggttgcgcgccggcgagacggcggccggtgacgatcgcgcgccggcaccgagcgagccgcccgagctgcgggaccgcgaccccgaccttcccgacgggttcgccgccgagaagttccggcggctgcgccgcgtgatggacgaacacgtcggcctccggcgcaccggcgcggacctccagcgcgcgcagggcgtgctccgccggctcaaaggcgaggtcgattcgtacgcccgcacgcggacgagtcgtgacctctaccagctccggaacgccgccgtcgtcgggctgctgatcgcgcgggccgccggtgagaacccggagagcgccggctgccaccaccgcagcgacgaggctgccgccgaggaggcccccgatgccggtcactga

SEQ ID NO: 42343 - DNA, 1527 bp, Halobacterium sp. NRC-1
atgcaggccgcgcttgtgattctggacggctggggcctcggcgaccacgacagacgcgacgcagtccgggccgccgacaccccgaccttcgacgagtacgccgaacgaggcgcgttcgggacgctgaccacgtccggccgggacgtggggttgcccgacggccagatgggcaacagcgaggtcggccacctcaccatcggcgcgggccgcgtcgtgaagcaggcgtacacgcgcatcgaggacgccatcgccgcgggcgacctctgcgggaacgacgccatctccggcgcactcgaccacgtcgccgacaccggcggcacgctgcacgtcatgggtctggtctcggacggcggcgtccacgccgaccaacagcacatccacgcgctcgtggagtgcgccgccggacgcggcgtcgaggcggccgtgcacgcgttcaccgacggccgggacacctcgccgaccggcggcgaggactacctcgccgacctcgaagccgtcgccgacgagcacggcaccggcgacgtggcgtccgtctccgggcggtactacgcgatggaccgcgaccagaactgggcgcgcacgaagcgcgcgtacgacgccatcacgcggtccgacggggtcgcccatcacgccgctgccgcggtcgacgccgtcaccgactcctacgagcgcggcgacaccgacgagttcgtcgaacccacgaccatcgagggcggcgccgcgctcagcgacggcgacgccgtggtgttcgcgaacttccgggcggaccgcgcccgccagctcacccggctgctcgcggacatccaccccgcggactgggacgccgacggcatcgagacgaacccgccggccgtgccggtggtgacgatgaccgagtacgacgagacgttcgactgcccggtggcgttccccgccgcggagcccacggacacgctcggggcggtgctcgcagcccacgaccacacccaactccgggtcgcggagtcggagaagtacgcccacgtgacgtatttcctcaacggcggccgcgaggtcgcgttcgacggcgaaacgcggacgatcgtggacagcccggacgtgccgacctacgacgagcagcccgcgatgagcgcgcccgcggtcaccgacaccgtgctggacgcgctggccggcgacgacccggacgtgctcgtgttgaactacgccaaccccgacatggtcgggcacaccggcgacttcgacgccgccatcgaggccgtcgaagccgtcgaccgggaactcggccgcctcgtgcccgcgctcaacgacgccggcgcacacgccttcctcacggccgaccacggcaacgccgacgacctggggacgcccgccgacccacacaccgcccacacgttcaaccccgtgccgttcgtctcgcttccgcccgcgtccggcgacaccgcggccgtccgcgacggcggcgcgctccgggacatcgcgccgacgctgctggacgtgctcggcatcgaccggccgaccgtgatgacgggggcgtcgctgctggagtga

SEQ ID NO: 42344 - DNA, 750 bp, Halobacterium sp. NRC-1
atgaccgaccgcgcaatcgaagcacgcgccctcacgaagcggtacggtgacacgacagccatcgagcggatagatctcgcggtccccagcggctcggtgtacggcttcctggggcccaacggggccgggaaaacgacgaccatgcggatgctcacgacgctcgtggaaccgaccagcggcaccgccaccgtcgccggcgttgaggtaaccgaccgagcgtcggtggttccgaacatcggctacctccccgaggagccgccgctgcacgccgagctcacggcgcgcgaacagctccgatacatcgcggggctccgggatatccccgacccccgggccgaacaacgcatcacggacctcctggagcggttctcgctgggcgacgacgccgaccgccgcatctcgacgtactccaaggggatgaaacagaaaaccggcatcatccaggcgatgctccacgaccccgacgtgctcttcttggacgaacccacttcgggactcgacccgcgcgcggcgcgcaccgtccgggacaccatcgcggatctcaccgccggcgacgccaccgtcttcctctcgacgcacatcctgccggtcgtcgacgacctcgcggacaccgtcggcgtgctctacgacggcagcctcgtcaccgaaggcccgccggacgccctcaagcagcgcgccgaggccggcgacgagcgcaccctcgaagacgtgttcctcaccgtcaccggcggcatcgacggggcggcgtag

SEQ ID NO: 42345 - DNA, 969 bp, Halobacterium sp. NRC-1
atggttcgcgcccggcacttcgacgagcgcgcgcttgccctccaacgccgcggctggatgcccggatacccaccgttcaaaggacaggaagggtcgcaggtcggggcggcacacgctctcgccggcgacgactggctgttccccacgtatcgttccaacgccatgcagctcgcccgtggcgtccccgcaagcgatctgttgctcttccggcgggggcgcgcggagttccactccgaccacgaccacaacgtcttcccgcaggccgtcccgatcgccagccagatcccgcacgcggtcggcgcggggatggcgatgtcctacaccgacagcgggcaggcgtcgctggcgtacttcggggacggcgcaacctccgagggggacttccaccaggggatgaacttcgcgggcgtgttcgacgcgcccgtggtgttcttctgtgagaacaacaactgggcgatctcgctgccccgggaacgccagacggcaagcgactccatcgcggcgaaggccgacgcctacggcttcgagggcgtgcaggtcgacggcaacgatccgcttgccgtctacgagacggtgaccgacgcgctggctggtgcccgcgacggcaccccgattctcgtcgagagcctgacctaccggcagggcgcacacacgaccagcgacgaccccgaccggtaccgccccgaggaggaggacctgccggcgtggcggaccgccgatccggtcgaccggtacgccgactacctccacgaccagggcgtcatcgacgccgggttcgtcgaggagtgtttcgacgcggccgccgacgagatcgacgacgccgtcgaaaccgccgaagcagccggcgcgcccgccgtcgacgagctgttcgatcacgtctacgccgagcgcacgccccgcatcgacgaccagaaggcgtggctggagtcgtggctggagacccacgatccacaggagatggagttctga

SEQ ID NO: 42346 - DNA, 600 bp, Halobacterium sp. NRC-1
atgctcgtcacgcttgagggactcgacgggagcgggaagaccacggtctgggagtcgcttcgagcgtcccacgacgacggcgtcacgttcaccgccgagccgacggactcgcagtacggccaggccgtccggcggtcggaatccgcggccgacgccgacccgatcgccgagctgttcctgttcaccgccgaccacgccgaccacctctcgcgtgtcgtctctccggcgctcgaccgcggggatgtcgtgatctcggatcgctactcggactcccggtacgcctaccagggcgcgacgctggccgacaccgtcccgcgcgccatggagtacgtccggggcatccaccagccctggacgcgccccccggacgtgaccctctacttcgacgtggaccccgacacgggggctgcgcggtccggcgcaaccaacaagttcgagaccgccgcgttcctcgccgacgtccgggcgaactacgagcagctcatcgactacacccccgagcggttcgtccgcatcgacgccacacagtccccggaggccgtgatcgcggacgccgaagcggcgctcgccgacgcgctgccggacgacgcctgggcgtga

SEQ ID NO: 42347 - DNA, 1533 bp, Halobacterium sp. NRC-1
atgacagacgcatacgtcggcgcgatcgaccaagggacgacaggcacgcggttcatcgtattcgaccaacacggcgacgtggtcgcgaacacctacgagaaacacgaacagcactaccccgaacccggctgggtcgaacacgaccccctggagatctgggagaacacgaaaagcgtcgtcacggcggggctctcggccgccgggctggacgccgatgacctcgccgcgatcggcatcacgaaccagcgcgagaccaccgtagtctgggacgccgcaagcggccgcccgatccacaacgccctcgtctggcaggaccgacgcaccaccagccgcgtcgaatccctggaggaaaacggcaagatcgagcgcatccgcgagaaaaccggcctggaggcggacgcctacttctcggccacgaaaaccgagtggctgctcgacgaagccgagccgctgaagctctcctcggcgcgcgccagcagcctccgggatcgcgcccgcgacggcgagttgctcatgggcaccatcgactcctggctcatctacaacctcaccggcgaacacatcacggacgtgtcgaacgcctcccggacgatgttgtacaacatcaccgacctggagtgggacgactggctgctggaggagttcgacatcccccgggagatgctgccggaagtacggccgtcctctgacgaggccgtctacgggcacaccgaccccgacggcttcctcggcgcggcagttcccgtcacggccgcgctgggcgaccagcaggcggccctcttcgggcagacgtgtttcgacgccggcgacgccaagaacacgtacggcaccggctcgttctacctcatgaacaccggcgaggacgccgtctcctccgagcacggcctgctcacgacgatcgggttccagctctccggggagcccgtccagtacgccctcgaggggtcgatcttcgtcacgggcgcggcgatcgagtggctcgaagacgtcgacctcatcaacaacgccgcccagaccgcggaactcgccagctccgtcgacaccaccgacggcgtctacatggtgcccgcgttcaccgggctgggcgcgccacactgggacggccgcgcccgcggcaccctcgtcggcatgacgcggggcacgcggaaagcccacatcgttcgggcgaccctcgaatcgatcgcctaccagacccgcgacatcgcggcggcgatggaggccgactccggggtgtccaccacgacgctgcgcgtcgacggcggcgcggtcaagaacaacttcctctgccagctgcagtcggacatcatccagaccgacctcgcgcgcccggaggtcgacgagaccaccgcgctcggggcggcctacgcggccggcctggcggtcggctactgggacagcctggacgacctccgggagaactggcgtgtcgaccggtcgttcgagccggagatggaccccagcgaggccgacagcaagtacggccgctgggaggacgccgttgatcgctcgctggcgtgggccacggaggactga

SEQ ID NO: 42348 - DNA, 1713 bp, Halobacterium sp. NRC-1
atggcgcaggaaccgcacgtggttgtcgttgggggtgggtcgaccggggccggcgtcgcccgcgacctcgcgatgcgtggccttggggtcacgctcgtcgagcagggcaacctcacgcatggcacgactggccggatgcacggcctcctccactcagggggccggtacgcagtcagcgaccaggccagcgcgcgcgagtgtatcatcgagaaccgcgtgctcagagagatcgcaacgcactgcgttgacgagacaggcgggttgttcgtgaaacggcccgaggacagcgagcagtacttccaggagaaactcgcgggctgtgaggcctgcgacattcccacgaaggtgctctccggggcggaagcccggcagctggagccacacctggccgacgacgtcgagaaggccatctgggtgcccgacgccgcgatcgacccgttccgcctggtggtcgcaaacgccgcgagcgcccaggagcacggcgcgcgcatcgagacacactcgacggtcacggacgtcgtcgtggaggacggcgcggtggtcggcgtggaagtcgaacacgcgaccggcgcgggcaagcgcgtgcacggcaccgagggcggcaccgaggtgatccgcgccgaccacgtcgtgaacgccgccggcgcgtgggcgggccgcctcggtgagatggcgggcgttgacgtcgaggtccgtccgtcgaagggcgtgatgaccgtgatgaacacgcgacaggtcgacaccgtggtcaaccggtgccggccgaaaggcgacgccgacatcgtggtgccccacgagaccacctgcatcctggggacgaccgacgaggaggtcgccgaccccgaggactaccccgaacagcagtgggaggtcgacatggtgatcgacgagttggcggagctcattccgatgctcgacgacgcccgcacggtgcggtcgttctggggcgtgcggccgctgtacgagcccccggacgtcgacagcgacgaccccacggacatcacgcgggactacttcctgctcgcgcacgacgaccgcgacgacctgcccgggatgacgaccatcgtcggggggaagctcacgacctaccggatgatggccgaggagatcaccgaccacgtctgcgagcgcctcggcgtcaccgcggactgtcggaccgcggacgtcgcgctccccgggagcgccgacaacaccgcgctcgacgactacatgacggagttcgggctgcggtcgccggtcgcccagcgcagcgtcgaccgcctcggctcgcgggccggcagcgtgcttgacacggacgaccccaaccccacgatctgtgcctgcgaggcggtcacgcgggcggaaatccaggacgccatcgagcagtccgggacagacttgaacgcggtgcggatccgcacgcgggcgaccatggggaactgccagggcgggttctgcgcgcaccgcctggcgaacgaactccacaccgccggctacgacgacgccaccgtgcgggcgtcctgggacgaactgctcgccgagcggtggcgcggccagcgccacgccctctggggcgaccagctctcccaggcgatgttgagctacgcgctgcacgcgaccacgcagaaccgcggccacgacccggccgacgcggacactgagatcgacttcacggcgttcgacgcggggccgctggcggccgacggcggcccggagggcgcgcatggcaattga

SEQ ID NO: 42349 - DNA, 1284 bp, Halobacterium sp. NRC-1
atggcaattgaatccgaggtgctcgtgatcggcggcgggctggccggcatcacgagcgcgctggcggccgccgacgcgggcgcggacacccgactggtgtcgtacaaacagagcacgctccggaacgccagcgggctcgtcgacgtgctcggctacacgcccagcggggacggtcccgtggtcgaccccttcgacgccatcccgtcgctgcccgacgcccacccgtatcggaccgtcggcgtcgacacggtgcgcgacgcgatggcgtttttcgacgcgcacgcgccgcgctaccaggggcaccacaccgacgccaacgcgctggtgccgacccacggcggcaccgtgaagccgaccgcgcgctatcccgccagcgccgccgccgggctggcgagcgacgaccgggacacgctgctggtcggcttcgagacgctgccggatttcaacgcggaccacgcggccgcccacctcgaatcggcgggcgtccccttcgacgtgcgcggtgtgaccgtgccgttcccgggcgacctccgggcgggcgcgaaggtcacccggtacgcggggctgctggacgcgaacccccaggtgtcggtggacggcaccgagcgcccgctccgcctggcgcttgccacacgggtcgccgacgcggccgccgacgccgaccgcgtcggcttcccggcggtgctgggcgacgacgatcccgcgggcgtccgagacgcgctcgcggaccacctgggggctgcggtgttcgaggtgccgatgggaccgccgtcgctgcccgggttgcggctgtccgatcacctgttcggcgcgctggaggcggcgggcgtgcgcatcgaaaccggcaaccccgtggtggacgccgacacgaccgccggcggcgtcgagaccgtgtacgtggagaaaaacggcgcgcgcatcccgaacagcgccgacgagtacgtgctcgcgaccggcgggctcgtggggaaaggcatcgactccgaccgggacgcggtctacgaaccgatcttcgactgccggatcgcgcacagcgacgaccggtacgcgtggttcgacgacgacgcgttcggcgaccacgcgttcgcgcagttcggcgtgcggaccgacgacacactgcggccacgcgacgacgacggtgccgccgcccacgcgaacctgcgggcggcgggcgcagtgcttggcggctacaacttcgcagcggagcactccggcagcggcgtctccatcgcaacggggtacgcggccggaacggcggcagcggaggcgatccacgatgagtga

SEQ ID NO: 42350 - DNA, 639 bp, Halobacterium sp. NRC-1
atggcgcggttcggcgtcgacgaggcggggaaagggccggttctcgggtcgatgttcgcggcggcggtggccggcgacccggccgccgttccggacggggtcgcggattcgaagcgcctcagcgccgaccgccgggcggagctcgacgaccgcgttcgggcgtcgatgcgggtgggtgtcgcggaggtgcccgtcgaccgcatcgacgacccggagacggacatgaacacgctcaccgtggcggcccaggcggacgcgctcgggcgggtggtggccgacggcatggcggggtacgttgacgccggcgacgtgaacgaacagcggttcggccgccgggtggccaaccgggtcgcggccgacgtggcggtgaccgccgaacacggggccgacgacgagtacgatctggtggcggcggcgagcatcgtcgcgaaagtcgcgcgggacgcccacgtcgacgcgctcgccgcggcgttcgacgcggacatcgggtccggataccccagcgactcgacgacgcgggagttcctggcggcgtacgtccgcgagcacggcgaactcccggagtgcgcgcgcgcgagctggcagaccagtcgcgacgcgctcggggcggccgagcagtccgcgctggacgagttttag

SEQ ID NO: 42351 - DNA, 1803 bp, Halobacterium sp. NRC-1
atgcccgacgcagacaccaccgacgaccccggggacttgcgaacgccgatcgtggccgtgctcggccacgtcgaccacggcaagactagcctgctggataagatccgcggctcggccgtcatcgaaggcgaagccggcgcgatcacccaacacatcggcgcgacagcggtcccgctggacaccgtctcggaggtcgccggcagcctcgtcgaccccaccgagttcgacctgccggggctgttgttcatcgacacgcccggccaccactccttctcgacgctgcgctcgcggggcggcgcgctcgcggacatcgccatcctcgtggtggacgtcaacgacggcttccagccacagacggaggaagcgatccgcatcctgaaggacacggggacgccgttcgtcgtcgccgcgaacaagatcgacacgacgccggggtggaacccgaacccggacgcgcccgtgcagggcacttacgacgaccaaagcgaccgcgtgcgctcggacctcgacgacgcgctgtacgaactcatcggcgagatgtccgacgcggggttctcctcggacctctactggcgggtgcagaacttccagaagaacgtcggggtcatccccgtctcggcggagaccggtgagggcgtcccggatctgctgacggtgctgatggggctggcccagcggtacatgaaatccgagatggaggtcaccatcgacggccccggcgcgggcaccgtcctcgaagtcaaagacgagcagggcttcgggacgaccgtcgacgtgatcctctacgacggcaccatccggtcgggggacaccgtcgtggtcggcgcgcagcccgagcccatcgtcacggacgtccgcgcgctgttgaagcccggcgacctcgcggagatgcggacggagaaacgcttcgggaacgtcgaccgaatgcaggccgccgccggcctgaaagtcgccgcgccggacctcgacgacgcgatggccggcgcgccgatccgcgtggtcggcgatcgtgacgtcgcggacgtcgtcaccgaggtggaggcggagctggcggaggtcgcggtcgaaaccggcgaggaggggatcgtggtgaaagcggacacgctgggcagcctggaggcgctcgtgagcgcgctcgaagaggccgagatccccgtgatgtcggcggaagtcggcgacgtcgcgccgcgggacgtggcgatggcgaccaccgtcgacagcgagaaacaccgcgtactcttggggttcaacgtcgacgtgctgccggccgccgcggagaacgccgaacgcgagtccgtgcgcgtgttcaacagcgacgtgatctaccagctcgtcgaggactacgaggcgttcgtcgacgcccaggagcgcgagcagaaagaagcggtcttcgacaacatcgtgcgcccggcgcggttccgcatcctgaaagaccacgtgttccgccagaacgaccccgcggtcgtcggcgttgaggtggtgtcgggcacgctcaagcggaacacgccggtcggcggtatcgagggcaacgacctcgaccgcgcgggcatcgtcaagggcatccaggatcagggtgaggacgtcgacgaagcccgcgcgggcaaccgcgtcagcgtctccatcgacggcccgacggtcggccgcgacatcaaggagggcgacgaactctgggttgacctgcccgaaaagcacgcgaaagtgttggaccaagaactcacgtctgacctgcccgccgacgagcgcgaggcgctgaaatcctatctggacatcatgcgcaaacgcgaccccttctgggggaagtag

SEQ ID NO: 42352 - DNA, 1236 bp, Halobacterium sp. NRC-1
atgtcgcgtagcccctcattgccggaccggccgacgctcgacgtcgatcccgagtcgacgccggcggaacgcctcaacgcgctccaagaccactacgtggatatcgtggcggtcaacggagagctgcaggcgcaactcgacgatgtcgaagcccgccgcgaagaactccgcgaggaggtcaaccgcctccagcgcgagaacgagacgctgaaaacggcgtcgctgtacctggcgaccgtcgaagacctgcccgaagacggcagcgccgtgatcaaacagcacggcaacaaccaggaggtcctcaccgagctgtcgccgcgactcgcggacaccctggaggtcggcgaccgggtcgcgatcaacgactcgttcagcgtgcagcgcgtgctcgacgacgagaccgacgcccgcgcgcaggccatggaagtcgacgagtcgccgtcggtcacgtacgctgacatcggcggcctcgacgaccagctccgggaagtccgggaagccgtcgaggacccgctggtcaaccccgagaagttcgacgcggtcggcgtcgaacccccgagtggggtgttgttgcacgggccgcccggcaccggcaagacgatgctcgcgaaagccgtcgcgaaccagacggacgccagcttcatcaagatggccggcagcgagctcgtgcggaagttcatcggcgagggctcccggctggtccgggatctcttcgagctcgccgaacagaaagaccccgcgatcatcttcatcgacgagatcgacgccgtcgccgccaagcgcacggattcgaagaccagcggggacgccgaggtccagcgcacgatgatgcagttgctctcggagatggacggcttcgacgagcgcggcgacatccgcatcatcgccgccaccaaccgcttcgacatgctggactccgcgatcctgcggcccggccgcttcgaccgcctcatcgaagtccccaacccgaacccggacgcccgcgagcgcatcctggagatccacgccggcgagatgaacgtcgccgacagcgtcgacttctcggatctcgccgccgacaccgcggagttctccggtgcgcagctcgccagcctcgccacggaagccgggatgttcgccatccgcgacgaccgcgacgaggtccaccgccaggacttcgacgacgcctacgagaaactcgtcgccgagggggacaccgagtccagcggcccgcggtacccgagctacattcagtaa

SEQ ID NO: 42353 - DNA, 1245 bp, Halobacterium sp. NRC-1
atggcagacgaacaccgtcaaccggaggtgaacatcggactggtcggccacgtcgaccacggcaagacgaccctggtccgcgcactcagcggtgagtggactgaccagcactccgaggagatgaaacgcgggatctccatccgcctcgggtacgccgacgccacgctgcgtcggtgccctgactgcgacgaaccggagtgttacacggtcgcggagacgtgccccgagcacgacaccgccaccgaaatcgagcgcacagtctcgttcgttgacgcccccggtcacgagacgctgatggcgacgatgctgtcgggcgccgcactgatggacggcgcggtgctcgtcgtcggtgccaacgagccggtcccccagccccagaccgaggagcacctcatggcgctggacatcatcggcatcgagaacatcgtcatcgcacagaacaaagtcgacctcgtcgacgccgaggaggcccgacagaactacgaggagatccaggcgttcgtcgaggggaccgtcgcggaggacgcgccggtcgtcccggtctccgccgaacaggagatcaacgtcgatctcgttatcgacgccctccagacggagatcgcgacccccgaccgcgacccgagcgccgatcccctgctgtacgccgcgcgatcgttcgacatcaaccgccccggcaccgagtggggcggcctcctcggcggtgtcatcggcggcagcctcgtggacggcgaactggaagccggcgacgaactcgaactccggcccggccgcgaggtcgaggaaggcgggaagacggagtggcggccggtcaccacggacgtccgcagcctccaggccggcggcgaggacgtcgacagcgccagccccggtggcctcctgggcgtgggcacgggcctcgacccgagcctgacgaaaggcgacgcgctcgccggccaggtcgccgggccgcccggcagcctgccgccgacgtgggagtccttcgagatggacgtggatctgctcgagcggctcgtcggcgcggccgacggcgagcagatcgacgacatctcgacgggtgagccgctgatgctcacggtcggcaccgccaccaccgtcggctcggtgacgagcgcgcgcgacggcgagtgcgaggtcgcactcaagcggcccgtctgtgcgcccgccggcgcgaagatcgcgatcaaccgtcgcgtcggcgcgcgctggcgactcatcggcgtcgggacgctgacggagtccgagtag

SEQ ID NO: 42354 - DNA, 1110 bp, Halobacterium sp. NRC-1
atgttcaccgaccgggacgcgttcgccggcagcatcacgctggtcgacgacgacatggcgatcgactggttcgtcgaccgcgcggccgccgaccgcatcagcgccaaccccgtgttggcgttcgtgttcggcgacgagttcggcgtcgactacgagaccgcccgcgacgccaaccggccggttcaggccgacccgcagtggatcgacgggctgctcgaggagtatttcgacgaggacgacgaggagatgctcgacctcgtggacgtgcggtcgccggcggaactcacggtgtccctcgacgacatcgtgctcaccgacgaccaggaagcggagatgtcgaaggtcgcgaaggccatcgagcaccgcgactacctggcgacgatcggcctcaacgaggtcggaaagctgctgttcgtggggccgcccggcaccgggaaaacctcgaccgcccgcgggctcgcccaccaactcgacctgccgttcgtcgaggtcaagctctcgatgatcaccagccagtatctcggcgaaaccgcgaaaaacgtcgagaaagtcttcgaggtggccaaacggctgtcgccgtgcatcctcttcatggacgagttcgacttcgtcgccaccacgcggaccggcgacgagcacaacgccatcaagcgcgcggtcaacacgctgctgaagtccatcgacgagatcagcctcgtcaccgatgacgtgttgctcatcggcgcgaccaaccaccccgacgagctcgacgcggcggcgtggcggcgcttcgacgagatcctctcgttcccgcggcccgacgaggggatgcgcgcggacatcatctcgctggtcaccagcgaggtggacatcgccgacttcgatcccgccgcgctcgccgccgaaaccagtggcctcaccggcagcgacctccggctggtgctccgggaagccgtcctcgacgcgctcgtcgaggaccgcacggaactcacacaggacgacctcatggccgccatctctgagttcgaggaccgcgaccacctccgcaacctcgacaccctcgaagacgccctcgacgacacccacagcgaccacacccacgacgaccatccagctcccaatccggaatga

SEQ ID NO: 42355 - DNA, 1233 bp, Halobacterium sp. NRC-1
atgcgggctgcgggatcgcggccagtaaaccgctggctggatgtcggccgttgtgggagctttaaggagcggggcgcgctcgcgtttggtatggcagccaccaccactccggtcatcgctgcggcctaccgcactccacagggaaaggacggcggcgtgtacgccgacacgcgcagcgaggacctctcggtgacggtcatcgaccacatcctcgcggagacggggttgaccggcgaccacatcgacgacctccagtggggggtcgcccagcagcgcaccgagcaggacaacaacgtcgcgcgcgtcatcgcgttgctctccgagctcggtgagaacgtgccggcggcgtcgatcaaccgctggtgtgcgtcctccatggaggccatcatgcgggccgcggacgcggtgcgggcgggccagcgggacgccgtcatcgcgggcggcgtcgagaacatgagccgggtgccgatggacggcgactcgtacgcccacctgcatccggggctgagcgagcagtacaacgtccccgagctcgagatggggatgaccgccgaggaggtcgccgagcgccacggcatcacacgcaccgagcaggacgagtacgccctccagagccagcggcgggcagccgaggcgaccgacgccgggcgcttcgacgacgagatcgtacccgtacagacggacagcggcctcgtcgaagaggacgaggggatccgcccggacaccacgctggaggcgctcggggagctccccacggtgttcaaaagcgacgggtcggtgacgcccgggaacgccagccagatctccgacggggcggcggcgacgctcgtgacgagcgaggcgttcgcgcgcgaccacggcctcgacgtgctggcgcgcgtcggcgaccacaacgtcgcgggcgtcaaccccgaagtgatggggatcgggccggtgccggccacccgcggcctgctcgaccgcaccggcgaggacatcgacgagttcgacctcgtggagttgaacgaggcgttcgcctcccagacgctctactcgcgggacgaactcggcatcgacaacgaccggttcaacgtcaacggcggcgcgatcgccgttggccacccgctcggtgccagcggtgcgcgcctcccggtcaccctgattcacgagatgaacaagcgcgacgccggcaaggcgctggcgacgctgtgtgtcggcttcggccagggcgcagcgatctccttcgagcgataa

SEQ ID NO: 42356 - DNA, 1953 bp, Halobacterium sp. NRC-1
atggacccccgcgacgccgaacgcgagtacgacgaccacgtcatcgcacgccagacactttcacgcacgttcgaggacgccgccgaacgccacgccgacagccccgcccaggcgtacaagggcggcgtctacgaccgcagcctggcccccgaggtggtcgaccccgcgcccgacggcggcgtcgaaacgctcagctacgacgccctccgcgacatcgttcgcacgctcgccgccggcttccgggacctcggcgtcacggccggcgaccgcgtcggcgtcttcgcgcacacccgcatggagtgggcgcaatgcgacctcgccgtgctcgccgccggcggcgcggtcaccactgtctacgccagctccagcccggcgcagatcgcccacctcctcggcgacagcggcgccgtcggcgtcgtcgtcgagaacgacgccctccgccagcgcgtccgcgaggtcgaatccgacctcgacgacctcgagttcgtcgccacgatggacacccccagcgacgacacgcgcccgctgtcagcggtctacgaccgcggccgcgacgccttcgacccggacgcctaccagggctggatcgacgaccgcgatcccgacgacctggcgagcctcatctacacctccggcaccacgggaacgcccaagggcgtcgccctcacacaccggaacttccacgcgaacctcaaccagtcccggcggcgattcgggccccggcccgaccgcggcgacgcccccgcggtcaccagcgacagccgccacctctcgtttctcccgctcgcacacgtgcttgagcggctctcggggcatttcctgccgctggcgtcgggcgcgcaggtctgctacgccgaatctccggacacgctccgggaggatttcggcctcttcgaacccaccagcgccaccagcgtcccccgcgtctacgagaagctctacgacaccatccgcgagcaggccgccgactccccggtctccgagcgcgtcttcgagtgggcgacccgcgtcggccgcgccgcccacaccaccgacgaccccgggatcgggctgcgcgccgcacacgccctcgcggacacgctcgtgttctcggacatccgggacgcccttgggggggagatcgagtttttcatctccggcggcggctcgctgtccccggagctgtgtgcgctgttccacggcatggggctgcccatcctcgaaggctacggcctcaccgagaccagcccggtgctcgcggtcaacccctacgaggaccccatcgtcggcaccatcggcccgccggtcacggacaccgagctgaccgtcgacgagaccatcgccagccccgagcaacgccagcgctgtgacggcgccgccggcgagctgctcgcgcgcggcccacaagtgttcgacggctactgggggctgcccgatgccaccgacgccgcgttcgtcacccgcgagggcaaagagtggttccgcaccggcgacgtggtcgaactccgccccgacggctacgtgcggttcctcgaacgcgccaagcaactgctgaccctctcgacgggcaagaacgtcgcccccggccccatcgaggacgcgttcgccgccagcccgctggtcgcacaggccatggtcgtcggggacggccagaagttcgtctccgcgatcctggttccgaacttcgacgcggtctccgagtgggccgccagccaggagatcgcgctccccgacgaccgcgacgcgatctgccgcgacgagcgcgtccgcgcccgcatccagtcggcggtcgacgacgtcaacaccggcttcgagccctacgagcggatcaagcagttccgcctcgtcgcgaccgagttcacggaagcgaacgacctcctcacacccaccatgaagaagaaacgccaccacatccgtgaccggttcgcggacgcggtcggcgacgtctacgacgactccgaattcagcacctaa

SEQ ID NO: 42357 - DNA, 1971 bp, Halobacterium sp. NRC-1
atgatgcggtccgtgggtgccgtcggggagcctttggtggtcatgtgtgtggcgtgtccgcgacgcggcggatgcgttgtcaccgtcgtggcggctgctaaaagttgttggtgccgtggcgtcagtcggaacttaaacccagggctatgtccggctcgtcgtgtgtctgtacggcacagtggctcgtgtatactgtggtgtgggctgccgtccgggcgtgtcgcggccgtttcgctgccctccgatccgagacgatttcaaaggatttatatagaatggcaatcaatctatctactgaacatggctcagcaacagcgaatgcagggacagccgatgatcatcatgggcgacgacgcacagcgcgtgaaagaccgcgacgcccaggaacacaacatctcggccgcccgcgcggtcgccgacgcagtacgctcgacgctcggcccgaagggcatggacaagatgctcgtctcctcgatgggcgacgtcaccgtcaccaacgacggcgtcaccatcctccaggagatggacatcgacaacccgaccgccgagatgatcgtggaagtcgccgaaacccaggaagacgaagccggcgacggcaccacgaccgcggtcgccattgcgggcgaactcctcaagaacgccgaggacctcctcgagcgggacatccacccgacagccatcatcaagggctacaacctcgccgccgaacaggcccgcgaggaagtcgacaacgtcgccgttgatgtcgaccccgacgacaaggacctcatccgcagcgtcgccgagacctcgatgaccggcaagggcgcggaactcgacaaggagctcctttcgagcatcatctacgacgcggtcaaccaggtcgccgtcgaaaccaacgacggcgggatcgtcgtcgacgccgccaacatcaacatcgagacccagaccggccacggcgtcaacgagtcccagctgctccgcggtgccgccatcagcaaggaccccgtccacgaccagatgcccgccgcagtcgaggacgccgacgtcctcctgctgaacgaggccatcgaagtcgaggaagccgaagccgacacctcggtcaacatcgagagccccgaccagctccagtcgttcctcgaccaggaggaaaagcagctcaaggagaaggtccagcagatcgccgacaccggcgcgaacgtcgtcttctgccagaagggcatcgacgacatggcccaacactacctcgccaaggagggcatcctcgcggtccgccgcacgaagaaatccgacatcgagttcctcacgaacgtcctcgacgcgtcggtcgtcacggacctcgacgccgcctccgaggctgacgtggtcgcgggctcggtcacgcgcgacagcgacgacgaactgttctacgtcgagggcgagagcgagcaggcccacggcgtcacgctcctgctgcgtggctcgaccgaccacgtcgtcgacgagctcgaacgcggcgtctccgacgcgctcgacgtgtccgcccagacgctctcggacggccgcgtcctccccggtggcggcgccaccgaggtcgaagtcgccagccgcctgcgtgacttcgcggactccgtctccgggcgcgaacagctcgccgtcgaggcgttcgccgactccctggagctcgtgccccgcgtcctcgcggagaacgccggcctggactccatcgacacgctcgtcgacctccggtcggcccacgagaacgacgacgacgaacacatcgggctgaacgtcctctccggcgacctcgaagacaccttcgaggccggcgtcgtcgaacccgcacacgccaaagagcaggccgtgacctctgccagtgaggccgcgaacctcgtgctcaagatcgacgacatcatctcggccggcgatctctcgacggacaagggcgacgacgacggcggtgccggcggcatgggcggcggtatgggcggtggcatgggcggcatgatgtaa

SEQ ID NO: 42358 - DNA, 675 bp, Halobacterium sp. NRC-1
atggctcaggacatcaagcccacccgaaagaacctcatggagatcgaggaccgcatcgacctctcggagcgcggccacgacacgctcgaacagaagcgtgacggactcatcatggagttcatggacatcctggatcagtcacaggacgtccggtcgggtctggaaggcgactacgagaccgcacagcagaagatcaacatggcgcgcgccatggagggcgatgtcgcggtcagcggggccgccgcggcgctcgaagagtaccccgagatcaccgtcgagtcgatgaacatcatgggcgtcgtcgtcccccagatcgaatcgacgaaagtcaagaaatccttcgacaagcggggctacggcatcctcggcacgagcgcgcgcatcgacgaggccgcagacgcctacgaggagctgttggagtcgatcgtgctcgccgcggaggtcgagacggcgatgaagaagatgctcaccgagatcgagacgaccaagcgccgcgtgaacgcactggagttcaagctgctgcccgaactccacgagggcaaagagtacatcgaccagaaactcgaagagaaggaacgcgaggagatgttccggatgaagaaggtcaaagacaagaaagaagcccaagaggaggcggccgacgaggccgcggccgcggagtcgacgggcgcgtag

SEQ ID NO: 42359 - DNA, 1416 bp, Halobacterium sp. NRC-1
atgaaagagtaccagacgatcactgaagtcagcggcccgctggtgtacgtcgaaaccgacgagccgatcgggtacgacgagatcgtcgagatcgagacgccgaacggcgacgtgaagcgcggacaggtgctggagtcaagcgacgggttcgtcgccatccaggtgttcgaggggaccgagggcgtcgggaaggacgcctcggtgcggttcctcggtgagaccctgaagatgcccgtgaccgaggacctgctcggtcgcgtgctggacggctccggcaacccgatcgacggcgggccggacatcgtgcccgacgaccgcgtcgacatcgtcggggaggcgatcaacccccacgcccgcgagtaccccgaggagttcatccagaccggcgtgtccggcatcgacggcatgaacacgctggtgcggggccagaaactcccgatcttctccggctccggcctgccacacagcgatctggcgctccagatcgcccgccaggcgtcggtgcccgaggaagaagcggagaccgacgacgacgagggcagcgagttcgccgtcgtcttcggcgcgatggggatcacggccgaggaagccaacgagttcatggacgacttcgagcgcaccggcgcgctggagcgctcggtggtgttcatgaacctcgccgacgaccccgccgtcgagcgaacggtgacgccgcggatggcgctgaccacggcggagtacctcgccttcgagaaggactaccacgtgctcgtcatcctgacggacatgacgaactactgtgaggcgctccgccagatcggcgcggcccgcgaggaggtgcccggtcggcgtggctaccccgggtacatgtacacggacctggcgcagctctacgagcgcgccggccgcatcgagggcaaggagggctctgtcacccagatccccattctcacgatgccgggcgacgacgacacacacccgatcccggacctcaccgggtacatcactgagggccagatcatgatgaaccgtgatctgaacagccagggcgtcacaccgccggtgaacgtgttgccgagcctctcccggctgatggacgacggcatcggcgaaggcctcacgcgcgcggaccacggtgacgtgtccgaccagctgtacgccgcctacgcggagggcgaggagctgcgtgacctggtgaacatcgtcggccgcgaggccctgagcgagcgggacaaccgctacctggacttcgcggatcgcttcgaggcggagttcatcgaccaggggttcaagaccaaccgcgacatcgaggagacgctggatctcggctgggaactgctgtcgatgttcccgaagaccgagctgaaccgcgtcgacgaggacctcatcgaggaccactacgtcgaggacgtcgccgacgaagccacggccgactag

SEQ ID NO: 42360 - DNA, 1671 bp, Halobacterium sp. NRC-1
atgaacgacgtcgtctacgtgggcgacgagggtctgatgggcgaggtcatcgagatcgaaggcgacgtaaccaccatccaggtctacgaggagacgtccggcatcgggccgggccagcccgtcgacaacacgggcgaaccgctcaccgtggacctgggcccggggatgctggactccatctacgatggtgtgcagcgtccactggacgtcctcgaagacgagatgggggcgttcctcgatcgcggtgttgacgcacccggcatcgacctcgacaccgactgggagttcgagcccaccgtcgaggcgggcgacgaggtcgcggccggcgatgtcgtcggcaccgtcgacgaaacggtcagcatcgaacacaaggttctggtgcccccccgcagtgacggcggcgaagtcgtcgccgtcgaatccggcacgttcaccgtcgacgacacggtcgtcgagttggacaccggcgaggagatccagatgcaccaggagtggccggtccgccgccagcgccccaccgtcgacaagcagacgccgacggagccgctggtgtccggccagcgcatcctcgacggcctgttcccgatcgcgaaaggcgggacggccgcgatcccggggccgttcgggtccgggaagacggtcacccagcagtccctcgcgaagttcgccgacgcggacatcgttgtctacatcggctgtggtgagcgcggcaacgagatgacggaagtcatcgaggacttcccggagctgcccgacccccagaccgggaacccgctgatggcccgcaccacgctcatcgcgaacacgtcgaacatgccggttgcggcgcgtgagtcctgcatttacacgggaatcaccatcgcggagtactaccgcgacatgggctacgacgtggcgctgatggccgactccacctcgcggtgggcggaggccatgcgggagatctcctcgcgactcgaggagatgcccggcgaggaggggtatcccgcgtacctggccgcgcgcctctcggagttctacgagcgcgccggctacttcgagaacttcaacgggaccgagggctccatctcggtcatcggtgcggtgtcgccgcccggcggggacttctccgagccggtcacccagaacacgctgcgcatcgtgaagacgttctgggcgcttgactcggacctcgccgagcgccggcacttcccggcgatcaactgggacgagtcctacagcctctacaaggaccaactcgacccgtggttcacggacaacgtcgtcgacgactgggccgagcagcgccagtgggcggtcgacatcctcgacgaggaatccgaactcgaagagatcgtgcagctcgtcgggaaggacgcgctgcccgaggaccagcagctcacgctggaagtcgcgcggtacatccgcgaggcgtggctccagcagaacgcgctccacgacgtggatcgctactgcccgcccgagaagacgtacgccatcctctccggcatcaagacgcttcacgaggagtcctttgaggcgttggacgccggtgtgccagtcgaggagatcacgtcgatcgacgccgcgccgcgcctgaatcgtctcggcacgacgcccgacgacgagcacgaggcggaggtcgcggagatcaaacagcagattaccgagcagcttcgggagctctactga

SEQ ID NO: 42361 - DNA, 903 bp, Halobacterium sp. NRC-1
atggagtacgtggaggcgcgccgggccgccatcgagcagcgcatcaccgaggcggtcggcggtgtcgagccgacggagctcggcgaccaactcgaacacgtcgtgttggccggcggcaagcgcgtccgaccgacgctcacggtgctcgtgtgtgaggccgccggcggtgccgtctggacgggggccgccgaagccgccgcggtccgggagaacgcggcgctgtcggccggcggggaggacgcactcgattacgccgtcggcgtcgagttggtgcacaacgcctcgctggtcgtcgacgacatcatcgatcggtcggagctgcgccggggctcggcgagcgcgtgggcggagtacggctacggaccggggatcgtcgcgtccgacggcctgctgggggaggcgttcgcgctgttctcgcgtgacccgcgcgcgatggagtgtgtgaccgattcgctggtggagctcggcgagggggaggccatcgagctcgtggcccggccggagaccgagcgcgagtacatggaactcgcgcgtcggaagaccggagcgctgttccgcgcggcggcggagctgggcgcgatcgcagcggacgccgacgggcgggccgtcgagcgcttcggcgagtacgccgagcgcgtcggcgtggcgttccagatccgggacgacgtgctggacgcgaccgcggacagcgacgcgctgggaaagcccgcgggggtcgacgaggccttggaccgccccagcatcgtgcaggtcacggaccggtcgccggacgcgttgaaccggttggcgggcgagcagtccgagcgcgcgctgggggcactggcggagctggagctgccggacggcgaggccaaagactacttgcagtatctcgcggagttcgtcgtcgagcgggacgcgtag

SEQ ID NO: 42362 - DNA, 786 bp, Halobacterium sp. NRC-1
atggaactcggactcgatggggacgtggcggttgtgacggcgtcgtcgagcgggcttggaaaggcgagtgcggcggcgctggcgcgcgagggggccgacgtggtggtgtgttcgcgcgacgaagagcgcgttgtggcggcggccgaggagatcggcgcggacgccgccggctcggtgcgtggggtccctgcggacatcaccgacggggcggacgttgcggcagtggtagagacagccgtcgagacgttcggcggcctcgatcacgtcgtcacgtccgccggcggcgtgcccagcgggcagttcaccgcggtcaccgacgacgactggacggacgccttcgagttgctcgtgatgagtgtcgtgcggacgcttgacgccgcccacgagcacctggtggcgggcgacggcggcaccgtgacgtgtatcacctcgaccagcgtgagcgagccgatcgaggggttggtgttgtcgaacgcggtgcggcgtggtgtcgtcgggctggcgaagaccgtcgcccgcgagtgggcaccggacgtgcgcgcgaacgtcgtccagccggggccacacgagaccgcgcgcatcgaggagttggtgtcggcggccgttgcgcgcggggaggctgacagctacgaggcggggctggcggggtggagcgaggaggttcccttggatcggctcggggagccgagtgagctcggcgacgtggtggcgtttctcgccagcgaccgcgcgagcttcgtgaccggtgccagcgtgcccgtcgacggcggccggctgtgggggtag

SEQ ID NO: 42363 - DNA, 2496 bp, Halobacterium sp. NRC-1
atggatccggacctggccgacgattacatcagccatcccgaccagctccaggaagccgccgaggaggcgttgcgggtgtacgatctgcccgtcgacgtgagcctcgggcaggcacacgttcgcgtgcacgggctggccgagcacacggacatccgggcgatccgcgccgaacacctcaacacgatggtttcgatccaggggatggtgcggaaggccaccgacgtgatgccgaagatccagcgtgcggtgttcgtctgccagcgctgtggcaccgacacggaggtgccacagggggatgcggggttccaggagccgtatcagtgtgagtcctgcgagcgccagggaccgttcaagctcgacccggatcggtcggagttcgtggactcccagaagctgcgcatccaggagtcacccgaggggttgggcggcggggagacgccacagagcatcgacgtccacgtcgaggacgacgccaccggcaacgtcacgccgggcgatcacgtcaccgtcaccggcgtcctccggctcgaccagagcgaggaggccaccgactcgccggtgttcgaacattacatggaagggtcgtcggtcgtcatcgaggacgccgagttcgacgagttgaacatctccgaggcggacaaagaggagatcgtcgcgctctcggaccacgaggagatccacgaggagatggtggattcgatggcgccggcgatctacggccaccgcgaggccaagctcgcgatgatgctgcagttgttctcgggcgtcaccaaacacctccccgataagtcccgcattcggggcgacctccacatgctgctcatcggtgacccgggaaccgggaagtgcgtgcggggcgacaccacggtggcgctcgccgacggcagcgagcgcgagatccgggacctcgtcgaagcgaacctcgacgacccgcggcccgtcgatgacggcgtctgggacggtgtggacgtggccgtcccgtcgcttgcagccgacggcaggctcgtgcagcgccgcgcgacgaaggtctggaagcgcgaagcccccgagacgatgtaccgcgtgcggacggcggccggtcaccggctcaccgtcacgccgagccacccgctgttcgtcgccgggtcgcacggcccggacgcggtccgaaccgaggatctggaggtcggacagctcgtcggggtcgccccggacggcgacggctccgggcaggtcgcacccgacgggggcgtcatccgggacgcacaaccagcgccggtgggggacgccgaaaccgtcgcgtggagcgccatcgaatcgattaccgaagtcgaacccgacgaggagtgggtgtacgacctcgaagtcgaggggacccacagttacctcaccgacggcgtggtctcgcacaactcccagatgatctcctacgtgcagaacatcgcgccccggtcggtgtacacctccgggaaggggtcgagtgcggcggggttgaccgccgcggccgttcgcgacgacttcggtgacggccagcagtggagcttggaggcgggcgcgctggtgcttgcggacaacggcgtggcggccgtcgacgagctggacaagatggccgacgacgaccggtcggcgatgcacgaggcgctcgaacagcagaagatctccgtctcgaaggcgggcatcaacgcgacgctgaaggcgcggtgttcgctgttgggcgcggcgaacccgaagtacgggcggttcgaccagtacgagccgatcggcgagcagatcgacctggagccggcgttgatctcgcggttcgacctgattttcaccgtgaccgatcagcccgaccccgaggaggacgcggcgctggcggatcacatcctgcagaccaactacgccggggagttgaacacgcaaaacgaggaactcgcgaacgcgaactactcggaggcggagatcgagagccagaccgaggacgttgcgccggcgatcgagccggggttgttgcggaagtacatcgcgtacgctcggcggacgtgtttcccgacgatgaccccggacgcgcgccaggccatcgaggagttctacgtggatctgcgatcgaagggcgcggacgaggacgcgccggtgccggtgaccgcgcgccagctggaggcgatcgtgcggttggcggaggcgtcggcgcggctccggctgtcggattccgtggagaaaagcgacgccgaccgcgtgatcgggatcgtgcagtcgtgtctccaggacatcggcgtggaccccgaaacaggcgagttcgacgccgacgtggtcgagaccgggcagtcgaagacccagcgggatcgtgtgaagaacatcaaggcactgatcggggagatcgaagaggagttcgacgacggcgcgccggtcgaggaggtcctcgatcgtgccgaggagatcgggatggacgccgggaaggccgaacacgagatcgagaagctcaaggaacgcggggagctctatcagccgaacacggaccacttgcgctcgatctag

SEQ ID NO: 42364 - DNA, 864 bp, Halobacterium sp. NRC-1
atgcagcatccacaccgctgccctgaatgcgacggcaccatccgcgaaaccgacaccgagcacgtctgtgccgactgcgggctcgtcgtcacggacgcgcccatcgaccacgggcccgagtggcggacgttctccgacgaccccgatcacgcacccgagcgtaccggcgcgccgctcacccgctcccggcacgaccgcggcctctcgaccgagatcggctacagcgcacggctcacgggccgcaaacgccgcaagttcgcacggctccgccgtcaacacaagcgcgccacgatcccctcgaaagccgactacaaccggatctacgggttcacggagatccgccgcctcatcggcacgttcggcatcggcaccgggctccgcgaccaggcctgcacgctgttcgcgtccgcccaaacggcgggcctgctccacggccgcaccatcgaggggttcgcggccgccggcgtctacgccacctgtcggaccaacggggtcacccgcaccctcgacgaaatcgccgccgccgcccgcgccacccgccccgagctcaccaccgcctacgacgccatgaaccgtgatctcgggctgccgaccggccccatcgacccccgcgaatacctcccacgatacgccgacgccctctccctgccggcccgcatcgagcgccaggcccgcgaactcgtcgccgcactcgaaaccgacggcctggtcgccggccgaaaccccagcggcgtcgccgccggctgcctctacaccgccgcaaccgagaccgaccacgccgtcacgcagtcggccgccgcggccgtcgccgacgtcacgccggtgacgctgcgcgcgacctaccagaacctcactgacgcctaa

SEQ ID NO: 42365 - DNA, 2406 bp, Halobacterium sp. NRC-1
atgacacgagacagttgcacgttgtgtgggttgcccacgccggagccgccggtcaccggcggagacgacgtcgacggcgcgttctgctgtcggggctgcatggaggtcgcgcgcacgcttgaggacccggcagccatggacgacgccggggccgccgacagcctcgacactggcgcggacacgacggacgtggacggcgaggcggcgtttctctccgtgtcggggatgcattgtgcgacctgcgaggcgttcgtggaggcccaggcgaccgacaccgagggtgtgcgggcggcgtccgcgagctacccgacggagacgctgaaagtcacgtacgaccccgagaccgtcgaccgtgaggccgtccgggcggcggtcgacgggctggggtacagcgccaccgagcgcgacggcgacgccgccgccgacgacgacgagtcggaagtggggcggctgctggtcgggggctttttcgggatgatgacgatgctgtggtacgtcctgtttctgtaccccgcgtatctggacgtgccgtcggccgcccagctgctcgacctcggggggctggcgggcagttatctgctggcgaacgtgtggctgatggcgaccgtggtgttggcgtacaccggctacccgctgttccggggggcgtacgtgagcctgcgcgccggccacccgaacatggatctgctggtggggatcgcggcgggcgcggcgtacgtcttcagcacggccacgatcctgaccggcggccgcgaggtgtacttcgacgtcgccatcgtcgtggtgcttgcagtcaccgtcggggattactacgaggggcgggtgaagcgcgcggccgcgggccggctggcggacctcaccgaggagcgcgtcgacgacgccacccgccggcgcgccgacggcgccacggagacggtcgccatcgaggagctccaggcgggcgacgaagtggtggtcggcaccggcgagcgcatccccgtcgacggcgtcgtcacgtccgggtcggcgaccgtcgacgagtcgctggtgaccggggagtcgacgcccgtcggggcgacgccgggcgacgacgccgtcggcggggctgtggtcaccgacggccgcctcgtcgtcgcggtcggcgacgacgccgcaagcacgctcgaccgcgtcgtgcgcgtgctctgggacgtgcagagcgcgcggccgggcgtccagcgcctcgtcgaccgcgtcgccgcggtgttcgtgccgctggtggttgtgctcgcgggggtggccggcggctggcacctgctcgcgggtggtgcggcggcgaacgaggcgttgctcgtcgggctgtccgtgctcgtggtgtcgtgtccgtgcgcgctcgggctggcgaccccgctggcggtcgctcgtggcgtccaggaggcgctcgacggtggcgtcgtggtgacggacgtgtcggcgttcgaggccgcgccggcggtcgatacggtggtcttcgacaagacgggaacgctcaccaccggcgagatgcgcgtgcgggacgtcgtcggcgacgacggcgtgctcgcgcgggcggccgccgtcgaacagtacgccgaccacccggtggccgccgcgatcaccgacgacgccacgcccgccggcgacatcgacgacttcgagcgcgtgcccggccgcggggtcgccggcagcctggcggttcggcccgacggggcggccgcggcggcggacgcgccccgggtggtggccgggaaccgcgcgctgttcgacgaccgcggctggcgggtccccgaggcgtacgccgagcgcgccggcgacgcgcgggcgaacggcaacgtgcccgtgttcgtcgggtgggacggcgaagcccgcggggtcgtggtggccggcgaccggccccgcgacgagtggacggacgttgtctccaccctggacgccgacggccgtgacgtggtggttgtgaccggcgacgaccccgaagcggccgcgcggttccgcgaccacgacgcgatcgcggcggtgttcgcgggcgtcccgccggagggcaaaacggaggcggtgcggtcgctgcgggccgacggcgacaccgtggcgatggtgggcgacggcgtcaacgacgcgcccgcgctggcggcggccgatctgggggtggcgctggaccacgcggcgctcgccgccgacgccgccgacgccgtcgtgaccaccgaggacctcggggccgtcccacgggtgttcgcgctgacggacgcgaccaacggccgcattcgccagaacctcgcgtgggcgttctgctacaacgccatcgcggtcccgctggcggttgcgggcgtgttgaacccgctgttcgcggcgggcgcgatgacggtgtcgagtctgctggtcgtcgggaactccacgcgctcgctgctggacgacggggtggctggcccgtga

SEQ ID NO: 42366 - DNA, 846 bp, Halobacterium sp. NRC-1
atgttactcagcgggtcctcgagtcagtcactcgcggccgcgctcgccgccgcaaccggcgagcggctcggcgatgtgacctacgactcgttcccggacggcgagcagctggtgaccgttcccccggccgtcgacggcgagcgcgcggtcatcgtggcgtccacgccgaccagcgacgcccacatcgaggtgctgcaactccaggacgccgcccgcgacgccggcgcgtccgagatcatcacggtcctgccgtacatggggtacgcccgccaggacgacgccttcgaccccggccagccggtgtcggcgcgcgcggtcgctcgcgccatctccacgggcaccgaccgcgtgctcacggtcaacccacacgaggacggcgtcctggagtgtttcgacgtgcctgccgcgggcgtcgacgccgcgccacagctcgccgcgccgctgcccgcggatctcactgaccccgtgttcctctcccccgaccacggcgcgaccgatctcgccaccagcgtccgggacgcctatggcaccggcgtcaccgatcacttccagaaggtcagacactccggcagcgatgtcaccgtcgaacccagtgagatccagaccgccggccgcgacgtcgtcgtcaccgacgacatcgtcgccaccggaaccacgatgagcgaagccatcaccgcgctcgacgaccccgcccgcgtgttcgtcgccaccgtccacccgctgctcgccggtagcgcccgcctgaagctcgcgcgcgccggcgtcgaagccgtctacggcaccgacaccatcgagtgcgccgtctccgaggtgtccgccgcgcccgccatcgctgacgccctctga

SEQ ID NO: 42367 - DNA, 1368 bp, Halobacterium sp. NRC-1
atgaacgtcttcgggtcgagcggaacgcggggcgtggccaacgaggagctcacaccggggttcgtgttgcgcgtcgcgaaggcggccggctcggtgtggcgcgccgaccgcgtcgcggtcgcacgggacacccgaaccaccggccgcatgctcgaaaacgcggccgtcgcgggcctccagagcatcggcgtggacgtcgaccggctcggggtggttccgacgccggccacgcaagcgtacgcggagcgcgccggcgtcccggcggtgatggtgaccgcgagtcacaaccccagccagtacaacggcgtcaagctcgtcggcagcgacggcgtcgagctggcggttgccgacctggagcgcgtggagcgcgcgttcaccaccgagcagttcgacaacgccgcctgggacggtgtgggagccgaccgggaggtggcgtccgcgggccgcgactaccgcgcacagctgtccgacgccgtcgaccgggcggcgatcgcggccgccgacctgacggtcgccctggacccgggccacggcgcgggcgcgctcaccagcccgacgttctaccgcgagctcgggtgtgacgtcgtcaccgtgaacgcccagccggacggccacttccccggccgggagcccgagccggtgcgcgaacacctcggcgacctcggcgcactcgtgcgcgcggccgacgccgacgtggggatcgcccacgacggcgacgccgaccgtgccatcttcgtcgacgagaccggcgagtacatcgagggcgacgccacgctcgcggcgcttgcggaggccgagctcgacgccggcgacaccacggtgtccgcggtgaacgtcagccagcgcctcgtggacgtctgcgaccgcactggagcgacgcttgagctcacgcccatcggctccacgcagatcatgacccggatccgcgagctggaagccgagggcgaccacgtcccggtggccggcgagggtaacggcgggatcatcttcccggagtaccgcatgacccgcgacggcgcgtacactggcgcacggttcctcgaactgctggccgacggcacgcccgcaagcgaggtcgtcgcgccgtacgacgactaccacaacgtccgcgtgaacgtcgactacgacacggaagcacaacggggggcgctcctcgacgcggcggaggcgcgcgcgctggacgcggacgccgaccgcaccaccatcgacggctaccggctggactacggcgacgcctgggtgctcgtgcggccgtcgggcacggagccggtcgtccgcatctacgcggagtccaccgaccacgagcgggccgaatccctcgcggaggcgttcgccgcggatctgcgcgcggcgcgggccgacgcctag

SEQ ID NO: 42368 - DNA, 1260 bp, Halobacterium sp. NRC-1
atggcgctcgttctacccaatcagtccactgagactggacagtgggttgaaattcgatggcagcgatccccatggaaacgattgttacgaaaatcatatagtcgcaggggtagatcctccgcacatgtcaggacgggggtacccgtgaccgagaccattcatcgagcacccgacgacacctaccgggtgctggacgagaacggcgagctggtcgacggcgcggaggtaccggacctcaccgacgacgagctcgtggagatgtaccgctacatgaagctcgcgcggcgcttcgacgagcgcgcggtgagcctccaacggcagggtcggatcggcacctacccgccgctgtccggccaggagggcgcacagatcgcgtccgcgatggcgcttgccgacgacgactggatcgtgcccagctaccgcgagcacggcgccagcctggttcgtggcctcccactgaaagacaccctgctgtactggatgggtgacgagcgtgggaacgcgatcccggccgaggagaacatcttcacggtcgcggtgccgatcgccagccagatcccccacgccaccgggatggggtgggcgtcgcagctcaaagacgaatccgacacggcgttcatgtgttacttcggggacggcgcgacctccgagggtgacttccacgaagggctgaacttcgcgggcgtctacgacacgccgaacgtgttcttctgtaacaacaaccagtgggcgatcagcgtcccgcgcgaacagcagacagcgacggacacgctcgcccagaaggccgccgcctacggcttcgagggcgtgcaggtcgacgggatggacccgcttgcggtctaccaggtggcacacgacgccatcgagaaagcgaaagaccccgacgaggacgaaatgcggccgacgctcatcgaggccgtgcagtaccggttcggcgcgcacaccaccgccgacgacccgtcggtctaccgcgaggagtccgaggtcgaggcctggaaggacaaggacccgatcccgcgtctggagacgttcctcgtggagaccgaccgcctcgacgacgcggccatcgagtccatcgaggccgacatcgaggacgcggtcgctgacgccatcgaggccgccgaggagacgccgcggcccgaccccgcatcgatgttcgagaacgtctacgcggagatgccacagcgcctagaacagcaactggagtatttccagtcgatccgagacgagtacggcgacgaggcgctcctggaggactaa

SEQ ID NO: 42369 - DNA, 894 bp, Halobacterium sp. NRC-1
atgggcgaggacgtcgggcagaacggcggtgtgttccgggcgaccgagggcctctacgaggagttcggcgacgaccgggtcatcgacacgccgttggcggagtcggggatcatcgggtcggcggtcggcatggccgcctacggcctgaagccggtgccggagatccagttctccgggttcatgtacccgggcttcgaccaggtggtgagccacatgtcgcggctgcgaacgcgctcccgcggccggttcacgctcccgatggtgctgcgtgcgccgatgggcggcgggatccgcgcgcccgaacaccactccgagtccaaggaggcgttttacgcccacgaggccgggctgaaggtcgcgatgcccagcacgccgtacgacgccaaggggatgctcatcgcgtccatccgggacccggaccccgtggtgttcctcgaaccgaagaagatctaccgggcgttccgcgaggacgtgcccgacgacccctacgaggtcgaactcggcgacgcggccgtccgcacggagggtgaggacgtgtcggtgttcacctggggggcgatgacccagcccaccgttgaggccgccgagaacctcgatcggatcgacgtcgaggtcgtggatttgcggagtctgagccccatcgacttcgacacgatcatcgagtcgttcaagaagaccgggcgcgccgcgatcgtccacgaagccccgaacacgggcggcctgggcgcggagatcacggcgaccatccaggaggaggcgttgctgtaccaggaggcccccgtcgagcgcatcaccggcttcgacgtgccgttcccgctggcggccctggaggactactacctgcccgagcccgcgcgcatcgcggccggaatcgaggaggcgttcgacttctaa

SEQ ID NO: 42370 - DNA, 1437 bp, Halobacterium sp. NRC-1
atggcccgcgaattcacgctacctgacgtcggagagggcgtcgcggagggcgaactcgtgcggtggctcgtcgacgagggcgacaccgtcaccgaggatcagccggtcgcggaggtcgaaacggacaaagcccaggtcgaggtgcccgcgccggtcgacggcacggtccaggaactccactgggcggaaggcgacgtggtgccggtcggcgacctcttcgtgacgttcgacgttgacggcgaggcgtcggccaccgcggacgacggcgacgaaagcggcgacgaggccgcgtcggcgaccagcgaggccagcggccggacgttcgcgccgccgagcgttcgcacgctcgcccgcgagctgggcgtcgacctcgacagcgtcgaggggagcgggccgtcggggcgcatcaccgacggcgacgtgcgcgccgccgcggagggcggcgaggacaccacggagccggccaccgaggccacgtccgcgacggaacgcgtcgacgaggacgacaccgcggcgagcgccggcagccaagagccggcgggccgcgagaagacgcttgcggcacccgcgacccgcggggtcgcccgtgagctgggcgtcgacatcaacgacgtgccggcggtcgaacagcgcgacggcgaggcgttcgtcaccgcggaggcggtccaggcgtacgccgagggcgggcaggccgcgcagggcgaggcgggcggcgcagccacccgcgagttcgtcgccggcggcgagaccaccgagccctaccggggcatccgccgcaccatcggcgagcagatggccgagtcgaagtacacggcgccacacgtcacccaccacgacaccgccgtcatcgacagcctcgtggagacgcgttcgaagctgaaagcgcgcgccgaggccgaggacgtgaagctgacgtacatgccgttcgtgatgaaggcggtcgtcgcggcgctcaaggagttccccgtgttgaactccgagctccgcgaggacgacgaggagatcgcgctcaagcaggattacaacatcggcgtggcggtcgcgaccgacgccgggctgatggtgccggtcgtcgagcacgtcgaccagaagtcgatgcttgagatctccacggagatgaacgacctcgtcgagcaggcccgcgagcgctcgatcgcgcccgcggacatggacggcggaacattcacgatcacgaacttcggcgcgatcggcggcgagtacgcgaccccgatcatcaactaccccgagacggcgatcctggggctgggcgcgatcgacgagcgcccggtcgccgaggacggcgacgtgcgggcggcccagacgctgccgttgtcgctgtcgatcgaccaccgcgtcatcgacggcgcggaggccgcgcagttcacgaaccgcgtgatggagtatctgactgaccccgaactactactactcgaataa

SEQ ID NO: 42371 - DNA, 1425 bp, Halobacterium sp. NRC-1
atggttgtcggagacatctcgactgggacggacgtcgcggtcgttggcgctggccccggtggctacgtggcggcgatccgcgcgggacagctcggcctcgacgtgacgctcgtcgagaaggacgcctacggcggcacctgcttgaactacggctgcatcccgtcgaaggcgatgatcacggcgtcgggcgtcgcccacgaggcgggccacgccgaggagatgggcgtgtacgccgaccccgacgtggacgtggcggagatggtcgactggaaggacggcgtcgtcgaccagctcacgggcggcgtggagaagctctgcaaggccaacggcgtgaacctcatcgaggggcgcgcggagttcgcgggcagcgacaagctgcgggtcgtgcacggcggcgacggccagggctcggagaccatcgagtacgagcacgccatcgtgtcgacgggctctcggcccatcgaggtgccgggcttcgacttcggcgacgaccccgtgttggattcgcggcaggcgctggcgatggcggagctgccgtcgtcgatggtgatcgtcggcggcggctacatcggcatggagctgtcgacggtgttcgcgaagctcggcgtggacgtgaccgtcgtggagatgctggatggcatcctgccacagtacggcgacgacatcgcgcgccccgtgagacagcgcgccgaggaactcggcatcgacttccacttcggcctcgcggccgacagctggacggacaccgacgacggcatcgtggtcaccgccgccgacgaggacggcgaggagaccgagttcgagaccgagaaggtgctcgtggcggtcggccgccagccagtcaccgacacgctgaacctggacgccgtcggcctcgaaccgaacgacgatgggcgcctggagaccgaccacgaggcccgcaccgacgtcgagaacgtcttcgcgatcggcgacgtcgcgcccggcccgatgctcgcgcacaaggccagcaaggagggcgaggtcgccgcggaagtcatcgcgggcgagccggcggccctggactaccaggccgtgccggcggcggtgttcaccgaccccgagatcgggaccgtcgggctcaccgaggacgacgccgccgcgcagggcttcgacccggtcgtcgggacgttcccgttcaacgccagcgggcgcgcgctcaccacgggccacgacgacggcttcgtggaggtcgtcgccgacgaggagtcggggttcctgctgggcgcgcagatcgtcggcccggaggccagcgagctcgtcgccgagctcggcctcgcgatcgagatgggggccaccctggaggacgtcgcgtccaccatccacacgcatccgacgctgtccgaggccacgatggaggccgccgagcacgcgctcggccacgccgtccacacgctgaaccggtaa

SEQ ID NO: 42372 - DNA, 1746 bp, Halobacterium sp. NRC-1
atggtactgattgtcacacaagttttaaatagaatcgcattcaatcaaagagtgattatggcgcagcagatgggtaaccagccgctgattgtactctccgaggacagtcagcgcacctcaggcgaggacgcacagtcgatgaacatcaccgccggcaaggccgtcgccgaatccgttcgcaccacgctcggcccgaaaggcatggacaagatgctcgttgactcctcgggcgaagtcgtcgtcaccaacgacggcgtcaccatcctcaaggagatggacatcgagcacccggcggccaacatgatcgtcgaagtcgccgaaacacaggagacagaggtcggcgacggaaccacgacatcggtcgtcgtctccggcgagctgctctccgaggccgaaaccctcctcgagcaggacatccacgccaccacgctcgcacaggggtaccgacaggccgccgagaaagccaaggagctgcttgacgacgccgcgatcgacgtctccgccgacgacacggagaccctcgagaagatcgccgcgaccgcgatgaccggcaagggcgcggagaacgccaagggcgtcctctcggatctcgtcgtgcgcgccgttcagtcggtcgccgacgacaacgacgtcgacacggacaacgtcaaagtcgagaaggtcaccggcggcgcaatcgagaactccgagctcatcgagggcgtcatcgtcgacaaggaacgcgtcagcgagaacatgccgtacgccgtcgaggacgccaacatcgcgctcgtcgacgacggcctggaggttcaggagaccgagatcgacaccgaggtcaacgtcaccgaccccgaccagctccagaacttcctcgaccaggaagaagagcagctcaaagagatggtcgacgcgctcaaggacgccggcgccaacgtcgtcttcgccgactccggcatcgacgacatggcccagcattacctcgccaaggagggcatcctcgcggtccgtcgcgcgaaatccgacgacttcacgcgactctcccgcgccacgggcgcaaccccggtctcgaacgtcaacgacatcgaggccgcggacctcggcgcagccggcagcgtcgcccagaaggacatcggcggcgacgagcgcatcttcgtcgaggacgtcgaggaagccaaaagcgtcaccctcatcctccgcggcgggaccgagcacgtcgtcgatgaggttgagcgcgccatcgaggactccctcggcgtcgtgcgcgtcactctcgaagacggccaggtcatgcccggcggcggcgcgccggagaccgagctcgcgatgcagcttcgggacttcgcggactccgtcggtgggcgcgaacagctcgccgtcgaagcgttcgcggacgcgctcgaagtcatcccgcgcaccctcgccgagaacgcgggccacgacccgatcgactccctggtcgatctccgcagtcagcacgacggcggcgacaccgaagcgggcctcgacgcctacaacggcgacgtcatcgacatggagtccgagggcatcgtcgagccgctgcgcgtgaaaacgcaggccatcgagtccgccaccgaggcggcgacgatgatccttcgcatcgacgacgtcatcgccgcgggcgacctggccggcggccaggtcggcgacgacgacggcgacgacggccccgctggcggccctggcggcatgggcggcggcatgggcggcatgggcggtatgggtggcatgggcggcgcgatgtaa

SEQ ID NO: 42373 - DNA, 561 bp, Halobacterium sp. NRC-1
atgaccgaccccaaggaaaccatcaacattgaaaacgtggtcgcctccaccggcatcgggcaggagctcgatctccagagcgtggcgatggacctcgagggcgctgactacgaccccgagcagttccccggcctggtctaccgcacgcaggacccgaaaagcgccgcactcattttccgctcgggcaagatcgtctgcacgggcgcgaaatcaaccgacgacgtacacgagagcctccgcatcgtcttcgacaagctccgcgagctctcgatcaaggtcgaagacgaccccgagatcgtcgtccagaacatcgtcacgtccgctgacctcggccgccagctgaacctcaacgccatcgccatcgggctgggcctcgagaacatcgagtacgagcccgagcagttccccgggctcgtctaccgtctcgacgaccccgaggtcgtggcgctgctgttcggctccgggaagctcgtcatcaccggcggcaaagagccaaaggacgccgagcacgccgtcgacaagatcacgtcccggctcgaggagctggggctcctcgactag

SEQ ID NO: 42374 - DNA, 849 bp, Halobacterium sp. NRC-1
atgcgcatcgccgttccgaacaagggacgcctccacgacccgaccctggcgctgctcgaccgcgccggcatcggcgtcgaagacggcgccgaccgccaactgtacgccgacaccgtcgacccggcgctcacggtgctgtacgcgcgcgccgccgacatccccgagtacgtcgccgacggcgcggcggacgcggggatcacgggccacgaccaactccgggagtccgacgtcgactgcgtcgaggagcgcctcgatctcaactacgggtcgtgccgactggtgcttgccgcccccgaggacggcgacgtcaccgcccccgccgacctcgacggggcgaccgtcgccaccgagttcccgacgatcacccgcgcgtacttcgcggacaccaccgccaccccggagatcgtggaggtgaccggcgcgaccgaactcacgccccacgtcgagatggccgacgccatcgtcgacatcacgtccacgggcacgacgctccgcgtcaaccgcctccaggtcgtcgacgaggtgttgtcgtcgtcagtgcggctgttcgcccacgaggacgtccacgacgaccccaaagtccagcaggtcgaaaccgcgctccgatccgtgctcgacgcccacgggaagcgctacgtgatgctgaacgcgcccgccgaccgcctcgacgacgtgaaggcagtgctgccggggcttggcggcccgacggtgctcgatgtcgacgaaccggggacggttgcggtgcacgccgtcgtccccgagcgcgacgtcttcgaggcgatctcggagctcaaagccgtcggcgcgtccggcatcctcgtcaccgaaatcgaacgcctcgtggactga

SEQ ID NO: 42375 - DNA, 1284 bp, Halobacterium sp. NRC-1
atgacaactgcaccggcgatcagcagccggctcgatgatcccgagtcggcgcgcgagacggggcgcgcgaagatcgattgggcgttcgagcatatgccgatcctgtccgcgctccgcgaggagttcgacgccaaccagccgctggccggcgaaaccatcgggatggcgatgcacgtcgaggccaagacggcggcgctggtcgagacgatggccgacgctggggccgagatcgcgatcacgggctgcaacccgttgtcgacacacgacggcgtgagcgcggcgctcgacgcccacgagtcgatcacctcgtacgccgagcgcggcgcggagggggaggcgtactacgacgccatcgacgccgtgctggcccacgagccgacggtcacggtcgacgacggcggcgacctcgtgttccgtgtacacgaggaccaccccgagctcatcgacaccatcatcggcggcaccgaggagaccaccacgggcgtccaccggctgcgcgcgatggacgacgacgacgccctggagtatcccgtgttcgcggtgaacgacaccccgatgaagcggctgttcgacaacgtccacggcaccggggagtccgcgctggcgaacatcgccatgaccacgaacctctcgtgggcgggcaaggacgtcgtcgtcgcgggctacggggactgcggccgcggcgtcgcgaagaaggccgccggccagaacgcgaacgtcatcgtgaccgaggtcgagccgcggcgcgccctggaggcgcacatggagggctacgacgtgatgccgatggccgaggcggccgaggtcggtgacgtgttcctcaccacgaccgggaacaagaacgtcatcacgcgagcgcacttcgagcgcatggacgacggtgtggtgctggccaacgccggccacttcgacgtggaggtcaacctcgatcacctctcggagctcgccgtctccgagcgcgaggcccgcgagggcgtccgcgagtacgagctggccgacggccgccgcctgaacgtgctggcggagggccgcctggtcaacctcgcgtcgcccatcgggttgggccaccccgtcggcgtgatggatcagagcttcggcgtgcaggcggtctgcgtgcgcgagctcgtggcgaaccgcgaggagtacgcggccggcgtccacaacgtgcccgacgagctagacatcgagatcgcggagatcaagctggcggccgagggcgtcgagtacgacgccctcaccgacgatcaggcggagtacatggactcctggcagcacggcacgtaa

SEQ ID NO: 42376 - DNA, 744 bp, Halobacterium sp. NRC-1
atgttcaaggcgatagtaagcgccgacacgctccaggagacactcgactccgtgagcgtgctggtggacgagtgcaagatccacctcgacgacgacaccctctccattcgcgcagtcgaccccgccagcgtcggcatggtcgacctcgatctcgccgccactgcgttcgaatcctatgaagccgacggcggcctcatcggcgtcaatctctcccggctggaggacatcgcgggcatggccgacgccggccagctcatccaactggaactcgacgaggaaacccgcaagctccacatccagatcgacggcctcgaatacacgcttgcgctcatcgaccccgactcgatccgccaggaaccggacatcccggacctcgatctgcccgcgcacgtcgccatcgaaggccgcgacatcgaccgcgcggtcaccgccgccgacatggtctccgaccacatcgcgctcggcgtcgacaccggcgacgacctgttctacgtcaacgccgaaggcgacaccgacgacgtccacctcgaactcgcgcccgaccagctcatcgacctcgacgccggcgacgcccacagcctgttcagcctcgactacctcaaggacatgaacaaggccatcccgacgaccgcggaggtcgaactcgaactcggcgacgagttccccatcaagctgcacttcgacatcgccgacgcacaaggccacgtcacgtacatgttggccccgcgcatccagtccaactga

SEQ ID NO: 42377 - DNA, 1374 bp, Halobacterium sp. NRC-1
atggacgaggtcatcagtttcggcacggacggctggcgtgcacccttatcggagttcaccagcgaccgcgtgcgcatcgtcgcacagggggttgccgaccacctcgcggccgacggcggcgcgggggacacggtcgccgtcggatacgacgcccgcgacacgtccgcggggttcgccgcggacgccgcggacgtgctggcggccaacggcttcgacgtggtgctgcccgagcgggactgcccgacgcccgcggtctcacacgccatcgtcgaacgcgacctggccggggcggtggtcatcacggcctcgcacaacccccccgagtacaacggcgtgaagttcattcccgctgacggggccggcgcgctccccagcgacaccgacgggatcatggcgaacctcgggacgccggcggctggcgaccccaccggcgagatccggcgggtggacttcaccggcccgcacgtcgcgcactgccgccgcctcgtggacgcgtcgctggacgggctgacggtcgtgtacgacgcgatgcacggcagtggccgcggcgtcaccggtgacgcgctggaagcggcgggcgcggacgtgatccggcggcgctgcacccaggacgccgcgttcggcggcaccccaccggagccgacgcccgaacacctcgccggcctcgccgacgccgtcgacgagcacgacgccgacctcggcatcgccaacgacggggacgccgaccgcgtggcggctgtcacgcccgagcgcggcgtgctcgacgggaactggttctacgtgctggcctacgactacctgctggagtccgggaccggtcccgcggtccgcaccgtctccacgaccggccacgtggacgcggtggccgccgcccacgactgcgaggtggtcgaagtcccggtcgggttcaagtgggtggcggcggccgtcgacgaccacgacgccctgttcggcggcgaggagtccggcggctacacgatgcgcgggcacgtccgccagaaggacggcgtgctgatggggctgctcgccgccgcggcggcgagcgaaaccgcgcttgacgaccgtatcgacgccatcgaggacgcccacggcgagatccaccaggacaagacgagcgtcgactgcccggacgaccgcaaacaggcggtgctcgacgggctcgacgccgcactcccggacagcgtcgcgggcgtcgccgtcgacagcgtcaacgacacggacgggttcaagatcgtgctcgcggacgggtcgtggctgctggttcggccgtcgggcaccgagccgaagatgcgggtgtacgcggaggcgggcagcgccgcccgcgtcgcggcgctgctggacgccggacgcgaactcgtcgcgcccgtcgtctga

SEQ ID NO: 42378 - DNA, 969 bp, Halobacterium sp. NRC-1
atgaccgacgccgcgggcggccgccaggagatctgggttgagaagtaccggcccgaacgcctcgaagacgtggttggccaccccgacatcaccgagcgcctgcagagctacgtcgaccgcgacgacctcccccacctcctgtttgcggggccggcgggcaccggaaaaacggcgtcctcggtgtcgattgccaaggaactctacggcgacgactggcaggacaacttcctggagttgaacgccagcgacgaacgcggcatcgacgtggtccgggaccgcatcaaggacttcgcgcggtcgtcgttcggcggccacaactaccgcgtcatcttcctggacgaggcggacgcgctcaccgacgacgcccagtcggcgctgcgccgcacgatggagcagttctcgaacaacacccggttcatcctctcgtgtaactactcctcgaagatcatcgacccgatccagtcccggtgtgcggtgttccggttcgcgcagctcggcgacgacgcggtcgccgcccacctccgtgagatcgccgagacggagggcctggaacacaccgacgacggcatcgacgcgctggtgtacgccgcggacggcgacatgcgccgcgcgatcaacgccctccaggcggcctcggcgaccggcgacagcgtcaacgaggagaccgtctacgcgatcaccgcgaccgcccgtccagaggagatcgagacgatggtgaccgaggcactgggcggcgacttcgcggccgcgcgagccacgctggacgacctcctcacgaaccgggggttggcgggcggcgacatcatcgaccaggtgcaccgctcggtctgggagttcgatgtcgaggaggcggccgcagtgcggctgctggaccgcctcggggaggccgactaccgcatcgcggagggcgcaaacgagcgcgtgcaactggaggcgctgttggcgtccgtcgcactgaacgccgaataa

SEQ ID NO: 42379 - DNA, 591 bp, Halobacterium sp. NRC-1
atgacagaccggacagccgcagtgacgcgggagacggccgaaaccgacgtggcggtcacgctggacctcgacggcgacggcgagcacaccgtcgacaccgggatcgggttcttcgatcacatgctggcggcgttcgcgaaacacgggctgttcgacgtgaccgtgcgctgtgacggcgatctcgacgttgacgaccaccacaccgtcgaggacgtggggatcgcgctcggggcggcgttcagcgaggcggtcggcgagaagcgcggcatccagcggttcgccgaccgccgggtgcccctggacgaggcggtggcgtccgtggtcgtggacgtgtcggggcgcgccgtctacgagttcgacggtgggttcagccagccgacggtcggcgggctgacgagccggatggcggcgcacttctggcggacgttcgcgacgcacgccgcagtcacgctgcactgcggggtcgacggcgagaacgcccaccacgagatcgaggcgctgttcaagggggtcgggcgggcggtggacgacgcgacccgcatcgaccagcgccgggcgggggagacgccctcgacgaagggcgacctctga

SEQ ID NO: 42380 - DNA, 699 bp, Halobacterium sp. NRC-1
atgctgtcggtccggaacctcgttcaccgctacggcgacaccgtcgccgtcgacggcgtcagcctcgacgtcgctgacggcgaatgcgtggtggtgacgggcgcgaacggctccgggaagacgacgctcgtccggcactgcaacggcctcctcgaaccggacgacggcgaggtgctcgtgaacggcacccccgttggtgaggatctcgtggccgcccgcgcgagcgtcgggatggtgttccagaacccgagggacggcttcgtcggcgcgacggtgggcgcggacgtggcgttcggcccggagaacctcggccgcccccgcgaggagatcgacgcccgcgtcgcggacgcgctggacgccgtcgagctcggcgggcggcgcgacgagcgcgtcgcggacctctcggggggcgaacaggagcgggtggccatcgcggcggcgctggcgatgcgccccgaccacctcgtgctcgacgagccgttcacgggcctggactggcccgcacggcagtccgtcctcgaccggctgcgggcgctacacgccgcgggaacgagtctgatcgtcgtcacccacgacctccgggacgtctggacgctggccgaccgcgtggtggcgatgcgggacggcgagatcgcgctccggggcgaccccgcggacgtccggggcgcgctccccgacgcgggggtgcggccgccgtga

SEQ ID NO: 42381 - DNA, 981 bp, Halobacterium sp. NRC-1
atggagcttccacaccgaccgcggcgactccgccgcgacggcgtccgtgatctggtttcggagacgatgttgacccccgccgacctggttgcgcccgtgttcgtggacgcgacggcggacgaacgcaccccgatcccgtcgatgcccggccaggagcgcgtcccgcttgccgacgccgtcgaccggacccgggagatcctcgacaccggcgtcgaggccatcgtgctgttcggcatcccggcgtccaaagacgacaccgggagccgggcgtacgccgacgacggcatcgtgcaggaggcgacgcggcgcatcaccagcgagaccgacgcctacgtcatcaccgacgtctgtctgtgtgagtacaccagccacggccactgcggggtcgtcgaggcggacgccgacaccgaccccacgctcacggtcaaaaacgacgagacgctgtcgctgctcgcggaaacggcggtgtcgcacgccgaggcgggcgcggagatgattgcgccgtcggcgatgaccgacggcatggtggacgcgatccggactgccctcgacgacgcggggttcagcgacgtgccgatcatgagctacgccgcgaaatacgagtcggcgttctacgggccgttccgggacgccgccgacggcgcgccgtcgttcggtgaccgccgccactaccagatggaccccgccaaccggcgggaggccagccgcgaggtcgccctggacgtcgagcagggcgcggacgtgctgatggtcaagcccgcgttgccgtacctcgacgtggtgagcgacgtgcgccgcgagttcgaccgcccggtcgcggcgtacaacgtctccggggagtacgcgatgttgcacgccgccgccgagaagggctggctggacctcgaatcggtcgcccacgagagcctgctgtcgatcaagcgcgcgggcgcggacctcatcatcacgtacttcgccgaggacgtggccgagaccctctga

SEQ ID NO: 42382 - DNA, 1338 bp, Halobacterium sp. NRC-1
atgaaccgcgagacgtcccgggagctctacgaccggtcgctcgacgtgctcgtcggcggcgtaaactccaccgtgcgagccgcgccacagccgtacccgacgttcgtgcagtccggggacggcggccacgtcatcgacgccgacggcaaccggtatatcgactgggtgatggggctcggcccgctgctgttgggccacgacctcccccagccggtcacggccgcgatccagcgccgcgccagcgacggcccgctgttcggcacaccgaccgagatcgaagtcgagcacgccgagttcgtggcgcgccacgtccccagcgtggagctgctgcgcttcgtgaactccggcaccgaggcgacggtgtcggccgtgcggctcgcccgcggctacaccggccggaacaagatcgtcgtgatgcagggcggctatcacggcgcacaggagtccacgctcgtggagggcgacgccgatcaccgtggcccctcctccgcgggcatcccgccggcgttcgcccagcacaccatcccggtgccgttcaacgacgccgacgctgtcactgaggtgttcgagacccacggcgacgacatcgccgccgtgctcgtcgagccgatcctggcgaacaagggcatcgtcgagccggtcgcgggctaccacgagacgctgcgggatctcacccacgaccacggcgcgctgctgatctgggacgaggtcatcacgggcttccgggtcggcgggctgggctgcgcgcagtccgaattcgacatcaccccggacgtcacgacgttcgggaagatcatcggcggcggcttcccggtcggcgcgatcggcggccgcacggacgtcatggaggagttcacgccgaccggcgacgtgttccaggcggggacgttctccgggcatccggtgacgatggcggccggcctggagacgctccagtacgccgccgaaaacgacgtctacgagcacgtgaaccgcctcggggggcggctccgcgaggggctggcagcggtggtcgccgaacacgcgcccgcgtacactgtcgtgggccgtgatagtatgttcaaagtggtgttcacgcgcgatggcgacgcgcagtcgggcgcgtgcaccgacggctgccgccaggaccccgactgtgagcgccacgccgcctgcccgaaaaccggggccgacgtcggcgacgccgccgtccagcgctggaaccgcgtgttccgcccgcagctgctggacgccggcgtgttgctctcccagaaccagttcgaatcacagttcgtctcgtacggccacaccgaggcggacgtcgacgagaccatcgaggcgtaccggagcgcgctctga

SEQ ID NO: 42383 - DNA, 1191 bp, Halobacterium sp. NRC-1
atgagcagccagcagattcgactcgcgacacgggggtctgacctcgcgctccggcaggccggcgaggtcgtcgacaccctcgaggaccgccgccacgacgtcgaactcgttgaagtggagacggagggcgaccgcgtgaccgacgcgctcatcagcgacctcgggaagaccggcgcgttcgtgcgcgcgctcgaccaggaggtcatggagggcaccgtcgacgccgccgtgcactcgatgaaagacgtgccgaccgaggttcccgaggacctcgttgtggccgcggtgccccaccgcgagaaccccgcggacgtgctcgtcaccccggacggcaccgatctcgaagacctgccggccggcagtgtcgtcggcaccgcaagcctgcggcggggcgcgcaagtgcaggcccaccgacccggcctcgacgtcgagcccatccgcgggaacgtcggcacgcgcgtggagaagctgctcgcgccggcgctgcaccgcgagcacgagcgccgcaccgaggccgagaaggaagcccaatcccgggacgcccgcgaacagcgccgcggcgactacaccgccgacatcgaggcgggcgtcgagaacctcgacaccgaggacggcgaggaaggggcggccgacgacggtgacgacaccgcgtcgagcagcgagttcgagcagtccgtcacggagtggttcgactcgctgacgccgctccagcagtccgcgatggagcgcgacccggacaccgagtacgacgcgctggtgatggcgcgcgtgggcttggagcgcaccggcttgctgcaccacgtcggcatcgaggagctgtcgacgggcacgcacgtgccggcgaccgggcagggggcgctctgtgtgaccgcgcgccgggacagcgacgtggtcgacacgctccgggacgccctcgaacacgtccggacgcgcgtggaagtgaccgccgagcgcgtcgtgctcgaggagcttggcggcggctgcatcgcgcccatcggcgtgcacgccctcgtgcagggcgacaccatccggacggccgtgcaggtgttcagccaggacggcagcgagcaggtcggggagacccgcgagctggacgccgagcagtacgcgacggacgcccgcgaactcgccgccgacctgcgcgatcggggtgccgcggacctcatcgaggacgcgcgcacggaggcctga

SEQ ID NO: 42384 - DNA, 915 bp, Halobacterium sp. NRC-1
atgacgaaagtcagcattgtgggtgcggccggaacggttggtgctgccgcaggctacaacctcgcgctccgcgacgtggtcgacgaactcgtgttcgtggacatccccgacaaggaagaggagaccatcggccaggcggccgacgccaatcacggcgtcgcctacgacgccaacaccgacgtcgtgcagggcgattacgcggacaccgccggctccgacgtggtcgtcattacggccggcatcccccgccagcccggccagagccgcacggacctcgcgggcgacaacgcgcccatcatggaggacatcggctcgtcgctggccgagcacaacgacgacttcgtgaccgtcaccacgtcgaaccccgttgacctcctgaaccgccacctctacgagagcggcgaccgcgaccgccactcggtcgtcgggttcggcggccgcctggacagcgcgcgcttccggtacgtcctggggcagcgcttcgatgtccccgtccagaacgtcgacgcgaccatcctcggcgagcacggcgacgcccaggtgcccgtgttctcgaaggtacgcgtcaacggcaccgatcccgcgttcagcgccgatgagcgcgaggagatcctcgcggacctccaggagtcggcgatgaacgtcatcgagaagaagggcgcgacacagtgggggccggcgaccggcgtcgcccacatggtcgaagccatcctcaacgacaccggcgaagtgctgcccgggtcgatggtgctcgacggcgagtacggcctcgacgacgtgggcctgggcgtcccggtgaagctcggctccgacggcgtcgaagaggtcgtcgagtgggagctcacggccgacgagcgcgacctcctggacgaggccgccgagaagctctccgcgcagtacgacgagatcgcgtaa

SEQ ID NO: 42385 - DNA, 1062 bp, Halobacterium sp. NRC-1
atgggcaacaccaccgacgaactgctcgacgacatcacgttcgacgccgacgaacccgaccgcgcggagatcgtttcgatgggcgaacgcacgtccgtgcgcatgctgaaggccgcgctggccgctcgcggcgtcgacgcgacgttcctcgaacccgggaccaccgactggccgatcgtcaccaacgagcgcggtgaagtcgacgccgacgcgacggccgccggcgttgaccgcctcgcgggccggctcggggacaccgtccccgtgatcacggggttcctcgcagaggacccacagggcaacgtcaccacgctcgggcgcggcggctcggacacgaccgcggtgatgctcggacggtacctcgacgccgacgaggtcgtcatcgtcaccgacgtggagggcatcatgaccggcgacccccaggtcgtcgagggcgcacgcaacgtcggccgcatcaccgtcgacgaactccgcaacctctcgttccgcggcgcggaagtcatcgcgccgtccgcgctctcgttcaaagacgacgccctcgacgtccgcgtgatccactaccagcacggcgacctgctgtccgggggcacgcgcatcgagggcaccttcgagagcatgatcgacatgcgggactcgccgctggcctgtctgaccgtcgccgggcgtgccatccgcaaccgccccggcatcacgtccgcgctctcgacggcgctctctgacagcgacatcaacgtcgacgccgtggcctccggcatggactcgatgacgttctacgtcgacgagtcggtggccgagcgcgccgagaacatcctccaccaggaggtcatcgccgtctccgagctgtcctcggtcaccgtcaccgacgacatcgcggcgatccgcgtgctcggcggcgaactccccaaccgcccgggcgtcctctgtcgcatcatcgacccgctcgccgaccgcaacatcaacgtcatcgacatcatctcctcggccacctccgtcgcggttttcgtctcctgggcggaccgcgagccggccctcgatgtcgtccagaacggcttcggctcgtag

SEQ ID NO: 42386 - DNA, 2415 bp, Halobacterium sp. NRC-1
atgacccacgccacatcagccacatccgacatggtcgctgcggcactcgaccgcgcgctcaccgatcacgaagacgacatcgactccgacgcccgcgaccgcatcctcaccgaagccacacgcaacgcctacgacgacgccaccaccgacgaacgatacgacgccctgctcggcgcgctcaccggccgcatcgaccgccaccccgcgtacaagaccgtcgcgggacgcgtgctccgcgagcgccttgaacgccgcctcgtcgacgactacgaccccgccacccgggatgccgccacccggcaagcgttccgtgacggcatccagcgcggcctcgacgccgatctcctcgacgagcgcatgggcgactacgaccttaaccgcctcgcagacgccatcaccccggcccgcgacgaccgcctcgactacatggccatggacaccctccgacagcggtacttcctccgggagcccgacgccgatccgtttgaactcccacagccgttctggatgcgcgtcgccatgggcgtcgcgcttcgcgaggaccccgccgaccgcgaggagtacgccatcgagttctacgacgcgctgtccacgctgcggttcgtccactcgacgcccaccctcttccacgccggcaccacccacgcccagctgtcgtcgtgttatcttaccaccgttcccgacgacttggacggcatcttcgacgcgtacaaggaacacgccaaactctcgaagtggagcggcggcctcggcaacgactggacgccgctgcgcgccgccggctcgctcatcgaatccacgggcgtcgagtcgacgggtaccgtcccgttcctcaaaatctcgaacgacgtgaccgccgcgatcaaccgctcggggaaacgccggggcgcggccgccgcctacctcgcgtgctggcaccttgacttccccgcgttctgtgacctccgccggaacaccggcgacgaacgccgccgcacccacgacatgaacaccgccgcctggatccccgatctgttcatggagcgcgtgcgcgctgacaagcagtggacgctgttctctccgaaggaaaccggcgacctctacgaactgtacggcagcgacttcgccgagcgctaccgcgagtacgaggcgatggctgacgacggtgacatccagcgcttcgagcgcgtggacgccaccgacctctggcgcaccatgctcacccgcctcttcgagacaggccacccctggctcaccttcaaggacccttgtaacgtgcgctccccacaggaccacgccggtacagtgcgctcctcgaacctctgcacggagatcacgctcaacacctccgaggaggagacggcggtctgcaacctcgggagcgtcaacctcgcgcgccacctcgacgacggcgacatcgaccgcgaacagctctctgaaacggtagaaaccgcgatgcggatgctggacaacgtcgtcgacctgaacttctacccgacggagaacgccgagcgctcgaacatgcgccaccggccggttggcctgggcgtgatggggttccacgacgccctccagcagatgcgggtgccgatggccagcgacgacgcgctcgaccgcgccgacgcactccaggagtacgtcgcctaccacgccatcggtgcctcggctgacctcgccgccgagcgcggcacctacgagagctacgagggctcgaagtgggaccgggacgtcttcccgcaggacactgttgatcgcctcgaatccgagcgcggccgcgagatcccggtcccgcgcgaggaacgcctcgactggagcgacgtgcgccagcgcgtcgccacccacggcatgcgcaactcgaacacgatggcggtcgcacccaccgccaccatctccaccatcgctggcaccacgccctccatcgaacccgtctactcgaacctctacgtcaaatccaacatgagcggcgacttcacggtggtcaacgaccgcctcgtcgccgacctcgaagaacgagacttgtggaccgaagaactccgcgacaaactcacctaccacgacggttccgtgcaggaactcgacgcggtgcccgaggacgtacaggaactgtaccggaccgccttcgagatcgacccgcgccaccagctccggctcgccgcgcgccgcggcgtctggatcgaccagagccagtcggtgaacgtcttcttccccgaaacggacggctcgaagctctccgaggtgtaccagacggcgtgggaactcggcctgaagacgacgtactatctgcgcacgctcggcgccagccagatcgagaagacaacgctagacatggacgagtacgacgacacccaattccggggtgatgacgacggagaggacgcggacggcgacggtgacctaccgagtgtcgaagaccccacctgcgaggtgtgtcagtga

SEQ ID NO: 42387 - DNA, 882 bp, Halobacterium sp. NRC-1
atgtacgtgggcgttcacccattgcgtatggcagattacgccaccgacgtactcgtcaccgccgactgggtcgacgaccacctcgaccagttccggagcgacgaccccgaccaccgactcgtggaggtcgacgtcgacaccgaagcctacgaggagtcacacgcccccggtgccatcgggttcaactgggagacccaactgcaggaccagaccacccgggacatcctcgacaaggacgccttcgaatcgctgctgggcagccacggcatcaccgaggactccacggtcgtcctctacggcgacaactccaactggttcgccgcctacgcctactggcagttcaaatactacggccacgacgacgtgaaactcctcgacggcggccgggactactggatggacaacgactacccgaccagcgaggagccgccgtcgttctccgcgaccgactacgacgccagcggccccttcgagggcatccgggcgtaccgcgacgacgtcgagaacgccatcgacaagggcctgccgctggtcgacgtgcgctcgcccgaggagttcagcggcgagatcctcgcgccgccaggcctccaggagaccgcccagcggggcggccacatccccggcgcggagaacatctcgtgggccgccacggtcaacgccgacggcacgttcaagtccgccgacgaactccgatcgctgtacgccgaccagggcatcgacggcgacgaaaccaccgtctcgtactgccgcatcggcgagcgctcctcgatcgcgtggttcgcgctccacgagctgctgggctacgacaacaccgtcaactacgacggctcctggacggagtggggcaacctcgtcggcgcgcccgtcgagaccggcgagtga

SEQ ID NO: 42388 - DNA, 774 bp, Halobacterium sp. NRC-1
atgtcggacaactgggtggtgacaccggactggctcgacgaacaggacgacgcgtcggtgcgtgtggtggacgtgcgcgacgcctgggagtacgacggcatcggacacgtgccgggcgcggtgaacgtgcccttcgatgcgttccggagcgcggacggtccacaggggatgctgccgccggccggggagtgggcggcggtgctgtcggcggcgggcgtcgagcgcggggacacgctggtggcgtacgacgacacccacggcgtgttcgcggcgcggttcctcgtgacggcgctgtaccacgggcacgacgacgtggcggtgttggacggggattacagcgcgtgggtgcgcgagcacgaaaccacgaccgggacgccggaagtagacgaaacgacgtacgagcccggtgagcggggtgttgacgtgttcgtggggaccgaggcggtggccgacgcggccgccagcgatgcggccgtggtcgttgacacgcgggacccaggggagttcgccgacggccacattccggacgcggtgaacgtcacgtggacggcgttcgtcgacgacgacacgcgggggttgaaatcccgggcggcgatcgaggacgtgctggccgagcacggcatcacgcgcgaggaccgggtggtgttgtactgcaacacggcgcgccggatcagccacacgttcgtggtgttgcggtggctggggttcaccgacgtgtcgttctacgaggggagcgtgcgggcgtggacggcggccggccggtcgctggtgtag

SEQ ID NO: 42389 - DNA, 1557 bp, Halobacterium sp. NRC-1
atgacagacgatcggtcgacggacgaacggcgaaccgcggaccgcgacttcgaagtcgacctcgacgacgtcctcgacgacgaggacgacgacgagggactcttcgatgacctgctcagcggcgagcccatcttcgagaacaaagaggtcctgcggccgtcgtacacgccccacgaactcccacaccgaaacgaccagatcaacaacatggcgaccatcctggtcgcggcgctccgcggtgagacgccgtcgaacatcctcatctacgggaagacgggcaccggaaagacggccagcgcgaagttcgtgagccaggagttggagaagacctccaagaagtacgacgttccctgtgaggtcgaatacatcaactgcgaagtcacggacacccagtaccgggtgctcgcacagctcgccaacacgttcatcgatcaaaaccgggcgttcgtcgacgcccgcatcgccgacctctcggacctccgggcacaggccgacgacgaccccaacgcactcgaaataggggggtcgccgggcgacgatcgtacaggcaacgaatcgagtgagggctccgatgtttcggacagcttttcggatcttcgggagcgcttcgactccgtcgcggagatcgacgaccgcatcgactccctggaagccgacaaggccgagatggaacaggtccccatgacagggtggcccaccgaccgcgtgtacgcgacgttcttcgacgccgtcgactacgtcgagcgcgtcgcggtcatcatgctggacgagatcgacaagctcgtcgagaaatccggcgacgatacgctgtacaacctctcccgcatgaactccgagttggacaactcccgggtgtcgatcatcggcatcagcaacgacctgaagttcaccgacttcctcgacccccgtgtcaagtccagcctcggcgaggaggagatcgtgttcccgccgtacgacgccaaccagctgcgggacatcctccagcaccggtcggacgtcgcgttcaaagccgacgcgctctcggacgacgtcctcccgttgtgtgcggcgttcgccgctcaggagcacggcgacgcccgtcgcgcccttgacctgctgcggaccgccggcgagctcgcggagcgcgaccaggccgaaaacgtcaccgaggaccacgtgcgccgcgcccaagacaagatcgagctcgaccgcgtcgtggaggtcgtccgaacgctgccgacacagagcaagctcgtgctctacgccattctcctgttggaggacaacggcgtgcacaacgtcaacacgggtgaggtgtacaacatctacaagacgctgtgcgacgagctcgacgccgacgtgctcacgcagcgccgggtcaccgacctcatcagcgaactcgacatgctcggcatcgtcaacgccgtcgtcgtctcgaagggccggtacggccgcaccaaagagatctcgctgtcggttccggtcgaggagacggaggcggtcctcgaagcggattcgcggctcagcgacatcgaagacatcacgccgttcgtgcaggcgcgcttcgagaacaattag

SEQ ID NO: 42390 - DNA, 1296 bp, Halobacterium sp. NRC-1
atgggccacgatcacggactccacaccaacagtgtacacgccggccagcgcgtcgacccggccacgggcgctcgcgcgccgccactctaccagaccacgtcgtacgccttcgaggacagcgccgatgccgccggccagttcgcccttgagcgggacggctacatctactcgcggctgatgaaccccaccgtggagaccctccaggaccgcctcgccgccctcgaaggcggcgtcggcgcggtcgccaccgcgtccggaatggccgccctggacctcgcgacgttcctgctggcacgcgccggcgactccgtcgtcgccgccagcgacctctacggcggcaccgtgacgtacctcacgcacagcgcccagcgccgcggcgtcgacacgacgttcgtggacgtcctcgactacgacgcctacgccgacgccatcgacgccgacaccgcctacgtgctcgtcgaaaccgtcggcaaccccagcctgatcacgcccgacctcgaacgcatcgccgacatcgcccacgacaacggcgttcccctgctggtggacaacacgttcgcgacccccgcgctggcaaccccgatcgaccacggtgccgacatcgtctggcactccaccaccaaatggatccacggtgccggcaccaccgtcggcggcgcgctcgtcgacgccggcagcttcgactgggacgcccacgccgccgactaccccgagatcgcccaggaaaaccccgcctaccacggcgtgaccttcaccgatcgcttcggggacgccgcgttcacgtacgccgcaatcgcccgcgggctgcgcgatctgggcaaccagcagtcgccgttcgacgcctggcagaccctccagaagctcgaaacgctcccgctgcgcatgcaacaacactgccggaacgcccagctcgtcgccgaacacctccgggaccaccccaacgtgtcgtgggtcaactaccccgggctggccgaccacgacacccacgacaacgcaaccacctacctcgattcgggctacggaggcatgctcacgttcggcgtcgaggacggctacgaggccgcccaatcggtcaccgaggagaccacgcttgccagcctgctggcgaacgtcggcgacgccaaaacgctcgtgatccaccccgcctccaccacccaccagcagctcacccccgaagcccagcgcgccggcggtgtgcgccccgagatggtgcgggtgtcggtcggcatcgaggaccccgccgacatcgtcgcggacctcgaaaccgccatcgaggccgcggtcgggtcggcgtag

SEQ ID NO: 42391 - DNA, 3039 bp, Halobacterium sp. NRC-1
atggcaacgcgcgacctccgctccgatgacccgtcaaccgaccccgacgccgattacgactacaccagcgacagcgtcgagcgccccgggctcgtcgacgacctccgcgagcgcgtcgacggcgacgtgcgcttcgacagctacacgcgccagctgtacgccaccgacgccagcatctacgaggcgctcccggtcggcgtcgtgttccccacgtccaccgacgacgtcgccgccgtggtctcgtactgcgccgaccgcgggatccccgtgctcccccgcggcggcggcaccagtctcgccggccaggcggtcaacgaggccgtcgtcctggacttcaaacacgcgatgaacggcttcgtcgggttcgaccccgaggccgagaccgcgcgcgcccagcccgggatcacgctcgcggccctcaacgacgaactcgccgcccacggtctgaagtacgcccccgatcccgcgtggggggacaagagcgtgctcggcggggccatcggcaacaactccacgggcgcacactccctgcagtacgagaaagccgacggctacctcgaatccgccgaggtcgtgctcgcggacggcacggtgaccacgctgggctgggtggacaccgacgacctcgacgcgctcgcggaccccgacggcgacctcgaagcccgcatctacgccgacctccggcggctcctcgacgaggaagccgaccggatccgcgagcgcttcccggacctcaagcgcaacgtctcggggtacaactacgaccgcctgctggcggacgccgaggcccacggcgcggtgaacgccgcccgcctgctcgccggcagcgagggcaccctgggcatcatcaccgaggcggaagtctccctggagccggtccccgcggagaccgcggtggcgatgctcacgtacgacgacgtgcgcgacgccatgcaggacgtggcccccgttctcgatcacgacccgtccgccgttgaggtgatggacgacgtgttcctcgatctcgcgcgggacaccgacgagttcgccgacgtcgtcgggctgctgcccgacggcacggactcgacgctgctggtggagttctacgccgacagcccggccgaggcccgccgccgcgtggccgacctgctggccgaccgcctgcccagcgccacgccggccgccgacccacccggagccaccaccaccgacgcccccgtgcacgcggtggacgcactggaggcctacgacgacgaccgccaggcccacttctggaagatgcgcaaggccggcctccccatcctgttgtcccgcaccagcgacgagaaacattacccctacatcgaggacaccgccatccccgccgaccacctgccggcgttcgtcgcggacttccaagccatcctggacgacctcgacacggtcgcgtcctactacgcccacgccggtcccggcgtcctgcacgtccgcccgctcgtgaccctcgccgacgaggcgggcgtcgcgaagatggccgaaatcgccgaccgcgtcaccgacctcgtcgtggagtacggcggcgcagtgtccggggagcacggcgacggacgcgcgcgcagccagtggaaccgcaagttctacggcgaggacctgtgggcgtcgttccgccgcaccaaggcggccttcgaccccgactggatcctcaaccccgggccggtctgtggggacgccgccggcgagatcgacatgaccgaccacctgcgtgtcgcccccgacgacgagttcgacgccgggttcgatcccgcactgaactgggacaccgagaacggattccggggcatgaccgagctctgtcacggctgtgccgggtgcaccggccaccaggacaccaccggcggcgtgatgtgtccgacctaccgcgccgccaacgaggagacactcagcacgcgcgggcgtgcgaacatgctgcgctcggcgatgaacggccacctccccgccgaccccctcgacgacgagttcctgacggaggtgctggatctctgtgtgggctgcaagggctgcaaactcgactgccccagcggcgtggacatggcgaaactcaaaaccgaggtgaaacacgccagccaccaggccgacggcgtcggcgtcctcgaccggctgttcggccacactgaggcgctgttccacctggggtcggcgctcgcgcccgtctcgaactgggccacggcgctgccgggtgccggcgcgctcgccgagaaaaccctgggcatcgccgccgagcgcgacctcccgacgttccggcgggagagcctccgggcgtggttcgacgcgcgcggcggcagccgggtgcccgaggcagccgccgagcacacggtcctgctcgcgcccgacccgtacaccaactacagcacggttgccgtcgggaaagccgcggtgcgcgtgctggaggccgcgggcgtccacgtcgcgctccccgacggcgtcggcaccagcgggcggccggcgtactcgcgggggttgatcgaccgcacccgccggatcgcgcgcgagaacgtcgcggcgctcgcgccgaaggtcgcggacggctgggacgtggtgtacgtcgaaccctccgacgcggtgatggtccaagacgactaccacgacctcctgtcaagcgcccccgcggcgtccgtcgccgccaacacgtacggggtctgcgagtacctcgaccgtcacgggctcgacgcggccgccggcttcgacgccgacggcgaatcgctggcctaccacggccactgccaccagaaagcccagcagcgcgaccaccacgccgtcggcgtcctccggcgcgcgggctacgaggtcgacccgctggattcgacgtgctgtgggatggccggcagcttcggctacgaggccgagcattactcgatgagccaggccatcgccgacatcctcgccgatcaggtcgccgacagcgacgccgacaccgtgactgcgccggggtcgtcgtgtcgcagccagctcagcgagcgcgacgacgtcgacaccgacggtgccccgccacatcccgtccagaagctcgccgacgcgctgtga

SEQ ID NO: 42392 - DNA, 1458 bp, Halobacterium sp. NRC-1
atgaccgggggcggcgatccggtggtgcgccgcgaccggttcagcggcggccccgcgcgctcgttcctctcgtcgatggacggcgacggccgcatcttcgaggcggacctcgcggtggaccgcgcacacgtcgtgatgctcgccgagcaggatgttatcggcgacgaggcggcggcggcgatcctgggcgcgctggccgacgtcgaggcggcggggttcgacgcgctgcccccgggcgaggacgtgcacgaggccatcgagacggcggtcgtggaggctgtcgggcgcgacggcgggaagctacacaccgcgcggtcgcgcaacgacgaggtggcggcgtgcatccggtaccggctgcgcgcggatctgctggacgccatcgaggtcgtggtggcgctgcggagtgcgctggccgacgtcgcggcggcggaggccgagacggtgatgccggggttcacgcacctgcagcccgcacagccgacgaccgtcgcgcactgggcgctctcgtacgcggggacgctcgcccgcgacaccggccggctgtgcgacgcctacgggcgcacgaacgagtcgccgctgggcgcggcggcgttcgccggcaccaccttcggcgtcgaccgcgagcgcacggccgccctgctggggttcgacggcgtcgtggcgaacgcggcggatgccgccgccagccgtgatttcctgctggaggcggtgagcgcgctggcgtcggtggcggtgacgtgttcggggctggccgcggacgtggtgttcttcgcgaaccgcgggttcgtcgaggtgagcgacgactacgcgtcgacgtcgtcgatcatgccccagaagaagaacccggacaccatggagttggtgcgcgcgaccgcgggcgacgcggtgggcgcgcagcaggccctcgcgacgacgctgcaggggctgccgcgggcgtacaaccgcgacctgcagcgtgcgactgggcacgcgtggaccgccgtggatggcgtgaccagcgcggtcgaggtggcggcgggcgtggtggcgaccgcgggctggcccgctgacgacctcgaagccgcggcgggcgaggggttttcgaccgcgaccggtgtggcggacgcgctcgcggcgggggggctgccgttccggacggcccacgaggtcgtggcgctggcggccgagcgcggctgcgagggggcgaccctggacgcggtggcggccgcgaccgaggcggtgaccggggagccgttgtccgcggtcgtggagccggcggcggtggctgacgcgctggatcccgtggggagcgtcgccgccagggattcggcgggcggcccggcaccggcggccgtcgaggccgccgtggcggacgtgcgcgacgggatcgacgccgacgaggcggcgctggcggccgaacgggcgtcgctggcggacgctgcggacgcgctggccgcggaggtgtcggggtatgtgtga

SEQ ID NO: 42393 - DNA, 1191 bp, Halobacterium sp. NRC-1
atgccatcaggaaccgtcgcgctcgccttctcgggcgggctcgacacgacagtctgtgtcccgctgttgaaagaggagtacggctacgacgacgtgatcggcgtcaccgtcgacgtcgggcagcccgacgccgagttcgcggcggcccgggagaccgccgccgcgctgggcgtcgagcaccacgtcgtcgacgccacggccgagttcgccgcgctgtgtttcgacgccgtgcgggccaacgcgacctaccaggggtatccgctcggcaccgcgcttgcccgcccggtcatcgccgacgccatcctgtcggtggccgaagccgagggctgtgcggcgctggcccacggctgcacggggaagggaaacgaccagttgcgcttcgaggcggtgtggcgcgccagcgaccacgacgtgtgtgcgcccgtccgcgagctcgggttgacccgcgagtgggagatcgagtacgccgccgagcgcgacctcccggtggaggcgggcaacgagggcgagtggagcatcgacacgaacctctggagtcgcagcgtggagggcggccacctggaggagcccgactaccagccgcccgcggacatctacgcgtggaccgacgcgccgagcggtgagacgggcaccgtcgacatcaccttcgaggccggggtgccggttgccgtcgacgggacggcgatggagccggtggcgctcatcgaggcgctgaacgaccgcgcggggagctacggcgtcggccgcacggacatgctcgaagaccgcatgctggggttgaaagtccgcgagaactacgagcatccggccgcgaccacgctgctggcggcccacaaggccttggaggggctcgtgttgacgaaggccgagcgggatttcaccgcggcggtgagccagcagtgggcgcaaaaggcctacgagggggtcgtcgagcatccgctgatggacgcgctgaacgggtatctggacgaaacccagtcggcggtcagtggcacggtgaccatcgccttcgagggcgggcgggcgcgcccgatcgcccgcgagagcgagcacgcggtgtactccgcggacgcggcgtcgttcaacaccgagaccgtggcggggatcgagcaggccgacgccacgggggtcgcgaagtaccacggcttccagtcgcggttggcgaacgcggcgttcgacggcaacaaatga

SEQ ID NO: 42394 - DNA, 2199 bp, Halobacterium sp. NRC-1
atgcagttcttcccgaagccgtcgccgtacgacaaccagcgggccgcgatggacgcgatccgggacgcactcgacggcggcaccaacgtgttgttcgagggggcgtgcggaacgggcaaaacccttgccgcgctcgcgccggcgctgtcgcacgcccaggccgaggacaaaacggtcgtcatcacgaccaacgtccaccagcagatgcgccagttcgtgcgcgaggcccgcgagatacacgccaccgaacccatccgcgcggtcgtgttcaagggcaaggggtcgatgtgtcacatcgacgtggactacgaggagtgccaggtgctgcgggacaacacccacgagctcgtggacgccacccgggacaaacgccagctcgaagaacgccagcgcgctctgctcgacgaggcacaggacggcgacaccgaggccgccgacgcccggcaggccgtcatggacgagctggaagccgtcgagtcggagttggcggccctccaggacggcaacgtctgcgagcgctaccgccagaacctcgtggggaacaccgacgagttctaccagtggctgtacgacgacgtccgcaccccggaggacatctacggctacgccgaggaggcggggttctgcgggtacgaactcctcaaggacggcatcgagggcgtggatctggcggtctgcaactaccaccacctgctggacccggggattcgggcgcagttcttccgctggttgggccgggaccccgaggacgtggtggtggtgttcgacgaggcgcacaacatcgaggacgccgcccgcgaccacgccgccgagacgctcaccgagcagaccctcgacagcgccctggacgagctccaggacacgagcgatcagcgggcagcggccgccgagcgcgtgctcggggcgttccgggatgcgctcgtcgagacctacgaggacgcgctgcgtccgggcggcgatggaccggcggacacgaagtcggcggtggagtcgaactgggtggacgtgccggtcgccaacgacgaccgccgggacgacctgacgctggcgttcctccagtcgtacaccggcccggggatcaccgaggacgtcaccgacgccctggggttgggggagtacctggacggggagtacgaggacgcgtatcggaacggcgacgcgacgacccgccgggagtgccacgtgctggccgccgccgagttcgtagaggcgtacgtcgagcgcggcggcgagttcgggcagtatccgacggcggcggtgcgccgcgacgaccgcaccgaggcggtgtacgggcgggccgagcgctacacctgcatcccgcgggaggtgaccaccgacctgttcgacgccgtgcacgcaagcgtcctgatgagtgcgacgctgcggcccttcgacgtgatcggcgacgtgttggggttggacgaccccgttgagttggcgttcgggctgcagttcccggaggaccgccgccggacgttcgccgtcgacaccgagccgttgttctcctcgaaccgcgaggaccgcgcgacccagcaggcggtcgcgggcgcgctccgggacgccgcggcgtacacgccgggcaactgtctgtttttcttcccgagttacgccgaggcgaagcgctaccacgacctgctggcggactgcgacgccacgcggtatctggacgaaccgggggtggcggctgacgacctccgggaggcgttcgtcgccgacggggacggcgcgctgttcacgtcgctgtgggggaccctggccgagggcgtgagcttcgacggcgacgacgcgcggacggtcgcggtcgtcggcgtcccgtacccgcatctggacgcgcggaccgaggccgtccaggacgcgtacgcccaggcgttcgcggaccgcgatgccgaccagggacttcgcagcgaccgccaggacgccggctggcggtacgcggtggagatcccgaccgtgcggaagacccgccaggcgatggggcgcgtgattcggtcgccggaggacttcggcgtgcggatgttggtcgatcggcggtacacggcggcgagccgcaccgggatgcagaagtattcggtgaacccgacgttcccgccgagcgagcgcgcggagatggtggacgtcgatccggagaagctgcggttctcgttgttgaacttctacggcgatctgggggcgtacggtggcgatccgccggctccgtag

SEQ ID NO: 42395 - DNA, 1161 bp, Halobacterium sp. NRC-1
atgggccgggatagcgctcgcaggctgttaagtaccccgtcacggcggcggccgagtgcggcgaccagtttcactttcagtgtgctgtatacgagactttatgcgtggggcggcacaaccaggagatacatgcctgaatccgatctcgaagagctgcccggcgtcggcccggcaaccgcagagaagctccgcgacaacggctttgacgcgttccagagcctcgcagtcgcgaacagcgccgaactctcgaacaccgccgacatcggcgaaagcaccgctgcggacgtcatccaggccgcacgcgaggccgccgacgtgggcggcttcgaaaccggcgcgaccgtcttggagcgccgagagcagatcgggaagctcacctggaacatccccgaagtcgacgacctcctggggggcggcgtcgagacccagtcgatcaccgaagtgtacggcgagttcggcgcggggaaatcccaggtcacccaccagctcgcggtgaacgtccagctcccgaccgaatacggcggcctccacggccgcgcggtgttcatcgactccgaggacaccttccgccccgagcgcatcgacgacatggtgcgtggcctctccgacgaaacactccaagcggcgatggaggcccacgagatcgagggcagcaccgacgacgaggacaccctcacggagctcgtcgacgcgttcctggacaagatccacgtcgcgaaaggcttcaactccaaccaccagatgctgctggcggagaaggccaaggagatcgccagcgaacacgaggacggcgactggccggtgcggatgctcaccgtcgactcgctgaccgcgcatttccgcgccgagtacgtcggccgcggcgagctcgcggaccgacagcagaagctcaacaaacacctccacgacctcgaaaaagtcgggaacctctacaacgccgcggtgctggtcaccaaccaggtgcagtcgaacccggacgcgttcttcggcgaccccacgaaacccatcgggggcaacatcctcgggcacaagtcgacgttccggatgtatctccggaagtcgaaaaacgacaagcgcatcgtgaagctcgtcgacgcgccgaacctcgcggacggcgaagccgtgatgcgggtacaggacgagggcctgaagcccgaataa

SEQ ID NO: 42396 - DNA, 1014 bp, Halobacterium sp. NRC-1
atgggcgagatggggttttacgcgccgaacctcgacggctacgggctgccgaacgtgtcggagacggcctacggcctcctgatgcaggagttggaggcgtgtgattcggggctgcggtcgatggcgagcgtccagggggcgctcgtgatgtatccgattcacgcgttcggcagcgaggcgcaaaaggagcgatggctgccggccctgggtgcgggggaggcggtggggtgtttcgggttgaccgagcccgaacacggctcgaacccgtcggcgatggagacaacggcggagccggacggcgacgagtacgtcctgaacgggtcgaagacgtggatcacgaactcgccgatcgcggacgtggcggtcgtgtgggccagggaccacggcgaggacggcacgccggtccgggggttcctcgtggagacggaccgcgacggcgtcaccaccaacgagatcgacgagaagctctcgctgcgcgcgtcgatcaccggcgagatcagcctccggaacgtccgcgtgccggcggagagccggctgcccggcgtcgaggggatgaaggggccgttgtcctgtctgacgcaggcccgctacggcatcgcgtggggggcggtgggtgcggcccgcaactgcttcgagaccgcacgggagtacgccaccgaccgcgagcagttcgaccagcccatcggggggttccagatgcaacaggacaagctcgcggagatggcgacacagatcaccacgagtcagttgctcgcccaccggctggccgggctcaaggagcgcggtgatctccggccacagcacgtttcgatggccaagcgcaacaacgtccggatggcccgcgatcaggcgcgtgtcgcccgcgagatgctgggcgggaacggcatcacgacggattacccgccgatgcgccacatggcgaacatggagaccgtctacacgtacgagggcacccacgacatccacacgctgattctcggcgaggacctcacgggcatgcaggcctaccagtag

SEQ ID NO: 42397 - DNA, 1050 bp, Halobacterium sp. NRC-1
atgtatggactgctaaaatccgcactgttcggactcccaccggagaccacacacgagataaccacgagtgccctccgggttgcacaacgcgtgggcgcacaccgtgcgtacgcgaaacagttcaccgtcaccgatccgcgactgtcggtcgatgccttcgggcagacgttcccgaaccccgtgggcatggccgccggcttcgataagaacgccgagataccgcgcgcgcttgccgggctggggttcgggcatatcgaggtgggcgcggtgaccgccgagcgacagccggggaacgaccggccacggctgttccggctgccggatgacaacgcgctggtgaaccgaatggggttcaacaacgagggcgcggacaccgtaggggcgcggttggacgccgagccactgcccgacgttccggtgggcgtgaacatcgggaaatccaagaccacgccgctagcggacgcccccgacgactacacgtacacgttcagccgtgtcggcgacgccgtcgactacgtcgtcgtgaacgtctccagcccgaacacccccggtctccgggagttgcagggccgcgaccagctggcggcgatcttggaggccttgcaggacgctggtgccagcccgttgttggtgaagctgtccccggacctccaccaggacgcggtggctgacgccgtcgagttggccaacgacctcggcctcgacgggatcgttgcgacgaacacgacgaccgagcgcccggaatcgttgagccacccacacgccggcgagcagggcgggctgtccggagcgccgatccgtgagcgcgcgaccgaacaggtgcggttcgtcgcggagcgcaccgaccagccggtcgtgggcgttgggggcgtcgcgacggccgaggacgcctacgagaagatccgcgcgggcgcaagcgtggtgcagttgtacacggcgttggtgtacgaggggccgtgggttgcaaaacggatcaacgaggggttggtgtcgttgctcgaacgcgacgggttcgacagcgtcgaggacgccgtcggtgcggacctgtag

SEQ ID NO: 42398 - DNA, 1470 bp, Halobacterium sp. NRC-1
atgtccgaccttgacttcggtgacgtcgactggaacgtacagtacatcgacggtgagtacgtcccgccgggagaccgggggacgctcgaagtcgatgacccatcgacacgcgagctgttcactgagatcccagccgggacgactgacgacgtcgacgccgcctacgaggccgccgcggacgcacagacggagtgggctgacacgccgccccaggagcgtgcgcgcatcgttgcggcggcgagcgagatcctcgcatcccatcgcgacgaggtcgtcgacctgctggcgacggagtccggaaccacgtacacgaagggcgcggccgaattcgaggcgtcggtcgggatcaccgacgaggcggcgtcgttcccgacgcggatgaacggcgaccacaagcagtccgtggtcgagggcaaggagaacatcgtggtgcgtgagccccagggtgttgtggggatcatctcgccgtggaacttcccgctgaacctctcgatccgcgcggtcgcgccggcggttgcggccggcaacagcgtcgtgctcaagccggcgtcgaacacgccggtgaccggcggcctgctcatcgcgaaggtgttcgaggctgcggggctgcccgagggcgtgttcaacgtcgtcacggggaagggcagcgagatcggtgaccggatcgccggtcacccccacgccgacgtgatctcgttcactgggtcgaccgcgatcggccgccaggtcgccgcgacggcgggcgagaacctcgcgctgccggcgatggagctcggcgggaacaacgtccacatcgtcacggaggacgcggacctcgacgacgccgtggacagcggggttttcggatcgttcctgcactccgggcagatctgcatctcgatcaaccgccacgtcgtccacgaggacgtctacgacgagtacgtcgagcgcctcacggagcgtgcggccgcgttgccgaccgggacggcccacgacgccgacacggtcgttggcccgatcatcgacgagagccagcgcgatcagatcctggactacatcgagcggactgtcgacgcgggcgcgacgctcgagaccggcggggaccacgacggcctcgtcgtcgagccgaccgtgctctcggacgccaccaacgacatggcggcggcgtgcaacgagcacttcgggccggtcgcgccggtgatcccgttctccgacgacgacgaagccgtggagatcgcaaacagcaccgagtacgggctttcgggcagcgtgcacgcgggcgacaccggtcgggcgcgtgacatcgccgaccgcatcgacaccggcatgatccacatcaacgatcagcccgtcaaccaggagccccaccttcccttcggcgggtacaagaactccgggctcggccggtacaacggcgagtacgtcctcaacgagttcacccaggagaagtgggtgagcattcagcgcgagacccgcgactacccgttctaa

SEQ ID NO: 42399 - DNA, 918 bp, Halobacterium sp. NRC-1
atggaactcggagtcgtcggcctcggccgcatggggcgcatcgtcgtcgaccgctgtctcgacgccggccacgacgtggtcgcgttcgacatcgacgcgaccgcgcgcgaggacgcggccgacgcgggcgcgacgcccgccgacacgctggacgcactcgccgcggagctcggtgccgagaagcgcatctggctgatggtgccggcgggcgaccccgttgacgccgccctcgacgaactcgcgccgcacctcgattccgacgacgtcgtcgtggacggcgggaacagccacttcgaggactcgacgcgccgcgccgaggaacacgacttcgcgtacctcgactgtggtacttcgggcggccccgccggcgcggaactcgggttctccctgatggtcggcggccccgagtgggcgtacgacgacctcgtgcccgtcttcgacgccgtcgctaccggcccagacggccacgaccgcatgggaccggcaggcgccggccactacgtcaaaatggtgcacaacggcgtcgagtacgcgctcatgcagacctacggcgaggggttcgagttgctccacgaggggcgctacgatctcgacctggaggccgtcgcgcgaacctggaacaacggcgccgtgatccggtcgtggctgctggagctctgcgaggaagcgttccgcgaggagggcagcgatctcggcaccgtcgccgaccacgtggccggcggctccacgggcacctggaccgtccaggaagccctcgaacaggaggtcccggtgcccctcgtctcccaggcgctctccgagcggttcggctcccgcagtaccggcggcgacaccggccggttcgcgcgccgcctggccaaccggctgcgctacgggttcggccgccacgaggtcgcccgcaccggcgacgacgcctag

SEQ ID NO: 42400 - DNA, 1986 bp, Halobacterium sp. NRC-1
atgggacagacgcttaccgaaaaaattctcgatgaccacctcgtcgagggcgacctccagcccggcgaggagatcggcatcgagatcgatcagacgctctcccaagacaccactgggacgatggtctggctgcagttcgaggcactcgaaatggacgaagtccagaccgagctcgccgcgcagtactgcgaccatcagacctaccagttcgacttcaagaacaccgacgaccaccgcttcctgcggtcggccgccggcacctacggcgcgtatttctcccgacctggcaacggcatctgccacaacgtccacaaggagaacttcgccgcgcccggcaagaccctgctcgggtccgacagccacacgccgacccccggcggtctcggccagctcgccatcggcgcgggcggcatcgacatcgccgtcgcgatgggcggcggcgcgtactacgtcgagatgcccgaggtcgtcaacgtccggctcgaaggcgagctccccgagtgggccaccgccaaagacgtcatcctcgagctcctgcgccgcctctccgtgaagggtggcgtcggcaaggtgctcgagtacaccgggcctggcgtggagtcgctgtccgtcccggagcgaaccaccatcacgaacatgggcaccgagctcggtgcgacgtcctcgatcttcccgacggacgaccgcaccgaagactggctcgcccggttcgaccgcgaagacgagttcgtcgacctccaggccgacgccgacgccgagtacgccgacgagatcgtcgtcgacctctcggatctcgaaccgctcatcgcagagccgtcgatgcccgacaacgtcgtcccggtccgcgaggtcgcgggccaggaggtcgaacaggtcatggtcggctcctgcacgaacggcgcctacgaggacgtcctgccggccgccaagatgctggagggccgcgaggtctccaagcacaccgagatgatcgtcgcgccgggctccaagcaggcctccgagatgctcgcccgcgagggctggacggccgagatgatggccgccggcgtgaacttcagcgaggcgacgtgcggtgcctgtatcggcatcggtcacgtgccggcctccgattcggtgagcctccggacgttcaaccgcaacttcgagggccggtcgggcatcgaggacgactccgtgtacctctgctcgccggaggtcgcgaccgcgtcggcgatcgccggcgagatcgtcgatccgcgcgacctctccgatgacctcggtgacctcgaggctcccggcttcgagatggggacctcgtactccggcggctacggggcgggcgacactgacatcatcacgcccgaggagtccatcgacgacgacctcatcaagggcccgaacatctccagtgtaccggtcaaagacccgctgggtgcggacgtgcgtggtgagaccctgctgaagatgcaggacaacatcacgaccgaccacatcattccggcgacctccgacatcctgaagttccgctcgaacatcgagcggctctcggagttcaccctctcgcgcatcgacgacacgttcgccgagcgcgcgaaggcagccgacagcggcgtgctcgttgccggggagaactacgggcaggggtcctcccgcgagcacgcggcgatgtgcccgatgttcctcggcgtggagtccgttctcgcgcagagcttcgcccgcatccacaaggcgaacctcttcaacttcgggatcctgccgctgaacatcgacgaggagacgtacgcccgcatcgagcagggcgacgacgtcgaggtcgtcgacgacgttgcggccgccgtcgcggacggccaggaggagttcacggtccgcgtgaacgacgactgggaggcgaccgcgaccctcgacgcctcggagcgcgagcgccgcacgctcgccgccggtggcaagctgtcgctgacgaagcagcgccacagcgagggctcgggcgccgcgcccgccgacgactga

SEQ ID NO: 42401 - DNA, 288 bp, Halobacterium sp. NRC-1
atgagtgacccgctccgcgagctgttcgacgtgatcgaggatcgcaaggaaacaatgcccgagaactcgtatacggccagtctgctggccgacgacgagaaaggcgagaacgccgccctggagaaagtcggcgaggaagccaccgagttcctgctcgccgccaaggacggcgacaccgacgaactcgcccacgagggcgcggacgtcgtctaccacatgctcgtcgtgctcgcccaacaggacatggacgtcgaggcgctgctggccgagctcgacgaccgccggtag

SEQ ID NO: 42402 - DNA, 741 bp, Halobacterium sp. NRC-1
atgcacgcccccgacctcgccggccggactgtgctcgtcaccgggagcgcccgcgggctcggccgcggcctcgcgctctcgcttgccgactgcggtgccgccgtcgccatccattaccacaccagcgccgacgccgccgacgaggccgccgccgaagcccgggcgctcggcgcaccggcagtcacgacggtccgcggcgatgtcaccagtcccgacgccgtcgaccacatcttcgacacggtcgaagccgacctcggtcccgtcgacgtgctcgtgaacaacgtcggcgcgttcgcgcccacgcactggacggagatcgacgccgacacctggcacaccgtcctcgacaccaacctcaccgcgcccttcctcaccgccaagcgcgcgctcccggggatgcgcgcccggtcgtggggtcgcatcgtcaacgtcggctacgcgtccgccgagaagggactggtcaaccccacgaacttcccgtacttcgcggccaaacaggggctgttgatgttcacccgcatgctcgccgccgacacccaagacgacggcatcaccgccaacgccgtctcgccgtacgtcgtccagaactccgacgagttccccgccgacgcaccacgtggccggtgggcgaccgtcgaggacatcgcgggcgtcgtccggttcttctgcgacgccgacagcggctacgtctccggcgagaacgtcaacgtcgacggcggctggctgcccgagcacgtgtag

SEQ ID NO: 42403 - DNA, 1266 bp, Halobacterium sp. NRC-1
atgagcgacaaccgccaccagaacctggccgtcatcggccacgtcgaccacggcaagagcacgatggtcgggcgcctcctctacgaaacggggagcgtacccgagcacgtcatcgaacagcacaaagaagaggccgaggagaagggcaagggcggcttcgagttcgcctacgtcatggacaacctcgccgaggagcgcgaacgcggtgtcaccatcgacatcgcccaccaggagttcaccaccgacgagtacgagttcactatcgtcgactgtcctggccaccgcgacttcgtgaagaacatgattacgggtgcgtcccaggccgacaacgccgtcctcgtcgtcgccgctgacgacggtgtcgcgccccagacgcgagagcacgtcttcctctcgcgaacgcttggcatcgacgagctcatcgtcgctgtcaacaagatggacgtcgtcgactacgacgagtccaaatacaacgaagtggtctccggcgtcaaggacctcttcgggcaggtcggcttcaaccccgacgacgcgaagttcatcgcgacctccgcgttcgagggcgacaacgtctcggaccactcggacaacacaccgtggtacgacggccccaccctcctggaggccctcaacgggcttccggtgccacagccgccgacggacgccgatctccggctcccgatccaggacgtctacacgatctccgggatcggtaccgttcccgtcggacgcatcgagaccggtgtgatgaacaccggcgacaacgtcagcttccagcccagcgacgtcggtggcgaggtcaagaccatcgagatgcaccacgaggaagtgccgaacgcggagcccggtgacaacgtcgggttcaacgtacgcggcatcggcaaggacgacattcgtcgcggcgacgtctgtggtccggccgacgacccgccgtcggtcgccgacaccttccaagcgcaggtcgtcgtgatgcagcacccgtcggtcatcaccgccgggtacacgccggtcttccacgcgcacaccgcacaggtcgcgtgtaccatcgaatccatcgacaagaagatggacccggcgtccggcgagacccaggaggagaacccggacttcatccagtccggcgacgcagcggtcgtcaccgtgcgcccgcaaaagccactcagcctcgagccgtcctcggagattccggaactcggctcgttcgccgtgcgcgacatgggtcagaccatcgcggccgggaaagttctggacgtcgacgaagcctaa

SEQ ID NO: 42404 - DNA, 954 bp, Halobacterium sp. NRC-1
atgagactggccgtcatgggggcgggagcggtcggacaggcggtcgtcgaccaggccgcgtcccacggccacactgtggttgcggtggcggactcgacgagcgcggtcgtcgacggctcgggggtggacgcggcggcggtgtgtgcgcgcaagcgcgacgcggcgagtgagatcgggacgggagcgccgagtgacgcgttggccgccgactacgacgtgctcgtggaggcgacgccgacgacgctgggggacgccgagcccggtttcgggcacgtcgagcgcgcgctgagtgcggaccgccacgtcgtgctcgcgaacaagggcccggtcgccgagcgctacgctggggtgtgcgagctggcggcggcgagcgcgggcagcctccggttcgaagcgactgttgggggtgcgatccccgtgctggcgaccatcgagcgcatcggcgccgaccgcgtgcgcgctgtccgtggcgttctgaacggaaccgcgaacttcgtgttgtcgcggatggcggcggcgggactggagtacgagcacgtcctggcggaggcacaagaggtgggggtcgcggaggcggatccgacgtttgacgtggacggcacggatgcggcgctgaagtgtgcgatcctcgcgaacgtgatcggcgaccgtgagtacgacctcgacggcgtcagcgtcgacgggatcacgggggtggcaccgtcggcgctggagctggccgagaccgacgggcagacgatacggctgatcggggaggtggggccggatcacgtgcgggtcgggccgcggttggtgccggccaacgggacgcttgcggtgtccgggaccacgaacatcgtgcagttggagaccgagcacgcggggcggttgaacctgtccggacagggtgctggcggggcggcaacggcgtcggcggtgcttgcggacgtcgatcacatcgccgaccaacagtaa

SEQ ID NO: 42405 - DNA, 1827 bp, Halobacterium sp. NRC-1
atgagtacggaacgcgaagccaaagtctacgtcaacgggagtctggttggaacacacgagaaccccgaagagttagcagaacagatccgggaggcgcgccgccgcggtgaggtctccgagatggtgaacgtctcggtcagggaccgcaccggtgaggtcatcgtgaacgcggacgctggccgggcacgccggccgttgctggtcgtggagaacggcgagccggtggtcacccaggaggaagtggaggccgtcaagaacggcgacatcgacttcgaggacctcgttgaggcggggaaagtcgagttcatcgacgccgaggaggaagaggacatcctcgtgggcgtcgaggaggaggagctcacgaccgaccacacgcacctcgaaatcgacccgcagctcatcttcgggatcggtgcggggatgatcccgtaccccgagcacaacgccagcccccggattacgatgggggcggggatgatgaaacagagtctggggctgccggcggcgaactaccgcatccgaccggacacccgccaacacctcctgcattacccgcagaaggcgatggtgaacacccagacgaccgagcagatcggctacgacgaccggccggcgggccagaacttcgtcgtcgccgtgatgtcctacgaggggttcaacatcgaggacgccctggtcatgaacaaggggtccgtggagcgcgcgctctcccgatcgcatttcttccgcacgtacgagggcgaggagcggcgctaccctggcggccaggaagaccgcttcgagatccccggcgacgacgtgcgaggcgcacgcggtgaggacgcgtacacgcacctcgacgacgacggcctggtgaaccccgagacgaaagtcgacgattcgtcggtgctgttggggaagacgagtccgccgcggttcctcgaagaacccgaggacatgggcgggctgagcccgcagaagcgccgcgagacgtcggtgacgatgcggtcgggcgaggacggcgtcgtggacacggtgacgctgatggagggcgaggacggctcgaagctcgcgaaagtctccgtgcgcgacgagcgcatcccggagctcggcgacaagttcgcgagccgacacggccagaagggcgtcgtcggccacctcgcgccccaggaggacatgccgttcacgcaggaaggcgtggtgccggacctcgtgttgaacccccacgcgttgccgtcgcggatgacggtcggccacgtgctggagatgctcggcgggaaggcggggtcgctggacgggcggtccgtcgacggcacgccgttcactggcgagggcgaggacgagatccgtggcacgctcgaagaccgcggcttcaaatcctccggcaaggaggtcatgtactccggggtgtccggggagaaaatcgaggccgagatcttcgtggggacgatcttctaccacaagctctaccacatggtgtcgaacaagctccacgcccggtcgaaggggccggtgcaggtgctgacccgacaacccaccgagggtcgcgcccgcgagggcggactgcgggtcggtgagatggagcgtgacaccgtcatcgggcacggcgcggcgatggtgctcaaagagcgcctgctcgattcctcggaccgcgaggagatccacgtgtgtgggaactgcggcatgacggccgtggagaactacgagcagcgccgggtgtactgtccgaactgcgaggaggagaccgacgtacacagcatcgagatgagttacgcattcaagcttctactcgacgagatgaaggcgctcggcatcgcgccgcgcctggaactggaggaggcagtgtaa

SEQ ID NO: 42406 - DNA, 1179 bp, Anabaena PCC7120
atgaaaaaagatttcatgtttacatctgaatctgtaactgaggggcatcctgataaactgtgtgatcagattagtgatgcgatcgttgatcgctttttacaacaagacccctacgctagagtcattaccgaatgcgctgcatccacaggtattgtatttatagccgccagatttgaacctaatactaatgttgattttacaaacatagccagacaagttattgatcaggttggttatgaacaaatggaatttaacggtaaaaattgtagtatattgaccagcctaaaagaattgcctcctgatccatatcacttatttaatgaacacaaactatcagatgcagaaatagaacaaattactgttaccaaccaagccacagtcttcggctttgcctgtcatcaaacctctaccctcatgccattaccaatctggttggcacacaaattagctagacaaattagtgaagttagaagacaaaatcttttaagttacttaactcctgatggcaaaactcaagtaggtgttgaatataaaaatcgcctaccctatagaatccatagtattacagtaattgccagccaaaataaaccgggaaaaccagacttaaagcaattacaagatgatattagagaaaccgtaatttatcctgtatttgctgatgaagaaattaaaccagatgaaaaaactagaatatttattaatcccgatggcccttttatagttggcggcccggcggtacattctggtttaactgggagaaaaaacgccatagatacctatggtgaatattccaaacacagtggttcggctttaagtggtaaagaccccatcagaatagatagagtaggtgcttatgtcgcccgttatgctgctaaaaatgtagtcgctgcaaacttagctgatgaatgtgaagtacaactaagttattctatcggactggctagacctgtaagcgtccaagtagaaacttttggaacaggtaaaatctcagatgaagatatcaccgtcttattagaaaagcactttgattttcgtttagcaggtattctgaaacaatttaatttaagacatctaccctcattaactaaagggggattttatagaaaactagcggcttatggtcatgtaggtagacaggatatcgatttaccttgggaaaaaatagataaggtaggtttg

SEQ ID NO: 42407 - DNA, 2605 bp, Anabaena PCC7120
tcttatgccagccagcacggttgtggataccttcaacacctctgcatcagggttatccagtgagtctgccgccgctaatttgagtatatatggggcgaatatcctttcggaaacggagatacgttctagtttcagcatcttagttgaccagttcaagtctttacctgtagctttgctgggtgtggcggctggtgtatcggtttttactggagggttgattgatgctgtagttattttaggtgtggttggtgtaaatgctgtgattggctacgctacagaaactcagtcagaacgcatcatccactctctcaagcaccaagaacaaacgtcagcttgggtgatgcgagatggcaaggcgcaagaaattcctgtagaaaatgtagttgtgggcgatgttttaattctcaaaccaggtagctatgtagcggcagatgccagactgattgaggcggataatttaagtattgatgaatcggctttaactggtgaaagtctccctgccagtaaaaatacggcatttttgacaggtgaggatgtaccattaggcgatcgcctaaatatgatttacaggggaacttatatcaccggtggtcaaggattggcggcggttgtagccactggacaatttacggaaatgggacacatccaaactctggtaggtacagccaatgcgacagaaacacccctggccagacaactagaccaggtgggtagccaattggtagtcattgggatgggtctttgtggtctggtgtttggtatgggagtgctgcggggatatggtttagtgcagatgttgaaatcatccatatctttggctgtagcggctgttcctgaaggtttaccgacaattgccaccacaaccttagccttgggtatccgtgatatgcggcgaaacaaagtccttgtccgtagtttgagtgcggtggaggctttgggttctgtgcagacaatttgcctggataaaaccgggacaattacggaaaataaaatgtcggtggtagaaattcacaccaacacgcgggaaattaaagttacagatggggagttcatcgccgggggagaaaatattaacccctatatgtacgatgaactgttaaagctgattcatgtctcggttctctgcaatgaaagtgaagtgagtcgagacgatggtgagtatgtagtcacaggttcagcgacagaaaacgccttaatttacatgggaattgcggcgggggtagatgcgatcgccctaaaagataagtatcctttactacaaacgaatctgcgatcggaaaaccgcaatattatgagtaccatccacgagactcataatggacataaatttgtcgctgttaaaggtagtcccggcgaagtggtgcagatgtgccaagggtggatgaaggatgggcaggtagtgcctttaaccgatgcagaccgacaaatgctggaaatagaaaatgaccgtatggcgggtaaagctttgcgggtgttgggtgtagcctacaaccatatagatgaatcccacaacggcaaccatgaaacagacctgatttggttgggtttagtagggatggcagacccaattagaaggggtgcaaaagcattaattgccgacttccatcacgccggcattgataccgtcatgataaccggtgatcaaagcccaacagcttatgcgatcgctaaagaattagaattgaaccgtcatacccaacttgaaattctcgactccaccaacctcaacaacctcaccccagaagccttaaccgccctcagcgacaaagtagatgtatttgcccgtatcagtcccagtaataaactgcaagtagtccaagctttgcaaggtgcaggtaaagtcgtcgccatgaccggtgatggcattaacgatgcccccgccttaaaagctgcccaagttggggtggcaatgggtaaagggggaaccgatgtcgcccgtgaggtagcagatatcgtcctggaagacgacagactggaaaccatgattatcgctgtcagtcggggacgaacgatatacaacaacatccgtaaatctgtgcatttcctcctagcgaccaacctcagcgaaatcatggtcatgaccaccgccaccgccgtaggtattggcgaacccttgaatgcaattcaattactttggttgaatttagttacagatatcttccctggtttatccttagcgatggaagcgccagaaccagaggtattaagtcaaccaccccgcaacccaacagaaccaattatcaaaaaatccgattttggcagaatcacttttgagtccgccaccatatctgcaagtaccctagccgcatacagttacggcatcctcaaatatggtatcagtccccaagccagcaccattgctttcatgggtctaaccacagcccaactactacacacaattagtagccgttccgaaaaacacagcatatttagttccgaaaaactcccacataatccttacctaactgcggcggtcactggttcttttgccctgcaactactcgctgtagctgtcccacccctaagaactttattaaagattacccccattaatctggttgatggtgcggtaattggtggtagtgccttactacctctgattgtg

SEQ ID NO: 42408 - DNA, 618 bp, Anabaena PCC7120
aatgttatccccgtcgaagaaatccgctacgatgaacggggtttagtgccagcaattgtgcaagattatttggatggcacagtcctaatgatggcgtggatgaatcgggagtctttacaaaagactttagatacaggggaaacttggttttggagtcgttcccgacaggaattctggcataagggcggaacttctggccatacccaaaaggtacaaagcatacgttatgactgtgacagtgatgcactgttagtaggggtggagcagattggagatattgcttgccatactggcgaacgcagttgttttcatcaggtggaagggaaaatcgtggcgccaccaggggatacattatcccaggtatttcaggtgatttgcgatcgccggaatcaccctacagaaagttcctataccagcaagttgtttgcaggtggcgataataagattttaaagaagattggtgaggaatcggctgaagtcgtcatggcttgtaaggatgacgaccaagaggcgatcgctggtgaggtggcagatttgctataccacactttggtggctttggctcaccatcaagtagatataaaggcagtttatcggaagttgcaagaacgcaggcgt

SEQ ID NO: 42409 - DNA, 1260 bp, Anabaena PCC7120
aaatcacaagaaatcttcgccgccgcccaaaacctgatgccaggtggtgttagttcccctgtgcgcgcttttaaatctgtaggggggcaacccattgtatttgatcatgtaaagggtgcatacatctgggatgtagatggcaaccaatacattgactatgtaggcacttgggggcctgctatttgcggtcatgctcatccagatgtcatcggggcgttgcatgatgctttagaaaaaggtactagtttcggtgcgccttcattcttggaaaatgttttggcggaaatggtcatcgctgctgttcccagcatcgaaatggtaagattcgtcaactcagggacagaagcttgtatggctgtattacggcttatgcgggctttcactaaccgggagaaagtcatcaagtttgaaggctgttaccacggacacgccgatatgttcctggtcaaagccggctctggtgtagccacactaggtttacccgattccccaggtgtgccaaaatctgcaaccagcagcactctcacagccccatacaatgacctcgaagctgtgaaggctttatttgaggaaaaccgcgatcaaatcgctggtgtcattctcgaaccagttgttgggaatgctgggtttattactcctgatgccggctttttggaaggactgcgggaactaactcacgaacatggagctttactcgtgtttgatgaagtgatgaccggtttccgtattgcttatggtggcgctcaagaaaagtttggcgttacacccgatttgacgactttaggcaaagttatcggtggtggtttgccagtaggagcctatggtggtcgtcgggatattatgtccatgattgcgcctgcggggcctgtatatcaagcaggaacgctttctggtaatcctttagcaatgacagccggaattaaaactctggagttattacaaaagcccggtgcttatgagtatctagagcgaattactaagaagttagccgatgggttactacaagttgccctggaaacaggtcatgcagcttgcggtggtcatattagcgccatgtttggcttattcttcacctctggccctgtgcataactatgaagatgccaaaaattctgacacagctaaatttggacgcttccatcgcggtatgttggagaggggtgtttacttagcaccttcccaatttgaggctggttttacctctttagctcacactgacgaagatattgaccagacaattgcgatcgcccgcgaagttcta

SEQ ID NO: 42410 - DNA, 864 bp, Anabaena PCC7120
aaagtaagaaaagccgtgattccggctgctggttttggtactagattatttccagctactaaagttgtgaaaaaagaactattcccaattattgatcaagatggtagagcaaagcctgtaattttagctattgtggaagaagctattagtgcaggaatcacagaagttggtattgttgtacagcctgatgatataggaatttttgctgatttatttaaaaatccacctgcaccagaacttttacaaaaactttcgccacaaaatcaagaatatagtcaatacttgcaagatttgggacagaaagttgttttattgacacaatcagaacaagaaggatatggccatgctgttttttgtgccaaagattgggtaggaaatgaaccgtttttattaatgttaggtgatcatgtttataaatccgacataaaaaaatcttgcgctcaacaagttgtagagatttatgcacaagttcatcaaagtgttgttggcttaactacaatgccagcagcgataattaacaaagctggatgtattgcaggagtatggcaagagtttaattccattttggaactaacgcaacttgcagaaaaacccaatcttgattatgcgcgtgagcatttgcgggtagaaggtatggcagaagatgagtttttatgtgtttttggcttgtatgtcctcacgccaaaaatatttgatttcctagcagatagtataaaccaaaatttacgcgatcgcggtgaatttcagttaacaaattgtttagataaattgtgtcaagcagaagggatgacaggatatgtggtgaaaggtaaatgttttgatacgggtctaccaaatacttatcgacagtcattaattgatttt

SEQ ID NO: 42411 - DNA, 1665 bp, Anabaena PCC7120
ttactacaaattttatttactggtattttcattaccctgttggggatgattacaccttatgccacttcaataattatagataatgccatccccgatagcgatcgctctttattattacaaatcggcttagggttattagttgcagctttaggtgcaggtttatttcaactggctcaaggttttgccttgctgcgaatggaaacctctggtgatgcttctactcaagctggtgtgtgggatagattactcaatttgccagtctcttttttccgagagtacaccacaggggatttactctcacgaatttcctcagtcagtgctatccgtcgtcaacttagcggtagaacgctgattaattttattactagtatatttgcgttattttacttaggacagttattttattacaactataaattagccctgattgccgttgctagtgccgtagtggcgatcgctatcacgacaatctctggtatccttctattatcaaaagtgcgacctctgttagaagtacagggtaatattttcgggcaaacagtacagttaatcaacggcatttctaaactgcatattgccggggctgaagaacgcgccttcgccgcttggagtaaaaactacactcgacaaatcaagctagaactcagcacccaattggtagaagattttgttgtaatcttcaatacaatcatccccatcattacctctggagtcctattctggtttaccaccaagctcttagaagaagctcaaacttccggaagtatcgccttttcccttgggacttttctcgcctttaacacagcctttagcaacttcaccagaggaaccacaaacctcagcaatacagttacccaaattttacaaattcttccccagtggcaacgcacacagccaattttaaccaccataccagaagtgaatctcagcaaatctgaccctggcaggctggcaggtaaaattactgtagataatgtaactttttgttatcgtcgtgatggcaacttaaccctggataatgtcagtatctctgctgaaccaggagaatttattgctctagtaggtagttctggaagcggtaaatcaactctgctgcggctactactgggatttgaaacaccccaagccggcagcatccattacgatggtcaagacctttccggcttagatgtggatgcagtcaggcgacagttaggtgttgtgttacaaaatggtcagctaaattcagcttccatttttgagaatatcgctggtgacgcacagattaccctagatgaagcctgggaagcagcgcggatgtctggttttgctgaagatgttaccgccatgcctatgcaaatgcacacggtagtcagcgaaggcggtggtaatctgtctggaggacaaagacagcgattgctgattgctcgcgccttagcattaaagccccgaattttgttatttgatgaagctaccagcgccctcgacaacagaacccaagcaatagtcagtgaaagtctagataaattacaggttaccagaattgcgatcgctcatcgactaagcacaattcgcaacgctcaccgcatctatgtattacaagcaggccgggtagtacaacagggaacttttcaagagttagcaaatactgaagggatttttgctcagttgatggctcgacaaatg

SEQ ID NO: 42412 - DNA, 2058 bp, Anabaena PCC7120
ctgcgagtgaaaacgcccacgctgctacaaatggaagcggtagaatgtggtgcggctgctttgggaattattcttggttactacggtcgagttgtaccattgccacaactgcggcgagactgcggagtttcccgcgatggcagcaaggcatctaatatggtgaaagctgccagaacttatggactagaagctaaaggttttaaaaaagaactgaagcaagtacaacaattacgccctccttatattgtcttttggaactttaaccattttgttgtggtagagggatttggtaaacatcaggtttatatcaatgaccccgctacggggccgcgtcatgtatcgttacaagaatttgacgagggatataccggaatagtactggtgatggaaccaggcgcagagttccaaaaaggtggtcgcaaacccagcatgattgcatctttgtggtcacggttacagggggctgagagtgctttagtttactgcatcgtggcaggatttttcttgacgattattgggttggtaatccccgtatttagtcaaatatttgtcgatgatatcttggtgcagggacgaatgttatggctgcaccctctacttttggcaatggcgatcgctgctatactgcaaggatcactcacattactacgactacgctacctacgccgactcaaaattagactagctgtgggtatgtctagccgtttcctctggcatattctccgcctaccagtgagcttttatgctcaaagatttgctggggaaatcagtaatcgcactaccctaaatgaccaagtagccgatgttctggctggacagttagcaacaaccatcattgacacattgatggtgcttttttatgctttggtgatggtgcagtatgactgggtacttaccttgatggtggtcagttttgccgccgtgaacgtcttaactttgcaatggatttctcgtcaacggatagatgctaatcaacgattaattcaagaatatgggaaggcggcgggtatatctatcgctacattacaaagtatagaaacactcaaagcatcagggttagagtctgatttcttttctcgatggtctggttattacaccaaggcgctcaattcccaacaggaactaggaattacaaaccagacattctcagttttacccacactgctatcggctctctccgccatgttgctcttgatagtcggtggtttccgcgtgatggatggacatctaagtatcggtatgctcatcgcctttcaaggtttaatgtctggttttcagcaacccgtcaacaatctcgtcaactttggtacgactctccaggaattagagggaaacttgattcgtcttgatgatgtgttggataaccccgtgggggaagtagggggtaaaacatcgtcttcatcactccaggcgcttcctaaattgcaaggatatgtggagttaaaaaatatcacttttggttatagccgcttggaagcgcctttaattgaaaactttaatctgtcaattaaaccaggacagcgtgtggcgttagtggggggaagcggttctggtaagtctaccattgccaaacttgtaagcggactgtatcaaccttggactggggaaatctactttgatagtcaaccgagagaggagatttccctccaactactgactaactctgtggcgatggtcgagcaggaaattttgctgtttggcggtacggtgagggacaatttaaccctttgggatactactgtaccagataaaaacctcatgagggcttgccaagatgctgcgatcgctgatgtaattttctctatgtctggaggttatgatgccgaactcatcgaaggtgctgctaatctcagtggtggtcaacgacaacggttagaaattgcccgtgcgttggtaaataatccctctatcctagttatggatgaagccaccagcgccttagacgcagaaacagaaaaaatcattgaccaaaatctccgccgtcggggatgtacctgtattatcgtggcgcaccgattaagcactatccgcgactgtgaccaaatcattgtcctggaa

SEQ ID NO: 42413 - DNA, 615 bp, Anabaena PCC7120
ctgtctttgcaattcactaccgttcccccagctaaatctcaaacacccgccggcttagttgtgactttgcatggttggggtgctaatgctgaggatgtggcatctttattaccctatttcaatttgcctgattaccagtttgtctttcccaatgcaccttatccatatccctatgctcctctcggtaggtcatggtatgacttgagacaagaaaatatgtatgagggattggcggaaagtcgggaactgctgaaagattttgtactttctttagaaagtagtactggtgtgcctttatcccgcactatcttaagtggattttctcaaggcggggcgatgacttttgatgtcggctcaaaattacctttggctggtttggtggtgatgagtgggtatttacatcctgaagccattagcccagataatactaatatccccccaactctgatcctacatggtacaagggatgaagttgtacccctgcaagctgctgtcaaggcacgcacaaccgtagaatcgctgggtgttcctgtccaatatcaggaatttgaggctggacacgaaatcaatttggaaatgttaaatgtagccagaaatttcattgtcaatgcactt

SEQ ID NO: 42414 - DNA, 2006 bp, Anabaena PCC7120
ttatacatcctgatggcagcatccacttcatcaaagcctatggggtggtggtgcgagatgctgagggtaatcctcagaaaatgattggagtccactttgatattagcgatcgcaaaaaatctgaggaaattattcgccaacaggtagaaagggagaaactgctacgagaaatcacccagaggattcgtcaatctctagacctccagaccatttttgacatcgcttgccaagaaatctgccaagtgattcaggctgatcgggtgggcattttcaagttctatcccgaatccaactttaatgacggcgaatttgtagctgaatctgtcgtcaaagaatttccctcagtgatagcaattcgggtacacgaccactgctttggagaaaactattcctctctctatgctttgggtaggtcttatgtggttgatgatatttatcacagtgacatgacaacctgtcacactgatatcttggctcagtttcatgtgcgtgccaatgtgattatgccgttactttgcggtgctgagttgtggggtttgctgtgcatccatcagtgcgcgacaactcgccactggcaacagtcagaaattgattttacacaacaacttgccacccagttagcgatcgccattcaacaagcaagtctggttgagcaattacagcaagaacttgccgaaagacatcaggcagaactaaagcttacccaaagcaatcaacaactggcaatttctaaccaagaactcgcccgtgccactcgtctcaaagatgaattcttggctaacatgagccacgaacttcgtacacccctcaatgccattctcggcatgaccgaagggttacaagaaggagtttttggcatgatcaataataaacaattcaaagctttagaaaccattgagcgtagcagctctcatttactggatttgatcaacgatattctcgatgtggcaaaaattgaagccggacagatcaaactggattgcaccacaatttcagtagctaatctgtgtgaatccagtctggtgtttatcaaacagcaggcattgcaaaaacggattcaggtggaaatcaaaattcccttcaatttacctgacttgttcgtcgatgaacgccggattcgtcaggtgttaattaacctgctcaacaatgcggtcaaattcacgcctgaggcaggacgcatttccctagaagttactcaactttcccccgatatatccactgtgcagaacttcctgcaaattgccgtgatcgatacaggcatcggcattatgcaagagaatatcaacaagctatttcagcccttcatccaaatcgatagcgctttaaatcgtcaatatgagggtacagggttgggactggcattggtgaagaaaattgtcgaactccacggtggtagggtgggcttaactagtgaactaggtataggcagctgcttcacgattgaactaccttgtattcccagtactcccgcatcaccggacttgattcgagatttattaactacccctactccagaactggactcccccactgctgatgaagccgtaagccttgcccctgtgatattgctagcagaagataataaagccaatatcaaaacattttctagctacctcagcgccaaaggctatgacattttgttggcaacaaatggtcaacaagccatagaactggccacaattcaccagcccgacttgattttgatggatatccaaatgccgggaatcgacggtctagaggcaatccgacagattcgccttgatcctcagttagtgaatattcccattgtggcactcacggcgctggcaatgactggcgatcgcgatcgctgtttacaagccggagccaatgactacctaactaaacccgtgaagctcaagcaactggcgaccactattcaacagcttttaattacaacaaaaaaatgaatctgccctctattctcgtaattgacgatctcccagataactttgatgttattgaaaccctcttaagtgagcaagact

SEQ ID NO: 42415 - DNA, 1903 bp, Anabaena PCC7120
atggcaaaagtagttggaattgacttaggaacaactaactcctgcgtcgcagtaatggaaggtggtaaacccacagttattgccaacgcagaaggtttccgcaccacaccgtcggtagtggcatttgctaaaaacggcgataccctagtagggcaaatcgccaagcgccaagcggtgatgaaccccgaaaatactttctattctgttaagcgctttattggtcgtcgctacgacgaagttacaaacgaagctacagaagtttcttacaaagtcctcagcagtggcggtaacgttaaggtagactctcctggagccggtaaacaatttgctccagaagaaatttctgccaaggttctccgcaaactagtggaagatgctagtaaatatcttggtgaaactgtaacccaagcagtaattaccgttcccgcgtacttcaatgactcccaacgtcaagcgactaaagacgctggtaagatcgctggtattgaagtcatgcggattatcaacgaaccaacagccgcttctttggcttacggttttgataaaaagagcaatgaaaccatcctcgtatttgaccttggtggtggtacattcgacgtatctgtcctagaagtaggcgacggcgtatttgaagtattggctacttctggtgatacccaccttggtggtgacgacttcgataaaaaaatcgctgatttcctagctgaacagtttataaaagacgaaggtattgacctccgcaaagacaaacaagcactgggacgcttaaccgaagcagcagagaaagccaagattgagctttccagcgtgacccaagcagaaatcaaccttccattcatcaccggctacccaggacggccccaaacacctggatatgactctgactcgcgctaagtttgaagaactttgtgctgacttgattgaccgttgccgtattcccgtcgaacaggcgctacgggatgccaaactcaagaaagagaatattgatgaagttgttttagttggtggttctacccgtatccccgccgtacaacaactcgttaagaatctgttaggtagagaaccaaatcaaactgttaaccctgatgaagttgtggcagttggcgcagcgattcaagcaggtgtactgggtggtgaagttacaggcatcttgttgttagatgtaacaccattatccttgggtgtagaaaccttgggtggtgtgatgaccaagattatcccccgtaacaccacaattcctaccaagaaatcagaagtattctctaccgccgtggatggtcaaaccaacgtggaaattcacgtcctccaaggtgagagggaatttgctaacgataacaagagcttgggaaccttccgccttgatggtattcccccagcaccacgaggtgttccccaaatcgaagtggtattcgacattgatgctaacggtatcctgaacgtcaccgctaaggacaaaggtactggtaaggaacagtccatcagtattactggtgcttccactctggataaaactgacattgaccgcatggtgagagaagcggaacaaaacgcttcatctgacaaagaacgccgggaaaaaattgagcgtaaaaaccaagccgattctttggcttaccaagctgagaagcagctacaagaattgggggataaagtccccgaagcggataaaaccaaagttgaaggtttagtgaaagacctgcgggaagcggttgctaaggaagacgacgagcaaatcaagaaactgaccccagaattgcaacaagcattgttcgcagttggtagcaacatctatcaacaagctggtggcggtgctgcaccaggtgcggctcctcaagatggcggtactacttcatctgatggtggtgatgatgtaattgacgctgattttacagagactaaataa

SEQ ID NO: 42416 - DNA, 961 bp, Anabaena PCC7120
atggcacaggatcgaaaatcaacagttatagtcactggagcttcttctggggttggtttgtacgctgcaaaagcccttgctaaaagaggatggcacgtcgtcatggcttgccgcaatttagagaaagcagaacaagccgcgcaagaagttggcatccccaaggatagttacagcatcatacatattgacttaggctcattggatagtgtgcgccagtttgtgaatgactttagagctactggccaaatccttagacgctctattgtgcaatgctgccatttatatgcccttaatcaaagagcctttacgcagcccagaaggttacgaattgacaatgaccaccaatcaccttggtcattttctgctgtgtaagctcatgcttgaagatttgcagaagtcatcggctgtggataaacgacttgtgattttaggaactgtcacccacaacccagacgagctaggtggtaaaattcctccgcgcccagacttgggtaatttggaagggtttgcccaaggctttaaaccaccaatttctatgattgacggtaagaaatttgaaccagtaaaggcttacaaagacagcaaagtttgtaacgtcttgaccatgcgggaactacatcgccgttatcacgaatctaccggcattaccttcacttccctttatcccggttgtgttgccgaaacaccactattccgcaatcactatcccctattccagaaaattttccccttgttccaaaagtacatcactggcggatacgtatcccaagagttggcaggagagagggttgcagatgtgattgctgcacctgaatacaaacaatctggtgcttattggagttggggaaatcgtcaaaaaaaagatggtaagtcttttgtacaaaaggtttctccccaagctcgtgatgacgaaaaagccgaacgcctatgggatttgagcgaaaaattagtcggacttgag

SEQ ID NO: 42417 - DNA, 1143 bp, Anabaena PCC7120
atgaaagtcctagttattggtggcgatggatattgcggttgggcaaccgcactttatctttccaatcgcggttatgaagttggaatattagatagtttggtgcgtcggcactgggataatgaactgggtatcgaaactctgactccgatcgcaccaattcagcaacgtctccagcgctggcaagatttaacaggcaaatctattgacctgtttgttggcgatattaccaactatgaatttctccaaaaagcgttgcataaatttgagccaaatgccatagtccattttggcgaacagcgttcagcaccattttcgatgattgaccgcgaacacgcagttgttacccaggtcaataacgttgtgggtacgttgaatttgctatatgcaatgaaggaagattttcctgactgtcacctagtgaagttaggaacaatgggggaatacggcacacctaatattgatatcgaagaaggctacatcaccattgaacacaatgggcgcaaggataccctaccttatcccaagcaaccaggttcaatgtaccacttgagtaaagttcatgatagccacaatatccattttgcttgtcggatttggggattgcgggcaacagacttaaatcaaggtgtggtttacggcgttctcaccgaagaaacggggatggacgaactcttaattaaccgactagattacgatggtgtgtttggtacagcgttaaaccgtttctgtattcaagctgcaacaggtcatcccctaactgtttatggtacaggtggacaaacgcgcggattcttggatattcgggatacggtgcgatgtgtggaactagcgatcgctaatccggctccatcgggtgagtttcgtgtttttaaccaatttactgaacaattcagtgttggtgacttggcattaatggtgaaaaaagctggcaatgccttgggattaaatgtagagatcaataatctcgataatcccagaatcgagaaagaagaacattacttcaatgccaaaaacactaaactactcgatttaggtttgcaacctcattatctctctgattctctgctagattctctcttaaactttgctgtcaagtatcaaggacgagttgatcaaaagcaaattttacctaaagtttcttgg

SEQ ID NO: 42418 - DNA, 588 bp, Anabaena PCC7120
aagttttactacaatcccatctctgttaatgctcgtcgagtttgggtagccttactagaaaaacaaatcccttttgaaccattgttgttgaatctcaatggtgatcagtttcaagaggaattcacggcaattaatcccctccagcgcgtacctgtgatagtggataatggcttacgggtgatagaatctttggcaattttggattatctagagacaaaatatcctactccctcgttgattcctagtgagcctggagcgatcgctacagttcgtatggtagaaatgatcacaatcagcgagcttcagcctgctacagtcatcttgactcggccattagtagaattagataccgatgccaaaaaactcgtatcggctcaagaggcagtagcgaaaattttacagttttatgaaactcttttaggtgaacagatttactttgcaggcaaagatttcacactggcagaagtggttgcaggtacgttgattccttctctccccctttttgggttctctttagatgattacccccgtctgctagcctgggcggaacgactagaagagcgagaaagttggcaacaaaccacccca

SEQ ID NO: 42419 - DNA, 2322 bp, Anabaena PCC7120
ctttggttagtaactcaaggtgctattagtccccacactatcacaggattaaatcaatcttctgtttggggtatgggtaaagtcattcgtttagaacacccagaattaaattgtcgttgtgtcgatttagatcctacacaagaactgtttacccaagttgaaaacctcgttactgaaattacccatcctggagaagaagcacaaattaccctacacaaatctgaacgtaaggtagccagattaactcgctgcactttgcaaattctcccccatgaaccttaccgtttaactattgctaaacgtggtgtaattgcatccttaaaatggcaatcttcaccccgtcgtcaaccccaacctggagaggtagaaattcaagtaaaagccaccggattaaattttattgatgttctcgacgctttaggattactaccttttgaacgtaattggtttggtgtagaatgtgccggtgaagttgtcgccattggtgagggtgttacacatttaaatgtcggtgatgctgtggttgcactggcggctgatagttttagtcaatatgtgacaactaacgctaattatgtaattaaaaaaccagattccctcagttttacagccgcagctaccattcccgccaatttcctcactgctgcttatgctttgcgggaagttgccaaaattcaaccaggaaaacgcattctcattcatgcagcgactgggggaacaggaatggctgctttacaaatcgcccaacaagcagggttagaagtcttcgctacagctagtgttgggaaatgggagactttacgcgctttaggtgtgcaacatatttttaattctcgtaccttgaattttgccgaggaaattcacgaaatcacccaaggggaaggagttgatattgtatttaactccctgtctggtgaatttatcccggctagtttatcggtactcaaaccccaaggacaatttatcgaaattggtaaacggggagtgtggaatgcacaaaaagttgctcaagtcaagcctgatgttgtttatcatttagtggatttgatgagtgttgctcaacaacaaccccagacaatccaaaccttgttacattgtctcatggcagagtttgaaagtggagaattgcgttggtctccgaccgaccgtaggtcatcgcatcctcaaaccattttccccgccaccaaaatagtagaagcgttgcagatgatgcaacaagcccgacacatcggtaaaatcgtcattacccacacacctactgagtcattacaacccgatgcaacctatttaattacagggggaatgggcggtttaggtttgcgtgtagcccgttggttagtagaaaaaggtgcaaaacatctcgtattgttgggacgtaaccaaccagatacaacagcacagcaacaaattcaagctttagaagcaacaggggcaaaaattatcataactcaggcggatgtcagccaaaaagaccaattagcagcagttttgacagatattcagcaaaaccatcctcctttacggggagtgattcacgccgccggagttttagatgatggcattttacagcaattaactccagagcgatcgcaccgcgtcatgaatcccaaagttacaggtgcgtggaatctccaccaattaacccaagacatccccctagattatttcatcatgttttcttccgcagcttccctactaggttctccaggacaggcaaaccacgtagctgcaaataccttcctcgatgctttagcccaatatcgccgccatcagggattacctgcactgagtataaattggggcgtatggtcagatattggtgcagcagctaaaagacaagtttctaatcaaatgagttcacggggtatcggtgaaattactcccgaccaaggtatagatattttagaatttatcctcacccaatcttccacacaagtaggggtaattcccatcaattggtcagaactgctcaagcaaaaattatcctcaactttctttgcagatttttacgagtccaccccaagcactagccaagaatatcaaccctctcaactaatccaacacatccaatgtttaggaatcaaagaacggatttcctacttgagaaaatacctccaaacagaagtcagtcaagttttaggttcgtcctcatctcaactaccaaatgtgcagttaggattttttgatatggggatggattcactgatgatggtagagttgcggagtcgtctagaaacaagtttaaagcaaactattccttctacagtattatttgaacatccgagcattcaagctttagcagagtatattgccactcagttg

SEQ ID NO: 42420 - DNA, 552 bp, Anabaena PCC7120
atgctgaaactttatggaggggcttttagccgcgcttcaatcgtgaagtggtatttagaagagctagaagttccctacgagtttgttttgttagatatgcaggcgggggaacaccttcagccggaatacctgaaaataaaccccattgggaaagtacccgcaattgtagacggggattttcagctttgggaatcaggagcaattttgctttatctgaacgacaagtacggtaaaacttccctgtcagcagaggaacgaggaatactctcccaatgggtagtatttgctaacgccaccctgggaactggtatttttgtcgaagcaaatcgagaaaaagaaatgccccgtttgctgactcctctcaatgaaatttttgagcatcaaccctttttgctgggtaatgaatttagcgttgctgatgttgctgtgggttctatattggcttatattcccatcatgctgaaactagatttgggcgattatccagccgtagtcaactatatcaagcaaatgactgagcgaccagcatttcaaaaaagcattgctggaaga

SEQ ID NO: 42421 - DNA, 990 bp, Anabaena PCC7120
gtgctcagttctgcaacttttaaactgcagccaactgcaacaggactgactgaaaatcatcgcctgcggctgttttctggctcttctaacgtacaactttctcaagaagtcgctcgttacctgggtatggacttaggccccatgatccgcaaaagatttgcggatggtgaactgtatgttcaaattcaggaatcgattcggggttgcgatgtctacctcatccaaccatgttgtcaaccagtgaacgatcacttaatggaattactaattatggttgatgcctgtcggcgcgcttctgcgcgacaggtgacagcagtaattccttactatggttacgctcgtgctgaccgtaaaaccgcagggagagaatcaatcactgccaagttggttgctaacctgattactcaagccggagctaatcgcgtcttggcaatggatttacacgctgctcaaattcagggatacttcgatattccgtttgatcatgtgtacggttcaccggtcttgctagattatctaacaagcaaacaactgcatgatattgtagtggtttcccccgacgttggtggtgtagcgagagcaagagcatttgcgaaaaagctcaatgatgccccactggcaattattgacaaacgccgtcaggctcataacgtcgccgaagttttaaatgtgattggtgatgtcaaaggcaaaaccgcagttttggttgatgacatgatcgatactggtggcacaattgccgccggcgctaaattattacgtgaagaaggggcgcgtcaggtatacgcttgtgcaacccatgcagtcttctctcctcctgctgttgaacgattgtccagtggcttgtttgaggaagtaattgtcaccaatacaatacccataccagaaagcgatcgctttccccaactagtagtgttatcagtcgctaacttgttaggggaaaccatctggcggattcatgaagatacatctataagtagtatgttccgc

SEQ ID NO: 42422 - DNA, 819 bp, Anabaena PCC7120
gtaggtttggtgacattagatttaatttacttggctgaatctgctcctcaaaataatcagaaattagtagcgactgattacactgtagcagcaggtgggcctgcgactaatgcggctgtgacttttagttatctgggtaatcaagccacagttttgggtgtagttggttcccacccgatgacgcagcttattcgtagtgatttgactaaatatcaagtagcgatcgctgacattgatcctactattaatacaccaccgcctgtatcttcaattattgtcacccaagccacgggggaacgggctgtcatttctatcaatgctgtcaaaactcaagctagtgaagactctatcccaccagatatcttacataatattgatatcgtgctgattgatgggcatcaaatgactgtagggtatgtcatcacgcaaaaggctagagctaataatatccctgtagtaattgatggcggtagttggaaaccaggattcgagcgaatcttaccattagttgattacgccatttgttctgctaacttttatccccctaactgtagttctagcgaagaggcattcgcatatctccataacttaggaattccccacatcgccattacccacggcgaacagccgattgaatatctaagttgtggcgaacatggtactgtagttgtacctaagattacagcagttgataccctgggggctggagatatttttcacggtgctttttgccactacatattacaagcaagttttactaaagcactagaaggagcagccaaaattgcggctgatgcttgtaaactctttggtacacgc

SEQ ID NO: 42423 - DNA, 1341 bp, Anabaena PCC7120
cagagacctaatccactaaaaactcaccctttcctgcaaaaactacaatggatagctgaccctgtagaatacatgaaaaaagcatctctgcaacatcccgatatgtttacagcagaggtaattggttttggtgacactgtagtgtttgttagccaccctcagggaatccagacactttttgctaatgacagaaaaaagttagtagctgttggggaagcaaacagaattttgtatcctttagtgggtaacaattctatgttcctactagaaggagtaaaacacaagcagcgaagacaactccttatgccctcctttcatggggaaagaatgcgcgagtatggccacttaatcagaaatattactgaaaacctttttagtcagctacaacaggatgttactttttccgctctcacagcaatgcgggaaatctcgatgcaggttattttgcaagctgtctttggtttttatgagggagaacgttgtcaacaattcaaacatttattaccaatttttctttcagaattatttcagtccccattggcttctagtatactctttttcccttcactccaaaaagacttaggtaatttgactccctggggaagatttgtccgccaaagagagaaaattgataaattgctttatgcagaaattgctgaacgcagacaggaaataaattctgatcgtattgatattctttccttactcatatcagctagagatgagacaggtgattccatgtcagataaagaattacgagatgaattgattaccttaatgatttctggacatgaaactacagggacagctatggcatggtctctatattggattctgcaaacgccagaagtatttcaaaggctgatccaagagttagacagccttggtgattctcctgatcctatgagtatttttcgattgccatatcttacagctgtctgtaacgaaaccttgcgaattaaccctgttgccatgttaacactacctagagtagtaaaagaaccaattgagctattgggaaatagactagagaccagtacaacagtagttggttgcatttatctgactcatcaccgagaagatttatatcccgaatcaaagttatttaaaccagagcggtttctcaaacgtgaattttcccagtatgaattcatgccatttggtggtggtgtacgtggttgtattggtcaggctctggctatgtttgaaatgaagatagtattagcaacagtcttatcacgttatcaacttgcactggcagatagaaaaccagaacgtcctcaacgtcaaggttttactcttacacctaccaatggagtcaagatgttaattacaggacaa

SEQ ID NO: 42424 - DNA, 1644 bp, Anabaena PCC7120
gttcaaagcgatcgcaccatactactagaagtgcattctcccacagccgctaaagccagagaagcgatcgctcctttcgctgaactaatcaaaagtcccgaacatatccacacctaccaaattacacccctaagtatttggaatgcacgggcggcggggatgcaggttgaggcgatggtagcagctttgcgtgactatgctaaatatcccataccagaagcggtggcacaggaaatttccaccttgggggagaggtatggattaacagtgattgaacgtgatgaagatagtttacgcttgcgggtgagcgatgttgccttggcagaactattagtgagagataaacaagtagcgccgttactaggtaaacgactttctgaggtttcttttcaagtagaagctggtctacgcggtacgttgaaacaggctttgctggctgtgggttatccggcggaagatattgccggttatgtgagtggggatgctttatctatcaagttgcgtgaggagacacgcacaggtaaaaaatttctgctgcgagactatcaacgtcaagcagcagaagcattttatcagtctggaagagtacaaggtgggagtggtgtgattgtgcttccctgtggtgctggtaaaaccattgtcgggatgagtgcgatcgctgccgtccaagagaatacacttatactaagtacgagtttaacctctgtgaggcaatggcgacgagaattgttagataaaacagatttaccagaagaggcgatcgctgaatacagtggagaagtaaaaaacacagggccaatcaccctctcaacctatcaaattcttacctatcgtcctaaccgcgaagatgattttccccactttgacttattcagcgcccgttcttggggtttaattatctatgacgaagttcacctcttacccgccccagtttttcgcatcacggctgaactgcaagcacgcagacgcttagggttaacagccaccctcatccgtgaagatggtagagaaggcgatgtctttgctctgatcggcccaaaacgttacgatgtaccttggcgagaactagaaacagaaggctttattgctaccgccagttgtacagaaattcgtgtatcccaagacgcagaaaggcaaatgacctacgctcttgcacccagacgcaaccagtttcgggtggcggcggaaaatccccacaaggtacaagtagttaaagagttattagagaaagagtcaggacaccgcatcttaattattggtgagtttctggctcagttagaaacccttgccaaagtcacaggactacccctaattactggcaaaactcctgaaaaagaacgagaacagctttatcaagcctttagggagggaaaactagggggattagtattatcgagagtgggtaactttgccattgatttaccagacgcagacatcctcatccaagtttcaggaaaatatggttcccgccaggaagaagcgcagcgtctaggtagagtactgcgtcctaaatctgatggtcgtcccgcccaattttatactctagtatctctgcgtacctgtgaagaggattttgctcgtcatcggcagttatttttaacagagcaaggttacagttataatattcaaattgtggatcagttt

SEQ ID NO: 42425 - DNA, 606 bp, Anabaena PCC7120
ggcagattcattgtatttgaaggggttgaaggttgcggcaaaactagccaaatgcagctttgtgcagagtggttgcaaagtttggggatttctgtggttctcacccgtgaaccaggaggaacagaattaggtttagatttgcggcgcttgttgttacagaaggcggaagataagccaatcgctgaggtgacggagttattattatatgctgccgatcgcgcacaacacgttgcccaagaactcaaacctaagttagctcagggtaagtatatattatgcgatcgctatgttgactctaccattgcctaccaaggttacggtcgcaatttggatatgaatctcatccatcagttaaatgacatcgccactggtggattaaccagtgacatcaccatctggctagatgtggatgttgaagtcggattagctcgtaaacggggggacaatgtaggactagaccgaattgaacaagaaaccatcgctttccatcgtcgtgtacagcaaggctatgcagacttagccgcatcctctccgaagcgaattatcagagttgatggtcaattgagtaaagaaactgtacataaaaccattcaggaaattcttagc

SEQ ID NO: 42426 - DNA, 1881 bp, Anabaena PCC7120
cgcgtttggaagattgaggacagcgaagctttataccggattgaaggttggggacagccttatttctcgattaatgcggctggtcacgtcactgtttctcccaaaggcgatcgcggcggttctttggatttgtttgaattggtcaatgctttgaaacaacgcagtttgggtttgcccttactgattcgtttttcggatattttagaagaccgcattgaacgcttaaatgcttgttttgccaaggcgatcgctcgctacaattaccctggtgtatatcggggtgtgtttcctgtgaagtgcaaccagcaacggcatttgattgaggatttagtgagatttggcaggccacatcagtttggtttagaagctggttccaagccagaattaatgattgctttggcgttgttggatacccctggatctttgctaatttgcaacggctacaaagaccgggagtatgtggaaacagccatgttatcccaaagactagggcaaacgccaattatcgtcctagaacaggtggaagaggtcgatttagtgattgcggctagtcaccaattaggaattaaaccgattttgggagtaagagcgaaattaagcacccaaggcatgggacgctggggtacatccacaggcgatcgcgctaaatttggtttgacgattcctgaaatcatccaagcagttgacaagctccgcgatgctgacttgctggattctttacagctaatgcacttccatattggttcgcaaatctccgccatcaatgtgattaaagatgccatccaagaagctagccggatttacgtagagctagcatccttgggagcaaatatgaaatacctggatgttggcggcggcttaggtgtagactatgacggttcccagaccaacttctacgcctccaaaaactacaatatgcagaactatgccaacgacattgtggcagagttaaaagatacctgtgcagagaaacaaataccagtaccaacactgattagtgaaagtggacgggcgatcgcctcccatcaatcggtactcatttttgatgttctcagtactagtgatgttccccgcgataacccggaaccgccaaaagaaggcgaatccccagttattaattacctgtgggaaacttatcaatccatcaacaaagagaactatcaagagttctaccacgacgctacccaattcaaggaagaagctattagccgcttcaatctggggattttgcgcctgagagaacgagccaaagctgaacgtctttattgggcttgttgtcagaaaattttagacatcatccgccagcacgattacgtacctgatgagttggaagacctagaaaaaatcatggcttccatctactacatcaatctttccgtgttccaatcagcaccagattgttgggcgatcgatcaactattcccaattatgcccatccatcgcctagatgaagaaccaacgcagcgaggaattttagcagacctcacctgtgacagcgatggcaaaattgatcgctttatcgacctacgggatgtcaaatctgtgctagaactgcaccccttccaaccaggggaaccctattatatgggaatgttcctcaatggtgcttatcaggaaattatggggaacttacacaacttattcggcgataccaacgccgttcatatccagttaacccccaaaggctaccaaattgaacacgtggtcaaaggcgataccatgagtgaagtggtgagctacgtccaatatgactccgaggacatggtagaaaacatccgccaacgttgcgagcgggcgttagaagaaaagcgcattaccttagctgaatcccagcgcttactccagacttacgaacaaagtctcagaagatacacatactta

SEQ ID NO: 42427 - DNA, 447 bp, Anabaena PCC7120
ttggaacgcacattcttagcaattaagcctgatggcgtacagcgtggactggttggggaaattatccgtcgctttgaaacaaaaggttttacccttgtgggtttgaagttcctccaagtcagtaaagaattggctgaacaacattatggcgtacaccgcgaaagaccattctttcctagcttagtggaatttatcacctctggcccggtggtagcgatggtttgggaaggtgatggcgtgattgcttctgccagaaaaattattggtgcgaccaatcccctaacagcagaacccggaacaattcggggcgattttggtattaacatcggtcgcaacctcatccacggttctgatgcaccagaaaccgcacaaaaggaagtaagcctatggtttacagatgcagaattagtcaattggcaaccccatttaacaccttggttgcacgag

SEQ ID NO: 42428 - DNA, 951 bp, Anabaena PCC7120
atgactaaaacagccttagttacaggtattactggtcaagatggctactatctcagccatttgctcctcaatcaaggttatcgagtagtgggattagtttcaccacaccgccaaccgaatttggcaaagttaggggatttggcaaacaaggtagaaatatataatgttgatttgagagatcctgtagcattgttaaatgcagtggaacaactgcgtccccaagaaatttataatttagctgcacctagttttgtgcctgattcgtggaaagacccactaggaactttggatctgattactgggactgctacccgactgttagatgcagtccgacaggttggtttatctacaagattctatcaagctagtagttccgagatgtttggggatgttttatcttctcctcaagatgaagaaaccagctttcgtcccaaaaatccctacgcagcagcaaagttacacgcccattggacaatggtgcatcaccgacagcgctatggtctatttgcctgtagtggcattttatataaccatgagtcacctttacgcccgcctcaatttgttacgcgtaaagtttctttggctgctgcatcgattaagttgggtttagctcagacactggaaatgggtaacttagatgctaaacgtgattggggatttgctggcgattacgtcaaagctatgtggctgatgttgcaagcagaggaaccagaagagtacgtaataggtacaggaaaactgcacagtgttaaagaattagtgtctatcgcttttgagtcggtgggcttaaactggcaaaatcatgtagtgattaatacagatttgctcagacaagacgaacattttcagctcgtagctaaccctattaaagctaaaaagaaccttggttgggaaacggaagttagctttgagagacttttagagaaaatggtgcaaacagatgtagaaaga

SEQ ID NO: 42429 - DNA, 1524 bp, Anabaena PCC7120
atgaaattggcttactggatgtatgcaggccccgcccacattggcactttgcgagtcgcaacttcatttaaaaacgtccatgctattatgcacgcgcctctgggtgatgactactttaatgtcatgcgctcaatgctatcgcgggagagggacttcacaccagtaacaaccagtgtggttgaccgccatgttttagcccgtggttctcaagaaaaggtggtagataatattacccgcaaagatgcagaagaacgcccagatttaattgtcttaactcccacctgtacctccagtattctgcaagaagacctagaaaacttcgtcgaacgcgcccagttggaggcaaaaggggacgtgttgctggcggatgtgaaccactatcgggtaaacgaactgcaagcaggcgatcgcactctccaccaaattgttcaatactatattgaaaaagcccgcaaaaaaggcgaactcccagaaggtaaaaccgccaagccctcagttaacatcatcggcatttctaccctggggttccacaataaccacgactgcaccgaactcaaaaggctgatggctgatttgggaattgaggtcaacgcggtcattcctgaaggcgcttctgttcacgagttgaagaatttacccagagcttggtttaacctcgttccttaccgggaattgggtttaatgacagctaattacctagaaaaggaatttggcacaccttgcatagatattgtgccaatgggtgtagtagaaactgcccgttgtatccgtaagattcaggaagtgattaacgctcaaggtgctgatgttaattacgaagactacatcaacgagcaaaccttgtatgtatcccaagctgcttggttctcccgttccatcgactgtcaaaacctgactggtaaaaaagccgttgtttttggcgacaacacccacgccgccgccttgacaaagattttgtcacgagaaatggggattcacgttgtttgggcgggaacctactgcaagtatgatgctgattggttccgcgaacaggtaagcgagtattgcgatgaagttctgattaccgaagatcatggggaaattggggatgcgatcgcccgtgttgaaccctctgccatcttcggtacacaaatggaacgccacgttggtaagcgtttagatattccttgtggtgtgattgctgcacccattcacgtacaaaacttccccatcggttacaaaccattcttgggttatgaaggaaccaatcaaattaccgatttaatctacaattccttcactttaggtatggaagaccacctattagaaatatttggtggacacgatacgaaggaagtaattactaaaggtatttctgctggttctgacctgagttggacaaaagatggcttggcagaattgaataaaattcctggttttgtgcgcggaaaagtcaagcggaatacagaaaaattcgcacgcgatcgcggtttcaaagatatctcagcagaggtgttatatgcagccaaggaagcggtaggagca

SEQ ID NO: 42430 - DNA, 1284 bp, Anabaena PCC7120
attcacgaaatcttcatgccggcgctgagttccaccatgaccgaaggcaaaattgtctcctgggtgaaatcgccaggcgataaagtggaaaaaggcgaaacagtggtggttgtcgagtcagacaaagcagatatggatgtagaaaccttttatgaaggttttctcgcccacatcattgtagaagctggtgatagcgcacctgtaggagctgcgatcgcttacgtagcggaaaccgaagccgaaatcgaagccgctaagtctttaggcagttctggtgctgctgcggctacccctccggccgcccctcaaccagtcgcaactaccgccgccgtaggtgtaccagccacatcacaaaatggctctaaccaccgtgagggtaggcttatagcttcaccccgcgcccgcaaattggcaaaagaactgaaagttgatttgacaagtctcaaaggtagtggcccctacggtcgcattgttgccgatgacatagaatctgctgttggtaaagtcaagcaaccagccacgacaccatctgcacccacacccacctttaccccagccgcacccccagcaccccgcactccagcaccagcgcctgcaccaatagcggctgcacctgggcaagtagtaccatttaataccctacaaaacgctgtcattcgcaacatggtggcgagccttgatgtacccgtgttccgtgtgggttacacaatcaccaccgatggcttagacaaactttacaaacaaattaaatccaaaggcgtaaccatgacagcgctactggcgaaagctgtggcggtgacattacaaaaacatcctttattaaatgccagctattcagatcaaggtcttgtttatcatcctgacatcaatgttgcggtagctgtagcgatggatggtggcggtttaattacaccagtgttaaaaaatgccgacaagatagatatctactccctatcacgtacttggaaatctctagtagacaaagccaggagcaaacaactacaaccagacgaatacactggtggtaattttaccctgtcaaacttggggatgtttggtgtcgatacatttgatgccattttacccccaggacaaggttcaattttagcgatcggtgcatctcgtccccaattggtagctacaggcgatggtttatttggtgtcaaacaacaaatgcaggtaaatattacatctgatcaccggattatttacggtgctgatgctgccgcatttttacaagatttagccaagttgattgaaactgatgctcaatctttgacactg

SEQ ID NO: 42431 - DNA, 1896 bp, Anabaena PCC7120
gtagattatacaaatgtagagtctttaccagaaatttggccgatagctgggaagaaatttggtgagactttagctctttacaatccccatgctaaaccagaggtaaagattacttatcaacaactagcagacaaaatccagctatttgcttctggattacaagcattgggagttcaagcaggcgatcgcatctccctaatagctgataatagtcctcggtggttcattgccgatcaagggattatgacagccggtgcagtggatgcggtgcgtagttcccaagccgaaaaggaagaattactttatattgtcgctcatagtggcagcacagctttagttgtcgaagatttaaagacattcaataagctgcaagatagactccacgacctaccaattcaagtggtagtcatacttaccgacgaaacaccaccgacagaacaaagcctcaaagtattgaactttcttcagttaatcgaagttggtaaaaatcatacttttgtcccagtcaaacgcaaacgcaacgaactggcgacattaatttatacctctggaaccacgggaaaacccaaaggtgtaatgctcagttatagcaatctcttacatcaggtcacaaccttccgagtagtagtacaacccaaagtaggtgatacggctctcagcattttacctagttggcacagctacgaacggactgtggaatattatttattgtctcaaggttgcacacaaatttatacaaatttgcgctcagttaaagctgacctgaaacaatataaacccaactacatggttgctgtaccgcgtctgtgggaatcgatttatgaaggagtgcagaagcagttccgcgaacagccagcaaacaaacaacggctgattaagtttttattgggcatgagtgaaaaatatatcaaagcccaaagaattgctcaaggtacaagtttagatcatctccatgcttcatcgttggaacgattaatcgctaaggtactagaatttgcttttttacccttccatgttttaggacaaaagttagtgtatggcaaagtcaaggaagcaacaggaggaagatttaaacaagtaattagcggtggcggtgcattaccaaaacacatcgacacattttttgaaattattggcgtgcagattttgcaaggttatggtttaaccgaaacatccccagtcaccaacgtgcgccgtccctggcgtaattttatcgggacatccggacaaccaattcccggcacagaagttaaaatcgtagaccctgagactcgccagcctttacctgttggaaaacgaggcttggtgttattgaaagggccacaagtcatgcaaggctattaccaaaacccagaagcaactgcaaaagccattgatcctcaaggttggtttgatagcggtgacttgggttgggtaacaccagataatgaacttgtgctaactggcagagcaaaagatacgattgttttgtccaatggggaaaatatcgaaccgcagccaattgaggatgcttgtttgcgatcgccctacattgatcagattatgctagtgggacaagaccaacgtagcatcggtgctttaattgtccccaacgtggaagctttggcaaagtgggcagaaagccagaatctcgtcttgagtgtagaggatgataatttaacctcctcatccagtcaaaaaattaacctggagagtaaaatgatccagggtttatttcggcaagaattgaatcgggaagtgcagaaccgtccaggttatcgcccagatgaccgtgttgggccgtttaaactgattctggagccattttccattgaaaacggcttaatgacacaaacgctgaaactccggcgacacgttgtcacagaacgctaccgcgatattatcaacgccatgttt

SEQ ID NO: 42432 - DNA, 447 bp, Anabaena PCC7120
atgggtgtatctggttccggtaaaaccaccatcggacaaatgttggcggaatctttacactgggaatttcatgatgctgacagtttccactcaccagacaatattgaaaaaatgcggcgtggtattcctctggatgataacgatagaataccctggttacaaagtttgcaaaccgctattatcaattggctgcaagacaatagaaatgttgtcttagcctgttctgccctcaaagctagttatcggcaattcttagttttagatagtgatattaaactcgtctacctgcaagggacatttgaactcattcaaacaagactgcaaaagcgtgagaatcattttatgaatagagaattgctcacaagtcaatttgcatcacttgaggaaccggataatgtcatacttgtagatatttcccagtcgcctcaagttattgtacaagctatt

SEQ ID NO: 42433 - DNA, 1179 bp, Anabaena PCC7120
acagtacgcgatatactcgctcatgtaaaagcgcgtggtgatgccgcagtccaggaatataccagtcgttttgatcactatagaccccattctcatcatttaagtgcggctttcattgccgaacaagcagcgaaatgttcagatgaggtaaaagcagccttagaactagcggctgaacgtattagttcttttcatcaaaaacaattaccccaagatattggttacaccgataccgcaggcgtaaaactgggcttaaattgggtagctttatcgcaagtgggaatttatgtccctggcggacgcgccagttaccccagttcggtcttgatgaatgccctacccgccaaaattgcaggtgtagaacgcatcgttatgactgtgcctatgcctcatggggaaatcaatcccgccgttctggctgctgcccaagtcgccggcgtaacagaaatatatagtataggtggagcgcaagcagtcggggcgttagcctacggtacagaaactatcacccccgtagataaaattgtcgggcctggtaatgcctacgttgctgaagccaaacgccaagtatttgggactgtgggtattgacagcatcgccgggccttcggaaattttagttgtcgccgatcgccaaaacaatccagaatggatcgcctgggatttattatcccaagctgaacacgatcccagcgctcaatcaattttaattactgactctgaatcctttgcccaacaagtgattgcggcggtagagcaaatcctcactaccttacccagtcaaaaagtagccagtagtagttggcaaaatcatggggcagtgattattgttagggatttagccgaaagtatccctttactcaatcaactagctccagaacacgtagaactgtgtgtagataaccctcaattgctagctagtcaaattaagtgtgctggtagtttatttttaggtcgttatactccagaggcgatcggtgattatttaggtggccccaatcacgtattacctacttcccgttctgcccgctttgcttccggcttaagtgtctacgattttctcaagcgcattacctatttagaatgcaatcaagcggcattgcagaaaataggccagtccgccgtcactcttgcagaaactgagggtttaccagctcatgcaggtagtgtagcggtgcgt

SEQ ID NO: 42434 - DNA, 1665 bp, Anabaena PCC7120
tctactattcaagctttacctcaagaagtcgtgtacctcattacagcaggggaggtaatcgactcatttgctgctgtggtgcgggaattggtagaaaattccttggatgcaggtgcaaacagaattgtagtttatttatggccgcagcaatggcgggttcgtgtggcagataatggttgcggcatgaacttagatgatttgcaacaagccgcctcagcccacagcaccagtaaaattcgttctagtgcagatttgtggaaaattcatagtctgggatttcggggtgaagcactacatagtttaacgacactagcagatgtagaaattatcagtcgcgcccccgaaaatgtggggtggcgagtagtttatggtgatagtgggaaagcagttcacgttgaagcgacagcgatcgctcctggtacagtagtcacagtctcgaatttattcgccagttgtgcggctcgtcgtcaaggcttacccacaacagcacagcaaatgaaagctgtgcaagccacaattcaacaaatcgctctttgtcatccccaaaccacctggcaagtttggcaaaatgaccggatttggttcaccatctcccccgccgccacagccggacaactcataccccaattcctcccccaactacgcccaagtgacttacaagaaatcaagttagagatacccaacccagaaaacccacaactcagcaccaacaacaagccaaacgcctcagcacttgccctagttgtaggattaccagaccgttgtcaccgccatcgtccagattgggtgcgggtagcaattaacggacggatgattaagttgccagaattagaacaaacaattttggcagcattccacagaacattaccacgcgatcgctaccctctttgttttgttcatcttctgatttcccccgaccaaatcaactggaaccgcaaccccgcaaaaacagaaatttacctccacgatttgagttattggcaagaacaagtgactcaagccattaaccaagcactacggattagtgctgccaatattccagagtctgtccagacaacgcgagttagtcaactactcaaagccgccgaagagaaagggaattataactttaatcctcgaaacgcaaatccagcagacaacactcagaactacctaaaagcagtagcccaagtcagtaacacttatatagtcgcagaacatcctgggggaatgtggctagtagaacagcacatcgcccatgagcgagttttatacgaacaattgtgtgataattggcgactcattcccgttgaaccaccaattattctttatcaactatccccagcccaagttgcccaattgcaacgcatcggtttagatattgacatctttggcgaacaactttgggcagtccgtaacttgccggcaatgttacaacaacgtgaagactgtgccgaagccattttagaactcagttggggaggggatttacaaacagcccaagtagccgtagcctgtcgcagtgctattcgcaacggtactcccatgagtctgccagaaatgcagaaattactagacgattggcaacgtactcgcaacccccgcacctgtccccacggtcggccgatttatttgtcattagatgaatcttccttatctcggtttttccgtcgtcattgggtgatt

SEQ ID NO: 42435 - DNA, 747 bp, Anabaena PCC7120
tcaggagattatagaaatgttattgcttattgccaaaagtgtttatccttgacagataacccggatttatcagtaaggatgcaaatactgtctcatttgggtaatgcttaccgtcatctgaacgactataacaaagccattgagtttctccaagcgtgtttgcaactaactcaaacattgcaagacaaacggagtcaagttgcagccttaaataatttgggattagtatataaagcctctggtaattttaatcaagcaattgggtatcaagaacaaagcctcatcattgttgaagaactcaaagatagctggggcatagaacaagtgctgaaaaatctaggcaatacttggtatgctttggataattacccaaaagcgatcgcctactacgaaaaatgcgtcaaaatagcactctccttaaataatcctcgtagtgctgctcaagtattgaaaaacttgggtaatgcttgctatgcgatcggcgattatgctaaagccattaaatactatgaaaaacgctggcaattagctagagacctcaaagataagcgtagtgaagaacagtctcttggtagtttaggtgttacctgtgaagctttaggtgaccatagcagagctattacatactatgaagcacgcctattgttagccagaagcatcaaagacaaacgcattgaagaacaagctcttgccagtctgaaaatagcttgttatgccttaggggattatgccaaagccatgcaatat

SEQ ID NO: 42436 - DNA, 1656 bp, Anabaena PCC7120
atacatcaagccaaactgcgaccagaagaacatatttatggcttgggggaaagagcagctccgttaaatctccgcacctgcggcaatgaagaggaaactaggacatacagaatgtggaactatgatgcaggaggcatatatgggacgggaactgaccccctgtatctttgcattccagtctatttaggtctgcatgaagaaggtagctacttaattttctatgaaaattcctttcctgccaactttagtttctcaaacttagctagagccgagtttgaaggcgggatgttgcgctattactttagtgcgggttctttgcctcaattgttggagcgatacacagaattaacaggtcgcccacctctaccaccacgctggacttttggttatcatcagtcgcgttgggggtacgaacgagaagccgcactgcgggaagttgtaaaggggtttgaaacatacaacattcccgtaagtgcattgcacctagatattgatgttttagataattttcgtgcctttaccattgaccccgatcgctttcctcatcttcctgagttagccgcagaattggcagctaagggaataaggttaattactattattaaccctggtgttcgagcatccagaaaaaacaaactgtttgaggaaggacgcgctcaggatgtcttttgtaaattgccaaatggtaaacctgcgatcgcttctgtttgggcaggtttatctgctttccctgattttaccaatccccaagcccgtcactggtggagtagacagtatgagtatctgcttgacctgggcattactggattttggcatgatatgaatgaaccaggtgtgtttgtactttggggcgacccttcactaccaccccatgcaacttggcattcaatggaaggtagaggtggcgaccaccgcgaagcgcataatttttatggattacttcaagctgaggctggataccaagccttatgtgagtaccaacctcaacgacgacctttcattgtttcgcgctctggttgggcaggtttacaacgttatgcctggacttggacgggagatattatcaccagttgggaaggattacgccaaactattcccacagttttaaacctgggattatcgggaattgcttacagtggttctgatattggtggattcaagggtcatccgagtgcagaattatacttacgctggtttcaggtatcctgcttcatgccattttgccgcacccattctgccaataatactaagcctcgtacaccttggagttttggtgaaccaacgctgggtattgtgcggcaattcttacaattacggtatcgtttgatgccctatttttacaccttagcttgggaatccactcaaaccggacatcctctagtacgtcctttattctgggcagatcaggacaatcctcacctttgggatatagatgatgcctttttgttgggtgatgccctgttagttgcggcgatcgccgaagaaggcgcaacctcaagaacaattatattacctaagggaaattggtataacttttggaatgatgaactcctagagggagaaaagcaggtcaaattaaaagcacctctagaacaaataccgatattggtcaaagcaggaagcatcttaccaatggaggaaaataatcaattgatt

SEQ ID NO: 42437 - DNA, 1449 bp, Anabaena PCC7120
ctcttagaagccaagcaagctgccgacgctgctaaccaagccaagagtgagtttctggctaatatgagccacgaactacgcacaccactgaatggcatccttggttttgctcaggtgctagaggtatcacccaatttgagggagaaagacttagagggagtgaacattattcaccaatgtggctcacatcttttactactgattaatgacattcttgatttgtcaaaaattgaagctcgtaaattagagttggtggtggctaatgtacatctgccaactttcttacatggtgtgagcgagatttgtagtatccgagcagcacaaaaggggattgcattcaaagtctctatgggcgatcgcctaccaacagtcatggaggtggatgaaaagcgcctcaggcaagtgctgatcaatttacttggcaatgctgtcaaatttacggatagcggcggagtgacttttaaagtagagttactggacactcaagatcaagataatcagcaatcctctgttgccaaaattcgtttccagattgaagatacaggcgtgggtatgtccccggagcaactggaaaaaatcttcttagcttttgagcaagtgggtgattgcagacggcaatctgaaggtactggtttaggattagccatcagtcaaagaattgccgaattaatgggtagccaaattcaggtacagagtcgtctgggtgaaggaagtatcttctggttggatgtaacacttccagtaccaatttcccatgattggcagacctatgccccaatgcaccagaaagtcattggtattcagggtagcgcgccgcaaattttgattgtcgatgatgatgacaaccaccgttctatgttaaacagtctgctacaagaaattggctgtcaaaccctagaagcaagcgacggcaaacagggactacagatggtcaatgaacatcacccagatttgattctgcttgatttagctatgcctaatatggatggctttgagctaatggttcagctacaagagaatccacaaactagttctatccccatcattgtctctagtgccagcgtattcgaggaaaatcgccaacggagtttgcaggctggagcaacagcgtttttgcccaagcccttacaaattgatgaactattcaatgcgctgcgatcgctactccaagtcgagtggatttatgcgccatctgcatctttgtctttatctcctcaaccagggcctacaactcctactgaattggttctgccatcacaggatgttttgcaacaactctatcatctatccatgatgggggatataccagcgattgagggaattcttagagagctaattcagcataatagtcagctaactccctttgccactgagttgagtaaacttactaccaacttccaaaccgcaaaaattcgccagttcctgaaatcatttgtcataacggagtcg

SEQ ID NO: 42438 - DNA, 852 bp, Anabaena PCC7120
actgccaaaattcttgatggtaaaactttagctgagaaaattcaaaaagaactgactgctcaaatcatagacgcacaagctaaaattggtcgtcctcctgggttagcagtattgatggttggagataacccagcctcagcagcctatgtgcgtaacaaggaaaaatcctgcgccaaagtgggtattgcttcttttggcaagcattttccccaagaaaccacccaaacagaattagaggatgtgattgctgcactcaaccaagacgaacaggtagatggcattctcgtacaattgcccttacctgaacatttagatgcggtgaaactgctgcatcaaatagaaccggataaagatgctgatggactccacccagttaatttagggcggttggtgcgtggggaaaagggtttacgcagttgcacccctgctggagtcatgcgcctattggcagaatatgaaatttctttgcgaggaaagcaagctgtggtggtgggacggagtattttggtagggaagccaatggctttgatgctcctagaagctgatgccaccgtgactattgcccactcgcgatcgcaagacctaaaatccatcactcaaaatgccgacattctcattgctgctgccgggttgccaggattaattactgctgacatggtgaaaccaggcgctgttgtggtagatgtggggataaatcgcgtgagtgatgctcatggcaaaagtcgcttagtaggcgatattaattttgcatcaattgctggtgtggcagaatatatcaccccggttcccggtggtattggccctatgactgtggctttgttattacaaaatacagtcaccagctatttacaa

SEQ ID NO: 42439 - DNA, 927 bp, Anabaena PCC7120
atggtagcagctgataacctccggaagatgtcagaggaagccaaatttaatctagtagcttatcttaaagagcggcaaaaactttgtgaagctgctttggatgcagccatacctattatttatccagaaaaaatttatgaatcaatgcgctactctctattagctggaggtaagcgcctgcgtccgattctttgtctggctacctcggaaatgatgggtgggacaatcgaaatagctatgccaacagcttgtgctgtagaaatgatccacaccatgtctttgattcacgacgacttgccagcaatggataacgacgattatcgtcgcggtatgctgacgaatcacaaggtatatggtgaagatattgcgattttggcgggagatggcttattagcctacgcttttgagttcgtagctatccgtactcctgaaagcgtacctagagaccgagtattgcaggtagtagcccgtttaggacgagcattgggagctgctggcttggttgggggtcaagtggttgacttagactcagaaggaaaatcagatacttccttagaaacactcaattttattcataatcacaaaacagcagctcttttagaagcttgtgtagtctgtggcggcattttagctggggcatcatcagaaaatgtacaaagactctcacgatattctcaaaatattgggctagcatttcaaatcattgatgatattcttgatatcacttctactcaagagcaattaggcaagactgcgggtaaagaccttttagcgaagaaagttacctatcctagcctgtggggaattgaacaatcgcgcgtcaaagcccaacagctaattgaggcagcttgtacagaactagaaccatttggagaagatgcacagcccctgaaagcgatcgctcacttcatcactagtcgtaatcac

SEQ ID NO: 42440 - DNA, 408 bp, Anabaena PCC7120
atgcgattgcatataattcttggcccaactagcgtaggtaagacagatcgctccgttgttttagccaaacaaaccaaagctccagtgattgtactagatcgcatccagatttatcaggaaatagcaactggtagcggtaggccactgattgatgaacttgagggaacgactcgaatatatcttgaagaacgtcaactagctgacggtaatttgaatacacttgagtcgttatctttggccttgcagcacatcgaccggctctcgtcacagcataaattgctgattctggagggaggatcgatatcactctgcacagctttatggaaaagtcggattctagaaaattatcaaaccactattgagtacgtgaaggtcgagaacgaggaactttatcaaagtcgattgtgg

SEQ ID NO: 42441 - DNA, 948 bp, Anabaena PCC7120
gccgttttaattcaaaatctacaaaagcgttacggtactgttgaagccgtcaaagatgtttctttccaggtggaaccaggggaaatctttggtttactcggccccaacggtgcaggtaaaaccactactctacgtgctttgtgtaccctcaccactccagatgctggcaaaatcgaggtatctggtatttctgtgttggataaccccagagtagctagacaacggctaggctatgttgctcaagaagtcgctttagataaagtgctaacaggaaaagaactgctgcaattacaagcagcactttatcaccttcccaatgccatagccaaacagcgaatcgatacagttttagatttactcggtctacaagaatacgccaataaaaaaacaggaacctattccggtgggttacgcaaacgcctagacttagcggctggcttactgcactcgccagatgtactggtgttagatgaaccaacagtaggacttgatattgaaagccgtttcgtggtttgggaattcttgcgaaaactccgagtatcggggacaacggttgtgattaccagccactatttagaagaaattgacgcgctagccgatcgcgtggctattatcgaccgtggtgtagtgattgccgttggtacaccttcagagctaaaagatagggttggaggcgatcgcatcaccttaagaatccgcgagttctcccccacagcagaagcagaacaagctaaatccctactgcaaggattaccttttgtcaaggaagttatcatcaacaacgctcaaggtaattccttgaacctggtagtaacaccacaaaatgatgctttaataaccatccagcaagcactcaacaacgccagcctaccaatttttggtatcgcccaatcccgtcccagcctcgatgatgtctatctagcagccaccggacgcaccctacttgat

SEQ ID NO: 42442 - DNA, 813 bp, Anabaena PCC7120
atgttgggtcagttattagacggacgctataaagttactcaagttttaggtgctggtggtttcggtaaaacttacattgctgaagacattaaactttacaataatctctgtgtcgtcaagcaactccaaccgatggctaatgatcctatgactttacaagtcgctaggcgcttatttgcatcggaagcagagttattacataaattaggaacccacgaccaaattccccaactactggcacactttgaagaacatcaagagttttttctggttcaacagttcattgatggacatcctcttagtgatgaactgactccaggaaagcgattaagtgagccttatactatcgctctgttaaaaaatatcctgcaacccttagcttttgttcatcaaaataacgtcattcatagggatatcaaaccacctaatctgattcgtcgtaaaagtgatggcaaagttgtgctaattgactttggggcagtaaaacagatcggtactcaggtggtgaatggtgaaggtgtaactaaaatgaccgtgagtattggtactgctggctatatgcctagtgaacaaagtcgtggtagccctcgattaagtagtgatgtctatgctgtgggaatgattggtattcaagctttgacaggattgatgcctcatcagttgcaagaagatatccagacggcagaaattatttggcgtgaattagtccaggtcagcccaagtttagcagatgtattagatagaatggtacgttacgactttcgccaacgctatcagtcagcagtcgaggctttagcgacggtgcagaacttg

SEQ ID NO: 42443 - DNA, 1706 bp, Anabaena PCC7120
  unsure (1)..(1706): unsure at all n locations
gaaaatttccagcccccagcccaatttccttcgggtccacattttggaaacggggggttttcaaattcccttcctttcaatgggtgggggccaaaaaggttaggaaaattggaaaactcttctcccccattccaagaaggaaggcgccaangcagttcccactggaagtttggtaaccggttccccaagaattttacccttagaagaaatcattcccgcaccacccatcgggactacccatcaaccctgactctgtttaccagacgaagaagaatatttagaatcagcgcgggtaaaaaatctcgtcaagacttatgcgactttcatgccagtacctatcaaaactggatggtgaagtattaaacagacaaaaagcaccttggcgggagtctcccagcaacctgacaaaagaagattatttagaattttaccgctatctctatcctttccaagaagaacccttactgtgggtgcatctaaacaccgactatccctttattattaacgggattctgtatttccccaaaatgcgtcctgatgtggatgtcaccaaaggacaaatcaagttattctgcaaccaagttttcgtcagtgataactgcgaagaaattatcccccagttccttgtacccatgcggggcgtaatcgatagtacggatattccccttaacgtatcacgtagtgccttacaaggcgatcgcaccgtccgcaaaatcggcgattatatagcgaaaaaagtcggcgacagactcaaagaactataccgcgacgaccgcgaacaatatattagtgcatggaaagacttaagcacctttgtcaaattcggtgtcctcaacgacgagaaatttaaaaagcaagtcgaagacataattattttccgcagtaccgttaaatgggaacaaccagcagaaacgccagccgttgaggtacagtcccaagaaggagatgtttggcaagatatcaccccttcccccgactctcccacaccaggcttaccatacacaaccctgaaagaatacttagaacgcaacaaagaacgccacgaaaaccgcgtattttacagcaccgatgaagcaacccaagccacttatatagaactacacaaaaaccaaggcttagaagttttattcctcgattccttcatcgacacccactttatcaacttcctcgaacaggaatatcaagatgtcaaatttacacgggtagattctgacctcgataataccttgctcgaacaagacaaagccggggaaattgttgaccccaccacaaataaaaccaagagtgagatcattaaagagttatttgagaaatccctcaataaacctaaagtcaacatccgcactgaagcactcaagtctgatgatcctcaaggtacaccaccggcgatcgttctcttaccagaatttctccgccgcatgagggaaatgaccgccatgatgcagcagcaaaacgcagattttcccgaagaccacattttactagtgaatacagcccatcccctaattcaaaacttggtaaacctcaaccaaggtgcaattattcaaggcgatggagaatcaaccacaaatcccttagtcaacttaatttgtcaacacgtttacgatttagcgttaatgtcccagaaaggtttcgacgcagaaggaatgaaatcttttgtcgaacgttccaacgacgtattaaccaagctgacccaacaagccaaa

SEQ ID NO: 42444 - DNA, 678 bp, Anabaena PCC7120
agaccttatcatcaaatacttattgtggaatgtggtgaaccgctagtagagattcctttagaattattttcctgggagtctccccatccttatgcaagattaggggctgcttacggagaatattcaccttattttttgcgtcagagtgttgttaactgtttaataaaagctcaaagttatttagagtcgctgcgtcctcgctggcgcatccaaatttttgatgcctatcgtccagtagctgtgcagcagtttatggtagattacagcttcgctatggcagttgaggaacgagggttaattgaggctgaattaacgccgcagcaacgccaagaaatttggcaagcggtttatgaaatttgggctgtaccgagtttggatgaaaaaactcctccaccccacagtaccggtgcagcagtagacgtgactttagtagatgatggcggacaggttgtaaacatgggttcgccgattgatgaattgtcagagcgatcgcatcccgattactatgccaatagtaaagaaccagcagcgccggagtatcacgctcatcgtcaattgttgtgtgatgtcatgttaaaagctagtttccaacgtaatccgaaggagtggtggcatttttgctacggtgatcaaatgtgggcttggttgagtaatcagcctaccgccatttatggacgt

SEQ ID NO: 42445 - DNA, 1281 bp, Anabaena PCC7120
gtaaagctgggaatcttaggattaggtacggtaggaacgggaacggtgcaactgctacaagatacagttggtcgtcaccctttgctgcaagaaatagaaatatatcgggtgggagtacgatcgcttgataaatcccgcgatgtacaattacagccggaagttataactacagatttagagtcaattgtcaatgacccagcagtagatattgttgttgaggtcatggggggattagaaccggcgcgatcgctcattctccaagccatacataatggtaagcacgtagtcacagctaataaagcggcgatcgctcgtttcggggcagaaatttttacggctgctaatcaagccggagtttatgtgatgctggaagccgccgttggtggtggtattcctgtaattcaaccattgaagcaggctttaagtgtcaacagactgcatactgttacaggcattgttaatggtactactaactacatcctcacccggatgcaaacagagggtagcgaatttgctgatgtcttagctgatgcccagcgcttgggttacgcagaagccgaccctacggcggatgtagagggtttagatgcggcagataaaattgctattctcgcgtcattggcttttgatgggcgaattaacttgcaggatgtctactgtgaggggattcgtcaagtcagtaaaacagatatcgcctatgccgaaaaattgggatttgtgattaaattactagcgatcgctaaaaatcaggctcaagatgccactaaactatcggtcagagttcaccccaccttcgtacccaaaacacatcccctagctagtattaacggcgtgtataacgccattcttgtagaaggagaacccataggtcaggtgatgttttttggccctggtgcaggtgcaggagcaaccgccagcgccgtcacctcggatatattgagtttggtagcagccctgaagagtaatacgacagcccccaatcccctattaacctgtagacacgaagaatatagccaagttgctcccattagcgaccttttaaccagattttacgcccgattcctcaccaaagaccaagctggcgtcattggtcaattaggtacttgctttggaaatcatggggtgagtatagaatcaattgtccaaactggctttcaaggggaactagtagagattgtagttgtgacgcacgatgtcagagaaggtgaatttcgccaagccctagcagaaattcaaaatttaccggcgattgatagcattcctagcatattgcgggtgttg

SEQ ID NO: 42446 - DNA, 1218 bp, Anabaena PCC7120
gtcaccgaaggccatccagataaaatctgcgatcaaatttctgatacgattttagacactttgctggcacaagacccgactagtcgggtggcagctgaggttgtggtaaatactggcttggtgttaatcaccggtgaaatcaccaccaaggctaacgttaattatgccaatattgcccgccaaaaaattgcggaaattggctacaccaatgctgataatggcttttctgctaacagcactagtgtaattgtggctttagatgaacaatcaccagatattgctcaaggtgtcaacactgctcaagaaacccgcgaacaggatagtgaagaactattcgataaaatcggcgctggtgatcaaggtatcatgttcggttttgcttgtaacgaaactccagaattgatgcctttgcctatttgcttggctcaccgcattgctcgccgactagcagcagtccgtaagactggggagttgtcctacttacgtcctgatggtaaaactcaagttaccgtcgtttatgaagatggccgcccagttggcattgatacagtgctgatttccacccagcatacagccaccatcggggatattactgatgaagcggcagtacaagccaaaattaaacaagacctgtggactgctgtagtggaaccagtgtttggtgacttggaaattaaaccagatcaagagacacgctttttagttaaccccactggcaagtttgtcattggtggcccgcaaggcgactctggtttgacaggacggaaaattatcgttgatacctatggcggttactcccgacatggtggtggcgctttctctggcaaagaccccacaaaggtagaccgttctgcggcttatgcggctcgttatgtagctaaaaatgttgtagctgccgggttagcagaaaaatgtgaagtccagttgagctatgcgattggtgtagcgcgaccggtgagtatttttctagataccttcgggactggcaaggtagatgatgaaattctgttggaactagttaaagataactttgaactacgtccagcagggattatccacagcttcaacttacgcaacttaccaagcgaacgaggcggacgtttttatcaggacgtcgcggcttacggtcacttgggacggaacgatctagatttaccctgggaacgtaccgataaggcggatttcttgaagcaagcggttactcattcattgtcagct

SEQ ID NO: 42447 - DNA, 1221 bp, Anabaena PCC7120
aaaggcaatcaggagggtttggctgtgtctaaaaaaactgtggctagtttatctgctgctgatatctctggtaaacgcgctttagtgcgtgttgactttaacgtgcctttagacgatcaaggcaacatcacagacgatactcgcattcgtgcggctctgccaaccatccaagatttgacgcaaaagggcgctaaggttattctagcaagccatttcggtcgtcccaagggtgtagatgagaagttgcgtcttaccccagtagccaagcggctatctgagttgttgggacaagaagttatcaaaaccgatgactcaattggtgatgaagttgcggctaaggtggctactttgcaaaatggccaagttcttttattagaaaacgtccgtttttataaagaagaagagaaaaacgatcctgaatttgctaaaaaattagcggctaatgctgatttctacgtaaacgatgcttttggtactgcacaccgcgctcatgcgtctacggaaggcgtgactaaattcctcagcccatctgtggctggatatttggttgagaaagaattgcagtacttacaaagtgcgatcgaaaatccccaacgtcctttagcagccattatcggtggttctaaggtttccagcaaaatcggtgtgattgaaacactactagagaagtgcgacaagctgatcattggtggtgggatgattttcaccttctacaaggctcgtggtttgaatgtgggtaaatctctggtggaagaagacaagctggaactggcgaagtctttggaagctaaagccaaggaacgcggcgttagcttgttgttacctacagatgtggtattagcagataactttgcacctgatgccaattctcaaactgtcagcattgaaaacatccccgatggttggatgggtttggatatcggccctgattctgtcaaagtcttccaagcagcccttgcagataccaaaactgtcatctggaacgggcctatgggtgtgtttgagtttgataagtttgctgctggtacagaagcgatcgctcatacactagcagagattggcaaaactggcacaactaccatcatcggcggtggtgactcggtagcggctgttgagaaggtaggtttggctgatcaaatgagccacatctccaccggcggcggcgctagcttagagttactcgaaggcaaagtactgcccggtatcgctgctttagatgaa

SEQ ID NO: 42448 - DNA, 1644 bp, Anabaena PCC7120
agccaatttgatgttttagtggtcggtgctggtgcggctggactgtatacggcattgtgtctgccagaatccttacgagtcggcttgattaccaaagaaactgttgctttatctgctagtgattgggcgcagggtggtatagctgctgcgatcgcccctaatgattctccttctctacatattgaagatacaattcaagcaggagcaggcttgtgtgatgttgcagccgtagaatttctggctcaacaagcccccaaatgtatcgaatctttggttaacttgggagttgcttttgaccgacacggacaagctttagcattaactttagaagctgcccattctcgtaaccgtgttcttcacgccgccgacactacaggtagggaagtcacaactactctcacggatcaagtattacgtcgtcccaatatccaagtaattcagcaagctttggctttgagtctttggctggaaccagaaactggtcattgtcaaggaatcagcctgttttatcaaggtgcaattacatgggtcagggctggggctgtagtcctggcgactggtggcggtggtcaagtatttgcccaaaccacaaacccggcggtcagtactggcgatggagttgcaattgcatggcgggctggggctattctccgggacttagaatttgtccaatttcaccccacagccttaactaaaccaggtgcagaccgtttcctgattagtgaagcagtccgtggtgaaggcgcacacctagtagataatgaagggcggcgatttgcttttgactatcacccggctggagaattagcacccagagacgttgtgagtcgggctatatttagtcatttacaacgcactgctgtcgatcctgccacagcccatgtgtggttggatatgcgccccatccccgaagacaagattcgtctccggtttcctaatattgttaaggtttgtcagcgttggggtatagatgttttccgcgaaccaattcctgtagccccagccgcccattattggatgggtggtattgccaccaatttaaagaatcaaactaatatacctggattgtatgcagtgggagaaaccgctagtacaggtgtacatggtgctaatcgtttagcaagtaattcattgctggagtgtattgtctttggcgcgcaactagcaaatctcacgccagcagatttgatacagcatacagaaacaccagccttacccacaagagaatttaagattgatgccagcgagtggcaacaccagcaatcacaattagccatactgcgagaaaagttaccgcgtctagtttggcaaagcgctggtatttgtcgagaacagtctactttatctgtggcgatcgctactgtaaaatcttggcaacaggattttgcagcgctgcctttaagccaatttttgttatctctacaaccaaacgagccagttagctgtaatttttcagataccgaccaacaactacgactctgggcagaaacaggcaatttactcgatgttgcctatttaatactcaaaagcgctgcttttagaattgaaagccgtggcggacacttccgtttagactatccccactcaaatcctgattggcaagtccactctctagtacaaaagcaccaatggtggcaatctccg

SEQ ID NO: 42449 - DNA, 1824 bp, Anabaena PCC7120
aacaatgactggcggctgttttcccgtttggttccttacgcccggcgtaatactaaactcctaattctggcaatggtactgctattaccacttgctttggctaatgccgtacaacccttgttaattggacaagctgtatccttaattcgtaaggaatctagcgcatacgagtttttgagaaatcgccccttgtcccaagggctacatataattgagggagtcttactctttacaattgttgttcgtttagcgttgacgggttaccaaggctatttgttacagaagttagggcaaaaaattacagccgctattcgccaagacttatttcatcatgtaacttctctggcagtccgtttcttcgaccgtacacccgttggtaaactaattacccgactcaccagtgatgtagaagtattgggagacgtattttccactggtgctattggcatcgtctctgacgtagttttgatggtggtcattactggtttaatgttttctatccagtggcaacttgcttctttgctcctggtgatgttgttaccagttacttggttaattatttacttccaacaagagtaccgcaaagctaattacaaagcgagggaagaactctctttattgaattcccagctacaagagaatgttttggggattaacgtagtccagttattccgccgggaaaagtttaatgctgagttatttcggactactaaccaacgctataccaaacaggtagatcaaactatcttttttgattcggctgtttccgcaactctggaatggattggcttaattgcgatcgctggtgtattgtgggtgggtggatggttactttcagacaatcaagttgattttgggactttatcgacctttattttatacgcccaacgcttattcgaccctttacgagattttgcggaaaaattcaccgtgattcaatctggatttacggccattgaacgggttagcgacattttagatgaaccgatagaaataagcgatcgctccaactctcgtttttccgtttttgatgctaaatttggttacattgatgaaattgtggctgatttggaatctcaaaatatcagcgacactccaaacatgggagaaatacgttttgaacacgtttggtttgcctataaagacgatgattacgtcatcaaagacttagactttattattcgtcctggcgaaaaagttgcattagtagggcctactggcgcaggtaaaagttctatcatccgtcttttatgtcgtctctacgaacccacccaaggacgtatcttagtcgatggaattgatatccgcgagttacctcaagcagaattacgccgttatatggcggtaattttacaagagggttttttatttgctggtaatgtcaaaagcaacattactttaggtgattactatacttttgaggaaattcaagcagccgcacaacaaacaaatattgccgaatttatcgaagaactacccttaggttacgatactaaattgcgagaacggggtacaaatctttctagtggacaaaagcaactgttagcttttgctcgtgcagctattcgcaatcctcaaattttggttctagatgaagccactgcaagtctcgatgttggtacagaagccttagtgcaggaagcattaaacgaattattaattgggcgaactgccatcattattgcccaccgcctgtctacaattcgcaacgtagatagaatttttgtgttaaaacgtggtgaattagtggaacaaggtagccatgaggaactgttaaattcaggagggctttattctactctgcataatctccaaatgctggga

SEQ ID NO: 42450 - DNA, 1380 bp, Anabaena PCC7120
ggcttgttttatgccacgcctgcccaagatgggatcttgtctcgcatcagaataccgggtggaattattaatagtacacaatgtcaggcgatcgcagatattgctgaccaatatggtggcggctatgtcgatgtgacaaatcgtgctaacgtccaaatccgggaaatacgcgccagcatagattctacagtcctcaagtatttgcaagatttgggtttgggttctagcaatgcaggcgtagaccaaatccgcaatattatgaccagtcccacggctggtattgatcctcaagaattaatcgatacccgccccttcgttagaagctgggataattacattactgaaaattctgtcttctcaggactatcggcaaagtttagcgtgtgttttgatggtgggggactagtttcggtaagcgatcgcctcaacgatatcacctttactgccactttagtagagaacaaagtttgcttccgtctgtgtttaagtatcggtgcaaaaggaaaaccgcctgttgacatcggaattttgttgttaccagaggaatgcttaccagtcttaacagccttggcggatgtttacttattgcatactgacgctagcagtaaacgcaagccccgtctgcgagaagtagtgaacagtttggggttaaataattatcttcaagaagctgaaaaacgtttaacgattccccttgggggaaagaacctaacccccctacccccttccctacgagggaagggggagaagacaaggcatttctcccctatccttgtagaagaggggttgggggggaggtcaaatagtaaataccaccacatcggcattcatccccaacaccaacaaaacttatattacattggtcttgttttaccccttggtcgtttggaaacttggcaagtcaggggtttagctgatttatctaccaaatatgggaatggaactctcaggctgacaccttggcagaacttgttgttaacagacattcctcaacaatcgctgactgacgttcagagtcaagttttggggttaggattagatttctcactcgcaaatatcaagagtggattagtagcttgttctggtattcaaggttgtgcggcggctgctacagatactaaaagtcatgccctcgcgctagcaaattatctagattctcacatcagtctagaacacccagtaactatccactttagcggttgtgataaatcctgcgcccaccacggcaatagtgatattactctactcggtgttaataatgaaatgggagaggggtatcaagtttatgtgggtgacggtgatagtaatgaaaaattcggtcgagaaattcacccctatataactgttgctgaattgccgacaacgatagagcgaatacta

SEQ ID NO: 42451 - DNA, 795 bp, Anabaena PCC7120
atagctagctgtggtagcgatcgcaccattaaaatttggcagttggctacaggtgaagatatttccagcttgaagggacactcaagaaaagtaaatgctgtagtttttagcccagatgggaaaaccttagttagtggtggtgacgataacactatcaaaatctggaatctgaaaaccgggaaagtaattcgcaccataacaggacatagcgatgcagttcataccctcgccatcagtcccaacggcaaaaccttagttagtggtagtgatgataacaccgttaaggtctggaatttaaacacaggaagattgattaataccctcaccggacatacattttgggtacgttccgttgctattagtcccgatggtgtgaatattgctagtggcagttttgataaaactgtgaaaatttggaacttagaaactggaactttaactcacacactggcgggaaatggcgaaacagtcacatcaattgcctttaatccagatggtaacactctggccagtgccagccgcgatcgcaccattaaaatttggaaggtaggcgcaggtactagagtccgtacattaaaaggtagtacagaaacaattacatcaattgcctttagccccgatggtaacaccctcgccagtgccagccgcgaccagactatcaagttgtggaatttagaaactggtaaggaaattcgcaccctagaaggacatgaaaatactgtgacaactgtggcttttactcccgacggcgcaaacctagttagtggtagtggagataacactatgagaatttgg

SEQ ID NO: 42452 - DNA, 1362 bp, Anabaena PCC7120
gatgtcgtgattattggcggcagtctcgcaggacgctatgccgcccttaccgccacccaaatgggggctaaagtggcattggtagaatcccagctaaataacagtttgattgttcaccaagccataggggaaattgccaacctaacccaaaatttgcataatttggctggctgtggcatcgatgctgtacaccctgatacttctgaaaagtgccaaatttccctaaaatgggcagcagcattgttttcggctcaaggtattgccgctaacgtccaagaacaaatgtctcttgctcacttgtcagcccaaggagtcgatgtcattgttgacagtggacaatttcaacgctcaccccatttagcttttgttgtaggtcagcgcctactacgcggtcgcacttatctacttgctagtggttccctaccagcaattcccaaaattgaaggattacaagctaccgactacctgacaccagcaaatatttggcaatatttatacaaacaacattctccatcttcggaactaccccaaaattgggtaattattggcggtactcctcaaagcatcgaaatatcgcaaactttagccagactgggttgcagtatcactttggtagttaaatctcttcatcttctacctcagcttgacccagaaattgcccagttgcttcaagcacagttagaaatcgatggtgtacgcatcctaactcaaaaaatggtgacacaagtcaagcgaatcgacgataaaaaatgggttcaggcaggagaaaaagcaatagaagctgatgagattctagtagcaattggccagaaaccaaatattgaatctttgaatttgccagaagtaggagtgaaatggcagcagcatcgtttactggtcaacgaaaaactacagactaccaatcaccgaatttatgcttgtggtgatgtcatttgcggttacgacttgcctaacgtagctaattacgaagctcgaattgctttgaacaatgctctgtttcttcccaggttgcaagttaattaccaaaatactccttgggcgatattatcccacccaactttagcccaggttggggtgacggagaaccaggcaaaacgccaatttagtcaacaagaagttatcgtcttgaggcattactataaatccatagcagcagcccaactgaaaaatgaaattacaggtatttgtaaattagtggtgctaggcaacggaaaaattttaggagctactatatttagtacacaagccagagagttaattaatctcattgctttggcaatgtctcgcaatatttctgtcaaacacttagggaatttatctgctgtctatccaagtttctcagaacttttagaacaaacagca

SEQ ID NO: 42453 - DNA, 1371 bp, Anabaena PCC7120
ataaaatttggtactgatggatggagaggcattattgccgatgatttcacttttcccaatgtgcgaaaagtgacaagagcgatcgccagctatctggaaacagcctacacaaaagatagaccagttctaattgcctacgatactcgttttttagctgatcagtttgcccagacagcagctcaagtcttggctgacttgggctggaatgtcaaagtcactgatcgggattgccccacaccagtaattgcttacaatgcccgtcacctgaattcggcaggggcattgatgtttacggctagccataatccagcaccctattgtggaattaaatatatccctgattatgctgggcctgccactccagaaattactgatactattgtggcaaatattgaaagtgcttcagatgaattgccaagtggcaaaccatcgggaacaatttctacttttgatcccaaaccggactatttacagtttatttacacattgctggatatagaacgaattaaaagcgctcaacttaaagtcaagtatgatgcgttatattctacatcccgtggctatttagatgaagtattgctagagagtggggtgcaattagaaagtttccacacttggcgcgatgtcctctttggtgggggaatgcctgaaccaaagggagaacagctagtggaattagtcgaagctgtccgccgcgatcatgcagatttaggactagcgacagatggcgacagcgatcgctttgggattgtggatgagctaggcaacgtcctcactcctaacactgtgttgttagttctagcgcggcatttaatcaagaataaaggcaaaacaggcgcgatcgtccgcactgtggctacaactcacctactcgataatttcgccgctaaatacggcttgacgatttatgagacagccgtaggttttaaatacattggggaaaaaatgcgggaaaccgccgtgctgattggtggtgaagaatcaggcggtttaagcattattgggcatattcccgaaaaagacggcgttttagctgatatgctgattgccgaagcgatcgcctatgaaggtaagcccctgagtcaattggtgaaggaagcgatcgccgaagctgatggccccttatataacaaccgtcttgacttacacttaacagaagctcataaagtcgccgtcatcgactcctttacaaaaaatcctccttccgaggtagctggaattaaagtgaaggaagtcggacgtaaggacggaattaagctgtatttagaagaaggtagctgggtgttgctgcgtccctctggtactgagcctttggtgcgtgtttacctagaaaccaactctcccgaaaaactcagcaaactagagcaagag

SEQ ID NO: 42454 - DNA, 600 bp, Anabaena PCC7120
acagtaattatcacaggcgcatctcaaggcattggcaaagccacagcattattatttgctcgtcacaactataatgttgtgctggcagctcgccaacttgatcgtttagaagcgatcgccacggagatacgggaaatgggacaacaagcgatcgccatttctaccgatgtgaaagatgctacacaagtcaataacatgatgcaaaaggcgatcgctcattttggtcaagtagatgtattaattaataatgcaggtatcttttgtttaggttctgtggaaaatttcagcttagaagattggcatcaaattattgatactaatttgtggggttatatccataccattcatgccatattgccccattttctccagcgtggtgcaggaactattgtgaatgtcagttctattggtggtttagaacctattccttatcatgtgccttacacagccagcaaatacgccataacagggttaacaaaatccctacacgcagagttatcacctaaaaacattcacgttagcggcatttatcccagcttcatcagcacccaacttatggaacgagccatttttcgtggtaaagatgaggaaatggctcag

SEQ ID NO: 42455 - DNA, 1725 bp, Anabaena PCC7120
atgctagagcatgatgtgattattgtcgggggtgggctggcgggatgtcgggcggctgtggaaattgcccgtactgaccctagtttaaatgtggcggtggttgccaaaactcaccccattcgttcccactctgttgcagctcaaggtggtatggctgcatcactgaaaaatgtagattctactgatacttgggaagctcacgcttttgatactgtcaaaggttctgattatttagcagaccaagatgcagtggcaattctgactcaggaagccccagatgtggtgatagacctggaacacatgggggttttattctcacgtctccctgatggtcggattgctcaacgggcttttggtggacactcccacaaccgcacctgttacgcagctgataagactggtcacgccattctacacgagttggtaaataatttgcggcgttacggtgtgcatatttaccaagagtggtacgtgatgcgcctgattttggaagaaaatgaggcgaagggtttagtcatgtacagcctattagacggacatattgaggttgtccgggctaaggcggtgatgtttgccacagggggttatggtcgcgtttataacaccacctccaatgattatgcgtctactggagatggcttggcaatgacagcgatcgccggtttacctctggaagatatggagtttgtccaattccatcccacgggtttgtatccggtgggtgtcttgatttccgaggctgtacggggggaaggggcgtatttaattaatagtgaaggcgatcgcttcatggcgacctatgcacccagtcgcatggaactagcaccccgcgatattacctcacgggcgatcgcttatgaaattcgggctggacgtggtgtaaatttggatggtagcccaggcggcccctttgtctatctggatttgcgccacatgggcaaagaaaaaatcatgagtcgcgttcccttctgttgggaagaagcccaccgcttagtcggtgtggatgcagtcactcaacccatgccagtccgtccgacaattcactattgtatgggtggtatccctgtaaacactgatggtagagtccgcagtagtggcgatggcttagttgaagggttttttgcggctggtgagacatcttgtgtatccgtccacggggcaaatcgtctcggtagtaattcgctattagaatgtgtagtctatggtaaacgaactggggcggcgatcgctcaatatgtgcagaaacgtaaattacctgccatagatgaacaacgttacatcaaacaagcccagcaagaaatccaagccctactggaacagccgggagagtaccgaatcaaccaagtccgccaagctttccaagatgcgatgacagattactgtggcgttttccgtactcaagagttaatgagccaaggttggcaaaaaattacagaaatacaacaaaaatacagtcaaatatacttagacgataaaggcagttgttggaatactgaactagtagaagctttagagttgcggagtttaatgatagtcggacagacgattttagcctctgctttaaatcgtcaagaaagtcgtggcgcacatttccgcgaagattacccacagcgagatgataccaagttcctgcaacacacaatggcttactattcacccgccgggattgacattcaatatcgcccagtcaccattaccatgtttgaaccacaggagcggaagtat

SEQ ID NO: 42456 - DNA, 2133 bp, Anabaena PCC7120
atgggcaaggtagtcggcatcgacttgggtacaaccaactcagtagtcgccgtgatggagggtggcaagccggtggtgattgccaatgcagaaggaatgcgaacaaccccctcggtcgttggcttcagcaaagatggtgaaagggttgttgggcaaatggcacggcgacaaacagtcctcaatcctcaaaatacattttttgccgtaaaacgctatatcgggcgcaggtataacgaacttagcccagaatcgaagcgtgtaccttatacaattcgcaaagatgaagttggcaatattaaagttgcctgtcctcgtctcaataaggaattttccgccgaagagatttcggcaatggtgctgaaaaagttggcagatgatgccagtgcttatttagggtcagcagttacaggggcagtaattacagtaccagcttatttcaatgattcccaaagacaagccacccgcgatgctggcagaattgccggtttagaagtgttgcggattctcaacgaaccgacagcagcgtctttagcttatgggttagaccggggtgatacggaaaccatcttagtttttgacttgggtggcgggacatttgatgtatcgattttggaagtcggggatggagtatttgaagtcaaagccaccagtggcgatacccaactaggtgggaatgactttgataagaaaattgtcgattggttggcagagcaatttttagagacagaaggtgtagacttaagacgcgatcgccaagctttgcaacgtttgatggaagcggcggaaaaagctaaaatcgaactctcggctgtcagcatcactgatattaacttacccttcatcactgctacagaagacggccccaaacacttagaaaccaggctgacgcgttcccagtttgaaggtttatgtgttgacttattaggacgcgtccgtaaccccgtgaaacgggcgctaaaagatgccggactcagacctgatgatattgaagaagtcgtactagttggcggttccacaagaatgccaatggtaaaacaactggtgcgggacttaattggcattgaacccagcgaaaatgtcaaccctgatgaagtggtggcgatgggtgcagccattcaagcggggattctggcaggagagttcaaagatgtgctgctgctagatgttacacccttatctttgggattggaagcgatcggtggcgtgatgaaaaaactcatcccccgcaataccaccatccctgtccgccgttctgatattttctccacttccgaaaataaccaaaactccgtggaaattcacgtagtccaaggtgaacgggaaatggcaggtgataacaaatctctaggacgtttcaaactttacggcattccccctgcaccacgaggtattccccaaatccaagtagcatttgatatcgatgccaacgggattttacaggtaacagctttagacagaaccactggcagagaacagagtatcaccattcaaggtgcttctaccctaagtgaatcagaagttaaccggatgattcaggaagcccaaaaatatgctgacgttgaccgggaacgcaaagagagggtagaaaaacgtacccgttctgaagccttaatcctccaaggagaacgccagctaagggaagttgctttagaatttgggatgcagtttgctcgtaatcgccgccaacgcattgataatattagccgggaattaaaggaaagtctcaaagaaaatgacgatcgcgggattgaccaagcctacgccgatctgcaagatgctctatatgagctaaatcgagaagttcgtcagtattatgctgaagacgaagacgacgatttatttgccacgatcaaagacatctttgtgggcgataaagacaaggaacgcgaccttcccagagatagctatcgagaacgggatgcttacaataacagagattatggcagagactatggcagagattacggacgagacagtcgtccttcctatgacaacagccgccctcctcgtaaatcaccccgccccagctatcaggataattgggacgatgatgatgattggctatagatgaggaatagggaggaatcaattcaaaatagcctatggtatcgcgtagcatctcctagagaaggc

SEQ ID NO: 42457 - DNA, 993 bp, Anabaena PCC7120
atgcagaatttgcagaattttcgtgattattacgagattttgggagtaacgaaagatgctactaatgaagatattaaaaagaattatcgacggttagcaagacagtatcaccctgatctcaatccggggaataaagacgcagaagaaaaatttaaaatcatcggcgaagcttatgaaatgctttccgatgcgactaaacgcgcacaatatgaccaatttagccgttattggaaacagaaaggctttcctaaacaaactcctaaatccaaggcttggggagatagtcgtaatggagaacgcaacggtaatgaaaatgtagatcccagccagtttaccaattttgaagattttctgaatcaagttatcggtgttggcagtcgtagagatagcaaaaatggtgcaagtaccaacacgacaaccgatccgtttcgttcgccaaaaagccgagttgaatatacagttcccaaaaatccctctcgtccagcccgtcgggatattgaagcaagattgaccttaccctttgaaaaagcttattctgggggtaatgaacgtattcgtttagaggatgggcgatcgctagaagtaacaatgcccccagggatggtaacaggtcaaaccatccgcctgcgtaatcaaggcataagcggcggcgacctctacttaaaaattaccgtcgaacctcacccactatttaaactagaaggtactaatatattctgccaagtaccagtcactcccagcgaagccgtcttaggaggacaggtagaagcaccaaccctagacggccccgtaaaaatgaccattcccccaggagttaggtctggtcaaagattccgcctggccaataaaggctatcccagcgataacggtaaacgtggtgatcaattagtagaaattcaaatacttaccccgaaaacgatcagtcaagaagaaaaagaactttacgaaaaactccggcaaattgaaacatttaaaccccgcgctgatttaatt

SEQ ID NO: 42458 - DNA, 1323 bp, Anabaena PCC7120
acaaatacaaatatttctcccaaccaggaacttttacctctaactgctaaagctaacagtcaaggaaacctggaaattggtgggtgtgatgtcacaactctagttgagcagtttggttcacctctatatatattagatgaagaaaccctacgcacagcttgtcagcaataccgggatggtttccaaaaatattatcctggagaatctcaggtattgtatgcctctaaagcatggaattgtttagctgtttgtgcgatcgcagcctcagaaggtttaggaattgacgtagtttcgggaggcgaactctacactgctctagctgctggtgtgagtcccgctaaaatctacctccacgggaataataaatctcgtgaggaactggttttagcaattgaatctggtgtaacaatcgttgcagataattggtatgaattgcgtatattggcgagtttagccgactcagaagagccaatccggctcatgttgcgcttaactcctggtatagaatgtcatactcacgaatacattcgcacaggacacctggatagtaaatttggctttgaccccaacgatttggctgaggtttttgagtttgttagccagcaaccaaatctcaactgcgtaggattacacgctcatattggctcgcaaatttttgagcgccaaccccatcgagatttagctgctgtcatggtgcagtggttaagggatgcgaataaatatggtttgaatgtcaccgaattaaatgttggtggcggtttgggaattaaatatgtagaatcagacgatccaccaagcattgatgagtgggtgaaggcgatttgtgaagtagtgcaagcagcttgtgcagccgaaaacttgcctttaccaaagctattatctgaaccagggcgatcgctcattgctaccagctgcatcaccgcatacactgttggctcatctaaaacaataccggaaatccgtacctacgtttccatagacgggggtatgtctgataatccacgcccaattacttaccagtcagtttatcgggcagtaattgccaataaattatctgccccccatacagaaacagttactattgcgggtaagcattgcgaatcaggggatattctgattaaaaatgcccaactaccaaaaactgaaccaggcgatattctcgtagttatggcaactggtgcgtacaattacagtatggcctctaactataaccgcctaccccgaccggcagcagttgtagtggcaaatggcgaagcaaacttaattttgcaacgcgaaacttatcaagacttaattcggcaagattgtttaccagaaagactt

SEQ ID NO: 42459 - DNA, 2451 bp, Anabaena PCC7120
atgtttgaacgcttcacagaaaaagccattaaggtaatcatgctggcccaagaagaggcccgccgtttaggtcacaacttcgtcggaaccgaacagatcctcttgggtctgatcggggaaggtacgggagttgcggccaaggtgctgaaatcgatgggtgtcaatctcaaagatgcccgcattgaggtagaaaaaatcataggccggggttcaggctttgtggccgtggaaattccgtttacgccacgggcaaagcgggttctggaactatccctagaagaagcgcgccaattaggccataactacattggcaccgagcatctgctgttgggcctgatccgggaaggggaaggtgtggcagccagggtgctagaaaacctgggggtggatctatctaaagttagaactcaagtcatccgaatgctgggagaaacagcagaggtttcggcgaccgggcaatcgggacgcaccaaaacacctactttggatgaattcggatcgaacctgacccaaatggcaactgataacaagcttgatcctgtggtgggacgcgccaaggaaatcgagcgagtgattcagattttgggtcgccggacaaaaaataaccccgtattgattggtgaacctggggttggtaaaaccgcgatcgccgaaggtctagcatcacgcattgctaacaaagatgtccccgacatccttgaagataagcgtgttgtcactctagatatcggtctactggtcgcaggcaccaagtaccggggtgaatttgaagaacgcttgaagaaaatcatggatgagattcgtcaagcgggtaatgtaatacttgtaatagacgaagtacacaccctcatcggtgcaggtgctgccgaaggtgcgattgatgcggcaaatatcctcaagccagccttggcaagaggtgaattgcaatgtatcggtgcgacaaccttagatgagtaccgcaagcacatcgaacgggacgcagcgctagaacgccgcttccagccagtgatggtcggtgaaccctccgtcgatgaaacaatagaaattttatatggtttgcgcgatcgctacgagcaacaccacaagctgaaaatctccgatgaagctttagtcgcggcggcgaaattatctgatcgttatattagcgatcgctatctgccagacaaagccatcgacttggttgacgaagctggttcgcgcgtgcggttgatgaactctcagctgccccccgcagccaaagagttagataaagaactgcgccaaatcttaaaagaaaaagatgatgcagtccgttcccaagactttgacagagctggggaactgcgcgatcgggaaatggaaatcaaagccgaaatccgcgcgatcgcccaaagcaagaccaatgcttctggtaccgaaggtcaagaacctgtagttacagaagaagacattgctcacatcgtggcttcgtggacaggcgttcccgtcaacaagctcaccgaatctgaatccgaaaagctgctgcacatggaagataccttgcaccagcgcttaatcggacaagaagatgcggtaaaagcagtttcacgggcaattcgtcgcgctcgtgtcggtttgaaaaatcccaaccgacccattgctagctttgtcttctctgggccgactggtgttggtaaaaccgagttggcgaaatccttggcttcctacttcttcggttccgaagaagcaatgattcgcttggatatgtccgagtacatggaacgccacaccgtcagcaagttgattggttcacctcctggttatgttggttataacgaaggtggtcaattaaccgaagctgtgcgccgtcgtccttacacagtggtgctgttcgacgaaatcgaaaaagcccaccccgatgtcttcaatatgctgctgcaaattttagaagatggtcggttaacagatgcgaaaggacgcaccgtagacttcaagaacaccttgctgattttgacatccaacatcggttccaaggtaattgaaaaaggtggtggtggtatcggcttcgagttctccgaagatcaaaccgaaacacaatacaaccgcattcgctccttggtgaacgaagaactgaagcaatacttccgtcctgagttcctcaaccgtctagacgagattatcgtcttccgtcagttgagcaagctagaagttaccgaaattgcggacattatgctcaaagaagtgtttggtcgcctcaccgaaaaaggtatcactttagaagtaagcgatcgcttcaaaggacgactcatcgaagaaggttacagtccgagctacggtgcaagaccgttacgtcgggcaattatgcgcttgttagaagatagcctagcagaagaaattctgtcaggtcgcatcaaagatggcgatgtcgccctcattgatattgatgaaaacggcaatgtgcaagttacttctcaacaacgccgggaattatta

SEQ ID NO: 42460 - DNA, 1482 bp, Anabaena PCC7120
tcaaaataaaaacataagattatgcctacttttccttctgatcctttatttcagtatcaatggcatttatacaactacgattggtttactggtactcgtggtcttgacctcaatgtagtcgatgtttgggatgactataccgggaggggtgtgacggttggtgtatttgaagggggtggtgttgaatacactcatcctgatttagctcccaattacaatactgctattgattatgatggcgttaccaacggtggtaatccttaccctctagctggagaaagcggtcatgctacttctgttgcgggtgtgattggtgcagctgcgggaaatggtattggtggggtgggtgtagcttatggttcaaccttagcttccttccgatttagttacaacaattctgatagtatgattcgggcattgcagcgcctacgcaatgtggatgtcgctaataatagttggggtagcacatcaatttttggggctgattttcttaatcctggatatgctccagtagttcaagctattcgggatgctgtccagtttggacgcaatggattagggactgcaattgtctggtcagctggaaattccagagaagagggtttaaataccaattattccaacttttccaactctcgccacgtcatttcggtagcagcgcttgaatatgatggtacagcttccttttatagcactccaggggcttctattctagtttcagcttttggcagtggggttcctggtagtattgtgactacagaccgtagaggatcagaaggttctagtttaggagactataactacgagtttaacggcacttcagcagcagcacctgaagtttctggggtagtcgccttaatgctggaagccaatcggaatttaggttatcgagacatacaagaaattctcgcctattccgcccgccagaatgatttctataacgtagggggaaattacatttggcaaattaacggtgctaacaattttaatggtgggggtttacacgtcagccatgattatgggttcggtttggtagatgcgcttgctgctgtgcgtttggctgagacttggcaaaaacagagccgattcaacaacgagcagtctctttcttacagttcaggtaatctaggtttgactgttcctgataacgatgaggcaggaattagtcacacttttacggtggcggctggcttagaaattgactgggtagaagtagaacttaatctgactcatccttatcggggtgatatagttgtttacctgacttctccgagtggggttcagagtgttttggttcatcaacctggtaataaggaagatgagggagacaatattgtgtttaaactctccagtacgcaacactggggagaaaccagcgctggcaattggacactgacaatacaagatttaggcccctcagatatcggcatttttaatagttggaaattaaatttatacggcgatgctgatactatcaatgac

SEQ ID NO: 42461 - DNA, 1206 bp, Anabaena PCC7120
actccctaagagttctttaattttgaattttgaattttgaattttgaattttgaattgctatgcccgatccctatgcttggttacaaaactcactcctaaccatccatcgggcagattggtatcgttcagtgcaagcaatacagggtcgtgctggcgcaagcgtagttttagggggtcaggaggtaattaattttgctagtaatgattatttggggttggctggggatgaacgcttaatagctgcggctgtagctgctactcaagaatttggcactgggagtactggttcgagattattgagtggacatcgagaactgcatgggcaattagaaaaggcgatcgcctcttggaaacaaacagaagacgcgttagtgtttagctcaggctatctggctaatataggagcgatcgcagctcttgtcggcaagcgtgatttaatcttatctgaccaatacaatcattccagtctgaaaaatggagctattctcagtggggcgacagttagggaatattcccactgtcaggtaggggaactgaaaacccaattacttgagcaacggcaaaactaccgacgttgtttaattttgacggatagcgtcttcagcatggatggggatttatgccctttaccagatctattagatttggctgaagaatttagttgtatgctcctagttgatgaagctcatgctactggagtgatgggtgaaactggtgctgggtgtgtagaacattttgggtgtacaggtaggcaattaatccaaattggtacattgagtaaagccttaggtagtctaggcggttatgtaacaggaagccacaacctgattgactatttgcgaaaccgcgcccctagttggatatataccacagggttatcacccgcagatacagcagcagccctagcagcaatcaatatagctcaacaagaaccacaacaccgaatgcagttatggcacaacgttaattacttgagagaattattacagaaaataccaaacctcaaattactaccatcagcatcgcccatactatgttttcagttgtcaagtcccagcgaagcgctacaagtgggtaagcaactaaaacaagcaggaatcttcgccccagcaattcgtccccccacagtccccacaagtcgcatcagaatatccttaatggcaactcataaagcatcacatatagaaaaattagtggccgtattg

SEQ ID NO: 42462 - DNA, 1758 bp, Anabaena PCC7120
atgcaattaagagattctgtacgccggacaaaaatcgtcgctacaattggccctgccactagtagccccgaaatgctgaaagccatcattgaagcgggtgcaacaacgctgcgactcaacttttcccacggttcccacgccgaccatcagcgtagtattcgcctaattcggcaaaccgcttttgaactaaatcagccagtggcaattctccaagatttgcaagggccaaaaattcgcttgggaaagtttgaaaacgggtctatagttttagctaaaggcgatcgcttcaccttaacaaatcgcccagttgttggtagtcaagaaattagctgtgtcacctacgattatttggcagatgaggtccctgtaggtgcaaaaatcctcctggatgatggccgtgtagaaatggtggtagaggatatcaaccgcgacaaaggggatttgaactgtcgggtgactgtagcaggtaagttatctaataacaaaggtgttaactttcctggcgtttatctctcaattaaagccatgaccgacaaagatcgtgaggatctgatgtttggtctagatcagggtgttgattgggtagccctttcctttgtccgcaatccgcaagacatcattgaaattaaagagctaatttccagcactggtaaacaagtgccggtagttgccaaaatagaaaagcatgaagcgatcgaacaaatggaagcagttctcgctttatgtgatggcgtaatggtggctagaggcgatttaggtgtagaactaccagcagaagatgtccccgtactacaaaagcgcttaattgccacagcaaaccgcttggggattcccatcatcactgctactcaaatgttagatagcatggtgagcaatccccgtcccacccgcgcggaagtgtccgatgtagccaatgccattcttgatggtacagatgcggtcatgctctccaatgaaacggctgtgggtagctacccagtggaagcagtggcgacaatggcaagaattgccgaacgcatcgagcaggaagaagctatggctagtaaattacgccaaatgcgagataaccgccgttctattcccaacgccatcagccaagctgtaggtcaaattgctgaacagttgggagcagcagcaattatgactctcacccaaacaggggcgactgcacgcaacgtttccaaattccgcccccaaacaccaatcttggcagtaacaccccacgttaacgtagctcgtcaactacaaatggtgtggggcgtaaaacctttgttggtcttagaattaccttccactggtcaaactttccaagccgccattaacgtcgcccaagagcatagtttactgtttgaaggtgatttagtcgtgatgacagccgggacgttacaaggggtatctggctcaacggacttgattaaagttgaagtggtaacggcagttctaggacagggaattggtctaggacagggtttggtaagcggttgtgctagggttgctcacaccgggatggatgtggggaactttaacgctggtgatattttggttgcaccccgcacaggtgcagattttgtcgaggcgattcgcaaagccggcgggattattacagaggatgaaagtttaactagtcatgcggcggtgattggtttacgcctgggtgtgccggtgattgtaggtgtgaagaaagccacgcaagttatccgtgatggagcaattttgactctggatttgcaacgaggtttagtttattccggagcagta

SEQ ID NO: 42463 - DNA, 615 bp, Anabaena PCC7120
aacacagttttaatcactggaggtgcatcaggaattggtttggcactagcacacaaatttctgcaagcgcaaaatacagtgataatcactggacggaatgctgaaaaattagctggcgtaaaggcattatggccggaaattctcactgaagttgctgatttacaggatttaaatatcttgcaaaagctagtcaatcgttacccaaatgtgaatatcctgatcaacaatgctggcattcaatataactacgaatttaccaatccagaaattaccccagagttaatcgaagcagagttacgaactaacttaattgcgccattgcaattgattaaactgatgttaccccatctgttgaacaagcccgaagccgcgattataaatgtttcctctggcttaggattagttcccaaagaaagcgcacctgtctactgtggtagtaaagcagggatacatattgctactaaagccttgcgctggcaactcgaaaccacatctattaaagtatttgaaattatcgcgcctttagttgatacacccatgactcaaggacggggtaaagggaagatttcccctgatgcactggtaaatgaattttggcatgattttacacgcgat

SEQ ID NO: 42464 - DNA, 1527 bp, Anabaena PCC7120
atggttagtctcctagaaaatcccttgcgcgttggtctgcaacaacaagggatgcccgaaccccaaattatagtcatctttggcgcttctggtgatcttacctggcgcaaactcgtcccagcactttacaaattgcggcgggaacgacgcattcccccagaaactaccattgttggtgtagcccgtcgggaatggagccacgaatacttccgcgaacaaatgcaaaagggcatggaagaggctcatagcagtgtcgaacttggagaactgtggcaagatttctctcaaggtctgttctactgccctggagacatagataacccggaaagttatcaaaaactgaagaatttgttaagcgaattagacgagaaacgaggtacacggggcaaccggatgttttacctctccgtcgcccctaacttcttccctgaagctatcaagcaactagggggagcaggaatgttagacgacccatacaaacatcgtctagtaattgaaaaaccatttggtagagatttggcatcagcccaaagcctgaacgcagtagtgcagaagtattgtaaagaacaccaagtctaccgcatcgaccactacttgggtaaagaaacagttcaaaacttactggtattccgcttcgccaatgccatttttgaacccctgtggaatcgtcagtttgttgaccacgtacaaattaccgtggcagaaaccgtaggcgtggaagaccgggctggttattacgaaaaagccggcgcactgcgggatatgttgcagaaccacctgatgcagctttattgcctgacagcaatggaagcaccaaactcaatggatgccgatagcatccgtacagaaaaagtcaaagtgttacaagctactcgcctggctgacgtacacaacctatcacgttcagcaatacgcggacaatacagcgctggttggatgaaaggtcaacaagttcctgggtatcggacagaaccaggagttgacccaaattcctccacccctacttatgtaggtatgaagtttttagttgacaactggcgttggcaaggtgttcctttctacctgcgtactggcaaacggatgccgaagaaagtcagtgagatttctatccacttccgcgatgtgccttctcggatgttccaatctgccgcgcaacaaagaaacgccaacattttagctatgcggattcagccaaatgaaggaatttccttgcgttttgatgtgaaaatgccaggagccgaattccgtacccgttccgtagatatggatttcagctatggttcctttgggattgaagctacttccgacgcttacgatcgcctattcttagattgtatgatgggcgaccaaacattattcaccagagccgacgaagtagaagcagcttggcaggtagtcacccccgccctttctgtttgggactcacccgccgaccccgccaccattccccagtacgaagccggaacctgggaaccagcagaagcagaatttctgattaaccaagatggtcgtcgctggcgcagactg

SEQ ID NO: 42465 - DNA, 1047 bp, Anabaena PCC7120
atggctaaagcctcagaatccttggatttgtctgtcaacgagtctacagataaagctctagaccgcgattgtacaaccttatcccgtcacgtcctccaacaactccaaagtttttccgcagatgcacaagatttgagtgcattaatgaatcggattgctttagcaggtaaattagttgcccgtcgccttagccgcgctggtttaatggaaggggttctcggatttactggggaggtaaatgtacaaggtgaatccgtcaaaaagatggatgtctatgccaatgacgtgtttatctcagtgtttaagcaaagcggcttagtttgtcgtcttgcatctgaggaaatggatgaaccatattacattcccgaaaattgccccataggtcgttacaccttactgtatgacccaatagacggttcctcaaacacagatacaaatctcagtttgggttccattttctctatccgtcaacaggaaggtgatgatagtgatggccaagctaaagacctcctcaccaacggacgcaagcagattgcggcgggttacattttatatgggcctagcacgatgctagtttatacaatgggtacgggagttcactcatttacccttgatcccagcttaggagaattcatcctcagcgaagaaaatatccgcattcccgaccacggcgcagtttacagcgttaatgaaggtaacttctggcaatgggaagaatcaatgcgggaatatatccgctatgttcaccgtacagaaggttacacagctcgttacagtggtgcaatggtgagcgatatccatagaattttggtacaaggtggtgtgtttctctacccagggacgattcaaaaccctgaaggtaaattacggttgttgtatgaatctgctcctttagcctttttaattcaacaagctggtggtcgggcaactacgggattagtagatatcttagatgttgtaccgaaaaaactacaccaacgtacacctctgattattggtagtaaagaggacgtagccaaggttgaatcatttattcagaatggtcat

SEQ ID NO: 42466 - DNA, 720 bp, Anabaena PCC7120
ttaacaactcacaatctgactattggttataaaacatccagaaaaaatgttcggtgtgttgcatcagatatttcggtatctctgcaatctggggaaatggtttgcttacttggccccaatggtgcgggtaagtctacattactgcgatcgctcgccggaatgcaacccccaatagccggagaagtccgactcttaggcgaaaacgtctatcatttacaaccacagaacttagccaaacgtatgagtttggtactgactgagaaagttgatgtaggaatgctatcagcctacactttggtgagtttgggacgacatccttatactgactggtgggggaggttaactcctgaagatgaagcaatagtacattgggcgataaaatctgtaggagcagtacacttagcacaacgccaagtcagtgaattaagtgatggtgaacgccaaaaaattatgattgcgcgtgctttggcgcagtcgccgatggtgatgttattggatgaaccgacggcatttttagatttaccacggcgggtggaaattatgcaattgttgcgtcaattagcacgagaaactaatcaagcaattctcctttctacccacgatttagatttagctttgcggcttgctgataaagtttggctattatcaactggtggaattttacaggttggcgcacctgaagatttggtgttaagtggtgcttttgctgatactttccgc

SEQ ID NO: 42467 - DNA, 1443 bp, Anabaena PCC7120
atggtcaccaccgcagaaaaaacaaacatcggttacattacccaaatcattggtccggttgtagacgttaaattccctaacggaaaattaccgcaaatctacaacgctctgaccatcaaaggcactaacgaagctggacagcaactcaacctcaccgtagaagtacagcaacttttgggcgacaaccaaatacgcgccgttgctatgagttccacggatggtttagtccgtggtctggaagtcgtcgatacaggcgctcccatcagcgtacccgttggtaaagcaactctcggacggattttcaacgttcttggcgaacctgtagacaacagaggcccagtcaacaaccaagaaaccctacccatccaccgtccggctcccaaattaaccgaactggaaactaaaccttccgttttcgagaccgggattaaagttgttgacctcctcacaccctatcgacgcggcggtaaaattggtctgttcggcggtgcgggtgtcggcaaaaccgtaatcatgatggagttgattaacaacattgcaacccagcatggtggcgtgtctgtgttcgctggcgtgggagagcgtacccgtgaagggaatgacctctacaacgaaatgattgaatctggggtaatcaacaacgaaaacctcaacgaatcgaagattgcgttggtgtacggtcagatgaacgaaccacccggagcaagaatgcgggttggtttgtctggtttgacaatggctgaatacttccgtgatgtcaacaagcaagacgtattgttgtttattgacaacattttccggttcgtacaagcaggttctgaagtatcagcgttgttgggtcggatgccttctgctgtgggatatcagccaactttgggtactgatgtaggtcaattgcaagaacggattacatctactaccgaaggttctattacctcaattcaagctgtatatgtacctgcggatgacttgacagaccccgcacctgcaaccacctttgctcacttagatggtacaactgtactatctcgtggcttggcatctaaaggtatttatcctgcggtagatccgctaggttccacctctaccatgttgcaacccaacattgttggtgacgaacactacaatactgctcgtgctgtccaatcgaccctgcaacgctacaaagaattgcaagacatcatcgctattctgggtctagatgaactgtctgaagaagacagactcatcgtagcacgggcccggaaagttgagcgtttcttgtctcaacccttctttgtcgctgaagtattcacaggttctcctggtaagtacgtgaagttagaagacaccatcaaagggttccagaagattctatctggtgagttggatgatctgccagagcaagccttctacttggtaggcgacatcaacgaagcgatcgccaaagccgaaaaaatcaaa

SEQ ID NO: 42468 - DNA, 1371 bp, Anabaena PCC7120
accaaaacaatcgaagttcgtaatccacgtacgggaaaatttgattatgtgattataccgccgccgccgaggttgctagcacagcaatgtaatcgggcgagacgggcgcaatctcgttggcaagaattgggtgtggaaggaagaatcacagctttacagcaatggaagcaagctatactttcccgacgtgaacaactaacagaagctttggtaaatgatacgggtagattatctataactgtattagaaatcgattcttttatcgctagtatcgatcgctggtgtggtttagcgccagaattactacaagagtctgccaaaaataccagcattccctttatcgctttacaacaatcattagttccttaccccctcgtcggcgtaattagtccgtggaattttcctttgttgctgtcgatgattgataccattccggcgttgctggcgggttgtgcggtggttgtcaaacccagtgaaatagctcctcgatttgttgcgcctctgttgatggccttaaatacagttcctgagttgcgcgatatcttaacttttgtggagggaggcggagaaactggggcaaatttaattaattatgtcgatttggtatgttttacgggtagtgtagctacaggaagagaagtcgcagaaaccgcagctagacgctttattccagcttacttggaattgggaggcaaagatccggcgatcgttttagagtcagccaatttagatttagctacctcagctattttgtggggtgcggttgtgaatacaggacaatcttgtttatctattgaaagaatttacgtagctgaatctagatttgaagagttttatcatcaattaatagctaaagcccatcgtctacaactagcttaccctttagtagaagatggagcgatcggccccatcattgctgaaagacaagccggaattgttaacgatcatattttagatgcagttgagaaaggggctgtcattcactgcggcggtaaagtcgaagaattaggtggcggttggtggtgtcgtcctacagtcatgacaaatgttaatcactccatgaaggtgatgactgaagaaacttttggcccaattatgccggttatgccttttcccgacgtggaagaagccgtatatttagccaacgacacaatttatggattaagtgcggcggtgtttgcaggttcagaagatgaagctttaaaagttgctcgacaattaaatgcaggtgctatcagtattaatgatgccgctcttactgctgtgatgcacgaaggagaaaaaaacgcctttaacttttctggtcttggtggttcgcgtatgggtgcatcagggttgaagcggtttttgagaaaacaagcatttttgatt

SEQ ID NO: 42469 - DNA, 225 bp, Anabaena PCC7120
gaaacttttgaaaaagtcaaaaaaattgttatcgaacaactaagtgtggagaaccctgacacagtaactccagaagctagttttgccaacgatttacaggctgattccctcgatacagtagaactagtaatggctttggaagaagaatttgatatcgaaattcccgatgaagccgcagagaaaattaccactgttcaagaagcggtggattacatcaataaccaa

SEQ ID NO: 42470 - DNA, 1245 bp, Anabaena PCC7120
atgacagattataatcgtaaacgcgttgttgtcacgggtgttggcgcgattacacctattggtaacacagcctctgaatattgggaaggattgttaagcggacgcaatggcattgactacatcacccactttgatgcgtctagccatgattgtcggattgctggtgaagtgaaaaacttcgacccccatgagtacttggagcgcaaagaagccaagcgcatggatcggttttcccaatttgcagttgcagcagccaaacaagcacttgtggattcccagttagtcattaatgaactgaacgccgaacaagtgggggttattattggttctggggtaggcggactcaaggtcatggaagaccagcaaaccatctatctcaaccgggggcctgatcgctgtagtcccttcatgattcccatgatgatcgccaacatggcggctggactgacagcaattcacactggtgccaaagggccaaataactgtactgtcaccgcttgcgccgcaggctctaatgcgatcggcgacgctttccgcctagtccaaggtggttatgcccaagccatgatttgtggtggggctgaggcagcaattacaccattaggtgtggctgggtttgcggctgcaagggcgttatcaactcgcaatgatgacccagctcatgcttgtcgtccctttgaccgcgatcgcgatggatttgtcatgggtgaaggtgcgggaattctcattctggaagagctgcaacacgccataagtcgcggcgctcgcatttatgccgaaatcgttggttatggtatgacttgcgatgcctaccacatgacatccccagtccctggcggcgaaggagcctccagagccatccaactggcactcaaagacgcaaacatcaccccagaacaagttagctacattaatgctcacggtaccagcacctcagcaaacgataccaccgaaaccgcagcgattaaacgagcgctaggagaccatgcttataaaatagcagtcagctccaccaaatcgatgacaggtcatcttttgggtggttctggcggtattgaagctgtagccacagtgttggcaactgctcatgaccaaattccacctacaattaatattgaaaaccttgacccagattgtgacctagattacgtgcctgactctagtcgcgctcacaaagtccaggtagcattgtctaattcttttggatttggtggtcataatgtcacactagctttcaaaaagtac

SEQ ID NO: 42471 - DNA, 2007 bp, Anabaena PCC7120
atggctgttgcaacccaatccctcgaagaactttctattaatgcgattcgtttcttggctgttgatgccatagaaaaggcaaaatcgggacaccccggactaccgatgggcgcggctccaatggcttttgtgctgtggaaccgctttatgcggtataacccgaaaaatcccaaatggtttaaccgcgatcgctttgttttgtctgctggtcatggttccatgttgcagtatgccctgctctacctgacaggctacgatagcgtcagcattgaggacatcaagcaattccgccagtgggaatccaaaacccccggacacccagaaaacttcatgaccgcaggtgtagaagtcaccactgggccactaggtcaaggtattgccaatggtgttggtttagcgatcgcagaagctcacctcgcagctaagttcaacaaacccgatgccaagattgttgaccattatacctatgtaattttaggtgatggttgcaacatggaaggcgtttctggtgaagcagcctcttttgctggacacttgggattaggtaaactgatcgctctgtacgacgacaaccacatttccatcgatggttctacagatgtagcctttaccgaagatgtttccaagcgttttgaatcttatggctggcacgtcatccatgttaaagatggcaacaccgatttagaagcaattcacaaagctattgaagaggcaaaagctgtcaccgataagcccaccatgattaaggtgacaaccattatcggttacggttcccctaacaaatctaatactgccggggttcacggtgcagcattgggtggagatgaagtagccttaactcgtcaaaatctaggttggtcacacgacccatttgttgttcccgaagatgtcctcaactatacccgtaaagcagtagagcgcggtgcaggctacgaatctgactggaacaaaacctacgcagattacaaagctaaatatccccaagaagcggctgaatttgagcgttacttaagcggcaaactggctgatggttgggataaggtactaccatcctacacccccgaagataaaggacttcccacccgtaagcattcagaaacctgcctcaacaaattggcggcggttctacctgaactcattggtggttcggctgacttgacccattccaacctcaccgaaatcaagggcaaaggcgacttccaaaaaggacaataccaaaatcccaacatccactttggtgtccgggaacatggtatgggcgcaatctgtaacggtattgcgctgcatggttcgggattaattccctatggcgctaccttcttaatcttcagtgattatatgcgcgctcccatccgtttatctgccctgtctcaagccggctcgatttgggtgatgacccacgattccatcggtcaaggtgaagacggcccgacccaccaaccaatcgaaacgctggcctcactccgtgctattcctaacctgacagtaattcgtcccgccgacggtaacgaaacctccggcgcttacaaagtagcaattgagagagctaagaacaacgctcctactttgttggcgtttactcgtcaaaatgttcccaacttggcaggtacatcgattgatgacgtagctaagggcggatacattgttgtagataccgatggcacaccagatttaatcctgattggtactggttcagaattgagcctctgtgtcaccgcagccgagaaactcaaagctgaaggcaagaaagttcgtgtagtctccttggctgcttgggatttgtttgatgcacaagatgcagcttacaaagaatcagttctacctaaagctgtcaccaagcgtttagctgtagaagcggctagcagcttcggctggcacaaatatattggtagtgaaggcgatgctgtaactatagaccgcttcggtgcttctgctcctggcggcgtttgtttggagaaatttggttttagcgttgataatgtattagctaaagctaaacaattgttg

SEQ ID NO: 42472 - DNA, 576 bp, Anabaena PCC7120
aatcctacagctaagtacacaattatttatgctcatgggaatgcagaagatttaggcgagattagacaatttctagaacaattaagagacttagggttcaatgtgttggcttatgattatcggggttacggtacaagcgcaggaagacctacggaaaataacgcttatcaagatattgatgcagcttacaactatttaaccaaagatttaaaaatactaccaaagaatattattgtttttggacgttcagtgggaggaggttcagcagtagatttggcggctcggcagccagtaggaggtttaattatagaaagtacctttacttcggcttttcaagttgtagtaccaataaaaattttgccatttgataaattcaataatttagaaaaaatcaaaaaggtgaactgtccagtattaattatgcacggtcaagctgatgagataattccttttactcatgcacaaaagttgtatgcagcttccccgtcaccaaagttgaaattatgggtagataacgccagccataatgatttttatggggtagctggtcaaagatataaaaatattttgagagaa

SEQ ID NO: 42473 - DNA, 455 bp, Anabaena PCC7120
aacttttcactttttttcaatacagggagaggtactgttcccataatgcaattaaatctccctactgcaatttaagagtcgttcgcaccatagagggacatcctacagtttctgcaattgcgctcggtgcggacggtcaaactctagtcagtggtggtcaagataaaacaatcaaagtctgggaactgcaaacaggaaagttgaaaaaaacactacggagtgattctggtgcaattaatgctttagcaatctctcctgatggcaaaactgttgtcagtggtagtggcgatcggctagttcgcatctgggatattacctcaaatcaacctcaaaagatactcagaggtcattctggcaatgttactcatgttgatatttcctctgacggaaagactattattagtcttgatcgtggtgactctcctgagatcaaagtctgggatctcaaaactctt

SEQ ID NO: 42474 - DNA, 1965 bp, Anabaena PCC7120
atgagcatttcaacttccgtgctgagtgatctgctacagtccctaccttacctgcggcctcagctatatttcaaagcttcattgacggccctttcccacgcgatggaagatcaggtgttggctgcgactttagaccagcctttagtaattgctagctttcaaagagagagattctatcgccaagaagctcatcgctatcagcgattggcacaacgtagtagtcaaatatacgttctatctgcaccggaaactgattttgccaatagctcggaatactacgaaaaggtagcatttgagcctgatgatgctttgagtcaagagtggcatttggtcgtagtagctgacaattatgctacttgcttggtatgtagagaaagcctgggttcgatcgccaaaaatcgacaaataccagagtttagtcctggccttgatatggatgcagggcgacgctttgaaggtatttggacatctgaacggggagtaagtatcaaagctgcccaattgctactagatagaattttggtttatcgaccagacttggcaaaaaaagtgacaaaagcttgtcagcgattcggcattggtgaaacgaaaatttactccaatgctagtagttttgtaactgaatatgcttgtgatattgatactgatccctttgtgcagcgcttagttacctacctgcaagctagtcagtataaattacataaagcttaccgttcaattgcggctcaagcacgaaaagaacgtttagtcaactcaattagtacagcaattcggcgatcgcttgatccgcaccaagtattacaaattgctgctcaagaactaggacaacatttaggagctagtcgttgtctaatttatcgcgcccaagccagtgatgcccaggcggtgatcgaacatgaatttttaactcctggtacggtctccattagcggtcaaaccagggaattaaagaacaattccctgtttaaagaagtggtagatcatggcgaaggtgtttgtgtcaccgataccttaaatgactttcggattacaaattctcccacattgtccttgattgccaaaaaactggcgattcgttcgtggttaatcgaaccagttgtatttcaagggagattattaggtattgtagaactgcattattgctcccttccgccccaccaatggcagccaggagaattggacttagtagaagcgatcgccacccaaattggagccgccttaattcaagcagaagcttacgccaacctagaagaactcaaccagcaattagaagctctagaccgtacccgcagcaacctgatagctatcactgggcatgaactccgcacacctttatcaacaattcaagtgtgcttagaaagtttggctaccgaacccgatatgcccgtggaattgcaacaggtaatgctaaatactgctttgtcagactcggaacggatgcgaaaactagtgcaggatttcttgactctttctaatttagaaagcggtcgagtggaatggcatccagaatccttaaccctacaagaatgtattgatttagcccttagtcgtctccgcatccgtcctggagtagagaaaccgccagcgattaaaacccaaatagacggaaacttacccttagtcagagcagacggtgattggctagtagaagtgttggcaaaactcgtagacaacgcttgtaaattcacaccaacacaaggggagatcaagattagtgccactcacaatggtagtcaaatggtagaagtcaccgtagccgatacgggacggggtatagagccaaatcgtttagaaatagtttttgaccgtttctaccaagaagaaggggcattacgccgcacagcaggcggtacagggctaggtttagcaatttgccgccaaatcgtcaacggttggggcggtgcaatttgggcagcttccacaggtaaagaccaaggtagccaatttcatttcaccattcccgtc

SEQ ID NO: 42475 - DNA, 1185 bp, Anabaena PCC7120
ctagccgtagttgtaggaatcctatttggtgcaggtaatccaaatcccaacttcatcgacttaatcaatcatctcaccatcccctgcaatttaatcctcaaagccctacgtgccttagccacaccgttgattttgctcgccattctccacgcctttcttacagtacatattccggggcgttcaggacgaaaactagcaatattgttgttgaccaataccctcatggcaattgtcatcggactgttggttgccaatttattacaacctgggcgttggtggtcggttgcatcctttggcgctgcacctacaaataaaacccttgacccttggggattactgcaagatatagttccaccttctatattacagcccttagttgataacaatgtgattcaactagtgttcgtggctttggcttttggggtagttttacgtgccatcaaaactgagcaggttgcccaaaaaaagaacgattatcaaccagttgagcaactaattggcttattgtttgaggctgtgatggcagtgttgaaatgggtaattgccctagttcccatcgccgtatttgggattgtcgccaaaaccatcgctttacaaggttttaaaccattcatctcattagctgcctttattgtcgccgtattaattgggctatttctccaaggaatttactatacactccgagttaaatttggttcttgggtaagtccccaaaggtttctccgtggtggtagcgatgcactgttaacagctttttctaccgcctcatccacagccgccatgcctgtaaccttccaagctttgatgcagaaaatcggtgtgcgggaatcttccgcatctctgggggctttggtaggtagcaatttcaacaatgatgggacggccttgtatgaagccatgtctgctttatttgttggtcagttgttgggactgcatttaaatctaccccaacaattgatggtagtgttcacctcaatcatcgcttctgtgggcgctgcggggattcctgaagctggactggtgacaatgacgctggtgtttacggcggtaggattgccgactcaatatattgccctcttgattacggtggattggtttctcgatcgctgtcggactgcaatcaatgtcatgggagatatgactattagttgtttgctggatggtaaaacacagcaggttgagcag

SEQ ID NO: 42476 - DNA, 852 bp, Anabaena PCC7120
ttaaatttaatccaatggtatccggggcatattgccaaggcggaaaagaatcttaaagaacagctatcgcgggtagatgtggtatttgaggttagagacgcgcggattcccttggctacccatcatccacaaatagatgagtgggtaggaaataaggcgcgaattttggtattgaatcgattagatatgatacctccacaggtgcgatcgctgtggatagattatttccaaaatcgcggtgaagtcccttattgtaccaatgcccaacatggtcaaggtgtagttggtgtggcaaaagcagcccaagccgcaggggtagaactgaatcaaagaagacgcgatagaggaatgctacctcgtgcagtgcgagcagtggtaatcggctttcctaacgttggtaaatcagccttaatcaaccgtttattaggaaaacgcgttgtagaaagtgctgctcgtcctggggtaacgcgtcaactacgctgggtgcgaatttctgaccagttggaactgttggatgctcctggagtcatccccgttaaattgggtaatcaagaagcagcagtgaaactagcaatttgtgacgatattggtcaagcatcttacgacaatcagctagtagctgcggccttgattgatctagtcaattcactccaagaacaagccggtgagttattaccaaaatcacccctatacacacggtacgaactcgaccctacaccccacacaggagaagggtatttacacgcgctagcagaatatcgccacaagggggatgtggaaagaacggcaaggcaattgttaactgactatcgcaaaggcttattaggaaccctacctttagagttaccacca

SEQ ID NO: 42477 - DNA, 1056 bp, Anabaena PCC7120
atgatagtagtcatgaaagtcggttccccagaagtggaaatcaaccggattaatgatgaattaaccagttgggggctgacaccagaaaaaattatcggcaaacacaaagtagtaattggcttagtaggtgaaaccgccgacttagaccccttacaaattcaagaagttagcccttggattgagcaagtattacgggtagaactgccttataaacgcgctagccgccaatatcgtcacggtgaagcctcggaagtagtggttaatactccagatggttccgtggtatttggtgaaaaccaagccttggtggtggttgctggcccctgctctgtggaaaatgaggaaatgattattgagacggcgcaacgtgtcaaggcagccggcgctaagtttttacgcggtggtgcatacaagccccgtacttcaccttacgcttttcaaggtcacggcgaaagtgctttggaattgttggcaaaggcgcgggatgttagcggtttgggtatcatcactgaagtaatggacgcgtcagaactggatattattgcagaagtggctgatgtcatccaggtaggtgcaagaaatatgcagaatttctccctactgaaaaaagtaggggcgcaaccaaaaccagtattactgaagcgaggaatggcagctactatcgaagattggttgatggcagccgagtacgttctagcagcaggtaaccctaatgtaattttgtgcgaacgaggtattcgtacttttgaccgtcaatatacacgtaatactttagatttgtcggtagttccagtattgaggaaattaactcacctaccaattatgattgatcccagtcatggtacgggttgggctgagtatgtgccatcaatggcaatggcagcgatcgcagctggtactgattctttgatgattgaagtacaccccaatcctaaaaaagccctatccgacgggccacaatccctcacaccagaacatttcgaccgcttaatgcaggaattagccgttattggtaaagctgtaggacgctggccacaaccagcagttgtaactgca

SEQ ID NO: 42478 - DNA, 348 bp, Anabaena PCC7120
actgccaaattatggaatctgcaaggaagggaaatagctactctcacacatgatggttggatcaaccatatatcatttagtccagacggcaagactattggtattcgttcaggggataaaacagtcaagttatggaatttacgagggcaggagattgccactctcaagcataacagttcaactatagtcagcgatccaatatttagccctgatggtaagactattgccactgtttcactagatcgtactgtgcgtctgtggactgaggtaagagatggttcttggcagcagtttgctgaatatcaaagtaggcgtgtagtattcagcccggataataaattaattgcc

SEQ ID NO: 42479 - DNA, 1005 bp, Anabaena PCC7120
atgaaaattgatcatgttcatttctatgtcgaagatgccaaggtgtggcgagattggttcctcaactatctgggttttaccggagtaagtagtaatatcggttctctacatacttgtacggaggtggtgcaaagtggagatgtctgctttttgctgtcttctccattattatctactagtcctgtggctgaatttctgcgtcaacatccgcctggagtgtcagatgtggcgtttgcggtagaagatgtagaggtagcgatcgctcatgcccaggctcatggtgctacaatcctacaacctataggagaacgtcaaattggtaatatctctcgccagtgtggcaaaatagccgcttggggtggcttaactcatacgttaattgaaaaattaaattccgataaccagataacttcatcacctaattttattaccgccatagaccatatagtcttaaatgtcgccgtaggtgagttagaagcggctgtggcttggtatgaaaaaattctcgatttgcaaccccgacaggcttttaagattcaaaccgatcgctctgccttgcatagccaagttatggtttctcgtgatggtagtgtacaattgccaattaacgagccagcatccagcaattcgcaaatacaagaatttctcaactttaatcgaggagcaggcattcagcatatcgccttgcaaacacaaaatattgtagatgcgatcgcccaatttcgtaaccgtggtttaccactgctttcagttccccaaacttattacacacaactcaaacagcgtctagagattcctctatcatcagcagaattagaggcgatcgctcaacaagaaattttggtagactggcgaaaggataatcaaaatggggtactattgcaaattttcacccaacccatatttgcagaaccaacttttttcttagaatttattgaacgtcgttcccaagcccaaggttttggggaaggtaactttcgcgccttatttgaagctatcgaaagc

SEQ ID NO: 42480 - DNA, 1875 bp, Anabaena PCC7120
attgcagaggcgatcgcagctagtcaaaaatatctgctatcactacaaaatccggctggttactggtgggcggagttggaatcgaacgtcaccatcacggctgaagttgtcttactccacaaaatttggggaacagataaaactcgacctctacataaagtagaagcttatctgcgatcgcaacaaaagcagcatggcggttgggaattattttatggggatgggggcgaactcagtacatcggttgaggcgtacatggcgctgaagttgcttggtgtacctgcaaccgaccccgccatgattcaggcgcgagattttattctccagcgtggtggtatcagcaaaacccgcatttttaccaagtttcacctcgcactcatcggctgctacaactggcgtggtcttccttctctcccagcttgggtgatgctgttacccaatcagttccctgtgaatatttacgaaatgtccagttgggcgcgttccagcactgtcccactgttgattgtctttgaccaaaaacctgtctaccaagtcaacccaactattaccctggatgagttatacgcggaaggtgtggagaatgtccgctatgaattaccccgcagtggtgactggactgatttattcctcactttagatgaaggcttcaagctggcagaaagtttcaattttattccctttcgagaagaaggtatcaaagccgccgagaagtggattatagaacgccaagaagccacaggcgactgggggggaatcattcccgctatgttaaattccatgctggctttgcgctctttgggttatgacaccaacgacccaattgtagaacgaggtttacaagcccttgataactttgccatcgaaacagtagattgttatcgagtccagccttgtgtgtcacctgtgtgggatacagcttgggttatccgggcgttgattgactctggtatagcaccagaccatccggctatagtcaaggcgggagaatggctattacaaaagcaaattcttgactatggtgactggaatgtcaaaaatcgccaaggtaagccaggggcttgggcgtttgagtttgagaatcgcttttacccagatgtggatgatacggctgttgtcgttatggcactccacgccgctaaactccctaatgaacaattaaagcagaaggcgtgcgatcgcgccctgcaatgggtagcatcaatgcaatgcaaacccggcggctgggcagcttttgatcttgataatgaccaggattggctcaattccgtaccctatggcgacttaaaggccatgattgaccccaacacagcagatgttaccgccagggtaatcgaaatgttgggtgcttgtaatttatctatcgattcccacaatctggaacgggcgctgacctatctgttaaatgaacaggaagcagaaggctgttggtttgggcgttggggtgtaaattacatttatggaactagcggtgttctctccgccttagctttaatcaatccgcaaaaatatcaacgccatattcaacagggtgctacttggttagttggttgtcaaaaccccgatggcggttggggtgaaacttgctttagctacaacgaccccagcctgaaaggtcaaggtgacagtacaccatcccaaacagcctgggcgttaattgggttgatagcagctggtgaagccactggtaattttgctcatgatgctattgaacggggaattaatcatctggtatccacacaacaaccagacggtagttggtttgaggcatactttaccggaacaggcttcccttgtcacttttacttgaagtatcactactatcaacagtactttcctttaattgcccttggacgttatcaagcaattaagtct

SEQ ID NO: 42481 - DNA, 1128 bp, Anabaena PCC7120
aaaacagtagtgcctgatactaaaattgtcgatgctaataataagtttggctttaagctgttttcggaaattgccaaacaagatggtaacgccaaaaatatttctgtgtcgcccacgagtgtagcgatcgccctagctatgacctacaatggcgctagcggctctacgcaaaaagcaatggccaaaaccctagagttacagggtatcagtctaccagaactcaactctggttacgcttcattaaacaagctgctacaaaatcctggtgaaaatgtccaactgactatagctaactccctgtgggttaatcaggatgttagtttgcgtcccgattttgtgcaaaccacccgcgatttctatcaagctaaggtgaccaatttagactttcaaaatgtcacggctgtaaatacaattaattcctgggtacaggaaaataccaaaggtaaaattgacaaaattgtcgataatattgaaccaaatcaggcgctatttcttatcaacgccatatattttaatggcaaatggagtaacgccttcgacaaatctcaaacaacaccacagaccttttacactgcatctggtcagcagaaacaacacccgatgatgtcacaaacgggtgaatatagatattatgaaaccccacaatttcagtctgtaagtttaccttatggtcaagatggcaaggtgagtctgtatatctttttgcccacaaaaaactctaacctcaaagccttttctcaaaacttaaatgcagagaactgggaaaaatggatgcctcagtttagaaaccgtgaaggctctattcggttaccgcgctttcaaacagactatgatattaccctgaatgatgccctgaagtctttaggcatggcagaagcttttagtaataaagccaacttttctggtatcggcgacaatttaactattagccaagtgagacataaaactgtgattgaggtgaatgaagaaggtacagaagctagtgcagcaacttctgtaggcatggtagcgacatctttgagagagccacaacagccatttaaaatgattgttgaccgtccctttttctatgcaattcgtgataatcaaagcaaaaatatcttgtttatgggtgcggttgtagaacca

SEQ ID NO: 42482 - DNA, 1621 bp, Anabaena PCC7120
tctttgaaagatgttggcgggctgggtgaggttgttaaagaacttaaggaattaatcgctattcccttaaaacgccctgacctcctggcaaaattggggttggaacctacgcggggtgtacttttagttgggcctcctggcactggtaaaactctaactgctcgtggtttggctgaggaacttggtgttaactatattgcgctggtggggccggaagttatcagcaaatattatggtgaagccgagcaaagactgcggggtatttttgaaaaggctgctaagaatgctccttgtattattttcattgatgaaatcgatagtttagctcctgaccggagtgcagtagaaggggaagtagaaaaacgtcttgtagcccaactgttaagcctgatggatggtttttcccacagtcaaggtgtgattgtactggctgcgactaaccgtcctgaccatcttgacccagctttgcgccgtccggggcgatttgaccgggaagtccagtttcgtgtgccagatgtgaaaggacgcagagatattctgcaaattctcacccgtgccatgcctttggaagaaacagttgacctggatgcgatcgccgaacgatctgtgggatttgtgggggctgacttaaaagccctctgtcaaaaggctgcttatactgctctgcgccgtcaaatgccttcggttgaaagtgcagttccagagaatatgacagttagccaagctgactttttgcaagcactcaaagaaatcaaaccagctgtactacgaagcgtggaagtcgaagttcctcacatcgcctgggacgatattggtggtttggatacgattaagcaaaccctacgggagtcagtggaaggagcgctgttatatccagaactgtatttgcaaaccaaagcactagcaccaaaaggcattttactgtgggggccgccagggacaggaaaaactttattagctaaggccgttgcttcccaagccagagctaattttattggtgtcaacggcccagagttactcagtcgttgggtgggtgcaagtgaacaagcagtacgggaattatttgccaaggcgcgtcaagcagagccttgtgttgtatttattgatgaaatcgatactttagctccagcacggggcagttttagtggtgattcgggagtgagcgatcgcgtagttggacaattgctcacagagttggatggcatagaagtaggcagcaccatcttagtaattggggcgaccaatcgacccgatgcccttgacccagctttgttacgcgccggacgcttagatttacagatgaaggtagatttaccagatttagctagtcgtctggcaattctcctagtccatagccaaggacgacccctagacggtgtggatttcaactattgggcagagatgacccaagattggaatggtgcagatttaactttactgtgcaatcaagcggcggtagaagcaattcgtcgttttcgctcccaaggattgacagacccttctgaaatcaagattactaccgatgatttcaactatgcttataaagttctcacagaacagcgcccagattaaatttttagctctttataggggctgggggagaggtcaaaaaagactcgcg

SEQ ID NO: 42483 - DNA, 2729 bp, Anabaena PCC7120
agtaataaacctgctgaaagtcaatacaaaactacattgagtcgagtcaattcccaagcaacattagtggcgaacaatccccatcaattccgagtaacagaaaacgtccacaaaaccgttttggacaatggtttgaccgtattcatcaaggaagtaccgactgtaccaattgtaagtgtacaggtatggtacaagtttggctcacgccatgaagaatcaggtgtcaacggcattgcccatcagttagaacacatgatgtttaaagggcacaaaaaggcgggccaattcaatttggacgtttatttagtgctttaggtagtgactccaacgcctttactagttatgaccaaacagcatattacggcccagtagaacgggataagctcaaagtgctgctggtcttgaaagcagacagaatgcaaaacgctctcattgatgctgacaaattagccagtgaaaagcgcgtagtcatttcggaattgcagggttatgaaaatagcccagaataccgcctcaatcgcgcggtcatgcaggcagtgtttcccaatcatccttatggcttacctgtaggtggtactaaggcagatgtagaaaaatttccagttgagaaagtacaagaatactatcaagacttttacagtcccgaaaatgccgtgttagtaattgtcggcgattgccaagcaaaagaaaccttggcaacagtaaaagagatatttggcggtattcctcagcgtcaacagccaacagccaacagtcaacagtcaataatcaatagtcaacagccaacagccaacagtcccatagttctaagagaaccaggtgcggcgggactgttacaagtgatttaccccctaccgccagcgagtcacccggatatgccagccctagaggtggtagattatatcttgactgaagggcgcaattctcgactatataaagcattgatagaatcgggtttagccagtgaagtagaagcttctattggtggtttgcagcaggctggttggtatgaattgttggtgacggcagatccagaccaagatataggtaaaattgactccgtattgaataaagcgatcgctaatcttgcccgcacagatgtaaaagcagaagaattagctagagccaaaagacagttagaagctgccatcattttgagtaaccggactatcactgatcaagccatgcagttaggcaatgatgagacaactgttggtaattatcgctttacagattattatttatcggcaattaggcaagtaacttcagcagatgtagtacgggtagttaataagtatttaccaaaatctcaccggaaagtaggtatttttcaaccaaccatatctaccagcaccaaagaagttggcaacaaaaagtcaacacaacgcacacaagaaaatctcgctggcgactcatctgtaacgtcatccgaggtgatgaagtatctaccatctctagatatcacaacagataatattccacagaaatctcaaacacgtttaccacagcagtttactttagctaatggtttacaagtatttttactacctgataaaagtacacctaccgtcaccttgagtggttatgttaaagcaggtacggaatttgatccagatggacaagcaggtttagcctcattagtagcagatagcttaatgagtgggacgaaaactaaaaatgcttcgactttagctcaagttttagatgataggggtgtgactttagattttgccgcgtaccgcaacggtatgcgtatccaagccgatagtttagctgaagattttccggtgctgattcggacattagccgacggactaaaaaatagtacatttcccaaaaaagaactggacttaaatctgcaacaagctgtaacttctctgaaaatggaattagatgatccgggagaagttgctagaagaatttttctgcaatcggtctatcctaagaaacatcccctacatacctttccgacagtggaaagtctgcggaagattcgccgtcaggatgtgattgcctttagtcagaaatattatcgtccagatactactgtgttggtgctaatgggggattttgaacctcagcaagtgcgatcgctcattcaagcagaatttggtgattggcaagctagtggagaacccccaagtataaactatccccaggttggactaccaaaaactaccacgcgagagaatccagtattacctggtaagacccaagctattacttaccttggttatgcaggtattaagcgtcaagatccgagattttatgcggcgctagtgttaaaccaaattttgggcggggataccttatctagtagattaggggcccaagtgcgcgatcgccaaggtttaacttatggcatttatagcgacttccaagccgaaaaagattttgggacattctggattgaaatgcaaaccagtcctgaagatgcgaataaagcgatcgctagcacccagcaagtacttgagcaaattcaccaacaaggtgtgacagcatcagaagtagagacagctaaacgtaccttgattggtaactataacgtttctttggcagacccagaagagttaaccaataaaattctgatgaatcaagtttatggactagaaccgggcgaactacatttttataatcaaaaaattcagcaggttaccttaactgaagttaatcaagcagctagtgaattactccacccagatcaagtagtagtagtaacggctgggcct

SEQ ID NO: 42484 - DNA, 1182 bp, Anabaena PCC7120
ctgatgactaacttcacttctcggatgcaggcggtacaatcaccgattattcctgtagttggggaattaattcaaaattcacctgggactatttctttgggacagggtgtggtttcttatagtccgccaccagaagctattgagcttttgccgagatttttggctgaccctgctaataatttatataaagctgtggagggtattcctcctttgttgaatgcgctgacagaaaaattgtctacattcaacaacattgaaatcacgacagataactgtattgtggtgacggcgggaagcaatatggcgtttatgaacgctattttggcgattacttctcctggtgatgagattattctgaatacgccttactacttcaaccacgagatggcgatcaccatggctggttgtcgtgcagtgttggtagaaaccgatgaaaattaccaactgtgtccagaggcgatcgctcaagctattaccccaaaaactcgcgcggtggtcacaatttcccccaataatcctacaggtgttgtctattgcgaagatttgttacgtaatgtaaatcaaatttgcgctaattatggcatctatcacattagtgatgaggcttatgaatactttacttacgatggtgtaaaacacgtttctccagcctcatttgcagggagtagtgagtatacaatttccctttatagtctttctaaagcttatgggtttgccagttggcgaattggttatatggtaattcccaaacatctgcttgtcgccattaaaaaagtccaagacacaattttgatttgtccgcctgtggtttctcagtatgcagctttgggagcattacaagcaaaaccagagtatttacaggatcatattggagcgttggcgcagcctgccgtaggcatcgctcaagtcagacaaatagtattcgactacctcaagcaactgcaaggcttatgtaatattactcccgccgatggtgctttctatgtttttctaaaagtgcatactcagatagatgcttttgcattagtcaaacaactaattcaagaatataaagtggctgtaattccggggacaacttttggcatggaaaatggttgttatctgcgggttgcttacggtgctttgcaaaaagatacagtcaaagaaggtattgaaaggttagtacaaggattgaaaacaatt

SEQ ID NO: 42485 - DNA, 1284 bp, Anabaena PCC7120
atgaatattgcagtggtggggttaagccataaaacagccccagttgaaattcgggaaaagctgagtattccagaaccacagacagaaagtgcgatcgcacaacttaccagctatcctcatattgatgaagtcgccattctcagcacctgtaaccgtctagaaatttacatcgttgcgggtgaaacagatcacggtattcgagaagtaactcagtttctttccgaacacagtaaattgccagtgcattccctacgtcagcacttatttgtcttgctacatgaggacgcagttatgcacatcatgcgagtggcggctggattggatagcctcgtactaggcgaaggtcaaattctggctcaggtcaaaaatactcacaaactggggcagcaatataacggtataaaaacaattttgaatcgattatttaaacaagcgctgacagcaggtaagcgagtccgcacggaaactagcattggtactggtgcagtttccatcagttccgcagctgtggagttagcgcaaataaaagctgaaaatttagcagcttgccgagtcacaattctcggtgctggtaagatgtcacggctgttagtgcaacacctcgtttctaaaggtgctacacaaatcagtattgtcaatcgttcacgagaacgcgcccaagaattagcaaagcaattttcagaacaccccattcgtactcatttgcttccagaaatgatgacagtcattgctgaaagccatttggtgtttacaagtacctccgcaacagagccaatacttgatcgggctaaattagaaatggttttagcaccaaaccagcccctcatgttatttgatatttccgtaccacgcaacgtccatacagacgtgaatgaactggtcaacgtccaggctttcaacgtggatgatttaaaggcggttgtagcccaaaattacgaaagccgcaggaagatggctcaagaggcagaacggcttttagaagaagaaattgaggcttttgatatttggtggcgcagtttagaaactgtgtctacaattagcagtctgcggagtaaaatcgaaaccatccgcgaacaggaattagagaaagccttatcaagattgggttcagaattcggcgacaaacatcaagaggtgattgaagccttaacaagaggtattgttaataaaattttacatgacccgatggtgcaattgcgggcgcagcaagatgttgaagccagaaggcgctgtatgcaaaccctgcaaatgttgttcaacctagatgtgggtgagcagtttagt

SEQ ID NO: 42486 - DNA, 2151 bp, Anabaena PCC7120
gagatcatccgtcaaggcaaaatgtttctccatcaagaatgggaacttcaagatggacgcaccttagagcaaaactatataccgattgtggttgatcataaactttatggtcatctgtggaaatatcgtgacattacccaatacaaaaaatcagaagttgctttgaggttaagtgaggaacgattaaagctggctgtagatgctgtagaagaaggtctatgggactggaatctagtcacgggagaagtttatcgtagcgcacgttggtttaccatgttgggttacacccctatggaaattggcaacgatattaaattcagagataagttgatccatccagatgatatccccttgatgcagcaaaggctgatatcccacctcaaaggtgatactcctttctatgaagtagaaatacgtttactcgctaaatctggagaatggaggtggattctcgaccggggtaaattagtgagtcgggattctcagggtagagctatcagaatggtgggaactcatttagatattacccaacggaaacaggcagaacaagacctacagcagcaatatcaacacactttactgctgaaacaaatcacagaagaaatccgccagtccttacaatgggaaaaaattctcaagacaacagttacagaagttcagcgaattttacaagttgatcgcgccctgattttccaaatcaattctgatggttctggcaaagtggttcaagaggcggtaatgcctggatggtcagtcactttagaccaagatatttatgatccctgcctcaaagatggataccttaatatgtatcgggatggacgcattactgccattgctgatgtgtatcaagggggtttgaaaccttgctatgtagaattcttgcaacagttccaggtcaaagctaatttggttgtaccaattcgagtgcgacgaaatttgtgggggttattaattgtccatcagtgcgatcgccccaggcaatggacggaattagaattggatctcctcaaacatctggcagatcaaatgggtattgccctcacccaatcccaattattggctcaggaaactaggcaagcccaattattagcgctgcaaaatgaagaactgaacgttgctaaacaagtagcagagaaggcaaatatggctaagagtaatttcctggccaccatgagccatgaaattcgtactccgatgaatgccatcattggtatgagtggactgctcctagatactaccctcaaacctgagcaattcgactatgtagaaactattcgcaacagcagtcacacattattaacaatcattaatgacatcctcgacttttctaaaattgagtctggcaaattagaactagaagaacaaccttttgatttacgcctttgtgtggaagaagccttagatttactggctcctcaagcagcctcaaaaggcatcgaactcatgtaccaactagaaccagacacacccactttagttgtgggtgacattactcgtatcaggcaaattctgtggaatttggtcagtaatgcggtcaagtttaccaaaattggcgaaatatgtatcactattggggcaaaacagaagatttataaacagacagaccctactcgctacgaatttcaatttgcagtccaagatacgggtattggcatagaacgcgatcgcctacatcgattattcaaaccttttagtcaagtcgatgcctccatgactagacgctatggtggtacaggcctgggactggcaatcagtaagcgcctgagtgaaatcatgggcggcaaaatgtgggtagaaagtcaatcgcatcaaggctctattttctatttcactgctaccttacaggtcaattcctctgccatcaatagcgccgccaaggtcgatccagaattggttggcaaacgattactgctagcagtcggtaacgccaacttgagaaaatgcttaacccggcaactccagtccttaggattagatgtccaggctgtagattccaacgcgacggcgctacattgtctatggcaacatacttccctagctctagctgtgttagatgttgatagcccacagatcaacggcctccacctcagtacaaaaatccgtgctattccccagcatcagaatttacctctggtgatgttgagtgct

SEQ ID NO: 42487 - DNA, 633 bp, Anabaena PCC7120
caaaatcaagtgtctgacaacaattctagtaaacaacctgataattcttggatcgcagagctaggtagaacagttgtattaagtattgttctcgccttgggtattcgtaccttcgtggctgaagcacgctggattccttctggctcgatggaacccactctccacgggactcccaaccagtgggaagcagacaaaattattgttgataagttgaagtatagattttctcaaccgcagaggggagacattgtagttttttcccctacagaagagttacaaaaagaacaataccaagatgcctttatcaaaagggtggttggcttaccaggggaaacagtagaactcagaaacggcagagtatatatcaataaaaagccccttaatgaagagaaatatctcggctccaaacaagccacagtcattgatgtctgtacgtcaggacagcaaccagctttcttaacaaaaccccagactataccttctgactcctatttagtactaggagataatcgtaatagcagctatgacagtcgttgttggggtgttgtcccacgtcaaaatattattggtcgtgcagttcttcgtttttggccactcaacaacgtaggagaaatcgataaatcgcctctatac

SEQ ID NO: 42488 - DNA, 3237 bp, Anabaena PCC7120
atgaaaacagccaccgaattacaagctcgactggaatattactaccagcaaatcaaaaccgtgattatgatacgtcaaaatcccatcactggtttgttacctgcgagtacagcaattactgcccacggtgattatacagatgcttgggtcagagataatgtttacagcattttggcagtttggggtttagcgctggcgtaccgtaaggtggatgaagaccaagggcgtacctatgaattagaacacagcgtcattaagttaatgcgtgggttgctgtttgcgatgatgcgacaggcgcacaaggtagaacaatttaaacaaactcagtcacctttggatgggttacacgccaaatacaacaccgctactggtgatattgtcgtaggtgatgatgaatggggacatttgcaattagatgccacatctatatttttattgatgctggcacagatgactgcttccggattgcagataatttacaccattgatgaagtcaactttgtccaaaatttagtttattacatcggccgagcttaccgcacaccagattatggtatttgggaacggggtaataaaattaatcatggcaatgctgagttaaacgccagttctgtaggtatggcaaaagctgccttagaagcgatgaacgaactggatttgtttggtgtgcggggtagtcaagcatcagtaattcatgtgctacccgatgaaatcgctcgcactcgcagcactctagaatccttattacctagagaatctgcttctaaagaaattgatgcagctttgttaagtattattagctatccagcgtttgcggtagaagatgcacaattgagagaacgcaccctcaacgagattatcaacaaactccaaggcaaatacggctgcaaacgctttttacgtgatggacaccaaaccgttttagaagacacccaacgtctgcactacgaaccttgggaactaaaacagtttgagcatatagaatgcgaatggccattattttttacttatttagcccttgatgggttattttgtgatgattcaaaacaagcgcaattttatcaagagcagttagaaaagttactcattgagcgtgatggcgtatcggccaacataggtcatagcttacgtttattaccagaattgtattatgttcccgccgaaaatgtggaagcggaaaagttagccccccaaactcaaccccgtttaccaaatgaaaatgtacctttagtttgggcgcagagtttgtattatcttggtcaaatgttgagtgaggggttactagccgttggtgatgttgaccccttaggcagacacttaactataggtaaaaaacgcgaagctttagtgcagattgtcttgttagcagaagatgaagacttacaagcacaactagcagttcacggtattgaaacgcaaacaccaaagcaagtagcaccaattcaagttagacaagctagtgaactatcaactatttatacccaaattgggcgtaacgataaacttggtttaacaggtcgtccagtgcggcggctgagaagtttgactacatcaagagtttttcgtctccggggtgagacaattgtttttttaccttcatttttagattctcagcagttttacttaacccttgattaccattttttggtagaccagataagaagtgaacttgcatacatccaaaagtattggagcgatttaggtcgtcccatattaactttaatgttgactcacaccatgctggaaactggttctcaagcattactagaactcatgcaggaattgaaagatggtgtatgtaatggtgtggcagtaaaattagggcgactgaatcaattgatgctgacaggggcaatccaaagaattgatttcctgcaagatgtggaattttaccagtcagcagtgcaagatgctggcaaacgttgttattacttggcttatcatcctgggaaaaactggcgtttgggacatagccaagaatttcaggtggaatacgaaactaacttggattttctgctgtcatccttgcgtgcatcagaaaatttatatgagcaaattgaattattgcagactttgactcgattgcaggggttggagtttgatacagggtttgggacaaatcaacgagttactgtagccgatttactggatgaagtttacaccaaagctggggagttgggtttttgggcagtggtgcggcgggcggctggtttgcggcaaatggtggatattggactaacggatgcagtgacaagtattttgattagaggtaagcaaatagctgtaggtagggcttacagtgaagcgtcattgatttccgtaccgatgcctcacaatgaaattgctgataaaatcaatcacttctgtcgtgaggatatccgcgatcgcgtgctgacgcaagaagtcctgatctatctgggtatcctcatcagatcacaaaccgaatcatttcaaggactactcaccctgagagttgggtatctcatcctcttaattaccagcgaactcgcccaagagttaaaagttacccaagatgaagcctacgaacgcttgatggaactgccaccatttgaagttaagacacgattacagcaggtattaacagcttatccagggatgagtcaactattgcgccagcaggaatcattgcacgtcaagcaaaaggtaactgatattgactgggtgatcttacctgctattagcgaagaaatggaagttcctatcggtggttggcgacgcttccgccaagccgagggtgcattaaaccgcgtcccgaaaaatttctttcagcaagtttggctaatcatgcagcattgcaaagggttggtcattggcgataaattagagcgacgcaatcgtttagatagtgatgtaattctgtcagaaatgactgccggtgaaaagaattttgccctacgcatcgagcatttgctaaataaaatcgaagcgccagaatatcgccaagttaatattgaagcattaatggaactagctgcgatcgcctctagaaaccccaacctacaaatcgaagaatacatagtactagatgtactcattggccacgccgtacgcttggcttggttagaacaacatccagaacgcggcgatcgctatgatgaggataaggcttcagcgtggcgatcgttttacaatacttcccctaaagaatgcgctacctatatcctcgaagccttcaagttcttgactgagtttgtgaaataaaggtaagggtgtagg

SEQ ID NO: 42489 - DNA, 906 bp, Anabaena PCC7120
agcattatcgtcttcggtagcatcaatatagatttagttgccacagcacccaagttaccaggtgcaggagaaaccttactgggagaagactttttcaaggttcctgggggtaaaggtgcaaaccaagctgtagcattagcaagattgggagttcctacccagatggtgggacgcgtcggcgcacagagttttggtgcagaactgatgcaaaatctgcaagacgctggcgtacaaactgacaatatttttgtagatgaaactgcaagttctggagtggcgatgatcaccgtagctcataacggtgaaaatcaaatagttgtcattcctggtgctaatgggcgagtcaatcaagtagatgtagaacgattatcacgcatattaccaacagctacagccctgctattacaattagaaattcctgtacctgccgttatcgcagctgcccaagcagcaagaagtaacaatattacagtaattttagaccccgcacctgcaccatcagatttaccaacagaactttactcctttgttgatatcattacccccaatgaagtagaagctgggcaacttgtgggctttccggtagacggggaagatgcagcgcgaaaggcagcaggggtgttattgcaaaagggcgtgaaaagtgcgatcgttaaactgggcgctaaaggtgttgtttgtgccacaaacaaagagacattttttgtcccagccttctccgtggatacgcttgatactgtagcggctggtgatgcctttaatggtggtttagcaacagcactttattctgggctttccttacatcaggcagttatttggggtgcggcggcaggtgctttagccgcaacaaaattaggcgcacaaacttcgttgcctgacaagttgacatttgaggccttcctcaag

SEQ ID NO: 42490 - DNA, 1695 bp, Anabaena PCC7120
aaggcttatattatcgtccctattctatctggtgaccaagtttggggattattagcaacttaccaaaactctggccctcgtcaatggaaaactggcgaaattaacatcgtcattcaaatcggcaatcagttagaagttgcattgcagcaagcacaactgctgacacaaacccaaagacaatcacaagccctagaagcagctgcgatcgccgcagatgcagcaaaccgagccaaaagcgaattcctcgccaacatgagccacgaattgcggacaccactcaacgcaattttaggcttcacacaaatcatgagccatgacaaaacactgtcgaaagacaaccaacagaacctaacgattattaaccgtgcaggagaacatttactagacttgatcaacgacgttctagaaatgtccaaaatcgaagcaggtagaaccaccttaaacattaatagctttgatttaattcacctgttggataacttgcaagaaatgatgcaaggccgagccacagccaaaggtttacacctcaaatttgaatacgcccctaacatagcccaacatatccaagctgacgaaagtaaactacgtcaagtcttactcaatatcttaggtaatgccatcaagttcaccgaaacgggcagtatcatcttacgggtaaagatggggactggggactggggactggggactgaggaagataccaaaactcatctctccatacctaacacccaatccccaatcactaatccccagtccctaatatttgaaatacaagatactggcatcggcatctgtgatgatgaagtatgtgtattgtttgaagcatttggacaaacggaagccggacgaaaatcccaacaaggtacaggattgggtttggctattagccgcaaatacgtacaactgatggggggtgatattagcgtcagtagtgctgtgggggtggggagtacatttagttttcagatacaagtgggcttggtttctgcccatgaaattccctatcagcccactacacgctcagtcattggtttagcaccacaacaacgagaatgtcgcatcttggtagtagatgatgtagcagacagtcgattgttattagtgaaactcctgtcatctgttggttttgtggtgcaagaagccgccaatggtcaagaagctctggctatatggcaacagtggcatccacagttaatcttgatggatatgcggatgccaataatggatggttacgaagccactcacttcattcgttctgctgaaatagaaaatcacaccaccatacccaacccccacacaattatcattgctttgactgctcacgcttttgaagaacaacgccaggcaatgctgcaagtgggctgtgatgatttaattaacaagccgttctccgaaaaagaaattctcgaaaagctcaataaatatttaggaataaaatacctttatcaagaagacagttctcaaaccctaaaagctaggacaaaaatatttacacatgataatttgttacctttgttatctacactaccaagggattggctaataaatttatataatgccgccgcccaatgtagcgatgatttgattttaaagttagttggagaaatatctgccgaaaataccgctttgaaagagtattttgtagatttagcccataatttccagtttgaaaaaattatggagatagttagtact

SEQ ID NO: 42491 - DNA, 648 bp, Anabaena PCC7120
atgctaactgcgattctctttgatttagacggtactatcgtcaatactgatcctatacattaccaagcttggcgacaaatgttgtggaaatgcaacatagaaattgatgaaacattttataaatctcgaattagtggtcgtttaaacccagaaattgttaaggacattctgccagaattatcatcagccgcaggtagagaatttgccgatgaaaaagaagccttgtttcgggaactagcctcccatcttcaaccattaaacggatttgctgaactcatagcttggacagaagtacatcagttaaaacgtgctttagtaacaaatgctccgagattaaacgcagagtttatgttggaggtattgggaataacagatagtttccatcaaattgtcttggctgatgattgcgtagcgggtaaaccagatccagcaccttatcaagttgctttgagtaagttggggattccagcagagaaggcgatcgctttggaagattccccctctgggattcgcgcagcagttggcgcaggtattcgtactattgggattgcctccactcacgaccctgatattttgctggaggttggctcatttatggcgattcctgattttacagatttacatttgtggacgttactaaactcatta

SEQ ID NO: 42492 - DNA, 1479 bp, Anabaena PCC7120
acaacacaaaaaccccaaacaaccccccaacaaaaccacctaaaaaacttcatccaaaactacaaccaacgcacccaaacctccaaaaaaatagcccaacaaaatcgccaaatactagccgataaaacctcaataggtttcaactttgcaccagaaaccaaagaactctgctacccaattgctatcgaaaaatccaacggttctcgcctgtgggatgtcgatggaaacgaatacatagacatcctcatgggactaggaattaacttatttggacataaccccccattcattcaaacagccatcagcgaacaactacaacagggaatgcacatcggtgtccaaaatacactagctggcgaagtagcccaactcatcagcgaactaacaggtgcagaaagagtcacctttagtaacacaggtacagaagccgtcatgacagccgtgcgtatcgcccgcgccgccacaaaacgcccaaaaatagcgattttcaccaactcctaccacggacactttgattctgtacttgtccgggcaacaatgacagaatatgctaaaaaagccgcccgtcgcatcatcgccgctaaatctggtagttttatcggtagactagcccaaccaattcaagcccttttcacagccaacctcaatcccaaagccgtacccgcagccccaggtattcccaacagtgcagctgctgacgtactgattttagagtacggtaacgaacattctttaaagctgattcgcaaacatcgccgagaactcgccgccgtcttagtagaaccagtacaaagccgttgtcccgaactgcaaccgcgtgaatttctgcaacaactacgacaaatcacccaagaactaggaatagtcctgatttttgacgaaatggtgacaggttttcgcatccacccaggaggagcgcaagcacactttggtgtaaaagccgacattgcaacctatagcaaaatcgttgggggaggtctaccgctttcggtaattgctgggaaagctagttacatgaactacatagacggtggacaatggcaatttggagatgattccacgcctcaagttcccacaaccttctttgctggaacattttgcaaacatcccctcgccctcgccgccgcccgtgccaccttacaacacctcaaaatttcaggtattgaattacacaacgaattaaatcaacggactacgcaactcgtcaacgatttaaatactcacatgacacagcagggtatagctatcaagtttactagctttggctcattttttgctgtagcagcctcccaaagcgcagttcccccaatggcgataaacttactctcttatcacctcatcacaaaaggaatacatctgcgccaaggagacaaaggcggttttctttccacagcacacaccgaagaagatattaatctcatcaaaaaagcctttatcgacagtattaacgaactacgcaacgaaggatttattaacaac

SEQ ID NO: 42493 - DNA, 1884 bp, Anabaena PCC7120
atgccgaaacgcctgctagtggttgaatctccgggtaaagtgaaaaagctcagtcaaattttgggttctgagtggattgtccgtgcttcttgtggacatattcgggaactgagtgatgagggtgaggatgctttggggttcagcatggatggtagtagtgtgcagtgtcactacgtaccgcgtgaccaacgttcaaaagaaactatccagcagttaaagagtgcggcgaagcaggtaagtgaagttgtgttagggactgacccggatagggaaggagaaaccattgcttggcatctcaaggaagttttgggattgagagaaccgaaacgggttgtctatacagagattacagcctcggcggtacagagtgcgatcgctcatccgcgcaaactggacttaaatttagtcggggcgggattgtgtcgagattgtctagataagttggtcgggtataagggtagtcctctggtttgggcgttaaataatggggccaagagtgtggggagagtgcagagttctacactccacctgatttgtcaacgggagagggaaattcaaagttttgtacctcaagattattggagtgtttgggttgattatgttgaaggtttccgcgctttctataaaggtgcagttaacactcgctcaaactctccagaagcagaagtagaaattcatgatgatgcggcgggaaatagcacaactgcgcctgagtctacccgcgtacttgcagaagccgaagctaaccgtttagtagaagaagcacgccgtcatccccaccaaatcgtgcagtatgagggaaaagttgccaaccgtcaaccaccgccaccttttattacttccactctgcaacaagcggctggttctaagttgaagtttgcaccagagaagacgatgcagctagcccaaaagttgtatgaggctgggttgattacatatatgcggacagactcggtaatgttgagtccagagttttgtgaaagtgcgcgtcagtggttggaacaaaatgacccgcagaatgtaccgacacaggttgccagacatcgcagtagcaagacagcccaacaaggacacgaagcaattcgccccactgatgtgtttcgtccttccgcccagttgcgaatagaactatccacggatgagtttaacttgtatgtgatgatttggaaacgggcgatcgcttcccaatgtcgtccagcccaactacgcaaaacggtcgtaatcacccagtctggtcaaattctttggcaagcaagaggacaagtagtagaatttctcggttatacccgctactggcctaatctcagcaaggataccctcttacccaccttgcaacaagggcaaatggtaactttagaaaatgccggtcacgagaaaaaacaaacccaacctccaccacgctacagcgaaccaaagttagtgcaacttatggaacgtaaaggcattggtcgtcccagtacctattctcccaccatcgccaccctgaagaaacggggttacgtcgaactgaccaaagacaacttacacccaacaaatctaggtttagaagttgatactttcttacaaaaagccctaccggatttactagaagcagaatttactgccaaaatggaaaatgccctcgatgcgatcgctgaaggtaaacaaccttggcagatatacttgaccacttggaatcagaattattttgccccagctttagccaaagctaagactgtcactgtcgattcaggcaagacgacaaaaacttttcccgcgcgtcaatacgataccagccggactcgctgccctgattgcaataactttctcagcaaaattcccagcagtaaactgaagaaaaaatacttcctcaaatgcactagcggttgtgaaaacactgtctta

SEQ ID NO: 42494 - DNA, 1668 bp, Anabaena PCC7120
cttgtagactacctcaagccgcaaaagagtaggatggtcaaatttgcgatcgcactcctcgttagcatcggcttacaaatcctcaacccccaaattctccgttatttcattgacacagctgttagtggtggggatagccaaaaattactcttagcggccttgctatttattggtgtagccttaatcacccaagcaatgtcaattatagccacattctacggtgaaaatgtcgcctggacagctactaataatttgcgtgcagatttagtagagcattgtttgagactagatttatccttccacaaataccgtacaccaggggaactagtggaacgcatagacggcgatgtgcagaatttatcagaatttttctcgaaatttactattcacatcttgggtaatttgctcatggtgttgggtgtgatagtagtcctgtttatagaagattggcgagccggtttagctattttattgtttgctctcaccgccttatctactctgattaagttgcgtagaatttcagttttccattggggagggtatcgccaatttagtgcagagttttttggcttcttaggtgaacagctaaccgggatggaagacatccgcgccaatggcgcgaaaaactatgtcatgcaacgcttctatacaataattcgtaactggctacccatctttcataaagcccgctttgccgatacaattctttgggtgacaaccaacggtatatttactttaggcagtgtaattgctctcatcgttggtgcttacctatggagtcaacagacaattaccatcggtacagtttacctattgtattactacaccaatattctcagcgaaccgattgaacaaattcgcaaccaatttgaagacctccaacaagcagatgcgagtatttaccgcatcacagacttattacaaattcaatctcaattacgtacaagcggcgaaaaattacttcccccaggtgcgctgtctatagctgtcgagaatatctcctttgcttacaatgaccggaaaaatgatactgaagattgggtattgcaagatgtatcttttaatttacctgcgggtcaggtgttgggtttactgggacgtacaggaagcggaaagtctactttggcgcgattactcttgagattgtatgatccacaatcaggttcaattcggttgggtggtgtacctatcgaccaaaccccactccaagaattaccggggaaagtcggattagtaactcaagatgtgcaactttttcaaaccacagttcgcaataacctgactttttttaatcctgacattactagcgatcgcatccatgaaacaatagaaatgttgggcttgtcagaatggttgcactctttacccaacggcttagatacaactctagggccagatagtagcggcttgtcagcaggacaagcgcagctattagcctttacccgtgtatttctcaaaaatcctggcttagtaattctcgatgaagcttcttcacgtcttgacccaatgacagaaagactcattgaaaaagctatagataaattattgatgggacggactgctattattattgcccatcgtttagcaaccgtagaaagagccaatcaaatcttaattttagacaaaggtaaaataagtgaatacggtgaacgaaaagaactagcaaac

SEQ ID NO: 42495 - DNA, 1524 bp, Anabaena PCC7120
cgttttactatgaggtcattactgagaagaaatttattagaacgtctcttaaataatcctcatgctcaaattaaggctgctcataatgatactgaaaaaactgtatcccaaggtgaagtaatcagctattttcgagatgataccgaacacattgaagataatgtggcatgggtatcagaaatatttggagaaggaatatttgctgttctttctttagtcatattattaagtgtcaatgtccccatgacactatttgttttcctccccttagtgggaatggtagtaattatccaaaaaacagaaacccgcatcaaacaatatcgcaaatctagccgtcaagcaactcaacaagtgacaggcattttaggagaaatatttagttctgtacaagctattaaagtagctggtgcagaacaagatgtcctctcttattttcgcactttgaatgataaccgtcgggagacgatggttaaagacaccctattaaaagccattctcaattcactatttcaaaacatggtgaatttcggtacaggtttaattttggtgatggcttcttttttgatgcaaagtggcagtaatcaattaacagtaggtgactttgctttatttgtttataatctatcatttgtcacaggtttttttgcctctgtaggcggctttatggcattgtataagcaaacggaagttgcttttgaacgtatgactactttaatttctggtgcatcaacagagactttggtagccccaaatcaactttatttacaagacttgggtaaaagtagaaaaaacttacctcgattagaacaaccaaaaaataatgcaagtcatcaactacaatcattaaaactaacaaatttaacttatatttatcctggtactactcaaggaattgtagatattaacttacaaatacagcgcggtagtttgactgtaattactgggcgcatcggtgcaggaaaaactacattgctcagagtattattaggattattacccaaacaagccggggaaatttattggaataatcatctagttgcagaccctgctaatttttttgtcccacctcgcagtgcttacactccgcaaattccccaactgttcagctattccttacgagaaaacattttgctgggattgtctaaggatgatgctgatattgaaacagcattaaaaatggctgtatttgagcaagatttagcagctatgaacgagaagttagaaactttagtgggaacaaaaggtgtgcggctttctggtggacaaatgcaacgggtagcggcggcgcggatgtttgtacgtcaaccagaattactgatatttgatgacctttctagcgcgttggatgtggaaacagaattggcattatggtcgcggatatttgctaatacaactgaggaaaatccttggacaccaacttgtctggtggtgtctcatcgccgttctgttttacgacgcgctgaccagattattgtaatgaaagcaggtagggttgtagcacaaggtaagtttgaagatatttta

SEQ ID NO: 42496 - DNA, 2328 bp, Anabaena PCC7120
gcaccaggcgcaccgggtgtttcctctgtttggtcttatgctggaaagcaaggcattggaacatcctatgaacagtatgtgaataacaaatatagcgatcgcgctcctacaaatgccatctccaaggtttggttttcgattgctcaaggcattgtgacggaaaccgcttatggagaaatcgatcgcgcccagatcaacgacttacaatttttagtcacaggaaaaggtttttttgacgaagagaaggttgctaccgaaagcaaggtggactatctagataaagatagtgatggtagaccgctttctcccgcttatcgtgtcatcaatacggataaagaaggcaaatacactattgaaaagcacatctttaccgatcctgatcaccaaaccttgtttacaaaagtgatctttactgcgaatgaggataacattaccccctacattctcatcaatcctcacatgaataatactggcaaagaagatgtagcttttgtcaaaagcgatagtctcaatgctagggaaggagaaattgtttatctcagtttgaagagttcattaccttttgtgaaaacctcagctggatatgtagctcgtagtgacggctatcaagatttaaaagacaacggggtgatggactggacttatgactacactgatcagagcaagccggggagtgtagctatgataggtcaactgcctgccctcagtaaaggacaaacttccacctttaatattgctgtaggctttggcagcacctatgaagcagcaactgaacaagccgatgcttctttaaaagaaggttacgaaagtctgttagcaaaatacaacggcaaaggcaacgctgtaggatgggaagattatctagcaagtcttagcaatctgccggccatgattgccaacactggtgacaaggggaaacagctatatgctagtgctttcaccctcaaaagtatggaagataaagaaaatccaggggctttaattgcttctttatccgttccttggggagatactgtgaacgcagacacctttgccacaggctatcgagcggtttggccgagagacttttatcaagcggcgatggcgttgttagctttaggagataaagaaactcctttaacggcttttaaatacctcccacaagtacaagtgcaatcagatacactaggtaactctggggctacaggctggtttttacaaaaaactcacgttgatggaaccttggaatggctgggagtgcagttagatcaaactgctatgcccattatgttgggttggaaattgtggaaagccggagtcttgtcggatggtgaaatcactcagcaatatcgcacgatgttgaaacctgccgcagaatttctggctaatggcggtaatgtcaatatacatacctctaatcaagcaaacaaccgcaagataaatccaccaagcactcatcaagaacgatgggaagaacaatcaggatattccccctctacaacggctgcgattattactgggttagttgcggcagctgatattgctgaaaatgcagctgatgatcctggtgcagccgcattctatttcagtaaagcagatgaatatcaaaagaatgtggataaatttatgtttaccacaactggagatgttaagaactgtaatggctctagtgaatatcttctgagagttacccctaatgcagatcctaacgatggaagtcgcatccacgacaacaatagtttactagaagcggatgaacgccagattttagatggtggtttcttggaactggtacgttatggagtcagaaaaggagatgatgctcacattgctgccagtgtttgcgccttggataatatcaacctctcagaagctttaagggttaggtatgacatagcttttgatggtaaaaagtatccaggattccgacgttatggcaatgatggctatggtgaacaaatcaacgatggtagtaactttcgggatattgatgacggacagaaaaaagatcgcagaggaaggatttggccgttcttcactggtgaacgtggtcattatgaacttgagttagctaaagctaaacatggaggaactattagcgatcaagaggttgctaaactacgggatacttatgtacgagcaatggaatattttgctaacgaaagtctcatgcttcctgaacaagtgtgggatggtgttggtgctaatactgctcataaatacatcactggtgaaggaacgaatagcgccacacctttagcttgggcgcacgccgaatatatcaagttagtcaaatctttgactgataagaatgtttgggattcctaccccattgttcaggcaagatac

SEQ ID NO: 42497 - DNA, 1281 bp, Anabaena PCC7120
ctgcgaatcattactcagcaggcagatgttaaagcagaactgcaaagaatctgcgatcgcactcacgacgaacaggtgcttcacaaggaagcaactgtgcgtgaagtgttgcaagcagtgaaacgccaaggcgacaaagctgttttgcattacacagacgaatttgacaatcaaattctcaaggctgaagagttgcgcgttacaggttcagaactggacgcagcttaccaacaggtatcccaggaactgctggaggcgattcagctagctagccgccaaattgaagcttttcatcgtcagcgagtccccaaaagctgggtacactttggcgatgatgatattgtcctgggcaaacgctacactcccatagaccgtgcgggtttgtacgttcctggtggtcgtgctgcttacgtcagtacagtgctgatgaacgcaattccggcgagggtggcgggtgtaccgcgtatagtgattgcgacaccaccaggcgcacagaaagcgattaatcccgcagtgttagtagcagctcaagaagttggggtgcaagaaatttatcgggtagggggggcgcaagcgatcgctgctttggcctatggtacagagacaatccccaaggtggatgtgattacggggcctggtaacatctatgtcaccttggcgaaaaaactagtttacggcaatgtggggatcgattccttagcaggtcctagtgaagtgctgattattgccgacgaaggggcaaatcctgtccatgtagccactgatatgctggcacaagcggaacatgacccaatggctgcggcaattttgtttaccacagacccagctttggcaaagaatgtccaagtagcggtggaaagacaattggtagatcatccacggcggatagataccgaaaaagcgatcgctcattacggtttaatcgtgctggtagaatccctagatgcagcagcagaactctcgaatgaatttgcaccagaacacctagagttagaagttaaagatccttgggctgtattacctaacattcgccatgcaggagctatattcctcggttattccacaccagaagccgtaggagattatctagcaggccccaaccataccctacctacatctggtgctgcccgttatgcctctgccttaagtgtagaaactttcctcaaacattccagtattattcagtattcccaaactgcgctcaacaaggtagctggagccattgacgctttagccacagccgagggcttaccctctcacgctgactcagtgaagcggcga

SEQ ID NO: 42498 - DNA, 1374 bp, Anabaena PCC7120
gattttcgtattgaacgcgattcgatgggcgatcgccaaattgctagtgatgtttattacggtattcaaactctccgagccgttgaaaatttccccattagtggtcttaagcccttacctacttacgtagatgctggtcttttaattaaaaaagctacagcaattgtcaatggagaactaggttgtattccccaagatattagccaagcgattgtgcaagcaaccgatgaaattctggcagggaagttaagagatcagttcgtcgttgatgtctatcaagctggtgcaggcacatcccaccacatgaacattaacgaagtcctagcaaatcgggctttggaaattttgggtgcagaaaagggcaattaccaacgagttagccctaatgatcatgtgaactacgggcagtctaccaacgatgttattcccacagcaattcgcatcggtggcttattggcactgaccaaaacattacagccagcattagaaaaagcgatcgccgccttagaacacaaagctgtagaatttcaagatattgtcaaatctggcagaacccatttacaggatgccgttcccgtccgcttgggtgataatttcgccgcttgggcgcatatcctctcagaacatcaaaaccgcatttacactgcctctggagacttgatggtactcggtttaggtggtagtgcggcgggaacaggcttaaacacccatcctcaataccgcgcccgtgtggtggaagtactggcagaattactaaacttaccactccaacccgccccccatctcatggctgccatgcagagtatgtccccatttgtgaacgtttccggggcgatacgcaacctagcccaagacttagcgaaaatttcccacgacttgaggctgatggactccgggccaaaaactggtttaaaagaaattcaactacccccagtccaacccggttcctcaatcatgccaggcaaatataaccccgttatggcagagatgacatcgatggtgtgtttccaggtgatgggttacgatcaggcgatcgctcttgcagcccaagccggacaattagaattaaacgtgatgatgccgttgattgcctatgatttgatccacagcatcgaaattctggggtcaaccatcgccgcccttacagaacgctgcattcaaggaattaccgccaacaaagaacgctgtttagcctacgccgaaggcagtttagctttagttaccgccctcaacactcacattggttatttaaatgccgcagatgtcgccaaagaatccttaaacacaggaaaatctctaaggcagattgtgttagaaaaaggactgatgagcgaagcagagttagccaccgtgttaaatctagaagaaatgagt

SEQ ID NO: 42499 - DNA, 2703 bp, Anabaena PCC7120
atccaatcacatcaatggcacaatttatctgcatcaaaagtggctcaatatttagatgcaaatctagatacaggtttgacatcaaatcagatagcaaaacggcaggaaagctttggtgcgaatgaactcaagggtaaaaagggaactagcccgatagtcagatttcttctacaattcaatcagccgttgctgtacattttgctgattgcaggtgcaatcaaagccttaattgggcagtgggtaaatgcttgggtgatttggggtgtcaccttaattaatgccattattggttttgtgcaagaatcaaaagctgaaagtgcgatcgcagctttagcttcttcagtccaaactaatgcaactatcctacgcaacggtcaaaaggtacaagttccttcacaagaattagtccctggcgatttagtactactgacctctggtgataaagtacccgccgatttgcgtttgattcagtcccgcaatctccaagtgaatgaatctgccctcactggtgagtcggttgctattgagaaaaataccgaacctgtggacgcgaatgcagttttagcagaacgcagcaacatggcttatgctggcagttttgtgacctttggcactggtaaggggattgttgtagccattggggaagctacggaaaccgggcggatatcccaactgatggagcagggtacaagccttaagactcccctaacacggaaatttgataaatttagccgcacattactatacataattttgggcatcgctgccctgacgtttgccgttggactgggatacggtaattcctgggcaagtatgtttgaagcggcggtggcttttgctgtcagtgccattcctgaaggattacctgccgtagtgacggtaacattggcaataggtgtttcacggatggcgaagcgacacgcgattgtgaggaaattaccagccgtggaaaccctcggtggcgctacagtcatctgctcggataaaacgggtacactcacagaaaaccagatgactgtacaggtgatttatactgacggtcaatactatacagttacagggacaggttatattcccgaaggtgaaatcttacgcgatgaacagccagtagattggcgtagttctcccgtattggcagaatgtctgcaagccggattgttatgtaatgattcccacttagagcagaaggaaggagaatggcaagttatcggtgatcctactgaaggagcgttgatagttgtggcgaataaagtggggctgactagcaataacttagaatcagaaatgcccaggctagatgtcatcccctttgagtctgagtttcaatacatggcaactttgcatgaagggggaagtggagaaaattctgcaagagtcaggactatctatgtaaagggttccgttgaggctattgtgcaacgttgtcagcagatgttaactggaggtaatcttgtttctgtggatgcccagactttacatcaagaagttgagacaatggctcatcagggtttgcgggtgttggcgtttgcacggaaaactgtatcggttagtcaagattccctggatcatgcagatatcgacaatgatttggttttcttgggactacaaggaatgatcgatcccccacgagcagaagcgatcgccgccgtagctgcttgtcaaaatgcggggattcaagtcaaaatgatcacaggcgaccacgctgccacagcacaagcgatcgctcaaaggatgggctttaatcaaaatggggaagttctcgcctttactggcgcgcaactagcccaaatgtcacaaacacaactggctactgccatagaagatggggctgtatttgcccgtgttgccccagaacagaaactccgccttgtagaagccttgcaatcaaaaggcgaggttgtagcgatgacgggggatggtgtcaatgatgcaccagccttgagacaagcagatattggcattgcaatggggggtgcgggtacagaagtagccaaagaagccgccgacatgattttgactgatgataactttgcttccatagaagcggcagtggaggaaggacggactgtttaccgcaacttattaaaagcgatcgccttcattttacctgtgaatggcggcgaatccatgacgattttaattagtgttttacttgccagagaattaccaattttatctttacaagtcctctggttaaatatggttaattccattgctatgactgtacccttggcttttgaaccaagttctcaacgggttatgcagttaccaccccgtagccctcgtgagccattactctccaaaagtttagtcaagcgcatcttcgcaatttctatctttaactggatattaatatttggtgtatttgaatggattaaacaatctacaggcaatattgatttagccagaacaatggcaattcaggcgttagtatctggaagatttttttatcttttaagtattagtcagttaggaattgctgccattaatttcctgcgaggagttaggcagaaacttagcgatatatcagccatagctatcggcattgtaactacaatcattttgcagataattttcagtcaatggagcttgatgaatcagttatttgctactgcaccattgaatttaactcaatggttaacttgcctacttgtaggtttaccaatgattcccgtagcacttatagtcaataagttcgacccc

SEQ ID NO: 42500 - DNA, 828 bp, Anabaena PCC7120
atgtcgctagtcgtgtcaacttctgcaaaacactttccggcttgggcttttttctcactggtatccaacggcatactgatgctggctgtcatcttgctaatttggcaacagcagaaattgtctatcctttccagtaatgcgcccctctcggttccagttagtcaaccccaagctgttgcaccagagttaggtccccgtcaccaactcaattaccaacaatgggtagatattcttaaacaagaagccaacgtcgctgccgaaaaacgtccccagcgcttaagcataatggctggggattctctaagtctgtggtttcccgtcgaattattaccagaagataggaactggctcaatcaaggaatttctggcgaaaccagtcgtggactattacaaagattgaatctttttgacaagactcaaccagagacgatttttgtcatgattggcattaatgacctaattcgtggggtaaatgatgaagtcattttagataatcagcgacaaattctccgttacctacgaaaaactcaccccaaaactaaaatctttgtccagtcaattttgcctcatggggcagaggaggcaacctgggaaggaagagaaaaacttttagctattcccaacagccgtattcagaagttaaatcagcaattacaaagtatagctactaaacaaagtgttaaatatctggatttgtatcccttgtttactaaccaaaaaggaaatatacgctcagagtttaccactgatggcttacacttaagccccgcaggttatgtggtttggcgtactgcgttgcaagtttatcaacagggagtagacagataa

SEQ ID NO: 42501 - DNA, 3636 bp, Anabaena PCC7120
agaaaggctgcctttttggctaattctcgctgtgctgatttagatattcgtgtgtttagcgatcgcgatattaccagcaagcgcctagaagtggaagcggcattgcaaggcgcggatgtgttttttggtagcctactatttgattatgaccaagttgtgtggttgcgcgatcgtgtttcccaaattcctatccgcttagtattcgagtcagccttggagttgatgagtttaactaagctgggtgcttttgccattggtgataaaccaaagggaatgcccaaacctgttaaatttattctcgacaaatttagcaacggacgagaagaagacaaacttgctggttatattagctttttaaaaatcggccccaaactcctcaaattcgttcccgtgcagaaagtccaagacttacgcaactggttaattatctatggttattggaacgccggcggcactgaaaacgtggctgctttattttggacactagcagaaaaatatttagatttaaaaatcggtgacattcccccaccaatcgaaacccccaacataggtttattgcatcccgattatccagggttttttgaatccccacgcgaatatttggcatggtatcaaaagagggaagaggcaggggtgcagggggcagggtgcaggggggaaaaaaaccctgttgttggtattcttctttaccgtaaacacgtcattaccaaacaaccctatattccccaactgattcgccgctttgaagatgcgggtttaatccccttacccatatttatcaacggcgtagaaggacacgttgcggtacgggattggatgactaccgactatgaatttcagcaacgacaaatcggtaatatcgccacaccttcactatctccagaagccgttaaagttgatgcaattgtttccaccattggctttcccctggtcggtggcccggctggttcaatggaagcaggtcgtcaagtagaagtagccaagcgcatcctcaccgccaaaaatgtcccttacatcgtcgctgcacctttattaattcaagatatccattcatggacacgtcaaggtgtgggtggtttgcaaagcgtggtgttatacgccttaccagaattagacggtgcaattgatactgttccccttggtggtttggtgggtgaagatatttatttagttcctgaacgggtacagcgcctcattggtagagttaaaagctggattgctttacgtcaaacaccagcagcagaacggaaaattgccattatcttatatggcttccctcctggttatggggctacgggtacggctgcattattaaatgttccccgcagtttgattaaattactccacgccctcaaagaccaaggttataacgtcggcgatatcccagaagatggggaagaattaattcgtctggtgaaggaaactgatgaagagatggaaagatgggagaaaaataaaccttttccctcttcagctaatactgttaattcccgtaaattagaaaaatggttaggatatctccgcacttcccgcatcgaaaaacaatggaagtctttgacaggtagcggaattaaaacttatggtgatgaactccatgttggtggtgtgcagttagggaatgtgtggataggtgtccagccaccattggggatacaaggcgaccccatgcgcctgatgtttgaacgtgatttaacaccccatccccaatatgctgccttttataaatggttgcaaaatgatttacaagctgatgctgttgtccattttggaatgcacgggactgtagaatggttacctggttcacctttgggtaatactggttattcgtggtcggatattttgttaggagatttgcccaatctatatatatatgcggcaaataatccttctgagtcgattttggccaagcgtcgcggttatggggtgctaatttctcacaatgtccccccctatggtcgtgctggtttatataaggaattaattacactgcgcgatttaattgcggaatatcgagaagaccccaacaagaattatgttctcaaagaagcgatttgtaaaaagattgttgatacgggtttagacacagattgcccttttgaagatgccaaacgtttgggtattcccttcactcctgaaaatatcaggatgtttagcgcccatgcttttgatgattatctggtgaaattatatgagtatttgcaagttttagaaactcggttattttcctctggcttacatacattaggtgaagcaccaaatcaagaagaattagcatcttatctcgaagcttattttggtgaagaacaagcaaaacaaccagaaatggaaaagcaaattacagatttgttgatgcaaaccacagatgaattaactaatttactacgcggattaaatggtgaatatattcctccagcaccgggaggggatttattacgagatggcgctggtgtgttacctacagggagaaatattcatgctttagacccctatagaatgccatcccccgcagcttatgaacggggtcgagaaattgctcaaaaaatcatcgctcagcatttacaagaacatcatacatatcctgaaacggtggcggttttattgtggggattagatgcaattaaaactaagggtgaatctttggggattcttttagaattagttggggctgaacctgtgaaagaaggaacaggtcggattgttcgttatgaattaaagcctttagcagaggtcggacatccgcgcattgatgtattaggaaatctatcagggatttttagagatagtttcgtcaacatcatcgaattattagatgatttatttcaaagggctgctgacgctgatgaaccagaagaccagaattttgtgagaaaacacgctttagctttaaaagcccaaggtgtagaaaatgcttccgcgagattattttccaatcctgcgggggattttggttctttggtcaatgatagagttgttgatggtaactgggaatctggggaagagttaggtaatacttggcaaagtcgcaatgtgtttagctatggcagacaagacaaaggacaagctagaccggaagttttgcagcaattattgaaaacgagcgatcgcatcgttcaagaaatagattcggtagaatatggtttaaccgatattcaagaatattacgccaacaccggcggtttgaaaaaagcagccgaaaagcaaagcggtaagaaagttacggctagctttgtggaaagtttttccaaagacaccacaccccgcaacttagaggatttattgcggatggaataccgcaccaagttactcaatcccaaatgggctgatgcaatggcgagtcaaggttccggtggtgcttacgaaatttcccaacgcatgacagccttaattggttggggtggtacggctgattttaaagatgattgggtttatgaccaggctgctgatacttatgctttagaccccgaaatggcagagaaattacgccaagccaacccagaagcttttcgtaatatcctcagcaggatgttagaagcgcatggacggggtttatggcaagctgatacagataagttagataagttgcgtcagttgtatgaattgactgatgaacaattagaaggcgtaacggtttaaata

SEQ ID NO: 42502 - DNA, 3250 bp, Anabaena PCC7120
gatattgagcaaattcgtacttttatcggtactagtttgattcaggtgattagtggaatagtgacgttgattagtgcagccgtaattttgctaatcatgaattggcaattagcaataattaccttaacagtagtacccatgtcagggtggttaatggcgcgattcatcactcaaaatgaccgactgttccggcaagtacaagagcagctgagtgacctaaatgctgtattgcaagagaatctgattggtatcagggtagttaaagcttttgtgcgggagtcggcggaaaggtcacgttatacaggtctgaatgatgcccttgttacggctaacatgaagacaattcgcgccattcgtaataccttcccatttatctttttactgagtaacttggtaaccctggcggtgtttggctatggtggggcgcaggtgattggtaatactttctctattggtgaactagtagcctttaacgcctatctcatattaattttgcaaccaattttactgattggctttgctgcaccagcgatcgcccaagcagccgcttctgctcaacgagtctatgaagttgtagatgcagcagtagaaatccgcgatcgcgctgatgccattccctttgaaacttgtggtggtagaatcacctttgaaaatgtgtctttccgctatcctggtgcagctacagaagccctcaaagatgtttcctttgaaactaaacctaacgaattaatagccattttaggcatgacaggttccggaaaaagtaccgtcatgaacctgattccccgcttttatgatgtcaccaaaggcgcaattcgcattgatgggcaggatgtgcgagacttcaccctcaacagcctgagaaagcacatcggcattgtatttcaagaaaccaccctattttcgggaaccatccgcgaaaatatcgcctacgccaaacctaaagcatcattagaacaggtgatggaagtagcgaaaactgctcaaattcatgattttattatgagcctgcccgatggttacgaaaccatagttggtgaacgtggcgtaggtttatctggtggacaaaagcaacgcatagcgatcgcccgcaccctcctcaccgattacagtattttgatcttggatgatagtacctcggctgtcgatgccaaaaccgccgccgaaatacaagccgaactggatagcatgatgcggcaaaaagcttgtgtcacctttgttgtggctcaacgtatcagcacagtcaagaacgctgatcgcatttttctcatagataaaggacggttagcagcccaaggtactcacgaggaattgatgcaaactagcccactttacggcgcgattttggaatctcaggtgaagaagagacaggaggcagaggagcgggggagcaggggagcaggggagacataagaagtaatgattgtttactcctaactcattacccattacccattacccattacccattacccccatgagaactccagccccagttattgcctccgagcaacaagcaactaagcaactttcaaccttacgacgcttcttacaatacctgcgtccctttcgcaaagaagttcccattgctttgagtttagtattaactggcgctgccacccaggcgatcgggccgtttttactgggttggtcagttgataacctgatagccaaagggaatttacaaggattactactgttattagtattattagggctaaattatagttttggtatctgggcaatccgtgggcaagttattcgcgtcggctggattatgcagcgattactggctcagttgaggcaagacatttttactaaaattcagagtttaccactcagcttttttgaccgtagtgaagccggcgatttaatgagtcgtctgctaaatgatgtcaacactgttaatcaagcctttgggcaaacagtggcacaaatgctaggtaataccttcagtttggtgggtattgtcattgctatgctctctattaatttacaacttggtttgttaagtaacctagtcgtccctctgatgatttttaccaccagcttatttgcccggtgggctaggactaaatttcgcgtcaccagacaaaccatcggagaactttccgccaagttagaagaagacattggcagtgtgtgagaagcccaagcctttaatcgggtacatctcaacatcgcagaattcgacattctcaacgccgctaatcgtgatgccaacgttgaggctgtggcgattacggcagcatttttaccatcaattgattttctcaacaccctagctacagcaggtgtccttgcctatggtggttatcttgctgtgacaggtgcagctacagtaggtgtagtgacatcatttttactttacgtccagcaattcttccgccccatccaaattctcagtcagttttacacccaagctcaatctgcatttgccggattagagcgaattttcctcttactagatgaaccatcccaactcaacgacgcaccaaacgccacccaaatgcctgctattcaaggcaaggtgacgttcgagaatgtcaaatttggttataacccagaacaactagtcctcaaaggagtgaatttacaggctaatccaggacaaatggtggcattagtaggggcaacaggctcaggcaaaacaacaattattaacttgatattgcgtttttatgatgtgtctgacggtgcagtaaaaattgatggcgttgatgtgcgtagtgtgactcaagccagtctccgccgtcagattggcattgtcttgcaagataatattttgtttagcggtactgttgccgaaaatattgcttttggtgcgccttatgccactcaagccgaaattgaagcggcggcacaaatggcaaacgtccatgagtttatcacttcactaccacaaggctacacaaccaaattgggtgaacggggcgcgcctctcagccaaggacaaagacaactcattagtattgctcgtgccgtattaattaacccccgcatcttgattcttgacgaagcaactagtagtatagatacccgtacagaagctctagtacaagatgcgatcgctcgtttattacaaggtcgcaccagttttgttattgcccaccgtctcagcactgtcacccaagctaatcaagtattggttattcagcaagggcaaatcatagaacggggtactcatgcagaacttgtcagccagcaaggtatttacgctaatctttacgcactccaattaggggcagca

SEQ ID NO: 42503 - DNA, 957 bp, Anabaena PCC7120
cgcccccgtcggttgcgtcggactgcaacactgaggcggatggtgcgggaaactaccctgacagtggatgatttgatttatccgatgtttgtcatggaaggagaggggcagaaagtagaaattacttccatgccaggatgttatcgctactccctagatttgttgctcaaagagatagccgaagtatcacagctaggaattccggcgatcgcacttttccctgtcatctccgaaaataagaaagatgacatcggtgcagaaagctacaacccagagggattagtacagcaaacagtcaaagccattaaacaagcagttcccgatattgttgtgatcactgacgtagcccttgaccccttcaccacacatggacacgatggtttagttgatgaaaacggcacaatcttaaatgaccccacagtggaaatgttagtgaaaatggcactttcccaagccgccgccggtacagattttgttgccccttccgacatgatggacggcagaattggcgcaatccgtcaagccttagatgcagaaggctacatcaatgtagggattttggcatactccgctaaatacgcctccgcctattacggcccctttcgggatgcgttagattccgcccccaaatttggcgacaaaaaaacctatcaaatggatgcagccaacgccagagaagcaattaaagaagtagaactagatattgtcgaaggtgcagatattgttatggtaaaacctgccctagcttacctagatatcattcatcaagtccagcaagctacccagttaccagttgcagcctacaacgtcagtggcgaatacgccatgatcaaagctgcggctcaaatgggttggattaatgaaaaacaagtgattttggaatctttaaccagcatgaaacgcgccggcgcagatttaattctcacctactttgccaaagaagtagcactgatgttg

SEQ ID NO: 42504 - DNA, 339 bp, Anabaena PCC7120
gtattaggtgttagttttagcccgactgaaaaattattggcttctgctggttgggacaacacagtcagtttatggcgacgagatgggactttgttgcaaaccttgttaaaaggcttgagcgacagcgttaatgctgtgaattttagtcctaatggtgaaatacttgctgctgctaattgggatagtacagtcaaattgtggagccgtgagggcaaattaattaaaaccctcaacggacacgaagctcctgtgttgagcgtcagttttagccctgatggacagacgttagcttcagctagcgatgacaacacaattattttatggaacttacatcttgat

SEQ ID NO: 42505 - DNA, 774 bp, Anabaena PCC7120
cgctacgaaattcaacagctattaggaaaaaaagctgggcggcggacactacttgctaaagatgttgtcactggcgaattagtaattgtcaagctgctggtttttagtagtgactttgagtgggatgatctcaagctgtttgagcgtgaagctgaaactctcaagtctttatctcatccccatattccgcgatatttggactattttgaggtaaatccccctaccatcaaagggtttgcccttgtacagagttatatctcagcccaaactttagagcaatacttacaatctgggcgtagttttagtgaatctgatattaaacaaatagccacagcaattttagagattcttatatatctacatggattgtatccgcctgttattcaccgtgatattaagcctagcaatattttgttgggagagcgttctggtaataatgtcggtcaagtgtatctaatagattttggttctgtacagacagctttgggtgcagaaggtgggacaaggactgtagtaggaacctacggttatatgcccccagaacaatttggtggacgtacagtcacagcctctgatctttatagcttaggggcaacattaatttatttggtaacaggtactcaccctgctgatttaccccaaaaagattttcgtatccagtttgagtcagtagctaatctcagtccgggtttggctgcttggttaaagacaatgactgaacccagtgtagaaaggcgcttcagttcaccacagcaagcactcaaagccttagaa

SEQ ID NO: 42506 - DNA, 1449 bp, Anabaena PCC7120
cttgatcaaaaccaaacaccactaatagaatctataaaagcttgtactgctcgacatcatgcagcgttttatactcctgggcataagcaggggagggggattgctcaacctttggctgatttgttgggtaaagcggtatttagtgctgatttgacggagttggctgatttagataatttatctgcgccccaaggagtgattcaggaagcccaacaattagcggcggcggcgtttggtgcctcacagacatggtttttggtcaatggttctacttgcggtgtcgaggcggcaattctggctacttgtagaccgggggataaaattattttgcctcggaatgtacattcatcggcgatcgctggtttaattctctctggtgctatcccgatttttatttatcctgaatatgacccagttttagatatcgcccatagcatcacgcctgaggctgtaaaagcagctttgcaacaacatcctgatgctaaagcggtgttgacagtttaccctacatattacggtgtatgtggggatttagaggcgatcgcccaagtcacccaccactacaatattcctttactagtagatgaagcccacggcgcacacttcgcttttcacccagaattacccacctcggccttagccgcaggtgcagatttaactgtacagtcgattcacaaggtactgggtgcaatgacgcaagcttcaatgcttcacatccaaggtgacagaataaatgcggttcgagttagtcaggctttgcagctgctacagtctactagccccagttatgtacttctagcttccctggatgcggctcgtcaacaaatggctttgtctggtaaacagttaatgtcccgtaccttacaactagcgaatgaagccagagaaagaattagtcaaattcctggcttatcagttttacagcctcctaccaagacaccatcaccagggtttacaactttggataaaacacgcttaactgtgactgtttccggcttgggtttaacgggttttgcggcggaagaaattttagatgaacaactgggggtaacggctgaatttgctacgttgcaacatctcacctttattattagcttgggaaacacagctactgatattgagcagttagtccaaggtttcacaactttagcagaaacaacactgcctactaaggcattagtcaacccaaaagttaatagtaatctggaatatttttcagaaatttctccccgtgatgccttttttgccgatagtgaaacgttatccatcgaacaggcgtgcgatggcatttgtgcagaaattgtctgtccttatcccccaggaatccccgtccttatgccaggagaagttatcacaaaacccgccattgaatatttgcaacatatccaaagtttaggcggattcattactggttgtgccgatactagtctgaatactttaaaagtttta

SEQ ID NO: 42507 - DNA, 918 bp, Anabaena PCC7120
atggcagcattgttaggacgagatttgttaagtctggcagacttgactcctacagaacttcaggaacttctgcaattggcgacccaattgaaatcgcaacagttgaagttgcggtgtaataaagtattgggtttgttattttctaaggcttcaactcggacaccagtcagttttactgtggcgatgtaccaactgggtggacaagttattgatctcaatccgaatgtgactcaagttagtcggggagaaccagtacaagatactgcacgattattagagcgatatttggatgttttggcaattcgcacttttgaacagcaggagttagcaacttttgctgagtatgcgaaaattcctgtaattaatgcactcactgatttagaacatccttgccagatattagcggatttattaactgtgcaagaatgttttgactcaatttctgggctaactttgacctatgttggtgatggcaataatgtcgccaattctttgatgcttggctgtgctttggcggggatgaatgtgagaattgccactcctagcggatatgaaccaaatccgcaagttgtcgcacaagcacaagcaatagctgatgggaaaacggaaatcctcctaactaatgacccagacttagcaaccaaaggtgcatcggtactttacactgatgtttgggcgagtatgggacaagaagcagaagcagacgatcgctttcctattttccaaccttatcaaatttctgagcagttattaagtctggctgaaccaaatgcaattgttttacattgcttaccagcccatcgtggtgaagagattacagaagaagtaatcgaaggttctcaatcacgagtttggcaacaagcggaaaatcgattgcacgttcaaaaagctttgcttgctagtatcttaggggcagag

SEQ ID NO: 42508 - DNA, 2073 bp, Anabaena PCC7120
atgaagctgacttcaattaaactatgcaattttcgctctttttatggcagaacaccggagatagttatcgctgggggagatgttctcaacactacgataattcatgggaataatggctcaggtaaaactagtttacttaatgcctttacgtgggtattatatgagaagtttagtgcagcttttgcctcgatagaacaactagttaataaacgagcgatcgccgaagctaaacttggacaagctgtagaatgttgggtagagattaactgggaacacgaaggtaaacgctacaacgtcaaacgccagtgtaaaggctataaaaataaaaccgactttgccataggtaaaacagaattactcatgcaggtagctggggatgatggtagatggtattacccaagccagcaaccagaagaaatcattgggcagattttaccagttagtttacatcaatactttttctttgacggcgaacgcatagaagaaatcgtgcgttctgataaaaaagcggaaattgctgaagctactaaaatctttttgggtgtggaagtaattaaccgttctatcagacatttgggtgaagctaaaaaaagtttagaaaatgagttaaaagcaattggggattccgagattaagcagcttttgcgtgaacaagagaaactagaacaagagattgaacgcattcacaccagacaaacagaaattaagcaagaattagaatatcagcaaacctttaagaaagaaacaggtaaccgtttacaagaactgagtgctgctaaggaattgcaacagagacgacaagaattagaaaatcaaaaaaactcaaatcaagaaagcctcagacaaactagagaagcactaaaaaagattatttccgcacggggttacacagtattattgtcagatactacagcccaatttcggacgatcatcaatcaacttaagcaacaaggtgaattaactgcgggaatttcgcgggaatttattcatgaattattaaaatcccaacgctgtatttgtggtgcagacttacatgaaggtaatcatgctcacacaaatgtgagtctctggttaaatcaagcaggttcctcggctgtagaagaaacagcaattcgtatgagcgcccaagtagacgaaatcgataagcaagcgatcgcattttgggaagaagttgataaggaacaagcgagaatcaatcagttacgtcaaaatatatctcaagttgaaaatgaattagaaactattcaagaacgcttacgcaaagacgctaacgaagaaattagcagtttacaaaagcggttagatgagattgaaagtaaaattgatgaattaaatagagaacaaggtgcaaatcagcaagaaatttctcatgtacaggctgatattgatgctttagttaaacaaattgctaaacaaaagctcaatgaagaaaagcagttattagctcaaagacggattaacgccacacaagacgcaattgaacgcttaacagaagtcagaaatcggcaagaaaatcagtttcgactgcaattagaaaagcgcttgcaagagatatttaactccgtatcttttacgccttatgtacctaaaattagcgataaatatgagttaactctggtagaaagtacatcagggatggaagcatcagttgcagcctctactggtgaaaaccaaattctcagtttatcttttattgccagtattattgataaagtcagagactggagcgaaaaacgcaaaatcttaacggtacctgatagcagtacttttcccatcgtcatggactcaccatttgggagtttagatgaaacctatcgtcggcgcattgctcaaacattacctgagttggctaatcagttgatagtgttagtaacaaaaactcaatggcggggagaagtggaaacagagatgacagatagaattggtagggaatacgtgctgacttactactcttctaagccagattgtgaacaagattatattgaattgagtgggggaagatttcctttggtgaaacaaagcccgaatgagtttgaatatactgaggtgatagtggtagagagggagtggtga

SEQ ID NO: 42509 - DNA, 1026 bp, Anabaena PCC7120
atggttcaagaacgcacaatacctaaatttaatactgccaacgccaaaatcaccaaagaagaagggcttcttttatacgaagacatgactttggggcgtttttttgaagataaatgtgccgaaatgtactacagaggcaaaatgtttggttttgtccacttgtacaacggacaagaagcagtttctactggcgtaattcaagcgatgcgaccaggggaagattttgttagcagtacctaccgcgaccacgttcatgctttgagtgctggagtcccagctagagaagtcatggcggagttatttggcaaagccacaggttgcagcaaagggcgcggcggttccatgcatatgttttccgccgaacatggcttattaggcggctatgctttcgttgcggaaggaattcctgtagcagctggtgcagcttttcaaagtaaataccgccgggaagttttgggagaccccaacgccgaccaggtaacagcttgcttcttcggtgatggtgcagctaataacgggcagttctttgaaactctcaatatggctgctctttggaaactgccaattattttcgtggtagaaaataataagtgggccattggtatggctcacgaccgagcaacttctgacccagagatttacaaaaaagccagcgtctttaacatggttggcgtagaagtagatggtatggatgtgctggcggtgcgtgcagtcgcgcaagaagccgtagcccgtgcgcgtgctggtgaaggcccgaccttaatagaagctctaacctaccgtttccgtggtcactctttggcagacccggatgaaatgcgtagcaaagctgagaaagaattttggttttcccgtgacccaattaagaagctagcagcttatctaatagagcagaacttggcagatgaggcagaactcaaagccatcgagcgcaagattcaggacgtgattgatgatgcggtgaagttcgcagaaagtagccctgaaccagaccccagcgaattgtatcgctttgtcttcgcagaa

SEQ ID NO: 42510 - DNA, 2580 bp, Anabaena PCC7120
atgaatttccaccaaaaagctcacaagactgggaagtctcgaatttaccgtgctttagtcgccacagcatttttagcaagcggcattttcccatttactacgcctgcactagcagaaggaactaaagcgggtcaatctatcaccaacgaagcaactgctacttacgaagaccccaacaatcccaacgtacccctgaatacaacttccaacactgtcacagtaacagtggcagaagttgcaggtattacagtagactacacaggtttagtggacgatgacggcggtacgattgaaataaatgatctcttaatcttcaattacaccatcaccaacgtcggtaacgaccccacccagttccgtatacctaatttggcaacaacaacagggcctgcaacagtttctgggacattaccaaacaacggtacactcaataatctgcaatatagtactgacaacggcgtaacttgggttaacatcactggttctgaggccattgttcccaacattgctgtcggcggtcaggtattagttagagtccctgttactgtacagccaggcgctcaaagcggtgacatcattacggttaggttaggtaataccccagccaatgctcaaaacgtcttgcgtagtcctgatggtggtgacgtttatactgtagataacctcaatggtagtgtgacggatgaagttgatggcgctcctgttaacggcactagagaagctagtgatacatctattgatgttcaagtaggtggaggcgttaaaacctactctttagccacagttctcaagacacgtactgcttacagcaatgcgggaacaactaattccattacagatgacacacttagttatggtctgagtttgcgagttgaaggtaatgaccccacaggacagggtatcactccagcagccttggaaggtaggggtatcaatcttaatggaacatctaatgtcccgcacatcttagtttccgatgccattcccactggcacagatttagtatcagtaacagctcccaacggatggacagcagtatatacgatatcaccaattgggacagatgctaatgctgcggcgtggacaacaacaccaccaggtgacttgagtacagtcacccgtgttggttttatcaacaacacagctatagttacatctgttgcacccaaccaaacagttaatggttttactattaacttaagagtcgaatccagctttgccggcacatctttaaatgttgccaacattgctcagttgtttggtcaaacccctggtaataacttccctgtctatgatgagtctggagaccaaaaccccagtaacttcaatggtcaatttgggaatatgacaccaaatctacctgctcttacagatctcaataatgatggtgtgcctgatagtttacctgataccagtgttgatgatggtttcgttgataatccagctgccccagaaacaggagttgacggcaataatgataatactggtgtaggcgacggtggtgaagccaacatcttcacgctagaagttcctgtagcttcagccattctcaatggcccagtcaatgctcctaatgccattggcccatctggtggtacaaacgatgacttcactaacaaatcttctttagtacctttcggcacacaaccaaactctacactaaatccacaaccagtagcctttaccaacactatcagaaatagcggtagcgctgctagtgactactctttagtacccatcccaccagcaagtaatacacctgctggaaacaatgctgatttacctgtaggtactttagtaacgattacttatgcttctgaatctagatcctatgtctggactggatctgagttcctttttgatctagatcgcaatccggctacaacaggtgatcaatccaccattaatctcacaagtgaatacatcactattcctagtgtagcaccaggtacaaacatcaactacggtgtggaaattgacttacctgatggtactcaattatctacagatattgataaaggtttccccgttcctgtgacagcctttgtggatgatgggactgctggcttaaatggagaagctgtacaaaatactacaattaaccgtgtatatactggcttcctgaaactgcggaaactttccagaatcttagatcaaaatgggcaacctgtagccggggctgatggcatacttagcgatactgacaagagtcctgtacctggtaacattattgagtaccagattcaatacagcaacatctctgagccacaatctggtaacggtaacatcatcctgaacgccagcaatgttgtcatcaatgaaaatggggtaactgcgcctaataactgggcgttagacaatgatagtaatggtcagattgataccagcaacattattggttcagctactgaccccaatggtactatccaattcttcaatggtaatcctgctactacctcaggtagtgatcagactggaactaccgtcaacactgatgtgactcggtatgtcaacagtgtgactggtcaagtagcaccaggtcaacaaagaacgtttactttccgacgcaaggttaactaa

SEQ ID NO: 42511 - DNA, 1440 bp, Anabaena PCC7120
acaccaaactgggtgaaaaacgctgtattctaccaaatcttccccgatcgttttgctagaagtaaacagccccacaagcgcctgttgcgtgatgcgcgttgggaagactgggatgcgatgcctacgctacaaggatacaaaggcggtgatttatggggcatcatggagcagttagactacattcaagacttaggcattgatgccatttactttacacccatctttcaatctgccagcaatcaccgctatcatacccacgactattatcaagtagacccgatgttgggtgggaatgccgcttttaaggaattactagacgcatcccacgaacgcaatattaaagttgtcctcgatggcgtatttaatcattccagtcgaggatttttctttttccacgacgttttggaaaatggccctcattccccttgggtaaattggttcaagattgaaggctggcctctggcaccatatacaggtgagttgccggcaaattatgtaggttgggctgataatcgcgccttgccagtatttaatcatgacaacccagaagtgcgggaatatattatggaaattgccgaatattggattaaattcggcatcgacggctggcggttggatgtaccatttgaaattaaaactcctggcttttggcaagaattccgcgatcgcgttaaagccattaaccccgaagcttatattgtgggggaagtgtggggagattccagcgagtggctagatgggacgcaattcgacggtgtgatgaattacttatttgccgggccgaccattgcctttgccgcaggcgatcgcgtagtcttagaacaagtccaaagccgcgattatcaaccatatccgcccctattcgctgccgaatacgccaccaaaattcaggaagtactgcaactttacccttgggacattcaacttacccaactcaacttattagcgagtcacgatacagcccgactcctgaccattgctggcggtgatcaagccagtatacaattagctaccctattactacttacctttcctggcgcgccaagtatctactacggcgatgaagtgggtttaccaggaggtatcgaccccgattctcggcggggctttcctttagaagctaactgggatagagaaatttatcagacccaccgtcaattaatagccttacgccgtacttacccagccttacgcacaggtgactatcaagttatttgggcgcaaggtgcattgtatatttttgcccgcaccttaggcaaagaagaattaattattgccgtaaatgtaggtacagcaacagcccaggctaatgtagatgttgctagtttgcagactcagccaaataaaatcctgtacggtcaagcagaatttcactggcacaatacagaagaaacaaaacaactgttcttaagtctccccccacgtagtggctgcattctg

SEQ ID NO: 42512 - DNA, 1287 bp, Anabaena PCC7120
gtgaaaaaagtcttagcaattattcttggtggtggtgcgggtactcgcctttacccactaaccaaactccgcgctaaaccggcagtaccagtggcagggaaataccgcctaatagatatccctgtcagtaactgcattaattcggaaatttttaaaatctacgtattaacacaatttaactcagcttctctcaatcgccacattgcccgtacctacaactttagtggttttagcgagggttttgtggaagtgctggccgcccagcagacaccagagaaccctaactggttccaaggtacagccgatgctgtacgtcagtatctctggatgttacaagagtgggacgtagatgaatttttgatcctgtcgggggatcacctgtaccggatggactatcgcctatttatccagcgccatcgagaaaccaatgcggatatcacactttccgtaattcccattgatgatcgccgcgcctcggattttggtttaatgaaaatcgataactctggacgagtcattgatttcagtgaaaaacccaagggcgaagccttaaccaaaatgcgtgttgataccacggttttaggcttgacaccagaacaggcggcatcacagccttacattgcctcgatggggatttacgtatttaaaaaagacgttttgatcaagctgttgaaggaagctttagaacgtactgatttcggcaaagaaattattcctgatgccgccaaagatcacaacgttcaagcttacctattcgatgactactgggaagatattgggacaatcgaagctttttataacgccaatttagcgttaactcagcagcccatgccgccctttagcttctacgatgaagaagcacctatttatacccgcgctcgttacttaccacccacaaaactattagattgccacgttacagaatcaatcattggcgaaggctgtattctgaaaaactgtcgcattcaacactcagtattgggagtgcgatcgcgtattgaaactggctgcatgatcgaagaatctttactcatgggtgccgacttctaccaagcttcagtggaacgccagtgcagcatcgataaaggagacatccctgtaggcatcggtccagatacaatcattcgccgtgccatcatcgataaaaatgcccgcatcggtcacgatgtcaaaattatcaataaagacaacgtgcaagaagccgaccgcgaaagtcaaggattttacatccgcagtggcattgtcgtcgtcctcaaaaatgccgttattacagatggcacaatcatt

SEQ ID NO: 42513 - DNA, 990 bp, Anabaena PCC7120
atggctgcaaccgacttcaaagactattacgcgattttgggagttagtaaaactgccactccagaggaaattaaacaagcttttcgcaagttagcccgcaaatatcaccctgatgtcaatcctggtaataaacaggcggaagcaagcttcaaggaagttaacgaagcctacgaagttttatcagatgccgacaaacggaaaaaatacgatcaatttgggcaatattggcgacaagttggcgaaggcttccctggaggtggcgctggtgtcgatatgggtggagtggacttcagccaatacggcaattttgatgagtttattaatgagttgttaggacgctttggtggtgctgcacctcgtggtgggcgacaaagttactcttatcgcactcctggtggtagaccagggggtggttttggtggcttcaacgactttggatttcaagatgtaggcgcagcaggcggtggtcaagatgccgaagctaccatcagcctaacttttgctgaagcttttgctggagttcaaaagcgctttaatttaggtaacgaaactattgatgtgcggattccggctggtactaaacctggtactcgcttacgggtaagaggtaagggtcaatttaaccccatgacacaacaaagaggtgacctatatttaaaagtagaatttcagccccactcattcttccaaattgaaggggataacttagcctgcgaaattcctattactcccgatgaagcggcgctgggagcctccattgatgtacctacacccgatggttctgtgaacgttaaactacctgctggtgtgcgttctggtcaatctctccgtttacggggtaagggctggcctatagccaaaggcggacgaggagatcagtttgtcaaagtggctattgtgccaccaaaagatatgagccaacaagagcgagaatactatgaaaaaatccgggctatccgcagttacaatccccggagtcatttacaacaa

SEQ ID NO: 42514 - DNA, 576 bp, Anabaena PCC7120
ctccgcgttggtcaacaggctcccgactttacagcaacagctgtagttgatcaggaattcaagacaattaagctttccgactatcgtggtaagtacgttgtcttgttcttctatcccctagactttacctttgtttgccccacggagatcacagcatttagcgatcgctacgaagaattcaagaaacttaacaccgaaattctcggtgtgtccgttgatagcgagttctcccacctagcttggattcaaactgatcgtaagtctggtggtgttggcgacctaaattatcccttagtttccgatattaagaaagaggttagcgacgcttacaacgtactagacccagcagcaggtatcgctttacgtggtctgttcatcatcgataaagatggtatcattcagcacgctaccattaacaacctagcttttggtcgtagcgttgatgaaaccctacggacattgcaagcaatccagtatgtccagtctcacccagatgaagtttgccctgctggttggcaacctggggaaaagaccatgactcccgaccctgtgaagtccaaagtttacttcgctgct

SEQ ID NO: 42515 - DNA, 996 bp, Anabaena PCC7120
atggaagttatatttaaaatcattcgtcaacaacaaaattctgctcctattgtgcagaattactttatagagacagaccccggtaatactatcttggattgtcttaatcgtattaagtgggagcaagacggaacactagcatttcgtaaaaattgccgcaatactatttgtggtagctgtgccatgcgaattaatggccgttcggctctagcttgtaaggaaaatgtaggtagtgaactagctagattacaaaaaatatcatcttcagctaatcaagcaactaacattccagaaattacgatcgctcctttaggcaatatgccagtcattaaggatttagtcgtagatatgaatagtttctggaataatctagaagcagttgcgccctacgtaagtacagcagcgcgacaagtaccagaacgggaatttttacaaacaccagatgagcgatcgcgtctcgatcaaactggtaattgtattatgtgcggtgcttgctactcagaatgcaacgcccgtgaagtcaaccccgatttcgttgggccccacgccttagctaaagcctaccgcatggttgcagattcccgcgatactgacacagcccagcgcttagaaagttacaacgaaggaacgaaaggtgtgtggggttgtacccgttgtctttactgcgattcagtctgcccaatggaagtagcaccattagagcaaattaccaaaatcaagcaggaaatactcacccaaaaacaagccagcgatagccgctcaattcgccaccgcaaagtattagtagagctagtcaaagaaggcggctggattgacgaaagacaatttggcttgcaagtcgtcggtaactatttaaaagacctcagaggattactcagccttgctcccttgggtttacggatgatcgccaaaggtaaattccccctatcgtttgaaccatccgcagggacagcacaagtgcgatcgctgattgaatcaatacaaaaagcgaatgag

SEQ ID NO: 42516 - DNA, 1341 bp, Anabaena PCC7120
atgaagtttgacaaaatattaattgccaatcggggagaaatagcgctgcgcattctccgcgcctgtgaggaaatggggattgcgacgatcgcagttcattcgactgttgaccggaatgctcttcatgtccaacttgctgacgaagcggtttgtattggcgaacctgctagcgctaaaagttatttgaatattcccaatattattgctgcggctttaacgcgcaatgccagtgctattcatcctgggtatggctttttatctgaaaatgccaaatttgcggaaatctgtgctgaccatcacattgcattcattggccccaccccagaagctatccgcctcatgggggacaaatccactgccaaggaaaccatgcaaaaagctggtgtaccgacagtaccgggtagtgaaggtttggtagagacagagcaagaaggattagaactggcgaaagatattggctacccagtgatgatcaaagccacggctggtggtggcggccggggtatgcgactggtgcgatcgccagatgaatttgtcaaactgttcttagccgcccaaggtgaagctggtgcagcctttggtaatgctggcgtttatatagaaaaatttattgaacgtccgcgccacattgaatttcaaattttggctgataattacggcaatgtgattcacttgggtgagagggattgctcaattcagcgtcgtaaccaaaagttactagaagaagcccccagcccagccttggactcagacctaagggaaaaaatgggacaagcggcggtgaaagcggctcagtttatcaattacaccggggcaggtactatcgagtttttgctagatagatccggtcagttttactttatggagatgaacaccggatttcaagtagaacatcccgtaactgagatggttactggagtggatttattggttgagcaaatcagaattgcccaaggggaaagacttagactaactcaagaccaagtagttttacgcggtcatgcgatcgaatgtcgcatcaatgccgaagacccagaccacgatttccgcccagcacccggacgcattagcggttatcttccccctggcggccctggcgtgcggattgactcccacgtttacacggattaccaaattccgccctactacgattccttaattggtaaattgatcgtttggggccctgatcgcgctactgctattaaccgcatgaaacgcgccctcagggaatgcgccatcactggattacctacaaccattgggtttcatcaaagaattatggaaaatccccaatttttacaaggtaatgtgtctactagttttgtgcaggagatgaataaa

SEQ ID NO: 42517 - DNA, 2826 bp, Anabaena PCC7120
cctgaaagttccactacttggcacagcttggaagttgataaagcactaggactgctcaatagtaatgcagacagtggcttgacaaccgaagaagttgaacaacggttgcaaaaatatggccccaacgagctagaagaacatggaggccgtagcgcttgggagattctgtttgatcagttcaagaacattatgttgttgatgctgattgcagtagcttttatttctgggtctttagattttatctcttggcaagcaggtgaactcaagcctggggaaatacctttcaaagatacgatcgccatcttagcgattgtcatcctcaatggtattctcggttatgttcaggaaagtcgtgctgaacaagccctcgcggcattgaaaaaactcgcctctccctctgtgcgggtcatccgtagtggtaagttggtagatgtagcagccaaagatatagtcccaggggatgtgatgttgttagaggctggggtgcaaatctccgccgatggccgcttgattgaacaagctaatttacaggtgcgagagtcggctttaactggtgaagcggaagccgtaaataaacaagcatctttacaactaccagaagatacatctttaggcgatcgcattaatgtagtttaccaaggtactgaagtagtccaaggtcgtggcaaggtgctagtaactaatactggcatgaccacggaactaggcaaaattgccaccatgttgcagtcggtggaaaatgaacctacccccttgcaacaacggatgactcagctagggaatgttctagtaagcggttccttggtgttggtggcgattgtcgttgtgggtggtgtcattcaagcagggaattttagccccctgagagacttattagaagtttccttgagtatggcagtagccgtagttcccgaaggtttacccgccgtaattacagttaccttggcactgggaacccagcgcatggtgcggcgtaatgccttaattcgtaaactaccagccgtagaaaccttgggttctgtaactactatttgttctgataaaaccgggacactcacccagaacaaaatggtagtgcagtcaatttacacaaaccataaaacttttcgcgtcacaggtgaaggttatgcaccagtgggcgagtttcagctagatggtcaaaacgtgccggcggaagattatccggaaattcccgctttgttagttgcttgtgctgtctgtaacgactcagtactacaaaaagaagcaggggaatggatgattttaggcgaccctacagaaggggcattagtgacactggcaggtaaagcaggcattgaaaaagaccagtggaactataagttaccccgtgtgagagagtttccgttttcttcggaacgtaaacgcatgagcgtcatttcccaggtagagaaggtagccacaggtgaaccgacaatggcaaccgttgatcccaccttggcaggtctggtcaacagtgaaccttacatcatgtttaccaagggttccccagagttgattttggcacgttgcacagccattcacttgggtgcaaactcagaccacctcaatgacgaacaacgtcaacaaattttggcagcaaatgaccagttggctagtaaaggtctgcgggtattaggttttgcttacaaacccttggcagaagtgccgccggaagggtcggatgagacatcagaacaaggaatggtttggctgggcttggtggggatgctagatgccccacgtcctgaagtccgggcagcagtccaagagtgccgagaagctggtattcgccccattatgattacaggcgaccatcaactaacggcaagagcgatcgccacagacctgggtattgcccaagaaggtgacagagttctcactggtcaagaattacaacggatggatgaccaggaattagaacaacaagtagacctagtaagcatttatgcgcgggtatctccagaacacaaattgcggattgtccaagcgctgcaacgtcgtggtagattcgtcgccatgacgggcgatggtgtgaacgatgccccagccctcaaacaagctgatattgggatcgctatgggtattactggcacagatgtcagtaaagaagccagcgatatggtgctacttgatgacaacttcgctactattgtcaccgcaactaaagaaggtagggtagtttacaccaacatccgccgctttatcaaatacatcctgggcagcaacatcggcgaagtcctcaccattgcggctgcaccactcatgggactaggaggagtacccctaacacccctacaaattctctggatgaacttggtaacagatggtttaccagccttagccttggctgtggaaccgcccgaacctgatgtgatgaagcgcccacccttcagcccccgtgaaagcatttttgctagaggcttgggttcttacatgattcgtatcgggattgtctttgccatcatcagtattatcttgatgaaatgggcttatgatcattcccacgcagtgacagggccaggactcgatcctgagcgttggaaaacaatggtctttacatctctgtgtattgctcaaatgggtcatgcgatcgccattcgctccaacaaccaactcaccatagagacgaatcctgtctcaaatccttatgtattaggggcagttgttgtcacaacaattttgcaactcatgctggtctacgttccacccctgcgggatttctttggcactcactggctaccacttgacgagttagcaatttgcgtcggcttcagcgccttgatgtttgtttgggtggagatggagaagttattcttccgctttatg

SEQ ID NO: 42518 - DNA, 1794 bp, Anabaena PCC7120
atggctaaatttaaagatattgtcaattactttcgtgacgactggaagctgagtgccttcactattgcagcgtctagcgtgtacgaagttgtggatttacttgttccttatgcaattgggcaaattttgaatgttttgtccaatcaacctttagataaacccttagaaggtgcgatcgccactctatcacaattaacgaattacccagttagcaaacttctatctttaggtgtattactgggtttaatttttctggttaccgtagtgagagcgccaacacaaccttggttaaccagttggtttcactgggatatagctttaagatcacgtcgagataaaacccaatcagcgattgagaaaattctcacactccccttagaattttatgatgtcaataaccccggacgcattgccggaaggctaggtagaggcctttctaatcacacttggacatatccagaaatcgccggacagttaattcccaaactatttcgtgtactaggaatttttggatttattgtcttgattgaatggcggattgcgattttctatctaatttctttcgtccttattctcggctttagcttgagacagttaaagagaataatttggcacgaaagtcttctagataaatacatggaaaacacagaaagccgcacatctgaactaatcaccaatatcaaaacggtgaaagcttttgctacagaatcgaaagaactaaagcgccaaaagcaacgtttagatcgtgagctaaaggtggtagattatcgcatccacagaggctatgttaacctgctgacttggcaaaaaactgtgattcagttttgtgtattcaccatcttgggtttaacattagccgcaacagtaagcggtaaggtttcccttggtcatttcgtcatgactttaaccttgtccagcatggcgtattctgagttagaaccgattagcacattagcagaagtgtttgctcgtcgctattcctcaatgctgcggtttcacgagtttctacaagagccgactggatacgatgcagctagtcttttggaagaagacaacacatcctcaccatacaaatttactggcaaagttgaattttctggtgtcagttttggctatgatgctagccggaaagtgttgcaagatatcaacttattcattgaaccataccaaaccgtggcattagtggggcgctctggttctggtaaatctaccttggtgaaactacttttacgctattttgaaccccaggatgggcaaattttgattgatggtcaagatattcgcaccttgaatgtaggtaagtatagacgcagactggcgatcgttcaccaagaagtagacgttttcaacgggactgttttggataacctcacctacggtagacctgaggctacttttgaggaggtgaaagaagcctgtagaatagccagagttgacgaagttatgcagcacttaccccaaggttattacaccgttgtcggggaacgtggggtgaggttgtctggtggacaaagacaacgtttggggattgctagagccttgctagtagaacccgatgtgctgatttttgacgaagccacctctagcctagattatgagtctgaacgtgcaattcaattggcgatgcgatcgattcagggtacttgcaccacaatcgtcattgctcaccgtctcagtacagtccgggaagcagacaagatagtagtcctagaccaaggaaagattgtcgaagtcggtaaccacgatgaacttttgcgtcaagaaggtatttaccgccgtttgcactccctccaa

SEQ ID NO: 42519 - DNA, 1176 bp, Anabaena PCC7120
cccaatccccccagtccccatcctaattcatcgcttatgcccctgtctgacgcaatgcctgctctccttgtcttggcagatggaactgcttaccgtggttggtctttcggtgcgacgggaaccaccattggcgaagtcgtcttcaacactggtatgactggctatcaagaagtattgacagatcctagttaccgtggtcaaattgtcgtcttcacctatcccgaattggggaatacaggcgttaatcctgaagacgaagaatcagcacgtccccaagtgcggggagcgatcgcccgcaatatttgtcataaaccgagtaactggcgatccacacaatccttacccgactacctcaaacagcaccacatccccggtatctttggtatagatacccgcgccctcacccgcaaaattcggatgtacggagccatgaacggcggtatttctacagaaattttggatgaagcggagttgttagaacaggtacaagcagctcctaacatggcaggcttaaacttagtccgggaagttaccacctctacagtctacgaatggtcagaccctacaacagcagtttgggaatttaacccagatggtacggtaaagaatggggaatccttgacagttgtcgccctagattttggtgttaaacgtaatattttacgtcgtttagccagttatggttgccgagtcattgttgtacctgccgatacatcaccagaagaaatcctcaaatacaatccagatggtattttcctctcgaacggccctggcgacccgtcggcagttacagaaggtattaccacagccaaagcattgctcgaaagcgaaaagcccattttcggtatttgtatgggacaccaaattttgggtcacgccttgggagcagaaacctttaagctgaaatttggacatcggggtttaaatcaaccagccggtttaacacaacgggtagaaatcaccagccaaaaccacagctttgcgatcgacccagattctttacctgaggcagttgtggaaatcagccacctcaatttaaacgatcgcactgttgcaggtctgcgccacaaatctctacccatcttttccgtgcagtaccacccagaagccagcccaggccctcacgatgctgattacttgtttgcccagtttgttcatcaaatgcggacaacaaaa

SEQ ID NO: 42520 - DNA, 1149 bp, Anabaena PCC7120
ttagaaaccgccaaaattgctgctgatgtcgccaaccaagctaaaagtgaatttttagcaagcatgagtcatgagttgcggacacctctcaatgggattttaggatacgcacaaatcctagaacgctctgaaaacatagcacccgcagcattagagggcattaatattattcatcagtgtggttctcacctcctcattctcatcaacgatattttagacttgtccaaaatcgaggcgggaaaactggaattacacaatacggattttgatttttcttacttccttacgggagtagtagaaatgtgtcgtatccgtgctttacaaaaaggtatctcttttcattacctaccagatcccgatctccctcaagcaattaatgcagatgaaaaacggctacgacaaataataattaatttacttggtaatgcgattaagtttactgagacaggtggagtcaatttcacaatacaagtcttagaagctggagccgatttcaacaaaattagatttcaagtggaagatacaggagtgggaatgactcctgaacaattgacaaagatttttttaccttttgagcaagtaggagataaaaataaacaagcagaaggtacgggattagggttagctattagctgtagaattgctgaattaatgggcagccaaatccaagtagatagcattttgggaactggtagtaaattctggctagatttaaatttaaatattatcagtcactggttacaaacatctagtgtactacagaagaaaaaaattatcggtattcaagacaaacagccaaaagttctaattgtagatgacaaatgggaaaatcgtgccataatttgtaatttcctgcgaccaattggttttgaatgccttgaagctgctaatggacaagaaggattaaatatagcagcaacaaatgagcctgatttgattattactgacttagccatgccagttatagatggctttgaaatgatccaaaccataagaagtttacctcaaatatccaaagttcccatttttgtttcttctgctagtgtgtttgaaagtgataaaaacaaaagtttgcaaataggaggaactgagtttttaccaaaacctttagaacttgataaattactcaagtatttacaagattattta

SEQ ID NO: 42521 - DNA, 1035 bp, Anabaena PCC7120
aataaattaactaacgcaaatattgaaaattatcacgttctcttaactccaaacgcagtaaaagaaaaattaccgttaacagaaactgcggcagaaatagttttacagtttagatgtgaaatagagaaaatcttagattttcaagatagacgcaaatttatagtagttgggccttgttccattcatgaccctaatgcagcattggaatacgcccataagttaaaaaaattagctgaacgtgtccaggataaactactgttgattatgcgggtgtattttgaaaagccccgcacaactgtaggctggaaaggattaattaatgatccagaaatggatgattcttttcatgtggaaaatggtttattgctagccagagatttactgatcaagctaacagagttagggctacccaccgctacagaagctctagaccctatcgtaccccaatatattggtgaattgatcacatgggcggcgatcggcgcacgcacaacagaatcccagactcacagggaaatggctagtggtctgtctatgcccgtgggctttaaaaatggcactgatggtaatattcaagtagctttaaatgctttacattctgccagaatgactcataattttttgggcattaatcctgagggacaggtcagtgtatttgaaacgaaaggtaatgcttacggtcatgtgattttgcgtgggggaaatcaacctaattttgatgttgcaagtgttaaacaagtagaagaaaaattaaaacaggctcagttacctccgagaattgtcattgattgtagtcatggtaatactaataagaattacaggttgcaatctgatgttttagaaaacgttgtacaacaaatagttgatggtaatacatcgattgtggggatgatgctggaatcaaatttatatgaaggtaatcaacccattaactgcaaacgggaagaattgaaatatggggtttctgtacctgacccctgtatcggttgggagcaaacggaaaaaattatcttggctgcttacgaaaaacttaat

SEQ ID NO: 42522 - DNA, 1197 bp, Anabaena PCC7120
cgcatagctttaatttcagttcacggagacccagcaatcgaaattggcaaagaagaagctggagggcaaaatgtttacgtgcgcgaagtgggtaaagcattagcccaactgggatggcaagtggatatgtttagccgcaaagtgagtcctgaacaagagttaattgttcaccatagcccactttgtcggacaattcggttaacagcagggccagaagaatttgtaccaagagataatggctttaaatatttaccagaatttgtacaacaactgcttcgattccaaaaagaaaacaacgttaattacccattagtgcatacaaactactggctttctagttgggtgggaatgcagttaaaagcaatccaaggaagcaaacaagttcatacttatcactctttaggagcagtcaagtacaaatctatagatacgattcctttggttgctactaaacgtttatcggtagaaaaacaagtattagaaacagcagaaagaatcgttgctaccagtcctcaagaacagcaacatatgcgatcgctagtttctactaaaggttacattgatatcgttccttgcggtacagatattcaccgctttggttcaattgctagacaagccgcaagagcagaattaggaattgatcaagaagcaaaagtggtcttgtatgtaggacgctttgatcaacgtaaaggcatagaaaccttagtacgtgccatgaatgagtctcaattgcgtgacacgaataaactcaaactaattattggtggtggtagtactcctggtaatagcgatggcagagagcgcgatcgcattgaggccattgtgcaagaattgggcatgacggaaatgactagtttcccaggccgcctcagccaagatgtcctccctgcttactacgctgcggctgatgtttgcgttgttcccagtcactatgaaccttttggattggtggcaattgaagcaatggcaagtggtacacctgtagtagccagcgatgttggtggacttcaatttacggtagtttccgagaaaaccggtttattggtaccaccaaaagatattgctgcgttcaacattgcaattgatagaattttgatgaatccacaatggcgggatgagttaggccttgctgcgaggaaacacgttacccacaaatttggttgggaaggagtagctagccaactggatggaatatac

SEQ ID NO: 42523 - DNA, 975 bp, Anabaena PCC7120
atgtttccaacacaccgccctcgtcgtttgcgtacccatccccaattacgccgcatggtacgtgagactgtattgactaccaatgatttgatttacccgttgtttgctgttcccggagaaggaattgctaacgaagtaaaatctatgcctggtgtctatcaactatcggtagataagattgttgaggaagctaaagaggttcacgatttaggcattcccgcaattattttgtttggtattcccgcagataaggatacagatgcgacaggtgcttggcatgattgcggtattgtccaaaaggctgcaacggctgtaaaagcagcagtacccgatttgattgtaattgcggatacttgtttgtgcgagtacaccagtcatggacattgcggttatttgcaagtgggtgatttgacaggacgagtattgaatgaccctactttagaattgttgaagaaaaccgcagtttcccaagccaaagctggtgcggatattatcgccccttccgggatgatggatggctttgtgcaggcaattcgcgcaggtttagatgaagcaggatttcaagacacgccgattttgtcttatgctgctaagtatgcttcggcttattatggcccatttagggatgcagcagattctacaccacaatttggagatagaagaacctaccaaatggaccctggtaactcccgcgaagctatcagagaaattgaactagatatagctgaaggcgctgatatgttgatggtgaagcctgctttggcttacatggacattatttggcaggtaaaggaagccagtaatttacctgtggctgcttacaatgtgtctggtgaatattcgatggtgaaagctgcggcgctgaatggttggattgatgaacagcgcgtagtgatggaaactttaactgggtttaagcgtgctggtgctgacctgattttaacctatcacgctaaagatgctgctcgttggtta

SEQ ID NO: 42524 - DNA, 720 bp, Anabaena PCC7120
gtgcggaaaatagttattgccggtaactggaaaatgttcaaaacccaggcagagtctcaagagttcttaaaagaatttctgcctgcattagaggaaacacctcaagaacgggaagtgctgctttgcgttcctttcactgatctggccattttgtctcagagcttacatggtagccttgtacaactgggagcgcaaaatgtccactgggcagaaaatggagcatacactggtgaaatctctggcccaatgttgacagaaattggtgtccgttacgtcattgtcggtcatagcgaacgacgacaattttttggggaaacagacgagacagtgaatttacgtctccaagctgcccaaaagtatggtttaacaccaattctttgtgtaggcgaaaccaaacaacagcgagattctggggaaactgaatcactaattgtcagccaactcgacaaagacctcataaatgttgatcagacaaatttggtgattgcctacgaacccatttgggcaataggcactggtgatacttgtgaaacaacagaggctaatcgagttattggcttaattcgcagccaattgaagaattctgatgtgccgattcaatatggtggctcagtcaaaccaaataatattgacgagattatggctcaaccagaaatcgatggcgttctcgtgggcggagcaagtctagaagctgcaagtttcgctaggatagtcaactat

SEQ ID NO: 42525 - DNA, 627 bp, Anabaena PCC7120
atgcaaatcagcgattatccccaacttaatttgtcctcagttcctcggattgcttcagtgcatcgcatcactggggaaacaaatgtacaagttactgtcaatttggatggtacgggaatttgtaaggcagctactggcattccctttttagatcatatgctgcatcaaatttcctcccacggcttgattgatttggatgtccaagccaaaggagattgggaaattgatgaccaccacacaaatgaagatgtgggtattactttaggtcaagctttggctaaggcattaggcgacagaaaaggtatagtccgctttggtaatttcctagcacctttagacgaagctttagtacaggtagcattggatttttctggtcgtcctcacctcagctatggcttacaaattcctacggaacgtgtgggaacttatgacacccaattagttagagaattttttgtggcattagtcaaccatagccaaatgactctgcacattcgccaattagatggcattaattcccatcacattattgaggcgaccttcaaagcctttgccagagcagccagaatggctatagaagtcgatcctcgccgcgctgggacgattcctagctctaagggggttttg

SEQ ID NO: 42526 - DNA, 792 bp, Anabaena PCC7120
atgacaacaaaaatctctatgctgaatctgactggaaaaaatgccttggttacaggtatcgccaataatcgttccattgcctggggaattgcccaacaactgcacgcagccggagctaaccttggtattacttatctaccagatgaacgtggcaaatttgagaagaaagtttcagaactcgtagaaccccttaaccccagcttattcttgccttgtaatgttcaaaatgatgaacaaattcagtctacttttgataccatccgcgataaatggggcaggttagatattctgattcattgtctagcctttgctaacagagatgatttgactggagattttagccaaacatctcgtgctggttttgccacggctttagatatcagcactttttcactggtgcagttaagtggtgcggctaaacccctaatgactgaaggcggtagtattattactttgtcatatttgggtggtgttagagctgttcctaactacaacgttatgggagtagccaaagccggattagaagctagtgtacgttatctagcatctgaactcggctctcaaaatattcgcgttaacgccatctctgctggccccatccgcaccttggcttctagtgccgttggtggcattttagatatgattcatcatgtggagcaagtagcccccttacgtcggactgtgactcagctagaagtgggcaatacagccgctttcttggctagtgatttagctagcggtattactggtcaagtcctgtacgtagatgcaggatacgaaatcatggggatg

SEQ ID NO: 42527 - DNA, 1725 bp, Anabaena PCC7120
ataaatttggtgtggactactagccacactatgactataattttggctactttaactttagtggctggtttgttacctgcggcgatcgcctatctcggtaaactaattgtagatggcgtagttttagcatcccaaggcaatacacaagggaatatttatgcacctttattgtatgtcggcttagaggcgatcgcagtagctttgttagcaggttctcaacggggactaattatctgtcagtcactattgcgggtgttactcggtcagcgagtcaatgtgttaatcctcaaaaaagccctgactttagatttgactcactttgaaaactcagaattttacgacaaattaaccaacgccagacgagaagcatcagtacgtcccctctctttagttaaccgtacctttggcttagtccaaaatgccctttctctcatcaccttcggctttttgttagtcaaattctcgatttgggcagtaattgtcttaattgtggcagcaatgcccgccttcatagccgaaactcgctttgctggggaagctttccgtctatttagttggcgtgcgccagaaactcgccaacagcactatatagaaaatcttttagctagagaagactttgccaccgaagtcaaactctaccaactaggagatatgcttttaggacgttaccgcaacgtatttcgccaactctacaacgaagaccgcgatttaaccatccgtcggggaatgtggggataccttttaggtttagttagtaccgtagccttttacatcgcctacgcttggattgtcatagaagcagtagtcgggagaatttcgttaggtgatatgacgatgtatctcaccgtctttcgccaaggacaatctacctttgctaatgccctgacttccattggtggtatgtatgaagataacctctatctctccaacctctacgatttcttagaagaaaaagtcactcaaccctggggtaaaatcacaaaaggtattgatacccaagacggtatccgctttgaaaacgtcacctttacctatccaggaagttctcaacccgccttaaaaaacatttccctacatttaaaaccaggcgaaaaactagcaattgtcggtgaaaacggttctggaaagaccaccctaattaaactcctcacccgactctataccccagactccggcagaattttattagatggcgtagatttgcaatcatggaatgtagacgcactgcgtcaacgcatcggcgtaatattccagaactttgtccgctatcagttcaccgtcggcgaaaatattggtgtcggggatgtagacagcctcaatgatacaacccgttggcaaatagccgcccaaaaaggtaacgcccatagttttatcgaacgcttaccccaacaattccaaacccagctaggaaaatggttcaaaagcggacaagaactatcaggcggacaatggcagaaaatcgccctagcccgtgcattcatgcggactcaagcagacattttagtcctagacgaacccacctcagccatagatgcccaagccgagtatgagattttcaatcatttccgcgcccttacccaaaatcaaatggtatttttaatatctcaccgcttttcaacagtcaggatggcagacaaaatcctagtaattgaaaatggggaagtaagagaacaaggaactcatgaagaattgttagcccgtgaaggactatatgccaaattattt

SEQ ID NO: 42528 - DNA, 1038 bp, Anabaena PCC7120
ccccaattggatcggttggatactaacgaaagcccctatgatttgcctcctgagttaaaacaaaagctcgcctggacttttcagcaagtaattgaaagtaatcgttatcctgatggcggacatgagacacttaaaagtgcgatcgccgaatatgtcaacgaatccgctaatatttcatcattacggtttaccgccgctaatatatctgtcggtaatggttcggatgaattaatccgttctttattaattgctacgtgtttaagcggagaagggtctattctcgttgctaatcccaccttttccatgtatgggattttggcacaaactttgggtattcctgtcgtgtcggtatcaaggaatcctgataattttgccatcgacttaacagcagctcaatctgcaattgaacaaactctaaatcctcccattcgggtggtgttcgtcgttcatcccaattcccccacagctaatcctttaactgcaaatgagttgagatggttgaaaagtctcagcgaacgaattttagtagtagttgacgaagcttattttgagtttagccaaaataccctagtcagcgaattggcacagcgtcctaattggataattctacgcacattttctaaagcttttcgattagcagccatgcgcgttggctattgtgtcgctcatccagaagcgatcgctattttagaaaaagtccgcttaccttacaatctacctagtttctccattgcatctgctttagttgccttacaaaatcgcgccatcttactagaatccattcctcaaactctagatgaacgcaccaagctgattaatgccttctctcagcatcctgcactagccgttgcagaaagtgccgccaactttattttcttgcgtctgaaagcagatagtgacaattcatcagacactactttactaaatcttcatcaacaactcaagaattctggcacattagtacggcaaataagcggcggattgagaattaccataggtacacctgaagaaaacatccgcacgcttaaccatatacaa

SEQ ID NO: 42529 - DNA, 1437 bp, Anabaena PCC7120
atgcgagtagcgatcgctggcgctggtctagcaggactttcctgcgcgaaatatctcacggacgcaggtcacactcccatagtcttagagcgtcgggacgtattgggtggccttgtggcggcgtggaaagactctgacggcgactggtacgaaaccgggttacacgccttctttggggcatatcccaatatgctgcaattactcaaggagttgggtattgaagaccgactccagtggaaagaacatacactgatttttaatcaaccagataaacctggaacactctcacgttttgatgttccggatatcccctctccctttaacatcattgcctcgatccttcgcaacaacgatatgttgacctgggagcagaagattaggttcgccattggactgcttccagccatagttcgaggacagaagtatgtcgaggagatggacaagtacagcttctcagattggttgaaaaggcaaggtgtgggtgagcgggtagcaagtgacgtgttcattgctgcatctaaggccttaacctttattaatcctgatgaagtttcctccacaattttattaacagccctaaatcgctttctgcaagagcgatatggctccaaaatagcctttttggatggttctcccacagaacggctgtgtcaacccatcgttgattacatcaccgaacggggtggagaagtcaggctcaacgcccctctaaaagagattttgctcaatccggatggtacagtaaaagggttcttgctgcgcgggttaaatggagagccagatgaagtgattacggcagacttttacgtgtcagctatggcagttgaccccttgaaagtcatgttgccacagccttggcagcaaatggagtttttccagaagctagaaggtttagaaggcgtgccagtaattaacctccatctgtggtttgatcggaaattaacagacattgatcacctgttgttttcgcgatcgcccctcctcagcgtttatgctgatatgagcaacacttgtcgtgaatatgctaatcccgaccgctcaatgctggaattagttctagctcctgccaaagattggattagtaaatccgacgaggaaattgtctctgctactatggtcgagttggaaaaactcttccccgaccactttaaaggagataatccagcaaaattgctgaaatctcacgtcgtaaaaacgccgcgttcagtttacaaagcgactcctggtcgtcaacagtaccgtccagcccaaaaaacccccattgccaatttctttttaagtgggagttacaccatgcagcgctatttaggcagtatggaaggggccgtactttctggtaagctaacagcgcaggcgatttgtgaatcgctgccagaggacaacacctcaaacctgcaaacgctaacccgaccgcctgcaacgaatgctgcaactgcc

SEQ ID NO: 42530 - DNA, 1134 bp, Anabaena PCC7120
gaactaagacaaagtgaagaacgcttccgttccttgagtacctgctcgcccataggtatttttgaaaccgataccgcaggatgttgtaaatatacaaatccccgctatcaagcaatttgtggcttggatgcgacagagagtttagataaaagatggctggaatctgtgcattcagaagaccaggaaagagcgatcgctagttggtctacttatatttatcaaggcggcgactattcagatgaattccgctttcaaacagtggatggtagcctgcgatgggtgcaagtacgctcctcaccaatgctttctggtaatggtgaattgcttggctatgtcggtacacttgaagatattaccgcccgtaagcaatccgaagaaattcgcgctcaggtaatccgcgaacaaaccgccagacaagaagcagaggcgacaaatcggatgaaagatgaatttttggctgttctctcccatgaactccgcacccccctaacttccatgttgggctggtcaaaaattctccgtgccaaaaaactagacgaaaaagccacagccagagccttggaagcaattgaacgcaatgctaattcacaagtgcaattaatagaagatattttagatgtatcccggattattcgcggtcaactgcggctaaatttatctcccgtcaatttgataactgtggtggaagcagctctagaagcagtgcgtcccctagcagatacaaaaaatatgaccatcaacactgtacttgactacaccttaagtcccgtcagtggcgattttgccagattacagcaaattgtctggaatctcctgactaacgcgattaagttcacaccgaaagaaggtcaagtagaaatccgattagaagggataaatggtgaattatctgatgatttgactcatgctcaaatccaagtcattgatacaggtgttggcattgcaagtgaatttctgcctaaagtctttgagcgtttccgccaagcagatagtaccaccacgcgatcgcataatggattagggttagggttggcaattgtccgccatttagtggaactgcacaacggtacgattttggcagaaagtccaggtgtgggcaaaggagctacctttactgtgagatttcccctcatt

SEQ ID NO: 42531 - DNA, 507 bp, Anabaena PCC7120
atgccattaaaactaatttccaagaaaagtacagcagcgttggcaattagcaccacagtagccttgtttggaatcagtttgtctagattaaagttgccatttgagacgtttacacataacgttacatctgtccccataattcaacccgatcgcaccatcaaagaccattcagcgtggatttatgcgatcgccattactcccgatggtaagactctagtcaatggcaactacgatggcacgattaaaacttggaatctgcatactggcaaattactccacacttttaaaagtcatactgatgccgtgtcatccctagctatgagtgttgatggtcgtatcctggttagtggtagttgggataaccggattaagctctggaatctggaaacaaatactttaatcagtacccttgatggacataaggacgatgtacagacagttgctatcagccccaacggcaagttagtcgccagtggtagtgccgacaacacgattaagctttggaat

SEQ ID NO: 42532 - DNA, 3358 bp, Anabaena PCC7120
ccatatcgtggtttatttgctttccgagaagaagatgcacacttattttttggcagagaagaattcacggctgatttagtcaaggcggtgaaaagaaagcggtttgtggctgtagtgggggctagtggcagtggtaagtctagtttagtgtttgctgggttgactccccagttacgacaagacccgaatgtgcaatggcaaatcatttcttttcgtccagggaaaaatccctttgaagctttggcgactgcattagtgagtttacgacagtgttgtccctctttttccctagaaaacatcctagagttgccagaagatagtaccactactcgcttactagaattagatttagcgatcgcattacaacaaaaccatcaattactacacaccatcctagaaaaggttgtgcagcaaaaatttggcactcgtttactactcatagcagatcagtttgaggaactttacaccctttgtccagaaccacaacgtcagccttttttagatttattactcaatgcttatagtttcactcccgccttcaccatcgttttaaccctgcgggctgacttttacagctatgctctttcttaccgtccctttagtgatgccttgcaaggagcagtgcagaaccttggccccatgaatatgaaggaattgcgtcgggtgatagaagaacctgctaaaaaaaatgcagataggactagaagcaggattaaccaatcaattaatcgacgagatagaccaacagccaggacatttacctttacttgagtttgcccttacccaattatggtcaaaacagcaaaataggctcttaactcatcaagcttatcaagaaattggtggtgtagaagaagccttggctaaccatgctgaggctgtatatgcccagctaaccgaagcagataggcaaagggcgcaacaaatatttatccaattggtacgtttaggagatgacacagaagctacccgacggttgacaactcgtgaggaagtcaggctagaaaactgggatttagtcacacgtttagcttcttcacgtctagtagtgaccaaccgtaatgagtccacggcagaagaaacagtagaaatcgtccatgaagccttaattagaagctggggacgactggaacagtggctaattgtggatggtgattttctacgctggcgcgaacaattacggttagcaattcgcctatgggaaaatagcggacatgatcaaggggtgctattacgaggtaaggccttgatagatgcccaagaatggcagttacaacgcgcacaagaactcaatacaaatgaaatcaggttcattaataagagtggggaactgagagaacttgaggtcaaacagcagcagcgcatacgtaaaatcgggatttcatccctagtcacaggcttaatcttagcccttggtctggctggggttgcttggttgcaaggacaaaaggcacggatgagcgaaactaaagcaatcagctcatcagccgaaagcttccttaatgcaaatctagagtttgatgggttaattgccagtattagagctggtaggcgcatcaaaggcactgatggaattgatgctaacactcgcactcaaattaccgagactctacaacagtccatcaacttcgtcagagagaaaaatcgtttagcagaacatgatggaatgctagagagtgtgagttttagccctgatagtaaatttattgccaccgccagcagagataaaacagtcaaaatttggagtcttgacggtaaaaaacagttagtcgtactgcgagaagagaaaggagagggttttaatagcgttgccttcagccccgatggtacactgatggctaccggcagttgggacaacacggcaaaaatttggagtcgagaaggtaaacgcctccacactcttgacggacataaagaagcagttttggaagtcgcctttagtcctgatagtcagctacttgctacggctagttgggacaacacagttaaactctggagtcgagaaggtaaactcctgcacaccctggaaggacataaagataaggtcaacagcatcacctttagcccagacggtcagctaattgccactgtcggttgggacaacaccatgaaactctggaatcttgatggcaaggaattgcgaacttttagaggacatcaagatatgatttggagcgtcagctttagcccagatggtaaacaaattgctacagccagtggtgacagaactgtcaaactttggagtttagacggaaaagaactgcaaaccctcagaggtcatcaaaatggggtgaacagtgtgacattcagtcccgacggcaaactgattgctacagctagtggtgacagaactgtcaaactttggaacagcaaaggtcaagaactagaaaccctctacggacacactgatgcagttaatagcgtcgcgtttagtcctgatggcacatccatcgctacagctggtaatgacaaaacggctaaaatctggaaactcaacagtcctaacagcattattgttcggggtcatgaagatgaggtcttcgacctagtatttagcccaaatggtaagtacattgctacggctagttgggataaaaccgccaaactctggagtattgtaggggataaacttcaagaactgcgaaccttcaacgggcatcaaggcagggtaaataagctgagttttagcccagatggtaagtacattgctacgacgagttgggataaaaccgccaaactctggaatctagatggtacattacagaaaactcttacaggacacaaagatacagtttggagtgtcaatttcagcccggatggtcagttaattgctacggctagtgaagacaaaactgtcaaactctggaatcgagacggtgaattgcttaaaactctcccacgtcagagtagtgtagttaatagcgcagtgttcagcccagatggtaaattaattgctacggctggttgggacaaaacagtgaaaatctggagtattgatggtcgattacagaagactttaacgggacatacaagtggtattaacagcgtcaccttcagcccagatggtaagctgattgctagtgctagttgggataatactgtaaaaatctggaatcttgatggcaaagaattgcgaactctgcgaggacataaaaatgtagttcataatgttaccttcagcccagatggtaaactcattgccactgccagtggtgataatactgtaaaaatctggaacattaacggtcaagaactgcgtaccctgcgaggctataaagatgcagtttggagtttgcggtttagtcttgatggtaagactctagccactggtagcaggtatgatatcgtggtttggcat

SEQ ID NO: 42533 - DNA, 1383 bp, Anabaena PCC7120
atgcgtgtttgtgtaattggtactggttatgttggcttggtaacaggagcttgcttggctcacatcggacatgatgtgatttgcatagataacaacgaagaaaaagtcaagatcatgaaggccgggcaatcaccaatttttgagcctggactttcagaaattatgcagtcggcgatccaatccggcaagattcaattttctaccgatttggcagcaggtgtagcccacggagaaatcttatttattgctgttggtactccaccattacccaccggtgaaagcgacacccgctatgtagaagctgtagcccgtggtatcggtgctaacctcaacggtggttataaagtaattgttaataaatctacagtacccatcggttccggcgactgggtaagaatgatcgttctggatgggattgcagaacgtcaaaaaaccctcgtaaccgcaggtggtagtgttgaggataaattacccgaattacctcagtttgatgtagttagtaacccagaattcttgcgagaaggttcagcagtatacgacacatttaacccagaccgcattgttttgggaggtaatagctccagagcgatcgcggcaatgcaagaattatacgccccaattgtcgagcgcaaatttgcagaaaaccaatctttaccaccagtacccattctggctacagacctcagttccgcagaaatgattaaatatgcggcgaacgctttcttagccactaagattagttttattaacgaagtagctaatatttgcgatcgtgtcggtgcagatgttacccaagttgccaaaggtatcggtttagactcccgtattggtaacaaattcttacaagctggtattggttggggtggttcctgtttccccaaagacgtagctgcactgattcacaccgccgacgactacggttatgaagcccagctattaaaatctgctgttagcgtcaacgagcgtcaacgcttgattgctttagaaaaactgcaacaagtcctgaaaatcctcaaaggcaaaactgttgggttactcggtttaacctttaagcccgacaccgacgacttacgtgatgcaccagcattgaacttaattgagcaactgaaccgcttaggcgctaaagttaaagcctacgaccccatagtgtcccaaacaggtatgcgtcatggtctttctggcgtattagtagaaaccgatgctgaacgtttggctgatggctgtgatgcgttggtacttgtgacagaatggcagcaatttagcggtcttgactacgccaaaatggccaaactaatgaataaccccgtcgttattgacggtcgtaacttccttgaccctgagactctggtacgggctggattccagtacgtaggcgttggcaga

SEQ ID NO: 42534 - DNA, 1008 bp, Anabaena PCC7120
accccaacggtaaaggcaaaactatccccgtctctaccagcaactgacgctaaagctagagtcagtaattttatgaaacagttgcaagatgaaattacacaagccttaacaaaacttgatggtgggagtgagtttcacgaagatagttgggaacgtcctgaagggggtggcgggcgatcgcgtgtgctacgtgatggtgcaatatttgaacaagctggggtaaatttttctgaagtttggggttctcatctccctccttccattttagcccagcgtccagaagcggaaggacatggcttttatgccacaggtacatccttggtgttacatccacgcaatccctatgtccccacagttcacctaaattaccgttattttgaagccggcccagtttggtggtttggtggcggtgctgacctcacaccttattacccctttgcagaagatgcggctcatttccatcagaccctgaaactcgcttgcgatgaacatcacccagagtattaccccgtatttaaacgttggtgtgatgaatatttctatctcaaacaccgggatgaaaccaggggtgtaggtggtctatttttcgattatcaagatggacaaggtgttttatatcgcggccccaaccccaaaggcgaagcagccaattatagtaatcaagtaggagaacccgcatcacgggattgggaagatttgtttagttttatccaaggttctggtaaagctttcttacccgcctacgtccctattgtagagcgccgtcatgggatggagtatggcgatcgccaacggaatttccaactttatcgtcgcggtcggtatgtcgaatttaacttggtttatgaccgaggcacaatttttggtttgcaaaccaatggccgtactgaatctattttgatgtctttaccacctttggttcgttgggaatacggttatcaacccgaacccaattctccagaagcggagttatatgatacattcctcaagccccaagattggagcaac

SEQ ID NO: 42535 - DNA, 1686 bp, Anabaena PCC7120
ctgccctatattagaccccagtggcagaatatcacgaaaggacttgtcggcattgtgggatacgtgctggctaccttaaccttaattaattttgcaggcaagttagctaatccttttggacaaggtaatgtagtggcgatcgctcaattagccgctatcttgggcttggtgtttcttgtccggggcttttttcagtctgtgcaagatatctatatgtctaaggctgctttgcggatagctttttatctccgcaagcaggtatatgggcatttgcaaaagctagatttaagctattttgaaacagccaaagcaggtgatttatcttaccgcctcacagaagatattgaccgcattggtgaagttgtcaataaactgtttcacgactttattccctgcgtgttgcagttaatagccattcccatctacatgatttacctgaattggcaactcaccttagcaacggtgattgttgccccattcatgggaattttaattggttggtttggggaacgtttgcgtaaatactccctgaggagccaaaatcgtgtgtctgatttgtcggcaatcctcacagaagttttcagtgggattcggctgattagggcatttgccgcagagaattacgaggtgactagatttagccgagaagctgaacgcagttttcaagccaaatactctgccgaacgcttgaaggccgtgcaaattcccattgtgggatttttggaagctttgagtgccttatccttgcttttggtgggcgcgtggcaaattcagcaaaataatttaacggtgggagaatttttcagttatctagccgccgccgggttgttaattgatcccatcggtcatgtgacgaataattacaacgaatttaagcaaggggaagcctctgttgaccggatttttgaattaatggcgatacagccgacagttttagaaaagcctaatgctgttaccttacctccagttaaggggaaagtagaatacagtggtgtcacctttgcctataaaccaggggaaactgtcttaaaagatattaatttgttagctatgccaggggaagcgatcgcctttgtaggtgcttctggggctggtaaaactacctttgttaatctcctcccccgtttttatgacccttcagccggacaaatcttgattgacggcgtagatattcgggatgtcagactacagagtttgcggcgacaaattggcattgttccccaagaaactattatgttttctgggacagttgctcaaaatatcgcctttggacaggacatatttgatttagaagcagtcgccgccgccgccaaaattgctaacgcccatcaatttattagccaactgccagaaggttacaatacttgggtgggcgaacggggtgtaaatttatctggtggacaacgccaaagaatagctattgcccgtgctgtgctgctgaacccacaaattttgattttagatgaggcgacatcagccttagattctgagtcggaggcgttagtacaggaagccttggaaagattaatgcagaatcgtacagtatttattattgctcaccgcttaagtacagtgagaagatgcgatcgcattttagttttagagcgaggacaaattgtcgaatcaggcactcacgaggaactgttagccctggaaaatcgttatgccaggttttacactcaacaa

SEQ ID NO: 42536 - DNA, 1239 bp, Anabaena PCC7120
ctaataggggtgttggtctatgtccaatctgcggaacaaacccaactcaaacaatcaaaagccttagcggatgcagctaaagaaagtgctgacagtgccaacaatgccaagagtgaatttctcgccaacatgagccacgaactccgcacaccgttgaatgggattctcggctatgcccaaattctgggacgctcgaaagtcttacccgacaaagaacgtcagggagtcaacatcattcaccagtgtggctctcatctgctcacactgatcaacgacatactggatttgtccaaaattgaagctcgtaaactggaacttgcctctcaagcttttcacttgccgtctttcatgcaaggcgttgtcgaaatttgccatattcgggtgcagcagaaaggcattgagtttcattacgaacctgatgccgatttacccgcaggtatcagtgccgatgaaaaacgtctacgccaagtattaattaacctactcggtaacgccattaagtttactgatcgcggtagtgttgccctacgtgttcaaagaactgggctggaggagtccgatccccgcaccaaactgcgctttagcatcgtcgatactggtgtggggattgcgtcagcagatatcaacaaactcttccaaacatttgaacaagtgggggagcagaagcggaaagtagaaggaacggggctaggattagccattagccaacagcttgtgcagttaatgggtggacagattcaggtcaagagtcagcttggtgtgggtagcgagttctttttcgagatcatcctgcccttagcaagtgactggagtcaacagcagaccgcatctgtgggtaatattattggctatgaaggagtaaaacgccatattttagtcgtagacgatcgctgggaaaatcgcgccgtcttgctgaatctgctagagccgctagggttcatcatcaccgaagccgaaaacggacaagcaggcttagaccaactccagcaacatcttcctgatttagtcattactgacttagttatgcctgtgatggatggttttgagatgctgcgaaagattcgggaacaggaacaactgcgatcgctcaaaattctggtctcttctgcttccgtcgctcaaattgatcaacaaatgagtattgatgccggcggcgatgattttctcgccaaacctgtgcaagtgaatgatttgttcacacttctcgaaaaacatctcgaactcacttggaaaactgaa

SEQ ID NO: 42537 - DNA, 618 bp, Anabaena PCC7120
agccaagctttacaagcaagtagtgataattgtgaattatactataaacgaggtttaagctattatcaattgggtgattatgaggcggcgatcgccgattattctcaagccataaatatcaaccttcacgatgctaaatcctatcataaacgtgggttagctttatcacaactagcagcttatgaagcggcaatcgatgattataatcaagcaattagaattaatccccatgctgcttctatttataaaaaccgagcagaagcacgctctcatctaggagataatcaaggagcgattgaagattatacccaagcgatcaagattaatccccaatatgcagatacatataaaaatagaggcatatctcgttatttattagcaacacaaccaggatttacccaagcaattaagattaatcccaatgatgctaatgcttacaaaaatcgtggtaatgcgcgtgctgatattggtgattatctaggagcgattgaagattataatcaggcaatccaaattaatcccaaggcggctgatgcttattataaccgtggtaacgcccgttatgatttaggggatgaagaaggagcgatcgctgattacacccaagcaatccaaatt

SEQ ID NO: 42538 - DNA, 2190 bp, Anabaena PCC7120
gtgactgaatctaccaaaaccctatgtccttattgtggtgtcggctgtggactagaagtaacaccacccgcccaactcaacaaagccacaaatcgagatagccaaggaaatccaacttggcgggtgcggggtgataaagcccatccatctagccagggtatggtttgtgtcaaaggggcaacgatcgccgaatctttggataaaaatagattacattacccaatggtacgggaatcacttgatcaagagttccgccgtgtcagttgggatgaagcttttgacctcatcaccaagcgtattcaatctgtgcgctttacccagggggcggaagctatatgtatgtatggttccggtcaattccaaacggaggattactacatagcccaaaaactgatgaaaggttgtttgggtagcaataattttgatgctaactctcggctatgtatgtctagtgcggtctctgggtatattcaaagttttggggctgatgggcctccctgctgctatgaagatttggagttaactgactgtgcatttttaattgggacaaataccgccgaatgtcacccgattgtttttaaccgcctggagaagtaccacagaaaaaaccataaggtaaaaatgattgtggttgatcctcgacgcacacccacagccgaagcagctgatttacatttggcgattaaaccgggtacagatattgacttgttaaatggaattgctcatttgttaatgcgttggaacatgatagatgtcggtttcatcgatgactgtaccagaaacttttcggcttacgctgaggtaattcgccactattcgccggaggtagtagctcgtcaatgtggtatcaccatcgaagatttagaaaccgcctcccgttattggggtgaatcgcagcgtgtgttgtccttatggtcgatgggtgtaaatcaatcaagtgaaggtacagccaaagtcagaacgattattaacctgcatttgatgacgggacaagtcggaaaaccaggggctgggcctttctctctcactggtcaaccgaatgcaatgggaggaagggaagcaggcggtttagctcatttattaccgggttatcgattggtgaaaaatccccaacaccgggcagaattagaagcattttggggattccagccagggcaaatttcaccccatcctggtttaactgcatgggacatgatcactggcttggaagacggtaacgtgggtttactgtggattgcggctactaacccagctgtaagtatgccagatttggaacggacgaaaaaggcattattgcgatcgcctttcaccatctaccaagatgcttaccaccccacagaaactacagcttatgcccatgtcttgttaccagcagcccagtggggtgaaaaaactggtatcatgactaactcagaacgtcgagttaccctatgtcaagccttccgccaaccaccacgagaagctaaaccagattgggaaatcttcgcagaagtgggacgcagattaggttttgaggacaagttcgcctttactaactcagcccaagtatacgccgagtttacccaactgaccaagggtcgcccttgtgatatgtctggtatcagccatcaacaattgcaagcccaaggccccactcaatggccccactcctctataaatatcgaaacacaaaaaccaactcaacacccaacagtcaacagtcaacagtcaacagtcaccagtcaacagtcaaaaagactctacactgatttacgttttcatacccctgatggtcgcgctcgatttggcgcatattattctaagggattagcagaaccaccagaccctagttatccttttgtgttgactactggacgattatacggacattggcacacccaaacccgtactggtcgcattgaaaaaatccgcgccatgcaccccgaaccatttatcgaaattcatcctcgtgatgcggcgaagttaggcattactgataatgtggtggtggaagtgcgatcgcgtcgaggtagcgccaagtttcccgccaaggtgacaaaagctatttccccaggtacagtttttgtgcctatgcactggggtaaactctgggcagatgacgcagaagctaacgccctcacccattcagaatcttgccccgattcactgcaaccagaattaaaagcctgtgcagtccaattaataccaatc

SEQ ID NO: 42539 - DNA, 1608 bp, Anabaena PCC7120
atgacagatacagtaactacccccaaagccagcctcaataagtttgagaaattcaaagccgaaaaagatggacttgccatcaagtcagagatcgaaaaaattgcctctttgggatgggaagcaatggacgcaacagaccgagatcatcgcctcaaatgggtgggtgtattctttcgcccagtcacccctggtaaatttatgatgcggatgcggatgccgaatggtatcctcaccagcgatcagatgcgtgttttagccgaagtggtgcagcgttacggagatgacggcaacgctgatattacaactaggcagaatattcaactacgaggtatcagaatagaagacttaccgcacatattcaataaatttcatgcagtaggtttaaccagtgtgcagtcagggatggacaacatccgtaacatcacaggcgacccgatagcggggttagatgcggatgagttgtatgacacccgtgagttagtgcagcaaattcaggatatgctcaccaacaaaggagaaggcaatcgagagtttagtaatttgcctcgtaaatttaatattgcgatcgccggtggacgggataattcagttcatgcggaaatcaacgatttagcctttgttccagcatttaaagaagggattggagattgggtattggggaatggggaagaatcatctacttaccaaaaagtctttggatttaacgtgttagttggtggtttcttttctgctaaacgctgtgaggcggcgattcctttgaatgcttgggtaactccggaagaagtcttacccttatgtagagcaattttagaggtctatcgtgacaatggactcagggctaatcggctcaagtctcgcttgatgtggctaattgatgaatggggtatagataagtttcgggcagaagtcgaacagcgtttgggtaaatccttactccccgcagcccccaaagacgaaattgattgggaaaaacgcgaccatatcggagtctataagcaaaagcaagagggattgaactatgtagggttacacatccctgtaggtagattgtatgccgaggatatgtttgaattggctcggatagccgatgtatacggtagcggtgaaatccgcatgactgttgaacaaaacatcatcattcccaacattaccgactcgcggttaaggactttgttgacagatcccttactagagagattttctcttgatcctggagcattgacgcgatcgctagtttcctgcacgggcgcacaattttgcaacttcgccctcatcgaaaccaaaaaccgcgccctagaaatgattaaaggcttagaagcagaattgacctttactcgtccagtgcgaatccattggacaggttgccccaactcctgcggacagccccaagttgcagacattggcttaatgggaacaaaagctcgtaaaaacggtaaagccgtggaaggtgttgacatctatatgggtggcaaagtcggcaaagatgcacatttaggtagctgtgtacaaaaaggcatcccctgcgaagacttgcacctagtattacgagacttactcattactaattttggagccaaacccagacaggaagccttagttaccagccaa

SEQ ID NO: 42540 - DNA, 1920 bp, Anabaena PCC7120
atgcatctgagtgaaatcacccatcccaatcagctgcacggtctatccatccgtcaactgcaacaaattgcccgtcagattcgagataaacacctgcaaacagtagctgaatttggtggacatctggggcctggcttgggtgttgtagagttaacactagggctttaccagactctagatttagaccgggataaagttatatgggatgtaggacaccaagcttatccccacaaattgattacaggacgctacagcgacttccataccctcagacaaaaagatggaattgccggttatctcaaacgtggtgaaaataaattcgatcattttggtgcaggccacgcttcaaccagcatctccgcagcattgggtatggctttagcacgagacatgaacggggaaaagtttaaagccgtggccgtgattggcgatggtgcattaacaggtggtatggcgttggaagctatcaaccatgctggacacttgccgaaaaccaacttattggttgttctcaacgacaatgagatgtctatttctcccaacgtcggcgcgattcctcgctacctcaacaaaatgcgcctcagtcccccggtgcagttcatcaaggataattttgaagaacagttcaaacacattccctttgtcggcgaatccctatctcccgaattaggaagaattaaagaagggatgaaacgtttagccgttcccaaggtaggtgcagtatttgaagaactgggctttacctacatggggccagttgatgggcataatttagaggaattgattgctaccttccaacaagcacaccaaatagctgggccagtgttagttcatgtagccactatcaaaggtaagggctacgaactcgcggaaaaagaccaagtaggctaccatgcccaaactccttttaacctgacaactggcaaagcaattccctccaacaaacccaaaccccctgcttatgccaaagtcttctcccataccctagttaaattagcagaacaaaaccccaaaattattgggattactgcggctatggcgacaggaacaggtttagataagctacaagcaaaactgcccaatcaatatattgatgttggcattgcggaacaacacgcagtcaccctcgcagctggtttggcaactgaaggtatgcgtcctgtagcagccatctactctactttcttacaaagggcatacgaccagattattcacgatgtctgtatccaaaatttaccagtattcttctgtttggatcgggcgggaattgttggttctgatggccctacccaccaaggtatgtatgacattgcctatctacggtgcattcccaacattgtaatgatggcaccgaaagatgaagccgaaatgcaacgcatggtagttactggtattgaacataccaccgggcccatcgctatgcgtttccctcgtggcaatggctatggcgtacccctgatggaagaaggctgggaacctttggaaatcggtaaaggtgaaattctccgcaacggtgatgatgtattaattatcggctacggcacaatggtttaccccagtatgcaggcggcggaaattctcagcgaacacgggattgaagcgactgtgattaatgcccgatttgttaaacccttagatacggaattaatcgtgcctttggctcagaaaattgggcgggttgtcaccctggaagaaggctgtgtgatgggtggctttggttcagctgtagcagaagcattgttagatgcagatgtggtggttcctgtcaagcgcattggtattcctgatgtattggtagaacacgctactccagatgagtctaaggcggaattaggtttaactagccgtcaaattgcggaaagagttctacaggcttactttcaaaagcaaccatctcctgtaagctaagtttctgtttca

SEQ ID NO: 42541 - DNA, 2559 bp, Anabaena PCC7120
tcttttgaccaagatagtaacgcacataaatcatttgaactacccggagctaggccacactataaccccgatcgccccggccaagtagagcatatttttctcgatttgaacttagatattcctcagcaaagttacgaaggtagttgcagtattcgtttattgcctatccgcaacggtatagatcgcttaactttggatgcggttaacttgcaaattcgatctgtgcaggtggatgaggtagggcaggactttgattatgatggcgaacagttggtaattcaactatcccaacccaccgagattggcaagcggatattaattgcgatcgcctatgctgtggaaaagccccagcgcggtatctactttattcaaccagattcacactaccctaataaaaccgttcaagtttggactcaaggcgaagatgaagactcgcgcttctggttcccctgtttcgactacccaggacaactttctacttcagaaattcgggtgcgagttcctaaatctctcatggcgatttctaacggtgaactgattgacactcaagaagatggcaaacataaaatctatcactggtcacaacaacagattcatcctacttacttgatgaccctcgccgttgccgattttgcagaaattcgggatgaatggcgcggtaaaccagtcacctactatgtagaaaaaggacgagaggcggatgctaaacgtagcatgggcaaaactccgaggatgattgagtttttgagtgaaaagtatggttacgcctatgcttttcccaaatatgcccaagtctgtgtcagcgactttatctttgggggtatggaaaatacttctactaccttattaactgacagatgtttgctagacgaacgcgccgccttagataaccgcaacactgaaagtttggtggttcacgaactagcccaccaatggtttggtgatttgctagttattaaacattggtctcatgcttggattaaggaaggtatggcttcctactctgaggtgatgtggactgaacaggaatatagcgccgaagaagccgcatattaccgtttattagaagcgcggagttatttgagtgaagatagcggacgctaccgccgaccgatggtaacccacgtttaccgagaagccattgaactctatgaccgccacacctacgaaaaaggatcttgtgtttatcacatgattcgggcggaattgggagaggacttattttggcaggcaatacaaacctttgtccgggataatgcccacaaaactgtagaaacaatagatttactccgggcaattgaaaaggctaccggacgcaatctcgctttcctgtttgaccaatacgtttatcgcggtggtcatcctgattttaaagttgcttattcttgggacggggaagcgaagttagccaaggtaacagtcacccaaactcaagtacccgcagataaggataaagatgtatttgacctgagaatccccattggttttggctataaccaaacagaagcagcagcaaaactgcaaactttcaccgtgcgggtacatgaacgggaacaaagtttttatttcccactcacagagaagccagactttatcagctttgatgtgggtaatcattggctgaaaactgtgtctttagaatatcccatcccagagttaaaagcacagttagcatctgacccagatccaatttcgcgtatatatgcggcggcagctttggcgaaaaaaggcggattagaagctactaaagccttagcagcatctctgaaaaatgaaccattctggggtgtgcgggtggaagtggcgaaacagttggcagaaattaagctagaccaagcttttgatggattagttgagggtttagcagataaaaatgcttatgtacggcgggctgtggtgcaagcactagcaaaaattaaaaccctcgctagttataaggctgtcaaaggtgtagtcaaagatggtgatgctagttactacgtagagtcggcagcttgtttggccttaggagcgatcgccgccattaatttcgatgacaaatccaaagaagaaaaagcgatcaagctcctgcaatcagttttagaagaaagggctgggtggaatgaagtagttcgcagtggggcgatcggtggtttagctgaactcaaaacctcggaagcagcgttagatttgatacttgagtatacaaaactcggtgtaccccaaccattacgcttggcagcaattcgggcattaggcaaaatttcccctggtcaaagcccagtcaatttagaacggattattgcccggctaggcgaactatctaaagaaaacttctttttaaccctgatggcagttgtcgccgcattagggcaaatggagacaccaaaggcaatgggagtattgcgatcgctcgcagatcaaacagccgatgggcgtgtgcgccgtttcgccgaagaagaactggcgaatgtgcagaaaaacatcggcacagacaacgctttacgaaaattacgcgaggaatttgaccaactcaaacaacaaaaccaagaacttaaaagccgtctagaaaatctagaa

SEQ ID NO: 42542 - DNA, 1566 bp, Anabaena PCC7120
tatcggattgccgcaatggcaggagcaatcatcctgacaattgccttaaaaaacttagccacatataccagcacgctatcatcaagttctctaactcgcagacttactgcggatatgcgagaggcaggcatcgatttattactaaatattgatatagattattatgccaaaaccaaagttggtgatttaatcaatcgtttgggaggtgaaattggccgtgccgctagttatgtaggcaatatcatcagattagttattgtcagcgttacaatttccgtttttgtctgtctattactatcaatttcttggcaattaactatcatggcgacaatcttgctgtcgctagtaacattagtcaatcaatttgcaattagtcgttctcgtcagtttggcaagatattgagtgaaatgtcgaaagcctactccatagctgtgctagaaactctcaatggcattcgtcttgtcaagactacagcgaacgaaaggaaagaatttaatagaattaaacgactaattcgtgagcgcgaatccgcagattttaaagctcagatgaactccaacgccatcactcccttaagtgaatttttgggagttacatctttgttaataattgtgctgttaagtaaaacttttttcgctgatcaaattagtacactttcggctgttctgttaacatatttactaatattattacgtctactacccctagtttctcaactcaatagtctccgtagtagctttgctagcatgaatgctagtgtagactcggtaactgaactactcagattagatgataaaccattcttaataaatggaaaaattgcctacaacggcttaaaaacagggattacgtttaaatctgtttccttcacttaccctggtcatgataaacaagtactcaaagatgtaactttaaaactaccccgtggcacaacattagcattggtaggaggctcaggagcaggtaaatctaccttggcagacttattacccagattttatgacccaactggtggctgtattattttagatgataccgatttgcgtgagtttgatatcacctctatccgtaagtgtatgggtatcgttagccaggatacttttctcttcaataattcagtgcggaataatattgcctatggtaaacaagaagccacagaagaagaggttgtagcagctgctaaacgggcaaatgcctacgaatttattagtaaactgccccaacaatttgatactatgattggcgatcgcggtgtcatgttatcgggaggacaaagacaaagattagcgatcgctcgcgctctcttacaaaaccctgatattctgattctcgacgaagcaactagcgctttagacaccgtttcggaacgtttggtacaaggagcgctagaagaactcagccgcgacaggacaactctagttattgctcaccgtctgtctacagtccgcaaagccgaccaaatcgctgtcttggagcaaggaaaagtcgtagaggtgggaacccatgaagagctattacaaaagggtggttactactcacgcctttatggaatgcagtttagcaat

SEQ ID NO: 42543 - DNA, 771 bp, Anabaena PCC7120
atgcaggtgattcgcttggcagcactttcagacaattacatcttcttattacacgacagccacaaaaatatcgccgccgttgttgaccccgcagaagccgagccagtacttaagcaacttgcacagctaaaagcagaattagtggcaatttttaacacacaccaccacaatgatcatgtaggtggcaaccagaaattaatccagaagtttccccaagtgaaagtttatggtggcgctaaggatcaaggcagaatccctggacaacaggtatttttacaaccaggcgatcgcgtgcaatttgctgatagagtagctgaagttatctttgtacccggacacacccgcgctcacattgcttactactttcctccccaaacagacgatacaccaggagaattattctgtggcgataccctgtttgctggtggttgtggtcgtttatttgaaggcacacccgcacaaatggtggaatctttaactaagctgcgttctttaccagaaaatacccgtgtctggtgcgctcacgaatacactttaaaaaatttacaatttgcacttagtgtagatagtaagaacaccgaattgcaaaaacgccttgacgaagttaagacaaagcgcagtcaaggaatagccacagtcccttcgttgttgggagtagaaaagctgaccaatcccttcctccgttgggagcaaccctcattacagttagcagttaatagtaatgaccccgtgcaaacctttgcccgcattcgaggattaaaggataagttt

SEQ ID NO: 42544 - DNA, 1149 bp, Anabaena PCC7120
cagtttgctaaacgtttagaaaaaattcctccttatttgtttgctgaaattaaccgtaaacgggaagcactaattgccaaaggagttgacattattaatataggggtaggtgatcctgataagccaactcctgctcatattctccaggcgatgcgtgaggcaattgacgacgcttctaaccataattatccaccttatgaaggtacacaagagtttagagaagcagctgttgagtggatggaacgtcgatttggggtgatggatttaaaccccaacactgaagttgtgtcttctattggatcaaaagaggctatacacaatacttttttagcttttgtggaagcaggagactacacgttaataccagaccctggttatcccgtatatagaacttctacgatttttgctgggggcgaagctttctccatgcctctgaaagcagaaaataaatttttacccgatttggatttaatccctgaggaagttgcccgtaaagcaaaaatgttgtggattaattatccaaacaaccctactggggctttagcaacattagagttctttgaggaattagtagctctttgtcagcagtacagtattttgttgtgccatgatcatgcttattcagaaatggcgtatgatggctacaaaccaccgagtgtcctgcaaattccaggtgcgaaggatattgccattgagtttcacagtctatcgaagtcatataatatgacaggctggcggattggatttgcagttggtaatgcctatgctattaaaggcttgagtcaagtaaaaacgaacgttgattctggagtatttaaagcaattcaaaaagcagcgatcgctgcttatgccactgatgaagtagaattacaagctgtaatgtcagtttatcaaagtcgccgtgacatcatcgttaagggattgcaatctttaggatggcctatcgaaccaccaaaagccactctttatgtttgggttcctgtaccgcctggatatacctctactgaatttactactttgctgttagataaatgtggtatcgtcgttcccccaggggttggttatggcgcgtcaggcgaaggttattttagagttgccctcactatctctgatgaacgtttacatgaagcgattcaacggatgcaggat

SEQ ID NO: 42545 - DNA, 927 bp, Anabaena PCC7120
tccccaattttgcattgtctacctcgtgtcgccattattggtgctggtagggttggtagcactttagctcaacgtattgctgagaaaaatttagcagatgtggtgctattagatattgttgagggtatacctcaaggattagcactagatttattagaagctaggggtattgaattgcataatcgtcagattatcggcacaaataattatgctgatacctctggttcgcaaatcgttgtcataacagccggatttccccgcaagccagggatgagtcgggatgatttgttgagaactaacgccaagattgttattgaggcagcaaagcaagcgatcgcctactctccctatgctatttttatcgtagtcaccaatcctttggatgtgatgacttatttagcttgggaagccacaggtttaccccgtaaccgcatcatgggtatggctggggtgttagactcggcaagatttgaaacttttattgctttagaattaggggtattacctgcggatgtcaaagcaatggtattgggtagccacggggatttgatggttcccctgtctcgttacgccacagttaatggtatccccattacacaattgttggatgcagtcacaatagaaaggttagtggaaagaacccgtaatggtggtgcggaaattgtggaattgatgcagactggtggcgcgttttttgcacctgcatcagctacaagtttgatggtggaatcaattttattgaatcagtcccggctgttacctgtgtctatatatctgcaaggcgaatacgatttaaaagatgtagtgattggtgttccttgtcggttgggattaaatggaattgagagtgtaatagaattaaatctcagtgatagtgaaagagaagctttacatatctcggctaaatcagtgcagaaaaatattgag

SEQ ID NO: 42546 - DNA, 580 bp, Anabaena PCC7120
ggtgctggttaaaaacttcttttactaacgttctaatttaaccggcctccagtgaaccttaataagcgggcaaaatttttttttagaaaatcaaagaatattccgcaaattcccggttatccagttgcgccagatagtgaccctggtattacaagagccaaagtttctggggatgacagtccaacaaagcccttagcttaccctttaattttgcgcggtttgaccaaagagacgattcagcagcgagtcagtcattggggcggaacagctgcaaatccctggtgattggttaggacgcactgaggtacaactttcggctggacagagacagctcgtagcgatcgctcgtgctttagtcattcaaccgaaaatcctcctgttagatgagccaacctctcatctagatattggtatagcctcccatcttatccaagtcttaacccagctaactcaaactcatcacacaacaattgtgatggtaaacagccagctagacttcactcagatgttttgtaatcggcttttgtatttacagcaaggacgtttattggttaatcaaacagcttctaacatcgactgg

SEQ ID NO: 42547 - DNA, 1005 bp, Anabaena PCC7120
tacgacaccatcattgttggtgctgggcctgcgggtggcgcagcagcctatcatttagccaagaaagggcgctcagtattagttttagaaaaagaatccttacctagatataaaccatgtggcgggggagtgtcaccaatagttgccgaatggtttgactttgactttagcccagcaatttctctgaaagtagactcgtttcgctttacttggaacttaggcgatcctgtagaagcgaagattgagactaaagagccagtgtggatggtacgtcgagatgtttttgaccatttcttagtccagcaagcccagaaacaaggggctgaactgcgtgataatacagaagttacaggaattgagtttaaaagcgatcgctggcaagttgacactgtcaacggccctgttacaagtcgctacttaattgcggctgacggtgctaaagggccaatggcaaaatggttaggctttaaagagcgtaaacgccgtttagccggtgcattagaagcagaagttcccgccaatgtcgaagataaatctacaattcacttcgagtttggtttagtgaaaaatggttatatttggaacttccccaaagaagatggttattctattggagtgggaaccttcattggtggtcaaccccaagattttaagaaaattttggttgaatactctcaattatttaatatagatgtcaaaaccagtaagcagtatggtcatccaattgctttgtgggatggtaatcaaaaattacacactcaaaatgctattttggcaggggaagcagcttgtgtagttgaccccatgaccgccgaagggattcgtccctcaatttatagtggtgttatggccgccggagccgttgacaaagcgctttctggtgatatcaacgctttggaacaatacaccgaaatcatccatgaaagttggggtgcggaaatggcttgggcgcaaaaattagccggagcattctatcgctttcctagcgttggttatcaagttggt

SEQ ID NO: 42548 - DNA, 855 bp, Anabaena PCC7120
atttggtctagtttaggttttggctttgcggaactgggaacagtcacatttgtcggacaacctggtaatcctcccccgcgtctgtttcgcttgccgttggatcaagctgctcttaaccgcatgggctttaataatcatggtgcggcggtgatggctgcacgcttggctgatgaaaaagggcagttttccatccctataggtatcaatttgggtaaatctaaggtgacacccttagaagccgccgccgaagattatttaaatagttttcgcttactcaaggagttgggtgactattttgtagttaatgtatcttctcccaatactccgggtttgcgatcgctccaagatgcctcaatgctcagttctatcttggatgtcttacaaaaggaaaataattcacataaacctatatttgtcaagatagcaccggatttagaatgggaagcgatcgctgacattattggattggctaaaacctaccagttagcaggtattatcgctactaacaccacaattcgccgtgatggactgaaaactcaagtgattgagcaaacaggcaaggcaccccaagaagaagctggaggaattagcggtgcgccagtgcgcgatcgctccacggaaatcattcgttttatttggcagcaaacccagggagaaattcccatcattggagttgggggcatatttacccctgaagatgcttgggcaaaaattactgctggagccagcctgattcaagtttatacgggctggatttaccaaggcccaatgatggtgagccagattttaaccgggttgctgtccaagttagaagaacatgaattaaattccatcagcgaagctataggcttagaa

SEQ ID NO: 42549 - DNA, 1029 bp, Anabaena PCC7120
cctcaccttttgcgggctgctcgtggtgaaattgtagatcgtccccctgtatggatgatgcgccaagcaggacgatacatgaaagcttatcgggatttaagggaaaagtatccttcatttcgcgatcgctctgaaattccagaggtagcgattgaagtttccctgcaaccttggaaagcctttcagccagacggagtaattttattttccgatattgtcacccccttacccggcttagggattgaaatggacattgcggaaggtaaaggccccatcattcatgcgcccattcgcactcaagcacaaattgaacaactgcgccccttagaaccagaagcagctttaccgttcattaaaaccatattgcaggctttacgccaagaagtaggtaatcaatcaacggtattgggctttgtaggtgcgccttggacgctagccgcctatgctgtggagggtaaaggttccaaaacctactccatcatcaaaaacatggcgttctcagaccctacgatactgcatcaactgttaagtaaattagcagatgcgatcgccatttatgctcgttaccaaatcgactccggcgcacaagtagtacagatgttcgattcttgggcagggcaactcagcccccaagattatgacacctttgccttaccctatcagcaacgagtattccagcaaatcaagcaaacccatcctgatacacccttgattttgctagttagtggtagcgccggcgtactagaacgcatgggacaatctggtgctgatattgtcactgtagactggacagtggacatggctgatgctagagccagattaggcaaacagatgaaagtacagggcaatcttgaccctggtgtactttatgcctctaaacagtttatccgcgatcgcatcatcgataccgttcgcaaagctggtaactggggtcatattctcaaccttggacacggtgtactaccagacacaccagaagaaaacgtcgccttcttctttgaaacagccaagcaactaaatgttttggtg

SEQ ID NO: 42550 - DNA, 876 bp, Anabaena PCC7120
atgaacttaacgccagatagtaaagttattattcaaggcttccatgaattcatttctgaaaatcatatcgcccagatgaaagcctatggtacaaatttggtagctggtgttcagcctggatacggtggacaggaactttatcatctgccagtttttgatttggttgaggaagtagtagggcaatttggcagtattgacaccacaattatctgtgtccacccttatcaagtactagatgcggccttagaagcgatcgcctctcatatccgacaaattattattatttctgctggtgtgccacccttggatatggtggaattactccgcaaagctgaagcgggtgaaacgctggtagtcgggcccaacagtcccggaattatcgtcccaggcaaaatcctcttgggtactcaaccaagtgaattttacacacctggagtagtgggtattgttagccgtagtagtactttgacttatgaagtggcgcgagaattaactcaagctggctggggacaatcaattagtgtgagcattggtagtgatgcaattgtgggttcatcgtttctgcaatggttacaaattctcgatgaggatgaaacaactgaggcgatcgttttagtaggacaaccaggcgggggtagtgaagaagcagccgcgcgatacattgccgaagcaatcgataaaccagtaattgcttatatcgccggcagacaagcaccaccgggaaaaacttggcgacaaacggggactttagctactgttgtcggtcgtccacctaattttggcactgctcaaagtaaaattacagcttttgaagccgccgaagttcctgttgcagaacgtccttctttgattccccaattattaaaaaaagcaatt

SEQ ID NO: 42551 - DNA, 1767 bp, Anabaena PCC7120
gtatcaaacaaactttctcccttgcgccgattactcaattatggacaaaaatatcgtggacaaatttaccaagcgtctacctattcggttattaatacagttttagatttagcccccccttggttagtgggtattgccgtagatatattagtgcaacaacaagattctacaattgctaaatttggtattaaagaagtagtatggcaatttgcattactttcattaattaccgttattgtttggatatttgaatcactttcccaatacgcttatgacagaatttggcgaaatgtggctcaaaatatccaacatagtttacgtttagacgcctacaatcatttacaaaaattagaatcggcttattttgaagacagcagtacaggcggtttgatgtcaattctcagtgatgatatcaaccaacttgaagattttttaaatgggggagcaaatgaagttatccaagtcaccacttccttaataattttgattgttggtgcgtttttcattttgccatttaacattactcttgcagcaatgttacctatgccctttattctttggggttcactggtatatcaaaaacggctagaaccccgttatgccgatgttagagaaaaagttagttttctcaactcgcggcttgctaataatattagtggaattacgacaattaaaagttttacagcagagaagtatgaaagtgccagactagcagaggaaagtgaagcttacagaaaaagtaacgccaaagcaattaaactttctgctgcttttattcctttaattagaatgttggttttagcagggtttacggctttgttatttctgggaggtatggcagcatattcacagaaaatatctataggtaattacagcgttttactggtgctggtacaaagattactgtggccattggtgtttttaggagaaacttttgaccattatcaaagaggaatggcttctactaggcgggtaatggatttattagatactcctatccaaattattacgggggatgtacctttagttgtggaaaatgtgcggggtgaggttgattttaaaaacgttacctttgcctatcaaaacagtgaagtgattattaaagatttatctttacatattcctgccggaaacactattgcggttgttggttctacaggttcgggtaaaagcactttagtgaaattattgttacgattttatgatgtttctcatggctcaattaccattgatgggattgatattcaaaagttaaatttatctgatttacgtcgcagtattggcttagttagtcaagatgtattcttatttcatggtacggtggcagaaaatattgcctacggtacttttgatgctagtgatgaagccattattaatgctgcaaaagtagctgaggcacatgattttattatgcgacttccccaaggttatgaaacaatagttggggaacgtggacaaaagttatctgggggacaacgccaacgtattgcgatcgctagagcagttttgaaaaatccgccgattttgattttagatgaggcaacatctgcggtggataatgagacggaagcagctattcaacgttctttagaaaagattaccgtaaatcgaactaccattgcgatcgctcaccgtctttctacaatacgccacagtcattgcatatatgtcatggagcatggtcaaattgtcgagcagggtacacacgaagatttaatcgccctggatgggatttacaccaacttgtggcgtgtacagtctggggtg

SEQ ID NO: 42552 - DNA, 1961 bp, Anabaena PCC7120
ctagcccgtgcaattggtgcattattgcagaaacataatgctaaaggtgaacgtgttttgctgctgtacccccagggattagacgtgatggcagcatttttgggtagtctttatggtggagtcattgccatccctgcacctcctcctgatgctggtagattgaaacgggctttgcctcggttacgggctattgttaaggatgccaacgctaaatttgtcttcaccaaccagcaccttttgggtgttctgcaagcagccaagttagattttcccgaatttgaggaaatgacttggtttgccagcgaagacatcgatttagaactagcagaccaatggcaagaccctgaaattactccaaataccctggcatatttgcagtacacatcaggctcgacttccacaccaaagggtgtgatgattagccaccacaacatcatgcaccactgcgcttatctacaaaaagcttgtggctatgatactgagagcgtttccatcacctggatgccatatttccacgattacgggctagtagaagggttgaccgtacccatttacaacggtcatccttgctatgttatgtcccctatgtcctttattaaacagcctgtacgttggttacaagcaatttctcgctatcgcggtactcatagtcaagctcctaactttgcttatgaacagtgcattcgccgcgtcaccgatgcacaactagctaccctggatctcagcagttgggtagcagccgggaatgccgccgaaccaattaaccctagagtgttagaagagttttttgagaagttcgcccctagtgggttcaagtgggaaacctttgcacccgcttatggattggcagaaaatacactgttggtttctaccagccccagaaatacaccacctgtcctgtgtttggtagaaaaaaccaaaattgagcagaacaaaattgtggaagccactacctgggacgatggagtccgggctatccctggatgcggtcgcttagtttgtgagacgcaagtggcaattgtcaatccagatactttgactcgttgtgggacggatgaagtaggcgaggtatgggtagcagaccctagcgtggctggtggttattggcaacgcccccaagaaagcgaaagtaccttccgtgccaagattgccgggaataatcaagtctctttcctccgcacaggtgacttgggctttatcaagggtggtgagttgttcatcaccggacggatcaaagatttgattattatccgggggactaaccattatccccaagacttggaatggactgtacaggaaattcacccagcccttcgcccagactatggtgcagccttctccatcgatgtggatggagtggaacaactggtagtcgtccaggaagttaaacgcaaaccagaagaagagtttaactcagatgaggtattgaccaatattcggcaagcgatcgccgaaattcatgaactgcaagcatacgctgtggttcttgtcaagcctggtaatgttctcaaaacctccagtggcaaaattcaacgacgtgcctgcaaagccagtttcctcgccggtgagttggaagttttagccgattggagcgaaaaccccaaatacaccgccagctatcggcgactacaaggggaagtaaattctttgctggaaaaggtgcaagttactcactaaggagaaaattatgcagccactcaagcaatattggatcgcagaagcattagagaaagatttgggcgaccctagcaacccaaataatgtgatgtcgtttaagcaggtaattgacctggacgaacgagaagagtttccccatgagattattaattggctctataactggaaactccagcactattacatccctacagaatgcggcggtgaatttacctcctttgacgagtttatcgcctttgtgcgcgtcctttcccgccgtgaccaaaccgcagcgatcgccttca

SEQ ID NO: 42553 - DNA, 906 bp, Anabaena PCC7120
aatcaaatgaaaaatgaaaaatggaacgctgaaaatattcctcctcaaaaaggaagactagcaattgtaacgggttcaagcagtggcatcggttacgaaacggcgcgggttttagctaataaacaagcgtctgtaatcattgcggttcgcaatttggacaaaggaaacaaggcactggcaaaaatccttcaacagaataaagatgccgacgtaaagttgatggaacttgatttggcgaatttagcatcagttaaaaatttcgctgaaaactttcggaaaaattatttgcgtctggatttactgattaataatgcgggtgtgatgattccgccgtattcaaaaacgacggatggttttgaattgcagttcggcactaatcatctcggacattttgctttgacgggacaacttttagaatttttgattagcaccgaaggctctcgaatcgttaatgtttcgagcggcgcacataatatgggcaagatagatttcgatgatttgaattgggagcagagaagttatgctaaatggaaagcttacggcgacagcaaacttgccaacctctactttacctacgaactcgaccgaaaactaaaagataacggtatcgacacacttgtaaccgcctcgcatccgggctggactgcaaccgaattgcagagaactgcgggtggcattgtgaaatatctcaacggcatcgttgctcaagacatcacaatgggtgcgttaccgactctgcgggcggcaatcgaagcaggcttaaaaggcgcagaatatttcggccccaatgggtttatggaaatgcgcggctatccaataaaagtcgaatcaaacgagttatccaaagaccaagcactcgccaaaaaactatgggttgtatcggaaaaactaaccgatgtgaaattt

SEQ ID NO: 42554 - DNA, 3984 bp, Anabaena PCC7120
atgttcacccacgtcaagtccaccattagacacattgcgcctgataacctgcgcggacgtaatttaattaaggtggtctatgtcgtgcttgagtcccagtaccagagcgcactgtcgcaagcggttcgcacgattaacgcgaataatcccaacctggcgattgaaatcagtgggtatttgattgaggaactgagagatccagagaactacgaagagttcaagcgggagatcgagggtgccaatattttcatcgcttcattgattttcatcgaagacttagcacagaaagtagttgcagcagtagaaccacaccgcgatcgcttagacgttgccgttgtctttccctcgatgccagaagttatgcgcctgaacaagatgggcagcttttctctggcacagttgggacagtcgaaaagtgcgatcgcccaatttatgcggaaacgcaaagaaaaatccggtgcgggattccaagatgggatgctgaagttattgcgaaccttgccgcaagtactgaagtatttaccagtggagaaagcacaggacgctcgcaattttatgttgagctttcagtattggctaggaggttcaccagaaaatctggaaaacttcttgctgatgctaactgataaatatgtattaaaagcagtagaaaaacagaattctgcatccgtagaatatgaagcgccagttgtatatcctgatttggggatttggcatcctttagcgccgagtatgtttgaggatgtcagagaatacctcaactggtacacagcccgtaaggatatatccagcgatttaaaagatcccttagcaccctgtgtagggttggtattacaacgcactcacctagttaccggtgatgatgcccattatgtggcaatggtgcaggagttggaagccttaggggcaagggtattgccagtttttgcaggtggtctggatttctccaagcctgtggatgcttacttttacgaaccaacgactaaaaccccgttagtagatgcagtgatctctctcactggttttgcgttggtgggtggcccggctagacaagaccatcctaaagcaattgacgcacttaaacgcctgaatcgtccttatatggtggcattgcctttagtcttccaaacgactgaagaatggttggatagcgatttaggcttacatccgattcaggtggctttgcagattgccattcccgaactagatggggcaattgaaccgattatattatcgggtagagatggcacaacaggaaaagcgatcgccttacaagaccgtatcgccgcagttgctcaacgcgctttaaaatgggctaacctgcgccgcaaacccaaactcaacaaaaaagttgctatcacagttttcagtttcccacctgataaaggtaatgtcgggacggctgcttacttagatgtatttggttccatctacgaagtaatgcaggctttgagaaacaacggctacgatgtgcaggacttaccagaaaacgctcaagagttgatggaacaagtcatccacgacgcacaagcacagtatgctagcccggaactcaacattgcttataagatgtcagtcccagaatatgaggaactaacaccttattcccaacgcctagaagaaaactgggggccaccaccaggaaacctcaacagcgacggacaaaacctgttaatttacggtaagcaatttggtaacgtcttcattggtgtacaacccacctttggttacgaaggcgaccccatgcggttgttgttctcccgttctgctagtcctcaccacggctttgctgcttactacacttacctagaaagagtttggggtgctgatgctgtactgcacttcggtacacacggttccttggaatttatgccaggtaagcaaatggggatgtctggtgaatgttacccagataacttaattggcacaattcccaacctgtactattacgcagccaataaccccagcgaagcgacaattgctaaacgccgcagttacgctgagacaatttcttacctaacaccacctgcggaaaacgctggtttgtacaaaggtttgaaagaactcagtgagttaattgcgtcttaccaaaccttaaaagatagcggtcgtggtatccccatcgtcaacacgatcatggataaatgccgcatcgtcaacctggataaagatattaacttgccagaaaccgatgccaaagatatgacccccgaagaacgggataatattgtcggcagcgtttaccgcaagttgatggaaatcgaatcccggttattaccttgtggtttgcacgtcattggtaaacccccaacggcagaggaagcgatcgccacactagtcaacattgccagcttagaccgtcaagaagaagaaattctcagcttaccccggatcatcgctaacagcctggggcgcgacattgacgaaatttaccaaaataacgacagaggcatactagaagatgtccaattactacaagacatcaccctagccacccgcgccgccgtccgcgccttggtagaagaacaaaccaacgcagaaggacgagtttccctcgtttccaagttgaatttcttcaacatgggcaaaaaagaaccttgggtagaatccctgcatcaatcaggttatcccaaagttgacacctcagccttaaaacccctgttcgagtatttagaattctgcttacaacaagtttgtgcagacaacgaactcggcgcattactcaaaggcttagaaggcgaatacatattacccggccctggtggagaccccatccgcaacccagatgtattacccacaggtaaaaacatccacgccctcgacccccaatcaatccccacagccgccgccgtccaatcagccaaaattgtcgtagatcggctattggcacggaacaaagctgacaacaatggtaattggccagaaaccatcgcctgcgtcctttggggaacggataacatcaaaacctatggcgaatccctagcccaaatcatgtggatggttggtgtacgtccggttcccgatgctttgggacgggtgaacaagttggagttaatacccctagaagagttgggacgacccagaattgacgtagtaattaactgttctggcgtattccgcgacttgttcattaaccagatgaacttgttagaccaaggggtgaagatggcggcggaagcggatgaaccattagaaatgaacttcgtccgcaaacacgcactgcaacaagctgaggaaatgggtattaacctcagacaagcagccacccgcgtgttctccaacgcttctggttcctactcctcaaacataaacttggcagtagaaaacagcacatgggatagcgaagccgaattacaggaaatgtacctcaagcgcaaatccttctccttcaattccgataaccccggaatgatggacgaatcccgccagctttttgaaagcaccttaaaaactgctgacgcaaccttccaaaacctggattcctccgagattagcttgactgacgtttcccactacttcgactcagaccccaccaagttggtagcaagtctgcgtggtgatggaaagaaaccttcatcctacattgcagacaccaccacagctaacgcccaagtccgcacattatccgaaaccgtccgcctagatgctcgtaccaaattgttaaatcccaagtggtatgaaggtatgctatctcacggttacgaaggtgtccgcgaactctccaagcggttggtaaataccacaggttggagtgcgacagccggcgcagtcgataactggatttatgaggatactaacgaaaccttcattaaagatgaagaaatgcagaaacggttacttaaccttaacccccattctttccgcaagattgtctcaactttgttggaagtgaatggtcgtggttattgggaaactagcgaggagaatttagaccgcctccgcgagttgtaccaagaagttgaagaccggattgaaggcatagaa

SEQ ID NO: 42555 - DNA, 1086 bp, Anabaena PCC7120
atgggcaatacttttggacatctgtttcggatcactacttttggcgagtcacacggtggaggcgtgggggttgtgattgacggctgtcctccgctactcgaaatttctcctgaggaaattcaactggagttagaccgcagacgacccggacagagtaagattacaacgcctcgtaaggaagcagacacctgtgagattttgtctggggtatatgaaggcaaaactctgggaacgccaatatcaattttggtgcgaaataaagatactcgtccccaagattatgatgagatggcgcaaaagtatcgtccttcccatgctgatgcaacttatgatgctaaatatgggattcgtaattggcaaggtggcggtagatcctcagcgcgggagacaattggtagagtagccgcaggtgcgatcgctaaaaaaattctccggcaagttgctaatgtagaagttataggctacgtcaaacgtatcaaagacttggaaggtgttgtagatcccaataccgtcaccctagaccaagtggaaagcaatatcgttcgctgtcctgatggcgaattggcagaccgcatgattgaattaatcgaacaaacaggtagacaaggtgattctatcggcggtgtagtggaatgcgtagcgcggaatgttcctaaaggcttgggtgaacctgtattcgataagttggaagcagatatcgccaaagctgtgatgtctttacctgctagcaaaggttttgaaatcggttcaggttttgccgggactctgctaacaggatttgagcataacgacgaatattatattgatgaaaacggtgagattcgcacagtaactaaccgttccggtgggattcaaggcggtattgccaacggagagaatatcattttgcgagttgcatttaaacccacagccacgattagaaaagagcaaaaaacagttactcgtgaaggcgaagaaaccctattagccgccaaaggtagacatgatccctgtgttctaccccgtgcagtcccgatggtagaagcaatggtggcgttggtactgtgcgatcatttgttacgccatcatggacagtgtaaggtgcta

SEQ ID NO: 42556 - DNA, 585 bp, Anabaena PCC7120
ttacatttgtacgattttttaccctcaggcaatggctataaagtccggcttctattaacacaaatgggcataccatttgaacgaacagaagtgaatattttaaagggagagagtcgcacaccagaatttttaagtaaaaattctaacgggagaataccagttttagaagttgcaccagggaagtatttagcagaatcaaatgctatattgctttacctgagcgaatatacagaatttttaccttacgaccgctatttaaaagcccaggtaatgcagtggttattttttgaacaatatagccatgaaccatatattgctacatctcgtttttgggtttctattttaggtaaagtggaagaatatcgtacagctttagaagaaaaacgggaacctggttatgcagctctcaaggtgatggaaaatcatttgaaatgccataattttttcgtagatgagcgttacacaattgctgatattgccttatttgcctatacccatgtcgcggatgaaggtggttttgatttaacgccatttccagctattcaagcttggatagacagagttaaagcccaacctggatatatt

SEQ ID NO: 42557 - DNA, 1158 bp, Anabaena PCC7120
ggtttagcctatcgctgctacaccacatcagaagaactagaagccctacgagaagggcaaaaagctaaaggtgaagccccgcgttacgacaaccgtcaccgccaccttaccccagaacaagaagccgaatttaaagcccaaggacgcagttttgtcatccgctttaaaatcgatgatgagcgagaaatcgtctggaatgacttagtacggggtaagatgtcttggcgaggcagtgatttaggcggtgatatggtcatcgcccgtgcttccgaaaatgatactggtcagccgttatataatttcgttgtggtgattgatgacatcgatatgcaaatcagtcatgtcatccggggagaagaccacattgccaatacagccaagcaaattctgctatacgaagcctttggggcaaaaatcccagagttcgcccatactcccctaattttaaatatggaagggcgtaagctctccaagcgggatggagtgacttccatttctgactttaagcaaatgggtttcacatccgaaggtttagtcaactacatgaccttgcttggttggtcgccaccagattctacccaagaaatatttaccttagaagcagccgccaaagaatttacttttgagcgggtgaataaagccggggcaaaatttgactgggcgaaactagattggttgaacagtcaatatattcacaataccccagttgatcagttgactgatttactcattccctattgggaagcggctggatattcattggctgggggacgcgatcgcccttggttagaacagttggtgggtttacttagcgccagcttgacccggttaaccgatgcggtagatatgagcaaactgttttttactgagacagtggaattgagcgaagaaggtagcaaacaattgcagcaagaaggttctaaagccgtgcttgaggcaattatcgccgccttggagactcaagcgcaactcacagaaacggctgcccaagacataattaagcaggtggtgaaaggtcaaaatgtgaagaaaggtttagtcatgcgatcgctcagagtcgccctcaccggtgatgtgcatggcccagacttaattcaatcttggttgctcttgaatcagattggcttggataagccacgcttgaatcaggcgatcgca

SEQ ID NO: 42558 - DNA, 2304 bp, Anabaena PCC7120
gactttctcagtcatctgaatcccagccaacgtcaagccgtggaacactattgcggccccttgttagttgttgctggtgctggttccggtaaaacacgagcgttaacttatcggattgctaatttaatactgaagcaccgtgttgctcccgaaaatattttggcggtgactttcaccaacaaagccgccagggagatgaaagaacggattcaacggctgtttgcagaacaattagcattgacagaacatggaaagcgtttagatttactaccagaacacgaacaaactaaattgcgatcgcgtgtttataaaactactattaaagaactgtggtgtggtactttccatagtttgttttcccgtattctccgctttgatatcgaaaaataccaagatgaaaaagggcgacaatggaaccgaaatttttccatttttgatgaatctgatgtacagggtctcatcaaagaaatcgtcactaaacaattaaatctcgatgataagaagtttgagcctcgttctgtccgctacgccattagtaatgcaaaaaatcaaggactttcaccccaggaatttgaaaaagaccaaccaaattatcgtgggagagtaattgctgatgtctataatcgctatcaagataaactagcagaaaacaacgctcttgattttgatgatttaattttaattcctacgagattatttcaacaaaatgagcaggttttaggttactggcatcgcaagttctgtcatattcttgtagacgaatatcaagatactaaccgcactcaatatgacctaattcgtctgttgacaactaatggcgaagagaaaaaaagtgcatgggagtggcaaaatcgctctgtttttgttgtaggtgatgcagaccaatctatttacagctttagaatggcagatttcaccatattactggattttcagaatcagtttggtgatggtttgccagatgaagacacccgcacaatggtgaagttggaagaaaactatcgttcttgtgaaaacattctccaagttgctaacgaactaattgaaaataatactcaaagaatcgataaagtcctcaaaccaacgcggggagcaggcgaagaaatttactgtcacaaggcagataatgaattagaagaagctgattttgtaattcgtcaaatccgcacattagaacatcaaaacccggaattggattggggaagctttgcaattttgtatcggacaaatgcccaatctcgtccctttgaagaattgttagtgaggaatcagattccttacactgttgtgggtgggatgaaattctatgaccgcaaagaaattaaagatgttatagcttatttaagagcgatctctaacccctcggatacagttagtttattacgagtaatcaacacccctcggcgcggtattggtaaagcaactattgataacttaatcaatgcttcccaacaattaggtactactctctgggaaatcttaagtgatgaaacatcagtcaatacattggctgggcgatcggcaaaaggggtgaataactttgccaaaatgattaaccgttggcaagaacaaatagctacagccccagttacagaaatagttatggggattttagaagattctggttacgtacaagatttacaaagccaaggaacagacgaatctgaagaccgcatccaaaacgtacaggaactttataacgctgtcttgcaattccaagaagagaatgaagatgtttctttaacagctttcctgcaaagtacagcccttagttctgatttagataacctcaaggaaggtcaaacagccgtttccctcatgactctgcacgcttccaaaggtttggaatttcctgtagtcttcttggtaggtttagaacagggattattccccggctaccgttcactaagtgaccccgcagccttagaagaagagcgtcgcctctgttatgtagggattactcgcgcccaagaacggctgtatttatccttcgcccgtgaacgccgcttatacggctcacgagaacccgccatgcgatcacaatttctcgatgaattaccagccgaattaatcacaacccaataccaagtccggcaaacttatactagacccccatctactaccaatggtaaagaaacagccaatcaagattggcaagtaggggacagagtattacacaaaagttttgggattggggaaataacccacgtttttggtgctggtagcaagctttctgtggctattaaatttacgagcttgggtcagaaaattgttgaccctagagtcgcccaattacaaaaggtg

SEQ ID NO: 42559 - DNA, 726 bp, Anabaena PCC7120
ctgtagatggaagtaattcgtctggataaagtttcgctatggcggcgaacccaagaagagttttcttatgacctcaagaaaactctcctatctttgatagaaggtaaatatcgtaagccagcgaaaaaattggttttagacaacgtcgatttagttgttgaaaaaggcgacaaaattggtattattggcgcaaatggatctggtaaatcaactttattgaagatcatttctggtatacttcaaccaacgactggcacagtcagagtcaaagggcaagttgcacctttgattgaactaggtgctggttttgatgcagaaatatctgtaatggataatattctgctctatggtgtattactgggattttcgagggcggaaatgaaagaaagggcgaactcaatattggagtttgcagaattacaggactatgctttagttcctgtaaaaggactttcttctggtatggttgctcgtttagggttttccattgccacagatgtgcagccaaatatcttaattttagatgaggtcttatcggtaggagacgaaaattttaaaaataaatgcaagcaaagaattgataatttttggaatggagatgcaacagttttagtagtttcccatgatttacagtttgttaaacaatattgtaatcagttggtttggttatctcatggaaagatagagtttataggcgattcaggagaggcaattcaacattattta

SEQ ID NO: 42560 - DNA, 984 bp, Anabaena PCC7120
tctgaggccttagcgaatcccagcccagatattatcgcctctagtgaccgcactgccaaaacccggcagttattaggtatgaaaggtgcagcgccaggagaaacttctatctggaaaatccgcctgcaattgatgaagccgattacttggattcctctgatttggggtgtggtttgtggtgcggcttcttctggtaactacacctggtcattggaaaatgttttgaaggcggcaacttgtatgttgttgtcggggccactcttgacgggttacacgcaaaccctcaacgatttttacgatcgtgaaatcgatgccattaatgaaccttatcgccccatcccttccggcgcaatttctgtcccccaggttgtgacccaaattgtgctgttatttattgctgggattgccgtcgcatttaccctggatttgtgggcaggtcatgagttccccaacgtcacagtattggcgttgtttggttcctttatcgcttttatctactctgcacctcccttaaagttgaagcaaaacggctggttaggtaactacgctttgggtgctagttatatcgctttaccttggtgggctggtcatgctttatttggtgaactcaactggaaaatagctgttctcaccttaatttatagtttggcaggcttggggattgccattgtcaacgactttaagagtgtagaaggcgatcgccaactgggattacaatcactacctgtaatgtttggtatcaacacggctgcatggatttgtgttgtcatgattgacgtgttccaaggattaattgcagcttatcttgtgaccattcatgagaatttatacgccgccatcttggtactgttaatcattccccaaatcaccttccaagatatgtatttcttgcgtgatcccttaaaaaatgatgtgaaataccaagccagcgcccaaccatttctagtattagggatgctcgttgccggtttagcattgggtcat

SEQ ID NO: 42561 - DNA, 1116 bp, Anabaena PCC7120
ggaattgatttgggaacaactaattctgttggtgcgtttaagttagcagaagtagaggtagtgacagctaatgacaacacacccccagatagaaaattaacgcgatcgcttgttgcctatgaccaggataaattattggtaggaaatcaagcttacaatcagttacgggctgacccagaaaatgtgattgcttcaattaagcgcttgataggtaggggttttagtgaccaagcagtcaaaaaacaaaggttagaggtcggttacaaaattactgaacctagctacggaaccgataacagcattgcggtttggctaggaggtcaagaatacagtccagaggatatctcggctgaaattctcaaaaaagtcgtatctaatgcccaagcttatcgtcaaggaattggcaagatagacgaagtaatcgaccaagccgtgattacgattcctgcctatttcaatgaccagcaacgctacgccacccgtaccgccgccctcaaagccggactgacacctttagaattactaccagaaccgacggcggctgctatatcctatggtttttcgccagatagcgaagatgtgaagacgattttagtttacgattttggtggcggtacatttgatgcttccctgattaccgcagctggtacttcatttattgaacagggaaaagcgggagatttatggttaggtggggatgacatcgattctcaaattatgaactttgtcaaaacccaagttgcccaggaggagaaaattggggatattgacggcttaatagccaaaatgccttattaccaaaggctaagatttaacgccgacctgaaaatggctgtagaacgtgccaaggttgaattaagtagcgcccaagtagcacggattagcccagcaactcaattactggatgaattaggtattgccattcctattgaagtagaaattactcgccagcaatttgaggcgatgattagtgacttggttgatcgttcagtgcagatttgccgcctcgccttacaagatgcagaatatcacttggaaatggtggatatagtgttgttggttggggggtcttcccaaattcctttagtacaacgcaaagttaaagaagcctttggt

SEQ ID NO: 42562 - DNA, 2124 bp, Anabaena PCC7120
acccatcttttacgacaaatagcagaccaagtaggtatcgctgtagcccaagcccaactcttagaagtagaaactcgacagcgacaggaactagaagttgcccgtagtcaggctgaattagcttctcatgctaaaagcgcttttttggcgaatatgagtcatgaaatccgcacacccatgaatgctgtattggggatgactggcttaatgctagaaactcttctcaaccaagagcagcgagattttatggaaactattcgcattagtggcgatgcacttttaactctcattaacgagatattggatctctccaaactggaggctggggaaatggctttagaaaatttgaattttaatttatcaacctgtgtggaagaagttttagatttattagccccccaagctcatagtaagggattagaaattgctgctttaatctatcgccacgttcctatccaactccaaggagatgctagccgtctgcgacaaattctcatgaacctgattggcaacgctatcaagttcactagttttggggaagtagtcatgcgagtagaattgcgatcggaaactcctactacagctattatccactttgccgttacagatagtggcttgggcattactttagaagaccaacacaaactgtttaccccttttactcaagtagatgcttccaccacgcgtaagtatggtggtactggtttgggattagcaatatgcaaacaattagtgacattaatgggaggagaaattggtgtagaaagtcagttaggcaaaggttctaaattttggtttgaaattcctttcgccaaacaactccagcctgtttcttttgtagaagattgcggactattaaacaatcgccgtttactggtggtggatgaccacgccactaatcgaaaaattatttatcaccaagttagtcgatggggaatgcaggtagatcaagctgatagagctgttgcggctctaagtatgattgtggaagcttgtcagcagaataagccctacgatgtcatcttaatcgatatgcagatgcctgaaatggatgggatggctttgggaaaacaaattaaggccaattctgctattcctccaacacccttaattatgctcacttctactaatcaacgtgacgaagtgcaacaggcaattaagattggatttgctgcttatttggtcaaacctgtaaaatcatctcggttgctcgacactataatgagtgttttaaaaactccgtcacaattggaagcagagaagttggaagtaaagagtcaagagttagaaaagaacaatttagatcacagccgcaaccataattttactgctacccaggctcagaattctgtttcaacaaaaactagaatcctactggctgaggataacttagttaaccaaaaagtggctcttaaacaactccaaagccttggttatacagctgatgttgctgctaacggcaaagaggttttacaactattaaaacaaattccctacgatttgattttaatggattgtcaaatgccaattcttgatggtttggaagccacaaaagaaattcatcgttgggcagaaagctcctttgctagctgtcgtcgtcctgtgattattgcgatgacagctaatgccatgaaagaagacaaacaaatgtgtctagatgccggcatggatgattatttgagcaagcctgtgatgaaagaacaattggcgacagcattagaatattggtgccagttaatactaaattcacgacaggcagtagagtttgatctaaatagtcttcctcttgactgggaacacttacatcaactttccgaaaacgatacagaatttgaattacatttgttgcaaatattcgttgaggatgtccgagctagattagagttagctaaagaggcgatcgctaacactgactttcaacagatggctcaacaagtccatcagctgaaaggcgctagtaccaatatcggcgctacagctatgtatctagctgctgaaaagctagaacagctagctcaaaaccaagagcgtagaggcagcatggagttaattacagaaatagaagagggtgtcaaccagattcaagcctttctaactagaagccaaattgtttgaccatgtttt

SEQ ID NO: 42563 - DNA, 759 bp, Anabaena PCC7120
cataagcagactgctctaattactggtgcagctagtggtattggttatgaattagtgtgtattttcgctgaaaatgattacaatctcgtattagtagatcgggcaaaggaaaaactagaagaaatagcgattgagtttcaagataaattcggaatttctgttaagcctattgtccgagatttatctaaaacaacatctcctgaagaaatttttcaagaggtagaacaggcaaatattaaagttgatgtgctagtcaataatgctgggtttggtacttatggattatttaatgacactaaccttactgatgaactagaaatgctacaggtaaatgtggtatgtactacccatttaactaagttatttctcaaaaatatggttcagcaaggtgagggaaaaatattaaatgtctcttctgctgcggcttttcaaccagggcctttgatggccgtttattttgcgactaaagcctacgtattatctttttctgaagcactcgccaatgaattagacggtacaggtgtcactgtgacggttctttgcccaggaacaacacagtctgctttccatcaaagaacggggatggcagattctaaactagtcaaaggtaaaaggatgatggatgcgtcaacagtagccgatattggttatcgtggtttaatgcagggtaaaacaattgttattcctggtttgatcaataaaatcatggcgaaaagtatcagatttatccccaggaaactagtaactaaaattgtcagg

SEQ ID NO: 42564 - DNA, 1161 bp, Anabaena PCC7120
atgggtcgtgtaggcgtattattactcaatctcggtggtcccgataagctggaggatgtagctccgtttctatttaacctattctccgatccggaaattatacgcttaccattccggtggttgcagaaacccttggcttggtttattgcttctcgacgcaccaaaacctcccaagagaactataagcaaattggcggtggctccccactacggaggattacggaagcccaaggagaagccttaaaggaacagttgcattatttgggtcaagaagcgaatatttatgtgggaatgcgttattggcacccatatacggaagaggcgatcgctcttttgacccaagataaccttgataacttggtgattttgccactatacccccaattctctatcagcactagtggctctagcttccgtctactagaaagactttggcaagaagatcccaaactacaacgtctggaatacacagtcattccttcttggtataaagaaccaggttatttacaggcgatggcggaactcatccgccaagaaatagagcaatttcctcatcctgatcaggttcatgtgttcttcagcgctcatggtgtacccaaaagctatgttgaagaagcaggcgacccctatcagcaggagattgaggaatgtactgcattaattatgcagactctcaatcgaccaaaccctcacactttagcgtaccaaagtcgcgtcggcccggttgaatggctacaaccctatactgaagatgcactcaaagaactaggcgcgcaaggtgtcaaagatttagttgttgtacctatcagtttcgtctccgaacacatcgagacactacaggaaattgatatcgagtatcgggaaatagcagaagaagccggaatccacaatttccgtcgtgtccctgcacctaatacccatccagtatttattagagctttggctgatttggtaattgatgcgctcaacaaacccagtttcaagctttcgcaagccgcccaaatcaagaaaatggtcaaaatgtatcctcctgagagttgggaatggggtatgacttctagtgcggaagtttggaatggacggattgcaatgctaggtttcattgctctaattatcgagttggttacaggccaaggtctactgcacatgattgggcttttg

SEQ ID NO: 42565 - DNA, 1617 bp, Anabaena PCC7120
atgcaagaatatgatgttgtaatgattggtgcaggacataacgggctagtttgtgccgcttatttgctgaaagctggctatagtgtcctgctactcgaaaagcgttctgttcctggtggtgcagctacaacagaggagtgtttgccaaaagaagcaccagggtttaaatttaatttgtgtgccattgatcacgaatttattcacttggggccagttgttgaggaattagaactggggaaatatggcttggaatatttagagtgtgatccagttgtattttgtcctcatcctgatggtaagtattttttggctcataaatctttagaaaaaacttgtgcagaaatcgctcggtacagcgaacgtgatgctaaaaaatacgccgagtttaccgaatattggcaacgggcaataggtgcaatgattcctatgtttaatgccccgccaaaatcaattattgatattgttggtaattacgatatcacgaaattcaaggatttattttcagtcatcggttctcctaacaaaacgctggacttcattcgcaatatgttaaccagcgcagaagatattctcaatgagtggtttgattcggaatttctcaaagcacccctagcaagattagcatcagaactcggcgcaccaccatcccaaaaaacgatcgctattggtgcaatcatgatggcaatgcgtcacaatccggggatggctagacctcgcggcggtactggcgcattaattaaagcgttagtaaatttagtcataagtaaaggcggtgtgattctcacagaccaacaagtcgaaaaagttttaattgatgacggtaaagccgttggtgtgcgggtaagtggtggtacagaatatcgtgctaaatatggtgtgatttctaacatcgacgcaaaacggttatttttgcaaatgaccgataaaagtgatgtagatgcagccgacccagatttatgggaaagattggaacggcgcattgtcaacaacaacgaaaccattctcaagatagatttggccttagatgaacccttgcgttttcctttccacgcccataaagatgaatacttggttgggtctattttaattgctgattctgtagcccatgtggaacaagcacatagtaaatgtacattgggagagattcctgattccgacccatcgatgtacgtagttatgcctagctatctcgaccccacattagcaccttctggcaaacatacagtctggattgagtttttcgccccttatcaaattgctggtgcagaaggtaccggtttcaaaggtactggttggacggacgaattgaaaaaccaagttgcagacaaggtagttgataaactggctacctatgcgccaaatgtcaaaacagccactattgcccgtcgtgtagaaagcccggcggaattgggagaaagactaggcgcatacaaaggtaattactaccatattgatatgaccttggatcaaatggtctttttccgtcctttgccagaaatagccaactacaagacccccatcgataatctatttctcactggtgcaggtactcatcccggtggttcgatttcgggaatgccaggacgcaactgtgcgcgggtatttttgcagactaag

SEQ ID NO: 42566 - DNA, 2946 bp, Anabaena PCC7120
atggtggatttgttacggcagttgcgtgatttgtgttcaccagaagggcaagccacaaaagaccaagcagtttctgctgtcaagttaattgaacagttgaatattaatgaagccattcgggcagctagggcttttgctttgtattttcagctgatcaacatcatagagcaggaatatgagcaaaggcagcaattaactcgctattctgacttagaagcggaaacagcacccctaaatggttccgaaaacattacctcatcctctaaccacaacgaagatgatgttattttcaaccggggtttagggactgatttcttaggaaaaaattggactaatcgtggacaagggaaacaaaaaggtacttttgcagcgttatttcccttattgtctaaattgaatgtcccaccccaacaaattcaacgcctgatttcccaactagatgtccgtttggtattcactgcccacccaacggaaattgtccgccacaccattcgggacaaacaacggcaagtagtagatttgttgcaacaactcgatgaggtggaaaatcgagctaaggacggcggcggctatccttgggaagcgggggaaattcgggaaaaattgctagaagaaattcgcttgtggtggcgtacagacgaactccaccagtttaagcccactgtgctggatgaagtggattatgctttgcattacttccaagaagttttatttgatgggattccccaactgtataagcgtttcaaatacgccctaaatcaaactttctcctggttagaaccaccaagcaaagatttctgttcctttggttcttgggtaggttcagacagagatggtaatccatcggtaacaccggaaattacctggcagacagcttgttatcagcgcaaaatggtgctggaaagatatatcaagtctgtcacccaattgattgaattattaagtatctccatgcactggagtgacgttttaccagacttattggaatccttggagttagatcagtcccagttaagtgaagtatacgatgctctggcgctgagatatcgccaagaaccctatcgtctcaaactagcttacgtcctcaagcgcctggaaaatacccgcgatcgcaatttagctttatataaaggtgaaacccccacaaatgaagatagccccatgtatcgttcggggtcggaatttttggcggaactgcgattaattcagcataacttgacggaaacaggtttaagctgccgagaattggataatttgatctgtcaagtggaaatttttgactttaacctgacaaaattagacatccgtcaagaatccaccagacattcggacgcgttaaacgagattctcgactatctccaattattaccccagccatacaacgacctctccgaagaacagcgagttgcttggctaacaaccgaactgcaaacccgtcgcccattaatttcgtcagaactaccattctctgacaaaactaatgatgtcattaaaactttccgcgtagtgcgatcgctccaacaagaatttggcattaatatctgccaaacttacatcattagtatgtgtcgtcaagtcagcgatgtcttagaagttttgcttctagccaaagaagccagactttttgacccagcgatcgccgtcggtacaattcaggttgtaccattatttgagactgtcgaagatttacaacgttctcgcagcgtcatgcgacagttatttgaattacctctataccgcgctttgctagctggtggttacaaaaataccgaagtaaaagtaccgaatactgagctaacaccccaatccccagcccccagtccccagtccgtactcacccccgacttacaagaagtcatgctgggatattccgacagcaacaaagactccggcttcttgagtagcaattgggaaattcataaagcccaaaaatcattacagcaaatcgccgaagaatatggcgtaaatttgcggattttccacgggcgcggcggttctgtaggacgaggcggcggcccagcccacgaggcgattttggctcaaccaggacacagcatcaacgggcggattaaaattaccgaacaaggggaagtattagcctccaagtactccttgctagatttagccctgtacaacttggaaaccatcaccacggcggtgattcaagccagcctcctgcgaactgggtttgatgatatcgaaccttggaacgaaattatggaagaattagcagcgcgatcgcggcaacattatcgtggtttaatttacgaacagcctgatttcattgactttttccaccaagtcacacccattgaagaaatcagtcaactacaaattagttctcgtcccgcccgtcgtccttctggtaagaaagatttaagcagtctccgcgccattccttgggtatttagctggacacaaacacgattcttactaccttcttggtacggtgtcggtacagctttacaagaatttttcaacgaagaaccagaagaacatctcaaattgatgcgctacttttatgtcaagtggcctttcttcaagatggtgatttctaaagtagaaatgaccttggcgaaagtagatatgcaaatggctggtcactacgtacaagaattgtctgaccctgaagacaaaccccggtttgagaaagtatttgagcaaatcgccaacgaatattatctcaccagagatttagtcttaaaaatcaccgaccacggtcggcttttagatggtgatcctgtactccagcgttctgtacagttacgcaatggtacaatcgtcccactagggtttatccaagtttccctcctcaagcgcctacgccagtccaaaaataatactgcaacctctggtgtcattcactctcgttacagtaagggagaattattgcgcggcgcactgttaaccattaatggtattgccgcagggatgagaaatacaggt

SEQ ID NO: 42567 - DNA, 990 bp, Anabaena PCC7120
atgactagcaacttagaagctcaacttttagcactgcggcaggaaggagaacaggcgatcgccgccgccgataccctcgaacgtctggaagaactcagagttagttatctgggcaagaaagggcaattgggggctttgttgcggagtatggggcagatgagtgcggaggaaagaccgaaaattggagcgatcgccaatacggttaaggaagccctacaagctagtttagacaagcaacgggaatctttagaatctgcccaaattcaggcacagttagacgcggaaacgcttgatgtcactatgcctggtatttacaagcctcaaggacgtattcaccccctaaatggcattattgaccgggcgctagatgtttttgtgggcttgggctacacggtggcgcaagggttggaaatggagacggattactacaattttgaggcgctcaacaccccaccagaccaccctgcccgtgatatgcaggatactttctacctcccagacggtaatctcctgcgtactcacacctcatcggtgcaaattcgttatatggaaaaagaggaaccaccaattcacattgtggctcctgggcgagtttatcggcgagataatgtagatgccacccactcggcagttttccatcaaatcgaactgttagccattgatgagggactaacttttaccgacctcaaaggcactattaaggtgtttttgcaagctatgtttggtgatttgccaattcgtttccgcgccagttacttcccctttaccgaaccctcggctgaggtagatttgcagtggaatgggcgctggttggaagtcatgggttgcggtatggtcgatcccaatgtgatgaaatctgtaggttataacccagaaatttacactggctttgcggctggttttggtgtagaacgtttcgcaatggtgctacaccaaatcgatgatattcgtcgtttatatgctagtgacttacggtttttgcgtcagttc

SEQ ID NO: 42568 - DNA, 855 bp, Anabaena PCC7120
atgaagttctacaaatatcatgctcttggtaacgactatttagttatcaatcctcaggatttaaaatttcccctaacacctgaaaaaattaaaataatttgccatcgaaattttggcattggatctgatggtattttgttggggcctttagcatcaacaaaagcacaatttgctttacgcattttcaaccccgacggaagtgaagcagagaaaagcggtaatggactgcggattttctcccgttacctgtgggatatgggactagttgacgaaaagccattctcaattgaaactgcgggtggaatagtggaatctgcgatcaaagatgcaggtaaaacagtccaagtagagatggggaaagtcagcttttggagtcgtgatattccagttattggcgatgacagagaagtaattcaagaaaaaatctttcttgatgaaggcatttttacattttgtgcagccacaataggtaatccacactgtgtaattcttttagatgacatcaattccgaggttgccagaaattttggcccaatatttgaaggttatcctcttttccccaatcgcactaatgtgcagtttatgaaagttttagatagaagcactattcaaattgaaatttgggaaagaggagcaggttacactttagcttcaggtagtagtagtagtgcggcggcggctactgcacataaacttggtttgtgtgactctaaaattattgtcaaaatgcctgggggagacattttaattcaaattaaagatgactttcatatatctatgacagattctgtcacaaaacttgcccaaggagaattgtcaacagaaatatttgccatagaaactgtcattaatatc

SEQ ID NO: 42569 - DNA, 1149 bp, Anabaena PCC7120
gcatcttccacacctcaaggatttagtacctttattactaatttgggtatacgtgatactactgaagattttgtattcttacgatcagatgtaccttgtgtagctgatggcgtatttactcaaagccttttcgctgggcctagtgtgactattagccgtcaaaatttacaagatgggcaagcacaagggattattataatttccaaaaatgccaacgttgctaatggtgctgtggggattgctgatgctcaagagattatacaactcgtggcacaggaaactgggattgctgccgaaaatttggcgatcgcatccactggggtaattggtagacgttaccccatagaaaaaattcgcgctggcttggtgggaatgggtcaaaaactaactgctgccgattttgacttagctgcacggggtattatgaccaccgacaccgtatctaaaatcgctgcacgacaagttggtaatgccaaattggtgggtattgctaaaggtgtcggcatgattgagccgaatatggcgacaatgttagctttcttttttactgatgccgcgatttctgccaatacactgcgtcaaatttttcgctctaccatagataaaacatttaattgtttaagcatagatactgatacttctactagtgatagtgcggtaattttggcgaatggtttagcgggtgaagttcctgaagcagaatttgctagtgcattgcaagaaattgcccatgatttagtgttaaaaattgcccgtgatggcgaaggcgcaactaaggtaattgaggtaaccgtagattcagccgctaactatgctcaagctaaacgagtagctaaagccattgttaattcaccactagttaagactgctgtgtatggtgcagatcctaattggggaagagtagctatggcaataggcaaatgtgaagatgaacgggatattaatccagatcaggtggtaattagatttgatgaagtgcaagtttatcctaatactttccaagctgaaaacttggagaagttaaaagaaattatgtccaaagaaaaagtcaatattcatgtaagtttgaatatcggtacagatgtggctactgtatggggttgcgacttgacagaaggttacgtggaaattaacggtaagtactctact

SEQ ID NO: 42570 - DNA, 609 bp, Anabaena PCC7120
gatacggtatttgtgggcagtgatgcttctgtctctactggtaatggtaacgatcaaatcttcatcggtgtcgagagtccagccagcaataccacagctaatggtggtaatggtgacgacgaaatcaccgtgattgaagcaggtggaagtaataacctttttggcgcagcaggtaatgatactctgcaagtcattgaaggttctcgtcaatttgcctttggtggttctggtaacgacaccctcacaagtaacggtagctataaccgtctcaatggtggttcaggagatgacaaattattctccagtgtgaatgactctttgttcggtggtgatggtgatgatgtgctatttgcaggtcaagctggtagtaaccgcctcactggtggcgctggtgctgaccagttttggattgctaatggtagtttaccaactagcaagaatactgtgactgattttgcagtcggtgttgacaaaatcggactgggtggaattggtgtgacacaatttagcgctttgagtctggtacagcaaggcgctgatactttggtgaaactaggggcgactgagttagttgcattacaaggaattacttcaactagtctgagtgtg

SEQ ID NO: 42571 - DNA, 1079 bp, Anabaena PCC7120
atgaaccaaaacaagcgagcattaataactgggattactggtcaagatggttcatatctaagcgaatttctcatagaacaaggttatgaagttcacggtattattcgccggacttccacattcaatacagaccgcatcgatcacatttatgaagatccccaccaagaaggagcgcggttatttcttcactacggtgatttaaccgatggtacaacactacgccgaattctcgaagaagttcaaccaacagaaatctataacttaggcgctcaatctcatgtgcgagtaagttttgattcgccagaatatacagtagatgccgtaggtatgggaacactacggttattagaagctatccgtgactaccagcgacgcacaggtattcaagtacgattttatcaagcaggttcttcggaaatgtatggtttagtacaagctgtacctcaaagcgaaactacaccattttatccccgtagtccctacgcttgtgccaaagtttatgcccactggcaaacagtaaattatcgggaatcttacggtttatttgcttgtaatggcatactttttaaccatgaatcacctcgtcgcggtgaaacttttgtcacccgcaaaattacaagagctgttgcccagattgtagccggcaatcagaaaagcatctatatgggtaatcttgatgccaagagggattggggttatgccaaagattatgtccgagctatgtggttgatgttgcaacaagaacaaccagatgattatgtagttgctaccggcgaaaccactcagtacgtgaatttcttgagttggcttttagctatgtaaatcttaactggcaagattatgtagagtttgatgagcgttatctgcgtccagcagaagtagatttattaattggtgatcctaccaaggcacaacagaaattgggatggaagccttctgtcacctttaacgaattggtagcactaatggtagaagccgatttgcaagctttaggtcagacttctcccaatggtaatacttcaatcctaccccaggatattgctactattcgtcaacaactgggtgtactccacttctga

SEQ ID NO: 42572 - DNA, 885 bp, Anabaena PCC7120
atggtcaacgatattgagtatatcaggcaagctgaagctactcgtgtgcaggtactaagcgaagcactaccttatattcaacaatttgccggtcgcaccgttgttgttaaatatggtggtgcggctatgaaagatagccacctcaaagaccaagttatccgcgatattgtctttctatcctgcgttgggttgcggccaatcttggtacatggtggcggcccggaaattaacagttggttagataagctgggaatcgaagcacagtttaaaaacggtctacgagtcactgatgctcccacaatggatgtggtggaaatggtattggtaggtcgagttaataaagaaattgtctctctaattaaccaagctggcggcttggcagtagggctttgtggtaaagatggtaacttaattactgcccgtccccaaggtcaagagggcattggttttgtcggggaagtaagtaacgttaacatcaaaattttggaaactttagccagtaacggctatattcccgttgtttccagcgttgccgccgatgactcaggacaggcttataatattaacgccgatactgtggctggtgaaattgctgccgccttaggggcggaaaaactgattttattaacggataccagaggtattttaaaagattatcaagaccctggaacattgattcccaaagtagatattcgggaagcccgcgaattaattaatagtggtgttgttagcggtgggatgatccccaaggttacttgttgtgtgcgatcgctcgctcaaggagtcagagccgcacacatcatagacggtcgtattccccacgccttactactggaaatttttactgatgtgggtattgggacaatgattctcggttctcagtat

SEQ ID NO: 42573 - DNA, 1827 bp, Anabaena PCC7120
aataaaagatggagaaatgcggggctgtacgcgctgctatttattgttgtaattgcgcttggcacagctttttttgaaaaacaaccccaaagtcgggaatcatggcgctatagccagtttattcaagaagttgaaaaaggcagagtagaaagagttagtttgagtgcagaccgttctacggcactggttacacccaaatatgaccctagtaaaaaacttgttactttagtcaacgatccagaattaattaatactctgactgcaagaggcgttgatattactgttttgccacaaaccgatgaaggattttggttcaaggctttaagcagcttatttttccctgtattgcttttggtgggcttattcttcttactccgtcgcgctcaaagtggccctggtagccaagccatgaactttggcaaatccaaagccagagtgcaaatggagccacaaacccaagttacctttggtgatgttgcggggattgaccaagcaaaattagaactaaacgaagtcgtagactttcttaaaaatgccgatcgctttactgctgtcggtgcgaaaattcctaaaggtgtattgttagtagggcctccaggtacaggtaaaaccctcctagcccgtgcagtagccggggaagctggcgtacctttcttctccatctctggttctgagtttgtggaaatgttcgttggtgtgggtgcgtcccgcgtccgcgatttatttgaacaagctaagtctaatgctccttgtatcgtcttcatcgatgaaatcgacgctgttggtcgtcaacggggtgctggtttaggtggtggtaacgatgaacgagaacaaactctcaaccagttactcaccgaaatggatggttttgaaggtaataccggcatcattattattgctgctactaaccgtcccgatgtacttgatgccgccttgttgcgtcccggtcgttttgaccgtcaagtcgtcgttgaccgtcccgactacgctggacgtagcgaaattctcaaagtccacgcccgtggtaaaaccttggctaaggatgtggacttggataaaatcgctcgtcgtacccccggatttacaggtgcagatttatccaacctgctgaacgaagctgctatcttagccgcacggcgcaacctgaccgaaatttcgatggacgaaatcaacgacgcaattgaccgcgtgttggctgggccagagaagaaagaccgggtaatgagcgaaaaacgcaaagttttggtagcttatcacgaagctggtcacgctttagttggtgcattgatgcccgactatgacccagtacaaaaaatcagcattattcctcgcggacgtgccggtggtttgacttggttcacccccagcgaagaccgcatggatacaggcttgtacagccgtgcttatctggaaaatcagatggccgtagctttgggtggtcgcatcgctgaagaaatcatctttggtgaagaagaagtaaccacaggtgcttccaatgacttacagcaagtagcccgtgtagcgcgtcagatgattacccgatttggcatgagcgataaactcggccctgtcgcccttggtcgtcagcaaggcaatatgttcctcggtcgtgacatcatgtcagagcgcgatttctcggaagaaacagcagctgctattgatgaagaagttcacaaattagtagaaacagcttacacccgtgctaaagaagtgttggtaaataaccgccacatcctcgaccaaatcgcgcaaatgctggttgataaagaaaccgtagatgccgatgagttgcaagaaattttggcaaataacgacgtgaaaaccgcc

SEQ ID NO: 42574 - DNA, 2184 bp, Anabaena PCC7120
tctcctgctttgcaacaaccgcttacgcctccagaacaaactccccaaagtcctacacctgtaaccctgagttatccttttgttagcagttggaatacgggtgcggcttgtttaacaatggcagcccaacacctggaaaatgcggtgaatttggaatgggtacaacgccaactgcgggggcaaagtcctaaacaagtggtagaagccggagaaaaactaggcttcgtactgcgaagattgcagatgacttgggctgagttgcgtcagctgactttcccagctttgttgctgttacaagccgagtccacgcctgatccttcttgggtgatagcttatggagtcaaaggcgatcgcttaattattgctaatcccttaaatcctgataatctttgtgagagtctaccacaatcagtggtggaacaatgctgggatggtcagttgtggcaagtagaactgatatccaaacaagaaaaatttaacctgagttggttcaccccagccgtttggaaatatcgcaaactcttagcagaagtattattagcgtcttttaccttgcaactattgggtttaggtacaccactaattacccaagttgtgattgataaggtcatggtacaggagagtttaccaactctcgatgtcatggcgatcgcacttttgttaatcgctgtgtttgaatcgatattgggtattctgcggttatttatctttactcatacagccagacgtttagatttaagcttatcagcacaattatttcgtcatttgatgcgcctacccttggcttattttgagtccaggcgtgtaggcgacaccgtagccagggttcaggaactagaacaaattcgtcagtttctcacaggcacagcactaacggtaattttagatagcatctttgccgtcgtgtatttggcattgatgttttattacaatattcctctcacttttgtggcgttagcggtgctgcccttatttgccacactgactatagttgctacaccaattttacgtaactggctaaacgaaacctttaaccgcagtgccgacagccaatcatttttagtagaaacagttacaggtattcattctgtcaaagctcatgcagctgaatcagtagcacgcgatcgctgggaaggattatttgctcgtttcgtgcgtactggtttcaaagcctctaccacatccaacattagcagtaatattggcgactttctcacaaacttttcctctttactaattctgtggtttggggcaaaattagtcattgaccaaaaactaacaattggtcaattggtcgcctttcaaatgctttctggtagggtgacagggccacttttacgcctagtacagttgtggcaaaatctgcaacaagtcctactttccgtagaccggattggggatattctcaacgtcgccccagaagcagagatgggaactggtttagttttaccacccctgaaaggtcaagttagttttgagcaaatatttttccgctacaaaaccaatacagaacccgtactgcgtgggatttcctttaatgtagaaccaggacagtttgtgggaattgttgggcgtagtggttctgggaaaagtaccctgtctaagttgctacaaaggctttatcaaattgaatcaggacggattctgattgatggttttgatatcaaaagtgcagatttgtcctccctgagacaacaaattggcgtagttcttcaagaagacttcttatttaacggttccatcttggaaaatatcacattggggaatcctgatattaccgccgagcaggtagtggaagctgctagattagctgtagcccatgattttatcagtcaattgccctacggttacgaaacgaacgtaggagagaggggtacagctttatcgggtggacaaagacaacgcattgctttagccaggttgtttctctccgactcgccgattctcgtgttggatgaagccaccagcgctttagacagtgaaaccgaacagcaagtgttacaaaatctgcaaaagatttctgctaaccgcactgtgtttctgattgctcaccgctttgcacccctaaaacgagcagatttgattctcgtgttagaaaaaggcgtgattgcagaacggggaacccatccagagcttttacaacaaaaaggcttgtattggtcactgtaccaacgtcaacaagca

SEQ ID NO: 42575 - DNA, 927 bp, Anabaena PCC7120
atgattgaagttgaacatctaagtaaaacctacggttccaccccagcaattactgatgtgacttttagtgtcgaacctggggagattttggggtttttggggccgaatggggcggggaagacgacaacgatgcgaattttggctggttatttacctgcaagtagtgggacagctaaaattgctggttttgatgtccatgacaattctttggcggtgcgtcaacgcattggttatttaccagaaaccccgccgttatatacagatatgacggtggagggatttctgcattttgtggcgcgaattaaaggggtgtccgcaggcgatcgctctctcaaggtaaacgcagcgatcaaacgttgtaatctggaggataggcgtaaagtaattatccgcaaattatctaaaggatatcgtcaaagggtgggtattgctcaggcgatcgtccatgacccaccagcaattatcctcgatgaaccaacggtgggactcgaccccagacaaatcatcgatgtacggaatttaattaaaagcctcgcgggaacccacacagtaattctctctactcacattctcccagaggcgagcatgacctgtaaccgtgttgccattatcaatcgcggtaaggtggtagctacaaacacaccagaacatttgatgacccagttgacaggtggatcaggttatgaaattgaagttgagggggaaatcacactagccaagcaggtattacaaaaagtgcctggggtgagcttggtagaatctattcctggtcatcatcttcccagagagaaccgtgcatacttgcgtgtactctcaaaaccgggaagcgaagccggcaaagatatcgccacaagtttaatcagttcgggatttggtttgtatgaaatgcgccgtgtcagcgctaccctagaagatgtcttcttgcaa

SEQ ID NO: 42576 - DNA, 867 bp, Anabaena PCC7120
acacttaagctacgcggtatgagttgcgcttcctgcgctaaaagtattgaagatactatcagttctgtcccaggtgtaaatgaatgtagtgtgaactttggggcagaacaagcaacagttaattatgaccccagaaaaacagatttacaagccatccaaaatgcggtggatgccgcaggttattctgcatctcccctccaagaacaaaacttgatggcaggagaagatgatgaagaaaaaagatatcgcctgcaagaatcccgtgatttgatgcgaaagctcacagtagggggcatcataggcatcgtgctggtgattggctcactaccaatgatgacagggttagacttacctttgattcccatatggctgcataacccttggctgcaattagtcctgaccactcctgtacagttttggtgtggttactccttctacatcaacacttggaaagctttccagcgccatgcggccacaatggataccctaattactttaggtacgagtgcagcatatttctattctttatttgcaactttatttcctagttttttcatcgcccagggattgatgccagatgtgtattatgaaactgcggcaattgtaattaccttgattttgttggggcggctatttgagaatcgcgccaaaggacaaacctcagaagctattcgcaagctgatcggtttacaagtgaaaacagccaggttgattcgcaacgggcgagaagtagatgtaccgattgaggaagtagaaattggtgatgtggtgctggttcgtcctggggaaaaaattcctgttgatggggaagtagttgacgggacatccacagttgatgaagcgatggtaactggggaaagtataccg

SEQ ID NO: 42577 - DNA, 2163 bp, Anabaena PCC7120
gaagcggccgaatgtggagcagcttccctagcgattattcttgcctactatgatagcattgtccccttagccgaactccgcattgagtgcggagtttcccgtgatgggagcaaagcctctaatatcattcttgctgctcgacgctatggaatggttgcagacggctttaaagcagaacacctagaacaactccaagacttaactcccccctacatcgttttttggaacttcaatcattttctggtagtggaaggattgagcaaacattgggtgttcctcaatgaccccgctactggtccccgcagggtttcctgggaggaatttgacgaaagttttacaggggttgtcctagtgatggaacctggtgccgactttaacaaaggcggtcgcaaacccagtgtcatcttaggcttgatagaccgtttgcggggttcaattggttcaattttatactgcattttcgccggatttttcttggtgttgcccggtttagcaattccggttttcagtcaggtgtttgtggatcatgttctggtggaaagtcgcactgaatggctgcgtcccctaattttagggatgattcttaccacggtgtttcaaggactgctgacactactccgactgcgctatttgagaaagttgaggattaagttggctgtgggaatgtccactcgcttcctgtggcatattctgagattacctgtgagattttatgcccaaaggtatgcaggagaagttagcaatcgcgccagtttgaataataaggtggctgaggtgctttccgggcaattggcaactacagttattgatgtagttatgatcttgttctacgccctagtgatgtttgcctatgattgggtattaacgttaattgggatctgttttactgcgatcaatgggttagccttgcaatgggttgctagacatcgcgtagatgcaaatatacgtttgatacaggattggggaaaagcaactgcggtgagtattgcagcgattcagagtatcgaaacgttgaaagcatcagctttagagtcggatttcttttcccgatggtctggatattatgccaaagctgttagcgcacagcaagatttagaagtcacaaatcaaatattagggattttgcccatactgctggcctctttaacttcgatgttaattttagtcgttggaggttggcgggtaatggatgggaatctcagcattgggatgttggtggcatttcaaagcttgatgctgagttttcagcagcctgtcaacactttagtagatttcggtactactctccaggaattagaaggggatttaaatcgcttagatgatgtgttaagcaattcccttgatccagaggtggagatggtaagcagggaagcaggggagcagagggagcaggggagagggggagatgaggagaaatccaaaatcgaaaatccaaaatcgaaaatccaaaatttgcaaggttatgtggagttacgaaatatcacttttggttactctcatattgacccgccattgattgaggacttcagtttatcgttgcaaccaggacaaagagtagcgttggttggtgcaagtggttcggggaaatcaaccttggctaaattaatctgtggactttatcaacattgggaaggagaaattcttttcgacgggattaaaagaagcgaaattccgcgtcatgtgttggcgagttgtctgtcgctggtagagcaggatatctttttatttggggggacggtgcgggataacctaacgttatgggatgctacagttccagatgagcagcttgtacaagcttgtcaagatgcagctatccatgaagcggtaatggcaattccggggggatatgatggggaattgttggagggaggggctaatttaagtgggggacagcgccagaggctagaaattgcccgtgcgttggtaaaaaatccagctattttagtaatggatgaggcgacatctgcgttggatgcccagacagaacaaattattatggaaaatctgcgacggcgcaactgtagttgcatactagtagcgcaccgtttgagtacgattcgcgattgtgatgagattattgttttagaacaggggaaggtggtgcaacgcgggactcacgatgagttatggcaagaaggaggagtttatgagcggttaattcgt

SEQ ID NO: 42578 - DNA, 609 bp, Anabaena PCC7120
gatacggtatttgtaggcagtaatgcttccgtctctactggcaatggtaacgatcaagtcttcattggtgtggatagtcccgccagcaatactacagctaatggtggtcatggtgacgacgaaatcaccgtgattgaagcaggtggaagtaataacctttttggcgcagcaggtaatgatactctgcaagtcattgaaggttctcgtcaattcgcctttggtggttctggtaacgacaccctcacaagtaacggtagttataaccgtctcaacggtggttcaggagatgacaaattattctccagtgtgaatgactctttgtttggtggtgatggtgatgatgtgctatttgcgggtcaagctggtagtaaccgcctcactggtggcgctggtgctgaccagttctggattgctaatggtagtttaccaactagtaagaatactgtgacggacttcgctgtcggtgttgacaaaattggactgggtggagttggtgtgacacaatttagtgctttaagtctggtacagcaaggcgctgatactttggtgaagctaggcgcgactgatttagtgatattacaaggaattacttcaactagtctgactgtg

SEQ ID NO: 42579 - DNA, 1300 bp, Anabaena PCC7120
  unsure (1)..(1300): unsure at all n locations
gttatgcaagcagaatatcggcagcgtcgtgagcaattaatggcgaagattggtagtggtacagggatttttcgcagtgcgccgatggcggtgatgcacaacgatgtcgaatacacttatcgccaagatagtgattttttctatttgacaggttttaacgaaccgcaagcagtagcagtattaacgccccatcatccagaacatcggtttatattatttgtccaacccaaggatcgagaaaaagaagtttggactggttatctgtgtggggtagatgcagccaaggaaatttatggtgcagatgaggcttaccccatatctgagttagatgagaaattgccccaatatctagaaaaagccgaacgcatctactatcatttaggacgcgatcgcaattttaatgacaaaattctcggccattaccaacaattactgcggacttatcctaaacggggtacagggcctataggaatagaagatacaggccccatcctgcacagcatgagactaatcaaaagtgaatcagagttggttcagatgcgtcaagctgcggcgatcgccacagaatcccataataaagccctagaatcctctgcaccagggctttatgagtacgaaattcaagcagaaatagaacatatatttcgcctgcggggtgcaatggggcctgcttacccgtcaattgtggcttctggtgcaaatgcttgtgtcctccactacatcgaaaataaccgtcagatgcaggatggagacttgctattaattgacgctggttgtgcctatggttattacaactcagatattacccgcacatttccagtcaacggcaagtttacaccagaacaaaaaatcctctatgaaattgtactagaagcgcaaaaacaagcgatcgctcaagtccaaccagggaactcatttaaatcagtccacgataccgccgtgcgcgtcctcacagaaggcttggtagaaattggtatcctcaagggtgagggttgacaaattaattgaagaagaaaaatataaaccttactatatgcaccgtactagccattggttaggattggatgtccatgatgtnaggcgttaccaacacggtgacgataaaccgcagattttacaaccaggtcaagtattgacggtggaaacccagactatatatggcccagattcaaaattagccgaagaccaaccagaaacagacccggtctgggtggggattggattgcattgagggatgatgtttggtaacagctacaggacatgagtttaaactggtgaagtnccgaagaagcatgaaata

SEQ ID NO: 42580 - DNA, 1741 bp, Anabaena PCC7120
tggtagtgacgaccagacagtacggctatgggatatcagcagtggtcaatgccttaagacatttaagggtcacaccagtagagtacgttctgtagtgttcagtccaaatagtttaatgctggccagtggtagttctgaccagacagtgcgactatgggatatcagcagtggtgaatgcctttatatctttcaaggtcacactggctgggtatattctgtggccttcaatttagatgggtcaatgcttgctactggtagtggtgaccaaacagtacgtttatgggatatcagcagtagccaatgcttttacatttttcagggacataccagttgcgtacgttccgtagtatttagttcagatggagcaatgcttgccagtggtagtgacgaccagacagtacggctatgggatatcagtagtggcaactgcctttacactttgcagggacacactagttgcgtacgttcagtagtatttagcccagatggagcgatgcttgccagtggtggtgacgaccagatcgtgcgcttatgggatatcagcagtggcaactgcctttacactttacagggatacaccagttgggtacgttttttagtcttcagtccaaatggggtgacgcttgccaatggtagttctgaccaaatagtgcgattatgggatattagcagtaagaaatgcctttataccttacaaggtcacactaattgggtaaatgccgtcgccttcagcccagatggggcgactcttgcgagtggtagtggtgaccaaacagtgcggctatgggatatcagcagtagcaagtgcctttacatcttgcagggtcacacaagttgggtaaattctgtcgtcttcaatccagatggatcaacgcttgcaagtggcagttctgaccaaacagtgcggctatgggagatcaacagtagcaaatgcctttgcaccttccagggtcacacaagttgggtaaattccgtcgtctttaatccagatgggtcaatgcttgctagtgggagttctgataaaacagtgcggctatgggatatcagcagtagcaaatgccttcacaccttccagggacacaccaattgggtaaattccgtcgcctttaatccagatgggtcaatgcttgctagtggtagtggtgaccaaacagtgcggttatgggagattagcagtagcaaatgccttcacaccttccagggacataccagttgggtgagttctgtaaccttcagtccagatggaacaatgcttgccagtggtagtgacgaccagacagtacggctatggagtatcagtagtggtgaatgtctttatactttcttgggacatactaattgggtaggttccgtcatctttagtccagatggagcaatacttgccagtggtagtggtgaccaaacagtgcgcctatggagtatcagcagtgggaaatgcctctacaccttgcagggtcacaataattgggtaggctccattgtctttagtccagatggaacattacttgccagtggtagtgacgaccaaacagtgcggctatggaatattagcagtggagaatgcctctacactttgcatggacacatcaattcggtacgttctgtagcttttagttcagatgggttaatccttgctagcggtagcgatgatgagacaattaagctttgggatgttaagacgggtgagtgtataaaaactttgaaaagtgaaaaaatttatgagggtatgaatattacttcc

SEQ ID NO: 42581 - DNA, 1425 bp, Anabaena PCC7120
caagcttttgaacaggcacaactgaaaaagtctaaagaggcggctgatttagctaaccatgccaaaagcgaatttttagctaacatgagtcatgaactgagaacgcctttaaatgggattttgggttgcgcgcaaattttgcaacgttcttccacgttacctgagcaagaacaacatcacatcaatattattgaacaatgtggttcccatctgctgaccttaattaatgacatcttggatcttgccaaaattgaagccaagaaactagaactacatggcgaagatgtgcattttccgtcttttatacaaggtattgccgaaatttgccaaattcgtgctgcacaaaaagatattttgtttgtctatgaacctgccagtaatttacctatatggctgcatattgatgccaaaaggttacgtcaagtgctgttaaatctgctaggtaatgcgattaaatttactgatcacggtcaagttaagttgaaagttgagacaattgaggaatcctctacgcaaaaaccagtcaaacaccgtattcgttactgtatagaagatacaggcattggcatcactgacgcagaattaagcaaaattttcttaccttttgaacaggtaggtgaaaaaaagcgtcagacggaagggacgggactgggtttagctattactcgtcagttagtgcagatgatggggagtgatatccatgtcacaagtcaagtaggacatggtagcaccttttggtttgaattggagatggtagctaccaatgaatgggtacagtcaatgatgactacctcagccagaaaaatcattggttttgagggaaatccccgcagaattttgatagtagacgatcgctgggaaaatcgtacagtcttgaatgatttattgcaaccattgggttttgaaataatggaagctgtcaatggtcaagatggtttagaacaagcgatcgctatttcaacagacctaattatcacagatttactcatgccagaaatggatgggtttacattaattcaaaatctgcgacaaataccccagtttaagaatctcaaaattattgtttcttccgctagtgtttttgaatctgatcaacatcgcagcttggcagttggtggtgatgactttctcagtaaacccatacaggcaaatgaattattgcgtcaattagaacgtcatttaaatttagtctggatttatcaaccttctgagtctgaaactcaagcaatttcagatgtagtaactcaaaacaatgatccatcaacacaattaattactcctccaccagaagtattacgagaactgttgacattagcgaaaaagggtaactttaacgccattatcaaatgtgcagatcaactagaggcagaagatacaaacttggctactttcgctcatcaacttagacaattagccagacaattt

SEQ ID NO: 42582 - DNA, 963 bp, Anabaena PCC7120
cccaaggattcacggcagcgatcgcagcaattcatgcagaacttacaggatgagatttgcacagccttagagcaacttgacgggaaagcaagctttcaccaagaccactgggagcgagcagaagggggagaaggacgtacccgcgtgattcgagaagggcgggtgtttgaacaaggtggcgtgaacttttccgccgtgtggggaaatagcctacctgcttcaattttggcgcaacgtccagaagcagccggacatgagttttttgccacaggaacttcaatggtgttgcatccccgaaatccctacgtaccaacagtacatctcaactatcgctactttgaagctggccctatttggtggtttggtggtggggctgatttaaccccatattatgcctttaaagaggatgcggttcactttcatcagacgctcaaaaatgcctgtgatgtccataatccagaatattatccaacctttaaacgctggtgtgatgaatacttctatttacgacatcgggaagaacagcgaggtattggtggtattttcttcgactatcaagatgctagcggtaagctttacgttgaaagtcaaacagatagttcagtcgcaatttacagccagaaagtgggaaatgtagcgcggaattgggaagatatctttgcgtttgtgcagtcttgcggtcaggctttcttacctgcttacttgcctattgtagaacgcaggcaaggaattgagtatggcgatcgccagcgtaattttcaactttaccgtcggggtcgttacgttgagtttaatttagtttacgaccgaggaactgtatttggtttgcaaactaagggacggacagaatcgattctcatgtctttaccacccttagcacgttgggaatattgctacgaaccggaagcaggaagcccggaagcagaactgacggaagtttttctccagcctagagattgggtt

SEQ ID NO: 42583 - DNA, 840 bp, Anabaena PCC7120
tcccaatatgatggcattgttatcgatggacattttattccctgtgtatcagtcagaaacccagcagaattaccttggggaaaattaggtgctgattacgtcgtataatcgactggattatttactgattctgagggcgcatctaagcatctacaagcaggggcgaggcgcgtcataatttccgcacctaccaaagacccggatagagtgcggacgctgttggttggggtgaaccatgatttatttgaccccagcaaagatttaattgtctccaatgctagctgtaccactaactgcctagcacccattgctaaggtaatcaacgacaactttggtttaaccgaagggttaatgaccacagttcatgccatgactgctacccaacccacggtagacggccccagcaaaaaagactggcgcggtggtagaggtgcagcccaaaatattattccctcttccacaggtgcagccaaagcagtggcgttggttttaccagagttgaaaggtaagttaactggtatggctttccgcgttcctaccccagatgtttccgttgtagatttaacattcaaaactgccaaagccaccagctacaaagaaatttgtgcagcgatgaagcaagcatctgaaggttcactagctggtattcttggttacaccgacgaagaagtagtttccacagattttcagggtgatactcattccagcatcttcgacgcaggcgcggggatcgagctaaactccaacttcttcaaggtagtagcttggtatgacaacgagtggggctactctaatcgtgtagttgacctgatgttgtcaatggtacaaaaagaacaactg

SEQ ID NO: 42584 - DNA, 1455 bp, Anabaena PCC7120
cgtcgaactaaaattatctgtactgtaggcccggctacatctgcaccagaacgtttagaagcgttggtagaagctgggatgaatgtagcacggctgaatttttctcatggagcttatgacttccatgcccaaactgctcagtatttgcggcaaatcagtgctgacagacaaaagcctgtggcgattatgcaagacctatgcgggccgaagattcgcttgggaactttaccaccagaagggttaatggtagaggctggtcaggaagtgacttttgtcttgcaagaaaagggtagtagtcttgatgaattgcctttacctttgccgaccttgttcgcaatggtacgacctggggaaccaatcttaattaatgatggtcgtgtcaagttgattgtgacagatcgcgatgccgatcgcattcgggctattgccaaaatcgggggtcttctttctacccgtaagggtgttaacctgccagcgactcgtttacctgtcagttccatcaccgaaaaggacttgcaggatttgcgttttggcatcgatttgagtgtagattgggtggcggtgtcttttgtgcgatcgccttatgacctcgaaccagcgcaacggatgattgaagcggcggggaaaactattcgggtaatcgccaaaattgaacgtccagaagccgttgagcaaattgattctatcatcgacgttgctgatgcgattatgattgctcgtggtgacttgggtgtggaaatgcctatccatgaagtcccattgattcaaaaggacatcattcgccgttgcaaccaagctggtaagcccgtgattacagcaacgcaaatgctagagtcgatgattagcgctcccgatcccacccgtgcggaggctacagacgttgctaactctattctcgatggtacagatgccgtcatgctctctggggaaacggctgtaggacaatatcccgtcgccgccgtccaggttatgcacgatatcgccgtgactacagaaaagtctttgcaagagggtagtaaacattgcttatcccatgaagcaggtggtctgagtgtcaccgaatctgtagctgaagcggtctgtcgtatcgcctacgaaacaggcgcaaaagcgattctttgcaacaccacatcagggagtacagcaaagctcgtgtcgaaatatcgtccgactacacccatttttgcgttgacccccgacgaaaccgcctaccatcagttagcactttcttggggtgtggaacctttattaaccccaccagtccacaatgcggaagaaatgtttatgaatctcatcaacaccgccgtgagaacgggtttggtgcatgacggtgacaaggtagttattacttctggagtgccaattggtaaatcaggcacaactagtttaattaaagtgcattctattggacaaccaatcaccgcctaatattcctagaataagtctgaggctttt

SEQ ID NO: 42585 - DNA, 996 bp, Anabaena PCC7120
atgactaaaaatctactagaacaattgcgagaaatgactgtagtagttgctgatacaggtgatattcaagcaattgaaaagtttacaccccgcgacgcgaccaccaatccctctctgattacggcagccgctaaaatgccagaatatcaggaaattgttgatcaaaccttactccaagctaaaaaagacgcaggcgcaggggctagcaaaggtcaaattgtctccctcgctttcgaccgtctggcggtatcctttggattaaagattttacaaattatccctggtcgcgtttctacagaagtagatgcccgcttgtcttacgatactgaagctactatcaccaaagcacgggaattaatcgctcaatataaagcggctggtattggcccagaacgggttttgattaaaattgcctctacttgggaaggtatcaaggctgcggaaattctggaaaaagagggtattcattgtaacttgacattgttgtttggattgcatcaggcgatcgcttgtgccgaagccggtatcaccttaatttctcccttcgttggtcggattctcgactggtacaaaaaagaaaccggacgtgatagctacccttctgcggaagacccaggtgtattatcagttactacaatttacaactactacaagaagtttggctataagaccgaagttatgggagctagtttccgtaacattggtgaaattactgaactagcaggtagcgatttactaacgatttcccctggtttattaggtgaactacaagccaccattggtgaactaccccgtaaactcgacccagctaaagcagcaactttggatatagacaagatttccatcgataaagctacatttgacaaaatgcacgctgccgatcgcatggcttatgacaaactagatgaaggtatcaaaggttttaccaaagcactagaagagttagaaacactactagcagaaagactagctcgtctagaagtagtagcaagtcac

SEQ ID NO: 42586 - DNA, 834 bp, Anabaena PCC7120
atgacaaatcaagctcctatcccagttattgtcaatggtgctgctggcaaaatgggacgtgaagtagtcaaagcagtagcccaagcaccagacttaaacttattgggtgcaattgacagcagtccagaacatcaaggtaaagatgcaggagaattagcggggttaagtgaacctctggaagttcccatcacaaaccaactagaaccaatgctgggttatgtcgctggagaaagacaggggccgccaggggtaatagtagactttactcatcctgactcagtttatgataatgtacgcagtgcgatcgcctacggtattcgtccggttgttggtacgacaggattaagcccagcacaaatccaaaatttagctgattttgccgaaaaagccagcactggctgtctgattattcctaacttctccataggtatggtgttgctacaacaagcagccgtcaccgcatcacaatattttgaccacgtagaaatcatcgaactgcaccacaatcaaaaagccgatgcacccagtggtacagctattcaaaccgccgagttactagcagaattgggtaaaacttttaactctgctattgtggaagagacggaaaaaatacccggagctagaggtagtttagctgaggaaggaattagaattcatagcgtccgcttacccggactgatagcccatcaagaagtaatttttggcgcaccaggacaaatttatacattacgccatgatacaagcgatcgcgcctgctatatgcctggagttttacttgcgattcgcaaagtcttacagctaaagtcgttagtatatggtttagaaaagatcctt

SEQ ID NO: 42587 - DNA, 1032 bp, Anabaena PCC7120
atttctggtttagtcgcagcgtatgaattaacagccgttggtcatgatgtcacccttttagaagcaagcaaacgtataggtggtagagtgttaaccctgcgaggagcctttcaaggagaggatttattagaacttggagcggctagaataccatcaaatcatcatttaacctttggttatatcaaacattttggtttaaaactttcacaatttgcgccggcagacgggaaatacctgaccatcaaagacggaaagcgtctgttaattccagcgaaagtactatttcaaaatcaaccacaaatccgtccccaagagattcaaaaactgacggatggatttgatttacttcctaaagcatttgcccaagcattgacaaaagaaattaaacttgatgagcctgttgctcggattgtacaaacctctaatggagttgaagtgtcgtgcttatcagggcaacgatatcttggtgattatgtgttatgcactgtcccattaaccgttttaaaccagattactttctcacctgaactatctgaggaaaaaaaacaggcggcggctggaggatataactatcgagcagcaactcgtggatttgtaaaatttcctaaccgattctgggaaagagaaaacttaaatggttggggatttttcgacgatgaagaactgtggcatactacttgggacagacctgaaaaaactggcattcttcatgcttatctcaaaggagaaaaaggtctggagatcgatggctttgaagggaaaactcagcagcaaaaattgctccagcattgggagaagattctgcctggggtaagtaattactctgtgcgctcatattttcattcctggacaaaagatatttggtcaaaaggaggctgggcttatcctacagatgaacaggaaaagaaactatttcccgaattaggtaagtcagaaggaaaaatttatttcgctggagaacatacttccaaaactagaggctggcttcagggagcattagaatctggacttaaggcggctcaagaaattcac

SEQ ID NO: 42588 - DNA, 999 bp, Anabaena PCC7120
aaacaaacttggagtcagcgatttgaatctgctctacatccagcgatcgctctttttaatgccagtataagttttgacatagaattaatagaatacgaccttacaggctctcaagctcatgcccagatgttggcgcatacggggattatttcgccggcagaaggagaacaactagttgcaggtttagaacaaattcgtgaagaatatcgccagggcaaatttcaacctggtatcgatgcggaagatgtccactttgcagttgagcgacggttaacagaaattgttggagatgtaggtaagaaattacatactgcgcgatcgcgtaatgatcaagtcggtacggatacaagactttacctacgtgaccaaattttacaaatcaaaacccaattacgggaatttcaacgggtcttattagatatagctgaaaaaaacgtggaaactctaattcctggttacactcacctacaacgcgcccagcctgtgagtttagctcatcacttgttggcttacttccaaatggcacaacgggactgggaacgcttaggggatgtttatcgccgggtgaatatttcgcctttggggtgtggtgctttagctggtacgacttttcccattgaccgccactacacagccgaattgttgcagtttgagcgtatttacgagaatagcttggatggagtgagcgatcgcgattttgccattgaatttttgtgtgcggctagtctgattatggttcacctcagccgtctttctgaagaaattattctttgggcatcggaagaatttcgcttcgtcatcctcaaagatagttgtgcaacaggttccagcattatgccccaaaagaaaaaccccgacgtaccggaattagtcaggggaaaaactgggcgtgtatttggtcatctccaagcaatgttggtaatcatgaaaggattacccttggcatataacaaagtcctgcaagaagccaaagaaggtttgtttgacaacgttaagaca

SEQ ID NO: 42589 - DNA, 1596 bp, Anabaena PCC7120
atgattttggctgctgatgcttggccgattccccccatatacaggatatctctactaattttgttgagtacctggatgcgtgctaccttcaattattttggcggagtatacactgaatcagcccaacttaatttagcagatcgcttacataagcaaatttttgagcaattacaagctctgaggttgagttactttgctcaaactcgttcgggtgaactcattaatacgattactacagaaattgaaagaatcaaacagggttttagtgggttagcttttgtgttaaccagaatcatgaccgtttgcgtttactttgttgtgatgttttctatatcatggcaactttcgattatttctgtgctgatatttttactgttagcagtgggattatctacgctgaataagcgagtcagagaaactagctttggcatttctcatgctaatgctcaatttacggctgtagctgtagagttcatcaatgggattcggacaattcaagcttttgggacacaagaatttgaacggcaacgtttctataaagcgagtactaatcaactgaatgcagctatcaaagttgttttagcttggacactagtaaaacctatagctgaaggtatagctactacggttttaattagtttgattgtgatttccttcgcgacttttacattaccagttgcctcattattgacattcttctttgttttagtcagggtgattcctaatattcaagatattaatggtacggttgcttttctgagtactttacaagggtcatcagaaaacattaaaaatattttgcagacgaataataaaccttacttgaaaaatggcaaacttcatttccaagggttgaagcgttcaattgatttagtatccgtagattttggttatactgctgataatttagtgttgaataatatcactctgacaattgagcgtggtaaaacaacagctctggtgggtgcatcgggcgctggtaaaaccacattagctgatttaattccccgattttacgatccgacagagggacagattttagtagatgggcttgatgtacagtactttgaaatcaattccctccgccgcaaaatggctgtagttagtcaagatacatttattttcaacacttctattagagacaatatcgcctacggtacatctggggcgagtgaagcggaaattagagaagtagcgcggctagcaaatgcgttgcaatttatcgaagaaatgcccgaagggtttgatactaagttaggcgatcgcggtgtccgtttatctggaggacagagacaacggattgcgatcgctcgtgcattactccgagatcccgaaatcctcattcttgacgaagccaccagcgccctagattcagtctccgagcgattaattcaggagtctatagaaaaactttccgtgggtagaacagtaattgcgatcgctcacagactctccacaattgccaaagcagataaggttgtggtgatggaacaagggcgaattgttgagcagggaaattatcaagaacttctagaacaacgcggaaagctctggaaatatcaccagatgcaacacgaatcaggacagactaattcg

SEQ ID NO: 42590 - DNA, 1245 bp, Anabaena PCC7120
ggcgatcaaatgtccaacctgactggtgtacgagcgattatgaaggacattatcgaaacgttgaagtctggtggagggcaggatttaattaatttgagtgcggggaacccgttgattttgccagaggtagaacagttatggcgggactgcacagcagaactcttagcaagtcaagaatatggtgaagtagtttgtcgctatggttctagtcaaggctatgcgccattaattgaagcggttgtgaaagattttaaccgtcgctatggtctgaatttaaccgatcgcaacatcttaatcactccgggtagtcaaactctgtacttttatgctgctaatgttttcggcggttacaccagtagcggcgacctcaagcaaattgttttacccctgagtcccgattacactggctacggtggtatttgtctagttcccgaagctttagttgcttacaaaccttctctagatattgatgcagcagcacacagctttaaatatcgccccgattttagccaagtgtctatttccgaaagcaccggctgcgtcattttctcccgcccctgtaaccctacaggcaacgtcctcacagatgacgaagtgagaaaaattgccgcccttgccgcaccttataatgtgccagtgctgattgattcggcttacgctcccccattcccggcgttgaacttcacggatatgtcgctgatttttggggaaaatattcttcattgcaccagcttatcgaaagcgggtttaccaggggagagaattggtattgctatcggtaatgaaagattaattcaagtcctagaatctttccagactaatgctagtttacattcctcacgctatgggcaggcgatcgccgctcgtgccattaactctggtgcgttggcacaaatcgcggaacaagttatccgtcccttctacaaaaacaaattcgccatcgtcgagaatgccttagaagcagccatgcccaaagaattaccttggttcctccatcgtggtgaaggtgctatctttagttggctatggttacaagatttgcccatcacagattgggaattataccaagaactcaaaaaagttggggtaattgtcgtccctggtagtacattcttccctggcttaaaagaagaatgggcgcacaaacaccaatgtgtccgcatcagcttgactggtagcgatactgaaatcgcccttggtatgcagcgtctagcaaaagcagtcgaacaaatttaccagcgtaca

SEQ ID NO: 42591 - DNA, 1107 bp, Anabaena PCC7120
gtggaagtgaaagcagcaatagcttacggcgcgggtaagccgttgacaattgaaaccgttcaactagaggggccaaaagctggggaagtattggttgaagttaaagccagtggcgtttgccataccgatgcttacaccctttcaggaaatgatcccgaaggtttgttccccgccattttaggacatgagggtgcgggggtagtagtagatgtgggcgctggtgttaccagtgtcaaaccaggggatcatgtgattcctctctacaccccagaatgtcgccaatgtgcctattgtttaagctttaagactaatctgtgtcaagctattcgtggtactcaaggacgtggtgtgatgcccgatgggactagtcgttttagtatcaatgggcagatgattcatcactatatgggtacatctacgtttgctaactacacagtgttaccggaaattgctgtagccaaaattcgagaagatgccccatttgacaaggtttgttacattgggtgcggtgtaacgacaggtattggtgcagtcatttatacagccaaggtggaagcaggggcaaatgtcgtcgtttttggcttggggggtattggtttaaacgtcatccaaggggcgcggatggtgggtgcgaatatgattgtcggcgtagatattaatcccagcaaacgcgccttggctgaaaaatttgggatgacacattttgttaatccccaagaagttgagggtgatttagttgcttatttggtggacttaacgaaaggcggcgctgattacagttttgaatgtattggtaacgtcaatgtgatgcgccaagccttagaatgctgtcataagggttggggtgtgagtgtaattattggtgtagctggtgcaggacaagaaattagtactcgtccctttcaattagtgactgggcgtgtgtggaaaggttctgcttttggtggcgctagagggcgtacagatgtgccgaaaattgttgattggtatatggatggaaagataaatattgatgatttaattactcatgtgatgccaattgaaaaaattaatgatgctatggatttgatgcacagaggtgaatcgattcgcagtgtggtgactttt

SEQ ID NO: 42592 - DNA, 1434 bp, Anabaena PCC7120
acaattaaactgtgggatgtgtctcaaggtaaatgcttgagaacgttaaaatcacatacaggatgggtgcgttccgtagcctttagtgcagatggacaaaccttagctagtggtagcggcgatcgcacaattaaaatttggaattatcatacaggtgaatgtctgaaaacctatatcggacatactaacagcgtctattctattgcctatagtcctgatagtaaaattttagtcagtggtagtggcgatcgcacaattaaactctgggattgtcaaacccatatctgcatcaaaactctacacggacacactaatgaagtttgttccgtcgcctttagcccagatggtcaaacactagcttgtgttagtttagaccaaagcgtgaggctctggaattgtcgcactggtcaatgtttgaaagcttggtacggtaatacagattgggcattacctgtagcttttagtcctgatagacagattttagctagtggtagtaacgacaaaacagttaaactctgggattggcaaaccggcaaatacatcagcagcttagaagggcataccgattttatttatggaattgcctttagtccagacagtcaaaccctagctagtgcgagtacagattcctcagtcagattgtggaacattagcacaggtcaatgcttccagattttactcgaacatacagattgggtgtatgctgttgtgtttcatccccaaggtaaaatcatcgccaccggtagcgctgactgtacagtcaagctatggaatattagcacaggtcaatgtctcaaaaccttgagcgaacatagcgataaaatcctgggaatggcttggagtccagacgggcaacttttagctagtgctagtgctgatcaatctgtgagactatgggattgttgtacaggtcgttgtgttggcatattgcgaggacatagtaatcgcgtttactcagctatctttagccccaatggagaaattattgccacttgcagcaccgaccaaacagtgaaaatatgggattggcagcagggtaaatgcctcaaaaccttgactggacatactaactgggtatttgatattgcttttagccctgatggaaaaatcctggccagcgcatcccatgaccaaaccgtaagaatttgggatgttaacacaggaaaatgtcatcatatctgcattgggcatacacacttagtttcttctgtggcttttagtccagatggggaagtggtcgctagtggttctcaagaccaaaccgtgaggatttggaatgtaaaaactggtgaatgtttgcagattttgcgggcgaaacggctttatgagggaatgaatattactggtgtcacagggttaacaaaagctacaattttcacattacaagctcttggtgctttgagatagttaaatagtgcagcaagacttaaatgt

SEQ ID NO: 42593 - DNA, 441 bp, Anabaena PCC7120
ggtaatattttatcggctgcttttagtcccgaaggtcaacttttagcaacctgcgatactgactgtcatgtgcgtgtatgggaagtgaaaagcgggaaattattactaatttgtcgaggacatagtaattgggtgcgctttgtggtgtttagcccagatggagaaatattagcgagttgcggcgctgacgagaatgtgaaactttggagtgtccgcgatggtgtttgtataaaaacgttaactgggcatgaacatgaggtattttctgtagcgtttcatccagacggtgagactctagccagtgcaagcggtgacaagacaatcaaactctgggatattcaagatggtacttgcttgcaaacgctgacaggacatacagattgggtgcgttgcgttgcttttagtccagatggtaacactttagcgagtagtgcggctgac

SEQ ID NO: 42594 - DNA, 1818 bp, Anabaena PCC7120
aatcgtttagtaggtcatggggatgtagtcacaagagttaaatttagccccgatggagaaaaactcgccagtgccagttgggataaaaccgtgaaaatttggcagcgtgacggtaaattattgcataccttgcgtggtcatacggatgcagtgtggagcgttaattttagccctgacggcaaaatgttggtcagtgctagtcgagataaaaccgtgaaagtctggcgtgtggaggatggtcaagaaattgccaccttaactcatcaaaattgggtagcgtgtatcggatttagccctgatagtaagacagtggcatcaatggaatggaatgggacaatgagactctggaacctccaaggacaggagttaaaatctttccctacccataaagccccagttgttgctgtccatttcagccccaagggaaacatgattgctaccgctagtcgagatggtacagcaaaggtttggtctttagatggcaaagaattattgtctctgggaggccataagaattgggtaatgtatgttaatttcagtgaggatggcaaaaacctagtaacagcaagtcgagacaaaaccgcgaaaatttgggatttacaagggaaagaactagcaacactacgcggtcatagtgataccgttgctagtgcagtattcagccgcgacggtcaaactattgctactgcaagctcggataaaaccgtgcgactctggaaccgcaaaggcgaagaattgcaagttttttggggacataccgatgctgtttggggtgtcaacttaagcaaagatggaaaacttctagttagcagtggcgaagatgggacggtgagattgtggaatatggaaaacggggaagccggaaaatttcaatccctaagtttcaatcttggtgaagctgcggcaggaactattagttttagccctgatggtaaaattttgggtacaactggtcgttacacaatggcgaaactctggaatcaccaaggacaagaactagtaacacttaacggtcatagcgacaccttaagaagtctgcaattcagcccagatggacagattatcgctaccgccagccgagataaaacagtcaaactgtggaatttaaatggtaaagaaagagcaactttgcacggacatcaagcagatgtcagaagcgcaactttcagccccgacagtaaaaccatcgctagtgcaagctgggatacaacagttaaactgtggaatttgaatggtagagaaatcatgactttgcgcggacatcaagccggcgtgagaaatgttagtttcagtcctgatgaccaaattatcgctaccgcaagtgaagatggaacggctaaactctggaatcgccagggacaagaactagttaccctcaaaggacatcaagcagggatacaggctgtaagcttcagtcctgatagtcaagttatcgccacagccagtaaagataaaaccgtgaaactctggaaccgacaggggaaagagctattgactctgctgggacacagaggtgaggtgaatgctgtaagttttagcccgaatagagaaaccattgctacagccagtgaagacatgacagtcaagctgtggaaccttaaaggaggacagatgcaaaccctttcaggtcttgatgctggagttaaaagcgtgagttttagcccagatggaaaggttttggcttcctctgattccctgggtaaagtcactctctggaatttagattttgattccagtcctgagaaattgttggcgcaggcttgtaattgcgtgagggattatttactcaatagtgcagatatcaaagagcatgagagg

SEQ ID NO: 42595 - DNA, 426 bp, Anabaena PCC7120
attttggtgctgcacgggccaaacctaaatttgctgggaaaaagagaaccaggagtttatggctccacaactttggctgagattaatagcttattggcagaagcagccctcaagttacaggcaaaagtgtttcccctacagtccaatcatgaaggcgtgttagtagatgctattcatgaggcgttggggaaacatcagggaattttgattaatgcaggagcttatacccataccagcgtagctttacgagatgcgatcgctgctgtaaatttacccacagtagaagtccatctcagtaatatctatcgccgagaagatttccgccatcattcctacatcgcccccgtagttattggtcaaattagtggctttggtgtgcaaagctatttattaggattgcaggggttagtggcgcatttgaaggga

SEQ ID NO: 42596 - DNA, 1137 bp, Anabaena PCC7120
gcagataggatacagcaactaccaccttatgtatttgcccgtcttgacgagctgaaagctaaggcaagggagcaaggaattgatttaatagatttggggatggggaatcctgatggcgcgacgccacaaccagtggtagatgcggctatccaagctttgcaagaccccaaaaatcacggttaccctccctttgaaggtacagcaagtttccgccgtgccattactaactggtacaatcgccgctatggggttgtactagaccctgatagtgaagccttacccctactcggttctaaagaaggattatctcatttagcgatcgcctatgtgaaccctggcgatgtggtgctggttccttctcccgcctaccccgcccattttcgtggcccggtaatcgctgggggtacagtccacagcttaattcttaaacctgagaatgactggttaattgatttaaccgccattcctgaagaagttgccagaaaagccaaaatattatactttaactatcccagcaaccccacaggcgcaactgcaccccgtgaatttttcgaggaaattgtggcatttgcccgcaaatacgaaattctcttggtgcatgatttgtgttatgccgagttagcctttgatggctatcaacccaccagcttactagaaattcctggcgcaaaagatatcggcgtggagttccacaccttatcgaaaacctacaatatggctggttggcgtgtgggctttgttgtggggaatcgtcatgtaattcaaggcttgcggacactcaaaaccaacctggactatggcattttcgccgccttgcaaacagccgccgaaacagccttacaactaccagatatttatctgcacgaagtacaacaacgctaccgcacccgtcgggatttcctcatccaaggattaggcgagttgggctgggatgttcccaagaccaaagccaccatgtatctgtgggtgaaatgtcctgtgggtatgggttcaacggatttcgccctcaacttgttgcaacaaacaggcgttgtcgtcacccctggtaatgcctttggggttgccggggagggatatgtgcggataagcttaattgcagattgcgatcgtttaggtgaagccttagaccgaattaag

SEQ ID NO: 42597 - DNA, 1065 bp, Anabaena PCC7120
ttaatcaccctcgcggttgccccggcaaaagttatccgtggctgtaatatattgcaggtagccgccacagaaattgccaaattgggcagtcgtcctttaattgtggcaggtaatagcaccgttgctatcagccaagagaaactacagccaattttagaagcccagaatctgcacgttgcccaagcctcttatggtgcagattgtgcggaagttagcttaaaagccttgaggaaagcagccaaagaacataaagccgatacgattatcgggattggtgggggcaaagctttagatacagcaaagttagttgcccatcagttagatatacctatagtcacaattcccacatcggcagctacctgtgccgcttggacggcgctatcaaatgtatattctgaggacggggcgtttctttacgatgtggctttatctcgctgtcccgacttgctgatacttgactacgacttgatccaaactgcaccacaacatacactagtggcagggattggggatgcgatcgctaaatggtatgaagcttctgttagtagtgggcatttagaacaaactttaattatctccgcagtccaacaagcgcgagttttacgcgatattttattccaaaagtcggcaattgccttacaacaaccaggtagtgaagcttggcgggaagttgttgatgccacagttttactagctggtgtcatcggtggactcggtggggcgcagtgccgtacagtagccgcccatgcagtccataatggtttaacccacattgccggacacagtagtatccacggtgaaaaagttgcctacggtattttggtacagctgcgtctggaagaaatggtacaaggtaatcaattagcagccgcctcacgacaacaactattaaagttttatgcagagattggactgccacaaaaattaggagacttggggttgggtaatattaccttaggcgagttacaaacagccgccgaaatcgctttaacacctcaatctgacattcatcgtctaccattcaaagttgtgttggaacagttaatggcagcgatggtttctacc

SEQ ID NO: 42598 - DNA, 1991 bp, Anabaena PCC7120
aaactccggaaaatttcggaacgcttaactctcgccatcagttctggaagatttggcatctgggaatttgactgcgttcaagaaaaagtaatttgggatgagcgaatgtacgaattgtatggtgttcaccctgaggattttcccggtaattttgatgcttggttaagctttgtgcatccagatgatcaagattatctcttggtaactatccagcaagttctgcaccaaaaccaagaatatgatgcagaattccaaattattcagccgagtggagaaatccgtgtcatcaaagcttatggtgttctcaattgcgatgaacaaggtaaacctatattgatggttgggattaacatcgatatcacagaacgcaaacaagcagaacaagaactgatccacaaccgagatttgcgagaagtaatttttaatgaatctgctgatgcgttgtttctagtcgatcctgtaacattgcttaccctggattgtaaccggcggacggtagaactatttgaggcaactaacaaaggtgaattactggggattgaaggtaggacgctccagcgtcgtccctttactagtaatgaaattgatactattgtcacccaaatgcagactaaagggttttggagtcaagagattgaatatgtgactcttaaaggcaaattattttggggaaatatagctgccaaaccaattaccatagctggtcgtaccctcaacttagtccgggtgaccgacatcaacgaacgcaaacaagcagaagaaaaactgttgcggacaaatgaacagcttgccaaggccaacgccgaacttgcccgtgctacccgcctcaaagacgaatttttggcaaacatgagccacgaattgcgtaccccactcaacgccattctgggtatgtctgaaggttttattgaaggcgtgtttggtgccattaatcaaaagcaggcaaaagcgatcgctactattaaacgtagtggcaaacatctactggaactgatcaatgacatcctcgacttgtccaaaatcgagtcaggcaaactagaactgcaaatcagtgatgtttctgtcagaagtatctgtgatggtagccttacctttattcagcagatggcgttgaaaaaaaatatctgtcttagtactcatataggttctaatttagataccattcaagtagacgatcgccgtttacgccaagtactaatcaacctcctcagcaacgccgtcaagtttaccccagaaggaggtaatgtgaagctcacggtttggctggaggaagtaggcgcaaataagccttaggggcagaaaaactcatatctcaatcctccattcccagcccccatatctgtttccgcgtcaccgatactggtatcggtatcgcctcagaagacataagcaaattatttcagccttttacccaacttgatagcagcctcaatcgcaactacaccgggacagggttaggtttagcactagttaaacgaattactaccctacacggaggaaccatcttagttaacagtgaagtcggacagggtagttgttttacagtccgcattccttacctgagtggggataattctctcaaaaaactacaagatcctgagcgtgttgatctacctgctaccctgataccaaaaactttgacaatacccgtaattttgctggcagaagataatcaagcaaacattgatactatatctagctatctggaaagtcgaggatatgagatggtattagcagaaaatggacaacaagctcttgattttgctagagaaaaatgcccagatttaattattatggatattcaaatgccaggaatgaacggattagaggcgatacgccagatccgtaatgagcaaaaatttattgatattcccataattgctttaacagccctagccatgccaagcgatcgcacgacttgtttagcggctggagctaatgaatatttgaccaagccaataaaactaaaacaactggtattaaccattcaa

SEQ ID NO: 42599 - DNA, 1365 bp, Anabaena PCC7120
gcaatggcgatcgccaccatcaatcccgccactggggaaacgctcaaaacctttgagccgcttaacgatgtagaaattgccgctaaattagatttggcagaccaggcttttgaaaagtaccgtcatacgagttttgcagagcgatcgcaagctctgcaagcagccgcaaatatactggagcaagaaaaagctgactttgcgaagttaatgactttggaaatgggcaagccttacaaagcagccattgccgaagtcgaaaaatgtgctgctgtttgccgctactatgcggaaaatgccgccgattttctggctgatgtcagtgtaaaaactgatgctagtcatagctttgtccgctatcagcccttggggataattttggcagtcatgccgtggaattttcccttctggcaagtgttccgctttgctgcacccgcactcatggcgggtaatgtgggcttactcaaacacgcatcgaatgtaccacagtgcgctttagccatcgaagatattatccaccgggcaggttttcctaaaggtgtatttcaaactctattaatcggtgcagcgaaagttgccgatttaatcgctgatgagcgagtaaaagctgctaccttaaccggaagcgaaccagccggcgcatctctagcggcggcggcgggaaaacaaattaaaaaaacagtcttggaattggggggaagtgacccatttattgtgttagaaagtgctgatgtagaagcagccgccgctacagctacatcagcaaggatgttaaataacggacaatcttgtattgccgcgaaacgcttcattgtggcagaagcgatcgccgatcaatttgaaaagttgctgttagaaaaattcacagcgctaaaaattggcgaccccttacatccagacacagacttagggccactagcaacccccgatatcctccaagatttagaccaacaagtacaaactgccgttaaaagtggcggcaaagtcttgaccggtggctatcctttagcagatcgtcctggcaacttttacccagccacaattatcatagatatcccagttgatcagcccattgcccaagaagaattttttggcccagtggcgttgttattccgtgtcccagatatcgatacagcaattcaactggctaatgctacaccctttggtttaggtgcaagtgcttggacaaataacgaccaagaacgcgatcgcctgatttccgaaattgaagcaggcgcagtatttattaatggtttagtaaaatccgaccccagactaccatttggaggcataaaacgttctgggtatggccgagaattaagcattcaaggcatacacgagttcgttaatgttaaaaccgtttgggtt

SEQ ID NO: 42600 - DNA, 2436 bp, Anabaena PCC7120
cccaaagtccaagcagcaagggagcaagaacccgctatgtttgaacacttcacttccgaagccatcaaagtcattatgctcgctcaggaggaagcacgtcgcctgggacacaatttcgtaggaactgagcaaattctcctgggtttgatgggagaaggaactggggttgctgccaaagtgctgactgagatgggtgtgactcttaaagacgctcgtcgtgaggttgaaaaaatcattggtaggggttctgggttcgtaccgccagaaattccttttaccccgaaagtgaaaagcctcttcgagcagtcctttagagaagcgcataatctcggaaataactacatcaacacagaacatttactcttagggttaacagaagccggtgaaggtgtcgccgctaaggttttacagaatcttggtgttgacctcaagagtgtccgctctgctgtcatccgtcgcttaggcgaagacccaaccgtggttgtgggtggtggcggttccagacggaaccaaacaccgatgatggaagagtttggcagaaatctgacgaaattagccaaagaaggtaaactcgaccctgtagtaggtcggcaaaaagaaattgagcgtactgtgcagattctcggccgtcgtaccaagaataaccccgtgttaattggtgaaccaggggttggtaaaactgcaatcgctgaaggtttagcacagcgtattattaaccaagatgtccccgacattttgcaagataaacaagtcgtcagcctggatatgggttctctggtagcgggaactcgcttccggggagactttgaagagcgcatcaagaaaatcgtagaagaagtccgttctgcgggtaatatcatcctggtgatagatgaaattcataccttagttggtgcagggggaacagaaggcggcttagatgcagccaatatcctcaaaccagccttggccaggggtgaattgcaatgtattggcgctaccacattagatgaatatcgtcaatacatcgaacgcgatgcggccttagagcgacgtttccaaccgattatggtcggggaaccatccgtagccgaaaccattgatatcctctatggtttgcgcggagcctacgaacagcaccacaaagtacatatttccgatgaggctgtggtagcagcagcgcaattggctgatagatatattagcgatcgcttcctgcccgataaagccatagacttaattgatgaagctggctctcgtgtgcgcctgcggaactcgcaaatttcccctaacaaggaactcaagcgccaactgactgacatcaccaaaagcaaaaacgaagcagttagactccaagacttcgataaagccgcaaaactccgtgacgaagaaattgccctagaaacagaactgcaagcagccaccactggccaaaccatcaagccagttgtggatgaagaagacattgcccaaattgtcgcctcttggactggtgtcccagttaacaagctgacagaatctgagtctgagttgcttctgcacctagaagatactctccacaaacggttaattggtcaagagcaagcagttacatcggtttctcgcgccatccgtcgcgccagagtcgggttaaagagtcccaaccgtcccattgctagctttattttctccgggcctaccggagtcgggaaaaccgaactagccaaagcattagcagcttacttctttggcgcggaagatgccatgattcggtttgatatgtccgaatacatggaaagccacaccgtttctaaactcatcggctctcctcctggttacgtcggctacgacgaaggcggacaactcactgaagccgtgcggcgtagaccatacacagtgttgctgttcgacgaaatcgaaaaagcgcaccccgatgtattcaatatgctgctgcaacttttagatgacggacacctcaccgatgccaaaggtcggaaagtggacttcaagaacaccttgattatcctgacttctaacattggttctaaggtaattgaaaaaggtggcggcggtttaggctttgaatttgacaaccaagccgaagctagttacaaccgcatccgcaacttagtcaacgaagaactgaaaaattacttccgtcctgagttcctcaaccgacttgatgaagtcatcgtcttcactcaactgtcgagagatgaagtcaagcaaatcgctgatatcatgctgcgtgatgtcgccagccgcctgaccgagaagggaattaccttagaagttaccgaacggttcaaagaattagtagtaacagaaggttataaccccagctacggtgctagaccattacgccgtgcaatcatgcgcctcctagaagattccttagcggaagtgttgctgtctggagaaatcaccgagggagacacagccattgctgatgtcaacgatgacggtcaagtacaaata

SEQ ID NO: 42601 - DNA, 1239 bp, Anabaena PCC7120
atggcagactggcaggaaattactggtggaattacagcaccaaaaggttatcgggcggcgggaattacagcaggactcaaaccttcggggttgccagatttagctttgatagtatcagatgtagaagcgatcgcatctggtgtattcacaaccagtcaagtaaaggctgcttgtgtagactactgtcggcaacgtttacaagccaagcaaagcgctcgcgccattctttgcaatgctggacaagccaacgccgctacaggtagtcaaggtattaaggatgcagaagaaagtgccgagttgttagcaaaagagttaaatatatcccccgaattaattctgttggcttccacgggggtaattggtcaacgaattaaaatggatgccttacgcaacggtattcctaaactaatagcatcccttacagatacaggttcagatgcagccgccggggcaattatcactacagatttagtcacaaaatctattgctttagaaacaactataggcgatcgtccagtccgcattggtggtatcgccaaaggttcagggatgattcatcccaacatggcgacaatgctagcttttgttacctgtgatgccgcagtttcctcccatctttggcaacaaatgttaactagggcagcagatagaagcttcaattccattacagtagatggagataccagtaccaacgatagtttaatcgccctagccaatggacagtctcgcaccccagccattactgaagtcggtgcagaatcggaaaaattagaggccatgctaacagcagtatgccagcatttagccaaagcgatcgcccgtgatggcgaaggtgcaacctgtcttatagaagtgcaagtcacaggcgcacatgatgaacaagcagctagacaaatcgccaaaactattgccggttcatcattagtgaagtctgcaatctttggtcgtgaccccaattgggggcgcatcgccgccgccgccggacgtgctggtgttcccttcgagcaggaaaatctgcaaattcagctaggagattttttactcttagacaatggtcaacccctcccatttgaccgcgccgccgccagcgcgtatttaaaacaagccgccacaggtgcttatcttcagcaagatacagtcttaatttctgtcaaggtcggtaatggtcatggcactggcaaagcttggggatgcgatttaagttatgactatgtgaagattaacgctgagtatacaact

SEQ ID NO: 42602 - DNA, 783 bp, Anabaena PCC7120
attatgaacgggttaaaaggtaaaaacactctgattacgggtgctagttctggtattgggcaggcgatcgctatccgtctggctcaagaaggttgtaacattgctattaattaccgcaaaagtccctcaggtgcagaggaaactgaagaaatggctttgcagaaggcttgtaaaaatgttgaaatttgcggtgttaagtctttgttagtacagggtgatgtttctcaggaagaagatgttgtcgagatggtcaacactgtaattgaggagtttggtagtctcgatattctcatcaataacgccgggattcaaactgaatgtccatcccacgaaatcacagcagaagactttgatcgcgtaattggagtcaatctgcggggttcttacttgtgcgcgcgtgaaactattaaacacctgctgactcaaaatcgttcaggggtaattattaatatttccagtgtccacgaaattatccctcgaccaatgtatgtcagctattccatcagtaaaggtggaatggaaaatatgaccaaaactctagctttggaatatgctcatcggggtattcgtgtcaattctgtagcgcctggagcgacaattacacctatcaatgaagcttggactgatgacccggaaaagaaagcagttgtagaaagtcatattcccatgaggcgtgctggtacttccgaggaaatggcggcagcagtagcatttttagcatcagatgaagcagcatacatcacgggacaaactttgtttgtagatggtggtctgtcgctgtac

SEQ ID NO: 42603 - DNA, 618 bp, Anabaena PCC7120
atgattgacctttactattggacaaccccgaacggccacaaaatcactatcttcttagaagaagtcggcttaccctacaacatcattcccataaatatcggtgctggcgaccaattccagccagaatttctcaaaatatccccgaataatcgcatcccagccattgttgacaatgaaccagcagacgggggtgcagcgatttctgtgtttgagtctggcgctatcttgttgtatttggcagaaaaaactggaaaattcatcccccaaaatattaggggacgtacagaggttctacaatggctattctggcaaatggcaggactaggcccaatggctggacaaaaccaccactttagtacttatgcacctgaaaaaattgagtatgccattaaccgctacgtcaatgaaacagggcgcttgtatgcagtgttggataaacgccttgcagatagagagtttgtcgctggtgaatactctattgccgatatcgccgcttatccttggattgtgccttatgaacgccaaagccaaaatttagacagtttcccccatctcaaacgttggttcgagacaattcaaatacgtccggcagtaattcgcgcctatgaaaaagccgaa

SEQ ID NO: 42604 - DNA, 9399 bp, Anabaena PCC7120
ctatttttccagcaagtagcaaaacaacccaaccaaaccgcaatcgtcaccacagaacaaactttaacctatcaacaggtgagcgatcgcgtctgtcatcttgccgaacatttacaacaattaagtgtaattcccaaccaattagtagcaattgtcatggataaaggttgggaacaaatagtagcagccttagcaattctaactgctggtgctgcctacgtacccattgacccgcaattaccagcccagcgtcgtctacatctattacaagaaacacaagcacaaattatacttacccaatcttggttagatacaactttagaatgggctgatcatctaactcggatatgtgttgacctctctccaaacctctctcctacaaggagagaggctttaacctctccctctgattcttcggatgtagaaccaatcttaaactctcccccttcccttgtagggaagggggctggggggttaggtcaacccacagatttagcctatgtaatttacacctctggctcaacaggaacacccaaaggtgtgatgattgatcatcagggagcagtcaacacaatattagatattaatcaacgctttggtgtaacagagaatgaccgagttttagcggtgtcatcccttagttttgatttatccgtgtatgacatctttggcattttagcggctggcggaacaatcatcattcctaaaagcggtaatgatcccacccattggatgcagttaattaaccaacatcaggtgacaatatggaacacagttcccgccctgatgcagcttttacttgacacctcccccacccaaaaccagacactccgcctaattttactcagtggtgactggattcctctcacattacccccacgcatccgcagccaatttaatcatccccaaattattagcttaggcggtgctacagaagcttccatctggtcaattttctaccccatagagacaatcgaccccaattggaaaagtattccctacggttattcattgactaatcaacaagtttacgtcctcaaccactccctagaaccctgtcccacctgggctattggcgaaatctacatcagtggtttaggagtcgccaaaggatattggcaaaatccagaattaacggcggaaaaatttattcaattggacatgggagagaatttcccccctacacccctacacccctacacccctacacccctatataaaactggcgacttaggacgctacttatctgatggaacaatagaatttttgggacgggaggattttcaagtcaaaattaatggctatcgaattgaattaggagaaattgaagccgctttacaacaacatccagccataactcaagctgtggtgacaactgcgggaaatgcactatctcaacagcaattagttgcttatctggtattgcaaccagaagtaattgctagtcaaaacactcttaactcctcctcacaactggatttcaaattgcaacaaaagggagtcagaaaatttgatgctggggtgcattctgtagctttacctggggttaaatcttctcaagtcaatttgcggcgacaaagttacagacagtttttagcagaaactatccctctaaatgccttgggtgaatttttcgagtgtttgcaaatgcaacatttagaaaattccccattaccaaaatatcgctatgcttcggctggtagtttatatccagtccaaacatatatctatataaaaccccatcgagttgaaaatttagcggctggtttttattactatcatccccaaaaacatcaacttatccagttaagtgatgagacaaacattgatagtagtatctatggcatcaatcaagagatttttacacaagcagcatttgccatctttttaattggtgacttacaagcaatttcgccagtttatggtgataaatctagggacttctgtttactagaagcgggttatatgggtcaactattaatggaaaccgcaccaaatcaaaatttaggcttgtgtcccattggggatttagaatttgatgcgatccgcgaacatttcattttacatgagcagcaaatattcttacatgggtttgtaggcggtattatagacccccattggacaacccgttggttatcacctgaaactgctcaaaccaaggtaacaaaagccgaattaattacccaaaaactacggcaattcctgcaacaaagattgccagaatatatgattccccgcctctatattcccctagaaacgctgccattaacaccaaatggcaaaattgaccgtcgtgcgttacctcagccagaatatcaatttagccaatctgaacagcctattatacctccctctacagaattagaaatagcactagctcaactatggcaatctattttaaatgtagaagtttctagcattcacaataatttttttgaattgggaggtaattcattatcagctactcaaataattactcagatgcggcaaaatctccaacttgatttacccattcgggaattttttctcaatcctaccttaactgcacaagctgagttactcaaacaacagtgggaagcaaaacaagaaattacaattgaacctattgaacgtattaatccacaagaattactggcaaatttagatgaactttctgatgaagaagtagagattttacttcaaaaaatgcagttagaagaggatgatttatctcacgcaaagacgcaaagacgcgaagaataggaggagaggagataattttctaatcaaactatctctcttttctcctctttgcgcctctgcgcctctgcgtgaggaaaaaatattattttacttgattaaattatgaatatttccacatcccaaaaacgcgaactattagcgaaactactacaacaaaaagccaccaaacaacattttccgctttcttttgctcaaaaaagattgtggtttctagataaattacagccaggattatcagtttataacgtacctgcggctttaaggttgacgggtaatctcgatgtcacgcgcctagagcaaagtttacaatcaattttgttgcgtcatgagattttacgcaccagttttgctgtaattaatgatgaacctgtacagaatattgctgtaaacgtcaaaataaatctacctataattgatttgcgggaattatcaccagaaaatcaagaatcacaagtcatacagcaagctaaattactcacagagcaaccgtttcaacttacagaaccgcctttattacgtgtggcgttactacaactgagtgatactgaatttgtattgattttggtcatgcaccacatcattacagattactggtcatttcgtgttttggtgcgggaattaatctcactttatcaaggtcaaaccttagcaaaattaccaattcaatttgcagattttgcaacttggcaacaaaaatggctgcaaagtgaagctagacaaaatcaattattatactggcaagaacaactaaaaaattatccccgtgaattatctttaccaacagattatccacgtaacgctatacaaacttttaaaggtgcaaggctattttttactttatcaccagaattatctgagcaattgcgacaattgagtcaacagtataatgctacgctgttcatgactcttttaacagcatttaatatcttattatatcgctacagtggacaggatgatatattagttggttctacagttactagccgcgatcgcccagaaattgctaacctcattggtctatttgttaataatctcatatttcgcaccaatttatctggtaaacccagttttatcgaacttcttaaccaagtaaaagaaacagttttaggcgcgttatctcaccaagatttaccctttgaagatttagtagaacaactgcaaccagaacgaaatttaagtcaaaatcctttattccaggtaatgtttgttctccataacacaccgaataaaacgacaaatttacctggattaaaaattgaacctctagaaaccgaacattctacatctcgctttgatatcagcttggatatgtacgaaacaccaaacggtttaaggggaacttgggaatacagtacagaattatttgaacaagctactattgaaagattaattgcacattttcaaattttattatcaaatattgttgataatcccaaacaatctattaatgaagtaccattattaacagttaaagaacaaaatctattaacagaatggaacgatacatttacagatattccagaattaacagtttatgaattatttagtcaacaagtagaaaaaacaccagataaaattgccgttctttttggtaataaatccctaacgtatcagcaactagaacaagaagctaatcacctagctgcctatttacaaaacataggagtgcaagcagaaacaagagtaggaatttgctgcgatcgctctctagaaatggtaatctccctattagcagttcacaaagccggcggtgcttacgttcccctcgaccccggctatccccaagagcgtttacagtttataatcaacgactcacaaatctcaatcttattaactcaaacttccttattaaacaacctcccactcatagaggaaatagcattaaataaacctcttaaaactcctctctgcgcctctgcgcctctgcgtgaaataaaaatcatcccactcatcagcaacaccgacaaaaccaatgatttatcacaccccaatcaactcgcctacctaatttacacctccggttcaaccggaacacccaaaggcgtgcaaattttgcacagaagcttaagcaacttcttaaccgcaatgtccaaagcaccaggactcacagcagaagataaccttttagctgtcaccaccctagcctttgatattgcagccttagagattttcttacccttaattgtcggtgcttgtttagtcttagtagaaagggaagtcaccctagatggagagagattagcacaagcgatcgcacaacatcaaatcacctttatgcaagccaccccagcaacttggcggttacttttagccagtggttgggaaggtaaacaggacttgaaaattctctgtggcggcgaagcattagataacaccctagcccaacaattattatcctgtactcaagaagtctggaacttatacggaccaacagaaaccaccatttggtcagcagcccaaaaactcagtatagatgaacccgtaaccatcggtcatcccatcgccaacacccaattttacgtcctcgacgagcatttacaaccagtccccatcggcgtaccaggagaattatatattggtggtgcaggagttgccaaaggatattggcaacgtccagacttaacagcagaaagatttctcaatcaacagtcaacagtcaacagtcaacagtcaacagtcaacaccttatataaaacaggcgatcgcgtccgatatctcccagatggtaaactagaatacttgggtagattagattatcaagtcaaaattcgcggttttcgcattgaattaggagaaattgaggcagtattagcacaacatccccaaatatcacaagcagtagtaagcgtgcaagaagatgaaccaggagaacagcgtttagtcgcttacatcgtccccaattctcaggatgtgggaagcaatgatttacagcaattcctcgccaacaaactcccaaaatatatgattcctggggtgtttgtcacattaacagccttacccctcacacctaatggtaaagttgaccgtaaagccttacccactcccaatacccaatcacaggtaaatgaaacccctcgcacaccaacagaggaagttttggcgagtatttgggcgatggtgttgggtgtcgagtcggtgggtattgaggataatttctttgatttggggggacattccctgctggcgacgcggttaatttctcaagtacggcaggtatttggtgtagagttaccattacgtaatctgtttgaaagtccgaaaattgcggatttagccagagtaatagaacatagtcaccacgaaattaacccaatattaccgattgctcgcactggtaacttacctctatcttttgcccagcaacgcttttggattttagcgcagttagaaccggatagccctttttataatattcctttggcggtgcaaattcggggtgatatccacttggatagtttgcagcgcagttttacggaagtggtgcggcgacaggaaattttgcgatcgcatttcttgaatgtcgatggacagcctgttttgaggattgctgatgtttgtgatgtcaatataccagtgattgatttacagggattaccggaatttgaacaacagcagcaggtgcaggagttggcgcgaactcaggcgcagcagccttttgatttggctggtttgttgtggcgggtgcggttggtaaaattgggggaggggaatcaggtattattgttgactttgcatcatattattgctgatgcttggtctgtggggttgttggttcgggaaatttctcgcgcattcgcggagcgtcccgcagggaaggcgcaaagacgcagagaggaggagaggattcagtatgtggattttgctttttggcagagggagtggttgcgggggagggttttagaggaacatttggagtattggcgcggacagttggagtctgcgccggtgatgttggaattaccgactgattacccccgtccggctgtacagtcttttcggggggctgtatatgggtttggtttgtcggcggaattgactcagggtttgcaagggttgagtcggcgttatcacagcactttatttatgactttgttggctgtttggaatgtgctgttatatcgttacagtggtgatgatgatattgtggttggtagtcctatagctaatcgcaatcgtgtagagacggaagggttaattggttgtttcgctaacactctggctttacgtactgatttgagtgctaatcctagttttgctgatttattgtcacgggttcgggcaactgctttgggtgcttatgctcatcaggatttaccttttgaacaattggtagatgtgctgcaaccagtgcgatcgctcagtcattcgcctctttttcaagtgatgctggtgttacaaaatttacctttgccagagttggatatggggggcatagaatggcaagtaattgaggcggatagtggtacagcaaaatttgacctgacttggttcgtgagcgaaactgctcaaggcttaagctgtaagttggaatataatactgatttattcgcagccacaactattgagcgtttagctggacatttagaaacattattacaagcagtagttctcaatcccgaacagcatattaacgaattaccgttattaaccactgttgaacagcagcaactcgcacaatggaacgccactcaacgccagtatcctcagcagtgtttacatgagttatttgaagcacaggtgagacaaaccccggaaaagatagcagtgatttggggtgaaaaacagctaacatatcaagaattaaacaccaaagccaatcaattagcctgtcatctgcaaagtttaggtgtccagccagaaacgcccgtgggaatttgcgttgaccgttccctagatatgattatcggcttattggctatcctcaaagctgacggtgcttacgttcccctagaccccacttatcccgaagccagattagcatttattattgaagattcccaaatgcaggtgttactcacccagcaaaaacaattaactaaactcccccaactccaaatccccataatttccctagacaccccaatccccagtccccaatccccagtccccagtccccagtccccaaccaacctagcctacatcatctacacctccggcactacaggcattcccaaaggagtcgccattactcatcaaagtccggtaacgctgatgtattgggcgcgagaaatttacacaagagcagaattaacaggtgttttagcttccacttccatttgttttgacctttcaatatttgaaatcttcgttcccctaagttggggaggttgcgtcatcctcgctgataatgccctacaactaccagaattaccagcagccgcacaagttactttaatcaatacagtcccctcagccgccagagaactgctacgtttaaatggtattgccgcaacagtacagacagtaaacttagccggcgaacctttaccgaaatcgttggtagacgaactctatcaacaatccacaattgagcgcgtatataatctttacgggccttcagaagataccacctactctacccatgcgctcattccccgcaatagtcaacaagccccgacaatcggtcaacccatcgccaacactcaagtttatatcctagaccaaaacctgcaacccgttcccgttggcatacccggtgaaatttacctcagtggcgcagggttagcaagaggttactggaagcgtccaaaattgacggacgagaggtttattaaacagtcaacagtcaacagtcaacagtcaacagtcaacactctctacaaaacaggcgatcgcgctcgttatcttccagatggtaatattgaatatctggggcgtttcgaccatcaggtgaaattgcgtggttttcgcattgaattgggggaaattgaagcgttacttcatcaacatccagagttaacgcaggctgtcgccattgttcgcaatgatacgccagaacatagccgcctagtagcttatgttgttcccaaatctcacattgaagcagcagaattaaggcaatttttagcggcgaaacttcctgcttatatgctaccgacagcgtttgtcatcctggaaactttacctctaacagctaatggtaaagtagaccgttttgctttacccatacctgatttatcgccagtcaccaccacaaccgcaccccgcacacccatagaacaacaattaattaatatttggactcaggttttaggggtagaatctatcagcattcatgataacttctttagattgggtggtgattcaattttagccattcaagcagtagccaaagcgaatcaacaaggcttggctttacgaccccggcagatgttccaatatcaaacagtggcagaactagcagccattgtggacactgataccacattatctagtgagcaaacaccaatcacaggggaagttcctctcactcctattcagcaatggttctttgagcaaaatctagtagatgcacatcattggaatcaagccattcttttagaagtacaccaatctcttaaccctgattacttacggcaagcattagatcaactattagcacaccatgatggattgcgatcgcacttccaacaaacccccgacggttggcgacaattt

SEQ ID NO: 42605 - DNA, 1179 bp, Anabaena PCC7120
tacgtcgttcctggtggtcgttttaatgaaatgtatggttgggatagctattttattttgcttggactgttgcaagatgaagaatgggaactagcccaaagtcaagttgatcagctactttaccaagtccagcattacggtacaatcctcaacgccaaccgtacctatatgctgacgcgatcgcaaccccccgttctgagtatgatggtcttggcgttattccaacacacccaagaccaagcatggctcaaatcaaccctgccattgctagaacagttttactattattgggtcgtaccgccgcatctaaattcagccacaggcttatctagatactacgccttaggcgaaggggctgcaccagaagtattattttccgagctagatgaaactggacgcagccactacgaacgtgtcaaggaatattacaagacatttgagattgatgattatgatgtgagtttgttttatgactcagaaagagacgaactcacagacttattttacaaaggcgatcgctccatgcgcgagtctggttttgatatcaccaaccgctttggcccctttagcgttgatatcgtccattatgcacctgtctgtctgaacagcctgctttatcaaatggagcaagacttggcgcaaattcacaagattttagataatcccgaacttgcagaacaatggagcgatcgcgccactttgcgccgtgagcgtatcaatcaatacctgtgggatgaagaaaaaggaatttatttagactatcacttctacagtggcaaacgccgtcattatgaatttgccactaccttctatcccctgtggacaggattatcctccccagaacaagcccaacgcattgtagaaaatctttccttatttacagccccagggggaatcttcaccagcacccatgtaacagggaaccaatgggacgcgccttttggctgggccccactcaccttaattgcagtccaaggactttatcgttacggatatcgcaaggagggggatgatattgctcataaattcctaactatggcgattcaagaatttacgaaatatggcttttttgtagaaaaatacgatgtagaacgttgttcggctcaagtttccgatgaaatctgctttggctatagttctaacgagataggttttggttggacgaacggagtcatttta

SEQ ID NO: 42606 - DNA, 1014 bp, Anabaena PCC7120
gatcccaaaatcggtggtgtaatgattatgggcgatcgcggcacaggtaaatccacaactatccgggccctggctgatctattgccagaaatccctgtagttgccaatgaccccttcaacagtgaccccagcgaccccgacttgatgagcgatgaagtccggcaaaaatcaggcacaggggcagaaattcccatagaatttaaaaaagtccaaatggtagacctgcctttaggtgctacagaagaccgagtgtgcggcactatcgacatcgaaaaagctttatctgaaggtgtcaaagcctttgaacctggacttttagctaaagccaacagaggtattctctacgtcgatgaagtcaacctcctagatgaccacctagtagacgtactcctcgactcagccgcaagtggctggaacactgtagaacgtgaaggtatttccatccgccacccagcccgttttgtactcgtcggttcaggaaacccagaagaaggcgaactccgaccccaattgcttgaccgcttcggaatgcacgccgaaatccacaccgttaaagaaccagctttgcgggtgcaaattgtggaacaaaggtcggaatttgaccaaaacccaccaacattcctagaaaagtacaaccctgaacaaacagcactacaaaagaaaattgtcgaagcccaaaagctcttgccagaagtaaaactagattatgacctgcgggtaaaaatctcagaagtttgttcagaactagatgtagacggtttacgcggtgacatcgtcaccaaccgcgccgccaaagccctcacagcttatgagggacgcacagaagttacagttgacgatatccgccgtgtaattacattatgtctgcgtcaccgcctgcggaaagaccccctagagtcaattgattctggctacaaagtagagaaagtgtttgcccgtatctttggggtagaactactagaagatgactcctcacaaaaaaacggtgcaggtcaaattaagacaggtgtccgg

SEQ ID NO: 42607 - DNA, 1218 bp, Anabaena PCC7120
ttgacactacgggttgctgttgttgggtcaggcccagctggttcctctgctgctgaaacactagccaaagctgggattgagacctacctgtttgagcgcaaattggataacgccaaaccctgtgggggggcgattcccttatgtatggtaagcgagtttgacttaccaccagaaattattgatcgtcaagtgcggaagatgaaaatgatttcaccttccaatcgtgaagttgatatcaatctgataaaagaagacgaatatataggaatgtgccggcgtgaagtcctagatggcttcttacgcaatcgcgcggcaaaattaggggcaaatttaattaatgccaccgttcataaagttgatatacctggaaataacagcgacccatacaccattcattatgttgaccataatgaaggcggcgcacaaggtgtcacaaaaactttaaaagtagatttgattattggtgcagatggggctaattcccgcattgccaaagaaatggatgcaggggattataattatgcgatcgctttccaagagcgtatccgcttacccgaagataaaatggcatattacaacgaccttgccgaaatgtatgtaggcaatgacgtttccacagacttttatgcctgggtattccccaaatatgaccacgtagccgtcggtactggcacaatgcaggtacacaaagccagcatcaaacagttacaggctggtatccgcacccgtgctagcgaaaaattagcaggtggtaaaatcatcaaagtagaagcccacccaatccccgaacatccacgtcctcgacgtgttgttggtcgcatagccttggttggagacgctgctggctacgttaccaagtcttctggtgaagggatttactttgctgctaaatctgggcggatgtgtgcagaaaccattgtagaagtttctcaaaatggtagtcgtattcccacagaaaacgaactcaagatttatctcaaacgctgggataaaaaatacggactcacttacaaagtgttggacatcttacaaacagtattttaccgctccgatgccacccgtgaggcatttgtagagatgtgtggagacttggatgtacaaaaactgactttcgacagctatctgtataagacagtcgtccctgctaaccccatcacccagttaaaaattactgccaagacaattggtagtctcatccgtggtaacgctttagcaccc

SEQ ID NO: 42608 - DNA, 471 bp, Anabaena PCC7120
aaacttttgctcgtcggacaaggtagcgtcggtaaaacatccctcatcgagcgactaatccacaataaatatgatagaaatcaaccccaaactgacggactcaaggtagaaacttggaacgtgcaggtcaatagcaaagacatccgccttaatgtttgggactttggcggacaggaaatttatcatgccacccatcagtttttcctgactaagcgcagcctctatcttcttgtttgtaattgtcgcaccagcgaagaagaaaaccgcatcgaatattggctgaaactaatcgaaagcttcggcggacagtcccccgtgattatcgttggcaacaaaaaagacgaacaacccctagacatcaaccgcaaagcattacgagaaaaatatcctaacatccaagcgattatcgaaacctcttgccaagacaatatcggcattgatgaacttcgcaccgcgattttgcagcaagtc

SEQ ID NO: 42609 - DNA, 969 bp, Anabaena PCC7120
atggcagaaacattattcttcaacgctctgcgggaagccattgatgaagaaatggctcgtgattccagtgtcttcgttctaggtgaagacgtaggacactatggcggctcttacaaagtcaccaaggatttatataaaaaatacggtgaactcagaattttagatactcccatcgccgaaaacagttttactggtatggctgtaggtgctgctatgacaggcttacgtccgataattgaaggcatgaatatgggttttctcctcctcgcctttaaccaaatctccaacaacgcggggatgctacgctatacctccggcggtaactttaaaattcctttggttattcgtggccctggtggtgtaggtagacagttgggtgcagaacactcccaacgcctggaaacttacttccaagcagttccaggcttgaaaatcgtcacctgttctacaccttacaacgccaaaggattgctgaaatcagccatccgcgatgataaccctgttctattctttgaacacgtcctgctttataacttgaaagaggacttaccggaaaaagaatactacctacctttagataaggcagaaatcgtccgttctggtaaagatgtaacaatcttgacttattcacggatgcgtcatcacgtcacccaagcggtaaaaactttagaaaaacaaggttacgacccagaagtaattgatttaatatccctcaaaccacttgatttagaaacaattggtgcatcaatccgcaaaacccacaaagtgattattgtggaagaagcgatgcgaaccggcggtattgcagcagaattaatcgcttccattaacgatcgcttttttgatgaattagatgcaccagtcctcaggctgtcatctcaagatattcctacaccatacaacggtactctggagcgcctaacaattgttcaaccagagcaaattgtcgaagctgtgcagaaaatgatt

SEQ ID NO: 42610 - DNA, 969 bp, Anabaena PCC7120
atgaccccagccacctccctgtttacccctgtggaagcagacctgcgaatactagcagataacctgaaacagctagttggaaatcgccaccccattttgtttgcagcagccgagcatctattcggagctgggggaaagcgtataagaccagcgatcgtgctgctgatatcacgagcaacaatgttagaccaaggcattacaccgcgtcaccgccgcctagccgagattacagaaatgattcacacggccagcttagtccatgacgacgtggtagacgaatctgaagtgcgacgaggtgtccccaccgttcatagtttgtttggcaatcgaattgcaattctagcaggagattttttatttgctcaatcttcctggtatttagccaacttggataatttgcaagtggtgaaactactctcagaagtcattatggatttggctactggggaaattcagcagggactaaaccgctttgacgcgagtatttccattgagacttatatcgagaagagctattacaaaacagcatctttagttgctaacagttctaaagcagctggtttattgagtgaagtgtctccagaaactgccgaacatctttacgcctatggtcgtcatttaggcatagcatttcaaattgttgatgacattttagattttactagcactacggatacccttggtaaaccagtagggtcggatctaaaaagcggtaatctcacagcgccggttttatttgctctagcagaaaaaccatacctagaggtgttgattgaacgagagtttgcccaagaaggagatttagagcaagcactagaactcatacaagatagtcaaggcatacagcagtcaagagagttagctgctcaccacaccaagttagcaattgagcatttggcaactctgccaccctcagaatctcaccaagcactgatcaagatagctgaatatgcaataagccgattgtat

SEQ ID NO: 42611 - DNA, 636 bp, Anabaena PCC7120
atggctctccgtcttggtgatacagtacccaactttacacaagcgtctacacatggcgacatagatttttacgcatgggctggtgatagctgggttgtgctgttttctcaccctgctgactataccccagtttgtacaactgaattaggaacagttgccaaactgaaaccagaatttgacaagcgcaatgtgaaagcgatcgctcttagcgttgatgatgtagaatctcacaacggttgggtaggcgacattgaagaaactcaaagcaccacactcaactaccccattttggcagatgcagatcgtaaagtttctgacctttacgacatgattcatcctaatgcgaatgcagctgtaacagtgcgttcagtatttgtgattgatcccaacaaaaaactccgtctcaccttcacctatccccccagcaccggacgtaactttgatgaactgttgcgagtcatcgattccttgcaactcaccgacaactacagcgtcgctaccccagccgactggaaagatggcgataaggttgtcatcgttccctccctcaaagaccccgaagtcttaaaagaaaaattccctaaaggttacgaagtagtcaaaccctatttgcggttaactcctcaacctaacaag

SEQ ID NO: 42612 - DNA, 390 bp, Anabaena PCC7120
caatgtattgtaaatcgccgcgctcagttttcggctagccatcgctattggttgccagaactgagtgaagccgagaatattgaaaaatttggtgcttgctctcgatttcctgggcatggacacaactacgtcatatttatctccctggctggagaactagatgaatatggcatggtgttgaacttgtctgatgtgaaacaagtaatcaagcgggaagttaccagccaactggacttttcctatctcaacgatgtctgggcagaatttgggcagactttgccgacgacagaaaatatcgcacgggttatctggcagcgactagctcctcacttacctttagtccgcgtgcagttatttgaacatcctgaactttgggcagattatcaagga

SEQ ID NO: 42613 - DNA, 387 bp, Anabaena PCC7120
gcttacctcactatcagcactcactttagcgccgcccatcggctggctcatcccaatcttagccaagaagacaacacagaaatttatggtaaatgtgcgcgtccccacggtcacggacacaactatcatttagaagtgacagtcaaaggcgagattgatccacgcaccggtatgattgtcgatttaggtgctttgaatcaggcgattgaagattatgttgtggaaccatttgaccacacatttttgaataaagatattccttactttgctgaggttgtgccaacggctgagaatatcgctctatacattagtaacttactgcgatcgcccatccaagaattaggagccaaactttacaaagttaagctgatagaaagtcccaataac

SEQ ID NO: 42614 - DNA, 855 bp, Anabaena PCC7120
tctgtagctattagccccgatggcgaagttatagttagtggctgtacagatcaaacagttaatatctggaatttgcaaactggtaaactcatccgcactctaacaggtaatttaggcgaagtttcctccgtagccatcagtcctgacggtaattttctcgccgtgggtagtggtgtacatcccagaagtaacgtcaaagtctggcatttaaaaacaggtaaactgctgcataccctcttaggacatcaaaaacctgtaaatgtagtagttatcagcccagacgggcaaattttagctagtggtagtaataaaattaaaatctggaatctgcaaaaaggtgatggcgttccgcccaccgtaggcgatcgcatttgcaccctttggcattcctcagccgttcacgccatagccattagccctgatagtaccatcctcgccagtggtagttctgataataaaatcaggctgtggaacccccgtacaggcgaccctttacgcaccctcaacagtcatgataacgaagtaaaagcgatcgccatcagtcgagacggacaatttttatttagcggtagcgccgacaccaccatcaaaatttggcatttaattacaggtcaaattctccataccctcacaggacactcaggcgatattaaatccctcacaaccagtcctaatggacaatttttatttagcggtagcgccgacaccaccatcaaaatttggcgcatttccacaggcgaactactacacaccctcaccggacattcagcatcagtcaattctgtagccatcagtcccggtggtaacctcctcgccagtggtagcgctgatcaaaccatcaaaatttggcagata

SEQ ID NO: 42615 - DNA, 1077 bp, Anabaena PCC7120
atggcgcttgtaccattgcggctgcttttggatcacgcggctgaaaacggttacggcatcccagctttcaacgttaacaatttggagcagattcaggcaatcctgaaggctgctgccgagacagatagccccgtaattttgcaagcttctcgtggcgctcgtaattatgcaggtgaaaacttcctccgccacctgattttggctgcggtagaaacctatcctgagattcccatcgtcatgcaccaggatcatggtaatgctccttctacctgctactcagcaatcaagaacaacttcaccagcgtcatgatggatggttctttagaagctgatgctaaaacccctgctagcttcgagtacaacgtcaatgttacccgcgaagttgtaaatgtagctcatgctttgggcgtaagtgtagaaggtgaactcggttgtttgggttctctggaaaccggtgcgggtgaagctgaagacggacacggttttgaaggtactcttgaccattcccaactgttaactgaccccgatgaagctgttaacttcgtagaagcaacccaagtagatgctttggctgtagctatcggtaccagccacggtgcttacaagtttacccgcaaacccaccggcgaaattttggctatcagccgcattgaagaaattcaccgccgtctacctaacacccacttggtaatgcacggttcttcttccgtacctgaagatttaatcgctttgattaacgagtacggtggtgctattcctgaaacctacggtgtacctgtagaagaaatccaaaaaggtatcaagagtggtgttcgcaaagtgaacatcgacaccgacaaccgcctggctatcactgcggctgtgcgcgaagctttagcaaaaaatcccaaggagtttgacccccgtcacttcctcaagccttctattacatatatgcagaaggtttgtgcagaacgctatgtacaattcggtactgctggcaatgctagcaagattaagcaagtttctctagaaacttttgctgctaagtatgctaaaggcgaattgaacgctatcagcaaggctgctgctaaggtt

SEQ ID NO: 42616 - DNA, 1141 bp, Anabaena PCC7120
atggaaaactttgttttttacaacccagtcaaaattttatttggcaaaggtcaaatcgctaatattgccgccgaaattccgactgatgctaagattcttattacctacggtggcggtagcattaaagccaatggtgtgtacgaccaggttaaatctgcattggctggacggaaaatctttgagtttggtgggattgaacctaacccccatttagaaactctgttgaaggcggtggaattaatacgccaagaaggtatcgattttctcttggctgttggtggtggttcagttgtggatgggactaaatttattgcggcggcggttccttttgttggtgacccttgggacatcttggccaagcaagcacctgtgactgcggctgtaccttttggggcggtattgaccttaccagctacaggttcggaaatgaatactaactcggttgtgactaagtgggaaaccaaagaaaagctgttctttgctagtcccttggtgtttcctcgcttctctgttcttgacccagaaacaacattttccttaccgcctagacaaattggtaatggcattgttgatgcctacacccatgtgatggaacagtatttgacttatccagttaatgcaccatttacaagaccgatgggcagaatctattttgaaaacgttgattgaagaggggccaaaaaccctagctaatcctacagattacgatgccagggcaaatttggtatgggctgcaaccttggcactcaatgggctaattggtgcaggagtaccccaagattgggctacacacatgattggtcatgagttaactgcactgcatggtctagatcacgcccaaactttggcgattgtcttacccagcacactctcaattagacgcgatcgcaagtggcaaaaactcctacaatatgcagagcgagtctggaacattgtcgatggttctgaagaatacagagtaaatgaggcgatcgctaaaactcgcaatttctttgagtctgtaggtgtccgcactcgtctatctgactacggtgtaggactagaaaccattcctctagttgtagaaaatttacaaaagcatggtttagcaatcttaggtgaacagaaagatgtagactctcaagtcgttgagcagatttta

SEQ ID NO: 42617 - DNA, 537 bp, Anabaena PCC7120
ctcaacttctactacaatcatcgttcacctatggcccgtcgtgtatggcgtaccttactagagaaagaaattatatttgagccaataatcatgagcttagatggcgatcaattacaacctgaatttttagaaatcaacccatttcatcatattcccgtcatattagataatggttttcgggtagtagaatctctagcaatcatggactatttggaagctaaataccctacacctgcactgttacctaaagaagctgagtctttagcaaaagtaagaatggtgcagatggtgacgacaaatgaactattaccaaaaatgatttccttgatttttgaggataaaaattcgtcaaaatttttgcaggcttatgagcatataaataaggtcttagcctttttatcagaatctttaggtaacgaatcttattatggtggagaacagttgactttagctgatattgtggctggaaccgatttatctttgttgccaaaattagggattagttttagtaactaccccaatttgcaagattggttt

SEQ ID NO: 42618 - DNA, 516 bp, Anabaena PCC7120
atggatttaaaatctctcattcgtgacatccctgattttcctaagcccggaattttatttcgagatatcactactctactgcgcgatcgccaaggattgcgatacactattgactttttagcggaaaaatgctctgaggcaaacttaaatatagattacgtgataggcatggagtcacgggggtttatttttggtactcccttagcctataaattaggggctggttttattcctgtccgcaaaaaaggtaagttacccgcagcagttcactcgattgagtatgaattagagtatggcactgactgtttagaagtacatcgggatgctttacatccagatagtcgagtgctaattgtagatgatttgattgccacaggtggcacagccagcgccaccgccaagctagtgcagcagattggctgcgaattagtgggatttgggtttattatcgagctacgggatttacaagggcgaaaacatctacccgatgtacccattatttccttagtggaatat

SEQ ID NO: 42619 - DNA, 375 bp, Anabaena PCC7120
tttgaataccctcaagatttaagatatttggatactcatgaatacgtgagactagatggcgaaatcgctactatcggtattacagaatttgctgtagatcaattgggtgatgtggtttttctagaactgccagacattggcgatttactaacaaaaggagacacttttggttcaattgaatcagtcaaagccgtcgaaaacttgaacgcaccaatcaccggaacagttgtagaacgcaacgaaattttggttgaatcgcccgaagcggttgcagatgatccctacggtgaaggttggttcttgaaggtgcgtgtgaatgatcctgacgaagtaaatgatgctttgacggcggatgaatatcgtgctgaggtagaa

SEQ ID NO: 42620 - DNA, 1815 bp, Anabaena PCC7120
  unsure (1)..(1815): unsure at all n locations
gtgacaccacaacgggtaactggtggcttcgcgctacttgatagcctgctgcgccacggcgttgagtatatctttggttatcctggtggggcgattctgccgatttatgatgatctgtataaggtggaagcaactggcagccttaaacatattctagtgagacacgaacaaggagcagctcatgctgctgatggttatgctcgtgcaaccggaaaagtaggtgtatgctttggtacttctgggcctggggcaactaacttggtaacaggtatcgctacagcctacatggattcaattccaatggtgattgttactgggcaagtaccccggaaaatgatcggtacagatgcgttccaagaaaccgatatctacggtattactctacccattgttaagcactcctatgtagtgcgtgacccccaagacatggcgcgaattgtggcagaagcattccacatagccagcacaggccgtccagggccagtgttgattgatgtgccgaaagatgtggcttttgaacaatttgattatgtacctgtagaaccaggttcaattaaattacgcggatatcgccccacggtgaagggaaatccacgccaaattaacgccgcgattgaattgatccgcgaaagccgtcgtcctttactatacgttggtggtggggcgatcgcatctggcgctcatgcagaaattcaagaactcgccgagttatttaatatccccgtcactaccaccctaatgggtatcggggcttttgatgaacaccatcctttatccttggggatgttggggatgcacggcacagcttacgctaactttgctgtgactgaatgtgatttattgatttgcgtgggtgctaggtntgatgaccgtgttactggcaanttagatgagtttgcttctcgtgccaaagtcattcacatcgatattgacnccgccgaagttggtaaaaaccgcattcctgaagtccccattgttggcgatgtgcggaaagtcttacttgatttattacgtcgttgcaaacaaacaagtgccaaaactacccccaaccaaaaccaagaatggcttaacttaattaaccgttggcgggaggattaccccctagtagttccccagcatccagacagcattcccccacaagaagtgattgtggaagtcggtagtcaagccccccacgccttctacaccactgatgttggtcaacatcaaatgtgggcagcccaattcctcaaaaatggcccccggcgttggatttctagcgcaggcttgggaactatgggttttggtttacctgccgcaattggcgctaaagtagctttcccagatgaacaagtaatctgtattagcggtgatgccagtttccaaatgtgtctgcaagagcttggtactgctgcacaatataagataaatgtcaagactgtaattctaaataacggctggcaagggatggtacgccaatggcaacaagcattccacggcgagcgctactcctgctcaaatatggaagtagggatgccagatgtagagttattggcacaagcctacggcattaagggtattgtagtcactcacagagagcaattgaaagatgcgatcgctcaaatgttagcctacgatggcccagttattttagatgttcgcgtcacaaaagacgagaattgctatcctatggtagctcctggtaagagtaatgctcaaatgattggtttaccgaagcaaccaccaaagaccagtgtcgaaccagtttattgcagccattgtggcacgtcaaatttaccaaatcacaatttctgttctgaatgtgggactaagttg

SEQ ID NO: 42621 - DNA, 1041 bp, Anabaena PCC7120
atgggttatggtgaagttgaaagctacgaagattttgctaactataacgaacaggcgctcaatctactgacagcaaaattcgcacctgtaccgacttggatttatccgccgttagcaaagttactggcgttatttgaccgtcacgaatggggacatcaacaccacgattttatttcccctcacaacgccatctttgaaaagcagcgtgctggcattgaacaaaatttacaagcaaaatggggcgatcgcattcaagttttcaaagcttttaatttttgcgctccttttttacctaaccaagttttggcggaaatcaaaagtcaaggttttgacaaaattctgatttatcccctactagtcgttgattccattttcaccagtgggattgctattgaacaagttaacaacgctttaactgagacaaatgatggtgaaaatcattggctgaaagcattacgttatataccttccttctataacgagccagaatacatccatttaatggctcatctggtagaggagaaaattaacgctgatttagccacagcttatttaccttcccaaattggcattgtgttgatgaatcatggttgtcctcacaaagccaaaggtttcacctctggaattgtcgaaagtcaagcgttgtacgacctggtgcgggaagagttaatttataagtatcccctcatttccgtgggttggctgaatcatgacacccccttaattgaatggacgcaacccaacgcagagcaagcagctaaaaacctgattcaattgggtgcaaaggttattatctttatgcctattggctttgctacagaaaaccacgaaactttactagatgtacaccacataattcatgatttagagaagaaatattctggtgtggattatgtgcagatggcttgtgtgaatgaccatccagagtttttggcgatggcggctgaatgggcaaatgctcagattgctgagttgcagcatgagcaagcagtggcaatcaacccacaattagctgtacatcatcatcaccatcatcactag

SEQ ID NO: 42622 - DNA, 1143 bp, Anabaena PCC7120
gccattgccgcgcacggtggacagttggttaatcgcgtagccacaccagcacaaagagaagagtttgtttccaaagctgagtttctgccccgtgtacaacttgacgaacgggcagtttctgatttagaaatgattgcgatcggtggttttagcccactcacagggtttatgaaccaagaagactacgatcgcgtggtttcggaaatgcgcttggctaacggtcttgcatggtcgataccaattacattatcggtcagtgaagaagtagcgtcttctttacaggaaggtagcctaattcgtctggataatcccgcaggtgactacattggggttttgcaactcacgcaaaagtatcgctacgataaaacccgtgaagccatcaacgtctaccgcacagatgatgccaagcacccaggggtacaagtgctttataatcaaggcgctgtgaatctggcaggtgatatatggctactggaacgcagttctcatcctctattccctgattatcaaattgacccagttgcttcacggcaaatgtttagagacaagggttggaagaccatagtcggctttcaaactcgtaatcccattcaccgcgcccatgaatatattcaaaagtgtgccttagaaaccgtggacggtttatttttacatcccttggtaggcgcaaccaaagaagatgatattgcagctgatgtgcggatgcgttgttatgaaattttgctagaacactattaccccgaagatagggtgatattggcaattaatcctgccgccatgcgttacgctggcccccgcgaagcaattttccatgctttagttcgcaaaaactacggctgcacccacttcatcgtcggacgagatcacgcgggagtcggtgactactacggaacctatgatgctcaatatatcttcgatgagtttgagcctggtgagttaggcattgtacccatgaagtttgaacacgccttctactgcacccgcaccaaacaaatggcgactaccaaaaccagccccagcagaccagaagaacgggttcacctatcgggaactaaagttagagaaatgctgcgtcgcggtgaattacccccaccagaattttctcgtcctgaagtagcagccgaattggcgcgggctatgcga

SEQ ID NO: 42623 - DNA, 1839 bp, Anabaena PCC7120
aaaccaccaaggttacggcaatttggcggcagtttcctaattctgctaactttgctgttattgcttaactttattgttcccagtttttctggccctcgcttgccacaggttccttatagtgaatttatcgctcaagtacaagctggtaaagtagacaaggcgattgtggggggcgatcgcattcaatactcgatcaaaactcaaacccccgatggtaaagtcgttgaccaagtatttgctaccacaccagtagctattgatttggacttaccaaagattctccgcaacaataatgtcgagtttgccgcaccaccaccagaccaaaacgcctggattggaaccctactaagttgggtagcaccaccattaattttctttgggatttgggcgtttttaattaatcgtcaaggtgctggcccggctgcattgacagttgggaaaagcaaagcccggatttactcagaaggtagcacaggggtgaaatttctcgatgtggctggggtcgatgaagccaaggcggaattagaagaaattgttgatttcttgaagaatgcgactaagtacacaaatttaggtgcgaaaattcctaaaggtgttttgttagtcggccctccggggactggtaaaacattattagcgaaggcgatcgctggtgaagctggtgtaccattcttcagtatctctggttcagaatttatcgagttgtttgttggtgtcggtgcggcgcgtgtccgtgacttatttgagcaagccaaaaaacaggctccctgcatcgtcttcatcgatgagttagacgcattaggtaaatctcgcggtggtgctggtggctttgttggtggtaacgacgaacgcgaacaaaccctcaaccagttgctcacagaaatggatggctttgatgctaatacaggtgtaattatcatcgccgctaccaaccgtcccgaagttctagaccctgctttgcgccgtcctggtcgctttgaccgtcaagtcgtggttgatcgccctgataaaattggtcgagaagcaattctcaaagtccacgccagaaatgtgaaattagctgatgatgtcgatttaggtaacatcgctatcaaaactcctggttttgccggtgcagatttagctaacctcgtcaatgaagcagcactgttagccgcaaggcaaaatcgccaagctgttgtgatggctgatttcaacgaagctattgaaaggttagtggctggcttagaaaaacgttctcgtgtcttgaatgaaaccgagaagaagactgtcgcctatcacgaagttggtcacgcaattatcggcgcattaatgcccggtgctggtagagttgagaaaatctctgttgttcctcgcggtgttggcgctttgggttatacaattcaaatgcctgaagaagaccgctttttgatgattgaagatgaaattcgcggtcgaattgctactctgttgggtggacgttcggcggaagaaacagtctttggtaaagtctccactggtgcaagtgatgatattcaaaaagccacggacttagcagaacgctacgtcactttatatggaatgagtgacaaattagggccagtagcttttgagaagattcaacaacaattcctcgaaggttacagtaatcctcgccgttccatcagcccaaaagtggctgaggaaatcgaccgcgaagtgaaacagattgtggataatgctcaccacatcgccttgagtatcctgcaaaataaccgtgacttgttggaagaaactgcacaagaacttttgcaaacagaaattctcgaaggtactgcacttagggaacgcctcagccaagctcaagcaccagaagaactg

SEQ ID NO: 42624 - DNA, 1374 bp, Anabaena PCC7120
atgcagatatcatcttccggctatatcctagcgttggacttgggaacaactggaaaccgggcatttatctttaacaatgcaggtaaaatagttgctcaagcatataaggaactaacacaacattacccccaaccaggatggttagagcatgacgcggaagaaatctggcaagatacctgctgggtgatgaagacagccatcgtcaatgcacaaatatctcctagtgaaattgcggctataggtttgactgtacaacgggaaacttgcctactctgggacaaaaccacggggagaccattacataaagccattgtttggcaagaccgccgcacggctcccctgtgtcatcagttacaggaaaaaggctatgctcaggaaatttacagtcgtactggtttagtagttgacgcttatttctccgcaactaaactccgatggttattagactacatcacaggcgttgatttaaaaaatgttttggcaggtacaatcgatacctggatattgtggaaattaacaggtgggaaagtccacgccaccgaccacagcaatgctagccgcaccatgttgatgaatttgaaaactggtgagtgggatgagcaactactagagattttgcaaattcctgcccatattctgccgcaaattcaacccagtttgggaaaatttggtgttacagataccagcttattagatgcagctatccccatcacagccattttaggcgatcaacaggcagctttgtttggtcatggctgcgatcgccccggtttaatgaaatgtacttatggcactggtagctttttagtagctcatactggctctaatattgttcgttctcaacatcaattaatttctacaatcgcctggacacaagccgataaacaggaaaatatcaatattggctatgctctagaaggcagtatgtttactagtggtgcttgtatccaatggttgcgtgacggcatcaagctaattaagacggctgctgaaactgagaccatggcaaatcaagtagccgataacggtggggtgtactttgtccccgcttttagtggactaggcgcaccctactgggatatgaacgctagaggagctttttttggcattacagccagcgtccaaccacagcatttagtccgggctgtattagaagcgatcgcctatcaagtgttagaagtagtacaagccatcaatgcctcttgtagtagccccatgcagcgcctaattgtcgatggtggtgcttgtgagaacaatttcctcatgcagttccaagcagatgttttaggtattcccgtagaacgtcccaccatgcgcgacacaacagtacaaggtgcagccttcgccgcaggtttagccgtgggattttgggat

SEQ ID NO: 42625 - DNA, 858 bp, Anabaena PCC7120
attaacactgcttttttcatgagtgcaacactttaccaacaaattcagcaattttacgatgcttcctctgggctgtgggaagagatttggggcgaacatatgcaccacggctattatggtgcagacggtactgaacaaaaaaaccgccgtcaggcgcaaattgatttaattgaagaattactcacttgggcaggagtacaaacagcagaaaatatactagatgtgggttgtggtattggtggtagttctctgtatttggcaggaaagttgaatgctaaagctacaggaattaccctgagtccagtgcaagccgctagagccacagaaagagccaaggaagctggtttaagtggtagaagtcagtttttagtggcaaatgcccaagcaatgccttttgatgataattcttttgacttggtgtggtcgctagaaagtggcgaacatatgccagataaaaccaagtttttgcaagagtgttatcgagtcttgaaaccgggcggtaagttaatcatggtgacatggtgtcatcgtcccactgataaaacaccactgacggctgatgaaaaaaaacacctagaagatatttatcgggtgtattgtttgccttatgtaatttcgttgccggagtatgaagcgatcgcacgtcaactaccattaaataatatccgcaccgccgactggtcgcaatccgtcgcccaattttggaacatagtcatcgattccgcctttaccccccaagcaatattcggcttactccgcgcaggttggactaccatccaaggagccttatcactaggcttaatgcgtcgcggctatgagcgcgggttaattcggtttgggttgctttgtggggataag

SEQ ID NO: 42626 - DNA, 912 bp, Anabaena PCC7120
gactggcaaggtgcagaaaacgcttttcgccaagcgttgcagcgagaacccaatttagcaatggctagagcttatctaggaaatatttacctgatgcaaaaccgtctagatgtggcggttcaggaatatggagaagcaattagacttaacccaaatttgggagaaacatattacaacctgggtttagcattgcaacaacaaggaaaaaaagagggtgctattacagcttatcgccaagctttagtgatagatcccagaagggtggaggcttattataacttgggtttggtattatacgaacaaggattattgcaggaggcgatcgccgcttaccaagatgcagttaatctcgaacccagtaaaatcaacgctcatcataatttagcgatcgccctgcaacaaacaggtaaaatggaggaggcgatcgttgcctatagagaagttttgaagttagatcccaaaaatgcggcagcttacagtagtttaggcagcctgatggcgatgcaaggacgaccagaggaagccatagccgcttatacccaagctgttcgccaagaccccaaaaacgccttagcttactataacttgggaataactttatataaccagggcgagctgcaaaaagctagtaacgccttcaaacgcgctcaggaagaatacagccaacaagggaacctggagcaaacagagaagactgagcagttaatgcagcaagttgctcagaaaatcgaggagcagaagctgcaacaaagacaagcatccacacccaagccgacagacaactctacaaataacctcttagaaaaactaactcaactaacagcaccaaaagaacaaccagctaattctggtgcagtacctgtctcggatgaacaaaagcagtttccaccaatattccctaataccaattct

SEQ ID NO: 42627 - DNA, 861 bp, Anabaena PCC7120
atgacaactcttacaggtaagacagtacttttaaccggcgcttcacgcggtcttggtgtctacattgctcgtgctttggcgaaagaacaggcaacggtagtttgtgtttctcgttctcaatcaggattagcccaaacgtgtaatgcggttaaggctgctggtggtaaagcgatcgctattccttttgatgtgaggaacacatcacaattatcggctcttgtccagcaggctcaagatattgtcggccctattgatgtcttgattaacaatgctggcatcgaaattaacggaacttttgcgaattactctctagcggaaatccaatcaatcttcaacactaatctattggctgctatggaattaacacgtttgttactacccagcatgatggaacgcggtagtggtcggattgtcaatattgcttctttagctggtaaaaagggcgttgctttcaacagcgtttactcagctagcaaggcaggtttgattatgtggactgatgcgatgcgtcaggaattagttggtactggtgtcaacatttcggtggtttgtccaggctatgtctcgcaaactgggatgactgttgatactcgtgtctctgcgcccaaattagcaggtatttctacgcccaaaagtgtagctaatgccgttgttaaagctattaaaaataaaacaaccgaagtaattgtcaatcaaaatcccatcacggaaagtttgacaaaattgatgttggctgtgggacaaatttctcccacttcggtggacagaatttatcgttggttcggtgtagtggatttcaaccaaaaacgggcggaaaatagagtcaaagacggctatgtagctgttgagtctcatcgctca

SEQ ID NO: 42628 - DNA, 945 bp, Anabaena PCC7120
atgcctaatctcaaatcaatacgcgatcgcattcagtcggtcaaaaacaccaagaaaatcacagaagccatgcggctggtagcggcggcgcgtgtacgtcgcgcccaagaacaagtaatcgctactcgtccttttgctgaccgtttggcacaagtattatacggtttgcaaactcgtctacggtttgaagatgtagacttacctctactgaaaaaacgggaagttaaatcagtaggcttgctagttatttctggcgatcgtggtttgtgcggcggttacaataccaacgtcatccgtcgtgccgaaaaccgcgccaaggaactcaaggcagaaggtctagattacacatttgttattgttgggcggaaagctgaacaatattttagacggcgtgagcaacccatcgatgctagttatactggcttagagcaaatccccaccgccgatgaagctaataaaattgctgacgaattgctctctttattcctctcagaaaaagtagaccgcatcgagttagtttacacccgcttcgtctccttggttagctctcgtcccgtcatccaaaccttgctaccccttgacactcaaggtttagaagcagccgatgacgaaatattccgtctgacaactcgtggcggtcaattccaagtggaacggcaaacagtgaccagccaagctcgccctttgccccgcgacatgatttttgaacaagacccagtacagattcttgattcactattgcccttgtatttaagcaaccagctattacgggcgctgcaagagtcagccgctagtgaattagccgcgcggatgacagcaatgagcaacgctagtgaaaacgctggtgaattaatcaagtctctttcactgtcctacaacaaagcccgtcaagccgccattacccaagaacttcttgaggttgttggtggtgcagaagcgttgact

SEQ ID NO: 42629 - DNA, 1518 bp, Anabaena PCC7120
atgagcatttcaattagacctgacgaaatcagcagtattattcagcagcaaatcgagcaatacgaccaagaagtcaaagttgctaacgtcggtactgtactacaagtaggtgacggtatcgcccggatctatggtctagaaaaggctatggctggggaacttttggaatttgaagacggcacagttggtatcgcccaaaacttagaagaagataacgttggtgcggtactgatgggtgaaggccgggaaattcaagaaggtagcaccgttactgctactggcagaattgctcaaatcggtgtcggtgaagccttaattggccgcgttgtcgatgctttgggtcgtgctattgacggtaaaggcgacatcaaagccagcgaaagccgcttgattgaatctcctgcgcctggtatcatcgctcgtcgttccgtacacgaaccgatgcaaaccggtatcactgcgattgactccatgattcctattggccgtggtcaacgggaattaatcattggtgaccgtcaaacaggtaaaactgcgatcgctatcgacaccatcattaaccaaaaaggtgaagatgtagtttgcgtttacgttgccattggtcaaaaagcttctaccgttgctaacgtagtccaaactctgcaagaaaaaggtgcaatggattacacagtagtagttgctgctggtgccagtgaacctgctaccctacaattcctggctccctacacaggcgctactattgctgagtacttcatgtacaaaggcaaagctaccttggtaatttacgacgacttatctaagcaagctcaagcttatcgccaaatgtccttgctgttacgtcgtccaccaggacgggaagcttaccctggagacgtattctacattcactctcgtttgttggaaagagcagcaaaactcagtgatgaactcggtaaaggtagcatgaccgcgctaccaatcatcgaaacccaagctggtgacgtttctgcctacattcctaccaacgtaatttctattacagacggtcagatattcttatcttctgacttatttaacgctggtattcgtccggctgtaaaccctggtatctctgtatcccgtgtgggttctgcggcacaaaccaaagcgatgaaaaaagttgctggtaagattaagctcgaactagcacagtttgacgacctccaagccttcgcgcaatttgcttccgacctagataaagccacccaagaccaattggcaagaggtcaacgcctgcgggaactcctcaaacagtcccaaaatcagcctctatccgtagctgaacaagtagccattctgtacgcaggtatcaacggttacttagatgatatccctgttgataaagtcaccaccttcaccaaaggcttgagagattacttgaagtccggcgttaacccctacttccaagacgtacaatcgaagaaagcactgggtgatgatgaagaaaaagcattgaaggcagctttagaagactacaaaaagaccttcaaagctacagcg

SEQ ID NO: 42630 - DNA, 549 bp, Anabaena PCC7120
atgacaagtaaagtagcaaacactgaggtagctcaaccttacgctcaggcactgttgtcaatcgccaaatcgaaaagcttgacggaagagttcggcacagatgcgcgtactttgctgaacctgctgacagaaaatcaacagctacgcaacttcatcgataacccctttattgcagctgagaacaaaaaagctctcatcaaacaaatattgagtgaagctagcccttacctacgtaacttcttactgttgttggtagataaacgacgcattttcttcttgccagagattttacagcagtatttggctctcttacggcaactgaatcaaaccgtattagcggaagttacttctgctgtggctttaacagaagatcaacagcaagcagttacagaaaaggtattggcactcaccaaagctcgtcaagtggaactggcaaccaaggtagacagtgacctgattggtggtgtgatcattaaagtaggctctcaggtaattgactctagtatccggggtcagttgcgtcgcctctccttgcgcttaagcaatagc

SEQ ID NO: 42631 - DNA, 1482 bp, Anabaena PCC7120
tttgatgtcatcgtgattgggtctggcattggcggactagtgacagcaacccaactcgcaaccaagggagcgaaagttctggtactagaaagctatatcattcctggtggaagtgctggctactttgagcgtcaaggctatcgttttgacgttggagcttccatgatttttggcttagggaacagagggactacaaacttactcacccgtgctttacaagctgtaaatagtagtgtagatgcgatcgccgatcctgtacaaatccactaccacttacccaacaacttaaacctgaaagttgaccgggtttatgataagtttttgcaaaatcttgctgcttactttcctcatgaaaaagaggggattcgtggcttttatgacgaatgttggcaagtatttaagtgtctcaaccgcatggagttgttgtcattagaagaacctcggtatttgctgcgatcgtttttgcaacatcctttagcgtgtctaggtttacttaagtatctgcctcaaaatgctggggatatcgcccgtcgctacatcaaagacccagaattattgaaatttatcgatatagaatgttactgctggtctgtagtgccagcagcgatgacaccgatgattaatgcaggtatggtcttttctgacaggcattatggcggtgttaactaccccaagggtggagtaggtcaaattgcccagaagctcgtagaaggcttagaaaaagctggtggcgagattcgatatcaagccaaagtagcaaaaatcattactgaaaaagactgtgctgtcggtgtgcaactaactaatggtgaaatttatcgaggcaaacggatagtttctaatgctacacggtgggacacatttgacaaattactacctgtagatcaaataccatctaatgagaaaaaatggcaacagaactataaaaaatcacccagttttttgagtttacacataggggtcaaagagtcagtcttacctcaagggacagaatgccatcatattatcttggaagattggcaaaatatgacccaaccagaaggcacactgtttgtctccatacccacattgcttgatccagaattagccccagaaggataccatataattcatgcctttacgcctaattggatgaatgattggcatgggttgtctgtgagtgactacgaagcgaagaaagaagagacagcctggcgaattattgacagactagaaaagatatttcctggcttagatgcaggtttagattatttagaagtaggcacaccccgtacccatcgccgctttttagggcgagaagacggcacttatggccccattcccagacgtaaactgcgaggattgttgtccatgccttttaatcgcaccgctatcaagggactgtattgtgtaggagacagtacatttcccggacagggtttaaatgcagtcgccttttctggcttcgcctgcgcccatcgtatcgccgtcgatttggggttg

SEQ ID NO: 42632 - DNA, 855 bp, Anabaena PCC7120
attacaggcaaaactaaactattaggggtaattggacatccggtggaacattcgctctcaccagtgatgcacaatgcagcgatcgctcaattaggattagattatgtatatctgccttttcctatagcaccagataatttagaagcagcgatcgctcttttggctactattggtgttgttggttttagtgtgaccattcctcacaaacaagcaatcatccccctgctttccgaaattagcccagttgctcaagctataggcgcggtaaatactgtcacccgtcaaaataatcaatgggtggggacaaacacagatatagaagggtttattgcccctttgcagacaacatataaacgagattggagtcagcaaatcgccgtaattttaggtaatggtggcgctgcgagagctgttgttgctggttgttatcaactgggttttgcggaaattcatgtggtggggcgcaatgtgcaacgcttagaagaatttcgccacagttgggaaaattcccccattgctgagaatttacaagtgcatacctgggattatctagcaaagctcatccctcaagctaacttactggtgaacacaaccccgatagggatgtatccgcaggttgatgagtcgcctttgagtgcagaggaactggtgaatttacaaactggtactattgcctatgatttgatatatattcccaaaccaacgcaatttctccaaaaagcccaacaacaaggcgcaattattatcgacggcttagaaatgttagttcagcaaggtgtagctgctttaaaaatttggttgcagcaggacgatattcctgtagatgtcatgcgtcaagctttaattaagcactta

SEQ ID NO: 42633 - DNA, 507 bp, Anabaena PCC7120
ccccacttcacccctgatggacaaatcaaggtggatatgggtttacctcggttactagctggggaaattccgacaactcttggtgctgctgatgggaaagtcattaaccaacccctagaagtagaagggcaaacttgggaagttacttgtgtcagcatggggaatccccactgtattacttttgtcgaagacgtggcggcgattcctttagaaatcatcggccctaaatttgaacatcacccagcatttccccaacggacaaacaccgaatttattcaagttgtcagccgtgactatttaaagatgcgtgtttgggaacgtggtgcaggaattactttagcttgcggtacaggggcttgtgcttccttggtagcggcggtattgactggaagaagcgatcgcctcgccactgtagaattacctggtggccccttggaaattgaatggtcagaagtagaccaaagaatttatatgaccggcccggctgatagggtattcacaggtaaa

SEQ ID NO: 42634 - DNA, 1128 bp, Anabaena PCC7120
gatgcagaaatcgctaaccgtatcaaagatgaatttttggcggttctctctcacgaactacgtacccccctcaaccctattttaggctggtcaaaattactgcgttctcgtcagtttgatgctgcaactacagaccgcgctttagaaactattgaacgcaacgctacactacaaacccagttaattgaagatttattagatgtctcacgcatcctccaaggaaaattaagcctcaatatttgtcctgtcagtttgccaattgtcattggagcagcaattgatactgtacggctagcagcagaagccaaagaaattaaaattcaaaatgtgttcgaccctaacttgggtcaagttatgggtgatgccaatcgtctacaacaagtagtctggaatctgctttctaacgcagttaaatttacatcccccggtggtacagtagaaatccatctcaaagccgttaatgatcaagcacagattcaagtaattgatacaggtaaaggaattacaccagagtttttaccttatgtgttcgattacttccgtcaggctgatggcacgacgacacgtaactttggtggcttaggtttaggactagcaattgtgcgtcaagtcgtagaactgcatggaggtacagttcaggccaaaagtccaggggacggattaggggctacttttaccgttaatttaccactctcacccaaaaatgaagcaatgaaccatgaggataaaaatcctgtatcagctaactttcaacctgccactctttcaggcgtgagagttttgattgtagatgatgaaccagacatccgcgacttagttacctttattctggaagattatgatgtaaaagtcatagccgtctcatcggcacaagaagccctagaagccctatcccaatctctaccagatattatagttagtgatattggaatgccagatgtagacggttatatgctgatgcgtcaactcagacaacgatcgccccaagaaggagggaatctgccggcgatcgccctcacagcctacgctggagaaattaatcaaaaacaagccctagccgccggattccaactgcacatatccaagcccgtagatccagatgctttaattgaggcgatcggtaatttg

SEQ ID NO: 42635 - DNA, 1899 bp, Anabaena PCC7120
atgtgtggcatcgttgggtatatcggaactcaagcagcaaccgagattttgttggctgggctagaaaaactagagtatcgcggttacgattccgcaggtatagctacggtttgggaaggagatgtaaattgtgtccgagccaagggcaaactccataacctgcgttctaaactagaacaactggctactccatctcaaattggtattggtcatacacgttgggcaactcatggcaaaccagaggagtataacgcccatccccatttagatacagctatgcgaatcgctgttgtgcagaatgggattattgaaaattaccgcgagttacgcgacgaactgaaacagaaaggacatgagtttcgttcggaaactgatacagaagttattcctcaccttatagccgaatttttaaaaaacctcccttcccccccgcttcctacttcttcctcccccttcctagaagcaatacgccaagctgttaagcacctacaaggggcatttgcgatcgctgttatctctgctgactatcctgacgaattgattgttgtccgccagcaagcgcccctggtgataggattcgggcaaggggagttcttttgcgcctccgacacgccagcgatcgtttcccatactcgtgcagtcttacccctggagaatggcgaaattgcccgtctgacacccctgggagtggagatttataactttgctggggacagactgaaaaaacaaccccgcctgcttaacttgaatcccacaatggtagagaagcagggattcaaacacttcatgctcaaggaaatttatgagcaaccaggagtagtcagagcgagtttagaagcatactttaatcccgatactaatactgatgaatcctttacatcaccagttaatttgggtttatctgaagaaatctatgcagatttagaacaaattcatattgtcgcctgtggtacgagttggcacgctgcattggtaggaaagtatttacttgaacaattagcaggaatctccactcaggtacattatgcttctgagtatcgctatgccccatcaccattaacagcgaatacattaattattggtgttactcagtcaggggaaactgctgataccctagccgccttagcgatggagaaagaacgccgccaaggcaaagaagccaaatatcaagcgcgactcttggggattaccaatcgcccagaaagcagccttggtcatcttgtaccccatattattaataccctggcaggaattgaaattggtgtggcagcgaccaaaacctttgttgcccaactgatggcgttttatgctctagctttggatttagcctatcatcgccaaacagtagcaccagataaactcgcagatattattcaaggtttacgtcagatacctaaggaaatcgaagctaccttagaacgtcaggaaaaactaacagaacatctagcccatgaatttgcagaaaccaaagacttcatctttttgggcagaggaattaacttccctattgctttagaaggagcattgaaattaaaagaaatcagctacattcacgcagaaggttatccagccggggaaatgaaacacggccccattgcattattagatgccaaagtgccggtagtggcgatcgcctatcctggtagtgtgtatgaaaaagtgatttccaattcccaagaagccaaagccagagattcccgcttaattggggtgacaccagtcaacgatggcgaagcggcggaaatctttaatgatttactacctgtttcatctgtggatgaattactatcgccgatcctcacagtagtaccattgcaactattggcttatcacattgccgcccgtcgcggtttggatgtggatcagcctcggaacttagcaaaatcagtgactgtggaa

SEQ ID NO: 42636 - DNA, 1452 bp, Anabaena PCC7120
atgaacttatcgtttcccgaactaggaatttcccaagaacgcgtagaacacttagaaaaacttggttttactgcaccaacaaacattcaagcccaagctatcccccaactgttgtcaggacgggatgtagttggtcaatcacaaacaggtacaggtaaaacagcagcattttcactgccaattttagagcgattagatcctcaacaaaaagcagtacaagccatagttttaaccccaacccgcgaattagcaatccaagtccacgatgcaatggcgcaattcgttggtaacagtggattacggactttagcaatttacggtggtcaatcaattgaccgtcaaatgctacaactcaaacgcggcgtgcatatcgtcgtcggtacaccagggcgagtaattgacctactagaacggggtaacctgaagctagatcaagtcaagtggtttgttttggatgaagccgatgaaatgttaagcatgggctttatcgacgatgtggagaaaattctttctcaagcaccccaagaccgtcagacagctttattctcagctaccatgccaccatcaattcggatgttggtcaacaagtttttgcgatcgcccgtcacagtcaccgtcgagcagccaaaagccacccccaataaaatcaatcaggtagcttatctcatcccccgtcactggacaaaagccagagccttacagccaattctggaaatggaagatccagaaacagctttaatctttgtccgcaccagacgtacagccgccgaactcaccagccaactgcaagcagccggtcacagtgtagacgaatatcatggtgacctgtcccaacaagcacgggaacggttattaactcggttccgcagccgtcaagttcgctgggtagtagcaactgacattgctgcacggggtttagatgtcgatcaactatctcatgtgatcaactacgacctacccgatagcgtcgaaacctacgtccaccggatcggtcgtactggtcgtgctggtaaagaaggtacagcaattaccttagtacaaccctttgagcgtcgcaaacagcaaattttcgagcgtcatgtccgccaaaattggcaattgctttccattcccacacgggcgcaaatcgaagcacgccacatcctgaaattgcaagagcaagtcagagaagccttagctggtgagcgtttagcttccttcttacccattgtcagcgaattgatcgaaaaatatgatgctcaagcgatcgccgcagcagcgctacaaatcgcttacgatcaaactcgtcctgcttggttaagtacagatgccgagattcccgaagaagtcgcatctactcctaaacccaaactaggcggtaagcgtcgtgagttttccggtgacagaggtcgttccaattggaacaaatctgacaataacaacagcgacgacgaaagacgcggtactcccaaa

SEQ ID NO: 42637 - DNA, 936 bp, Anabaena PCC7120
gtggaaacaattaccttagggaaaaatggccctaccgttacacccctttgtattggaacttgggcttggggagataagctgttttggaattatggcaatggctacggttcagaacagttgcaagaagcattcaccgccgctttagaagctggtgttaccttctttgacacagcagaagtttacggactaggactatcagaagaactattagggcaatttgtaaaacaggcaaaacaacctgtacaaattgccacaaaatttggccccttaccttggcgattttcaggacaatctgtttctgatgctttaacagacagcctcaagcgactgcaacttgagcgtgtggacttgtatcaggtgcattggccatttacttttttgttaagtcaagaaactttaatgaacaccttagccgatgaagtgaagcggggaaggattgctgccgtgggtgtgagtaattactcagcttcccaaatgcgccaagctcaccaaatattagccgctaggggtgtacctttggcagtgaaccaagtccgctattctttagtaagccgccaaatagaaactgaggggattgttgcaactgcccgtgagttggatgtaactattttggcttacagccccttagcacaaggtttacttacaggaaaatattctgctgacagtgatgaagttccaactggtgctagaagtatagacccaagatttaagaaagagggattgcaaaaaattgccccagtgatatctttactacgcagcttaggggaaaaatacgatcgcactcctgcccaagttgctttaaattggttaatcgctcaaggtaacgtaattcccattgctggagtgaaaactgcccagcaggtaagacaaaatgcaggcgctttaggttggagattaaatgatgaggaagttcaggagttagaaaaagttagtcgt

SEQ ID NO: 42638 - DNA, 822 bp, Anabaena PCC7120
atgggaatttgtggaaaattgggtgtagcggcgttggtggcgttgattgtcgggtgttcgcctgtccaatcccaagtgccaccattaactgaactttccccatcaatcagcgtgcatttactgctgggaaatcccagtggtgcaacgccaacaaagcttacacctgataattacctgatggtcaaaaatcaatatgcactctcctacaacaacagcaagggaactgctaactgggtagcttggcagcttaactcctcatggctagggaacgcagagcgtcaagataacttccgcccagacaaaacattgcctgcgggttgggtgcgagtgactccttctatgtactctgggagtggttatgaccgggggcatattgcaccttcagcagaccgcaccaagacaacagaagataatgcggctactttcctgatgacaaacatgatgccccaaacacccgataacaatagaaatacgtggggaaatttagaagattattgtcgagaattagtcagtcagggtaaagagctttacattgttgccgggcctaatggtagtcttggcaaacccctcaaaggtaaggtgacagttcccaaatccacttggaagattgttgtcgtactagatagcccaggctcagggcttgaaggtattactgctaatactcgcgttatcgcagtaaatattcccaacgacccagaattaaataatgactggagggcttataaagtcagtgttgatgaattagaaagtttgacgggttatgattttttgtctaatgtttcccccaatattcaaacaagtattgagagtaaagttgataat

SEQ ID NO: 42639 - DNA, 612 bp, Anabaena PCC7120
ctcccaatgatcattgtccatcatctcaacaactcgcgctcgcagcgtgtgctatggctacttgaagagttaggcatcgaatacgatatcaagttttacgaacgcgactccaagacgatgctagcaccagcatcactgcgccaagtccatccgctcggcaagtcaccagtgattacagatgcagaagtgactgttgctgagtccggcgctattatcgaatacatagtagagcgctacggcaatggtcagttaatcccaaaatccggtacgccagagcgtctgcgctacacctattggcttcattacgccgaaggttcggcaatgccacctctggtaatgaaccttatatttaaccgctttggggcaggggatagcggggcaaacgacgcatttatcgcgccccaaatcgagcttcactttgattacatagaagctgaacttggtaagagtacgtggtttgtaggctcagaatttaccgccgccgatatccaaatgagctttcctttggaattggttgtcctgcaagccgaacttatctcaagccgaccaaagattcaggaatttatcgaacgcatccatgcgcgacctgcctacaaacgcgcccttgaacgt

SEQ ID NO: 42640 - DNA, 1074 bp, Anabaena PCC7120
atgagtaaaagtaggcgaataggcattcttactagtggcggggattgctctggtttgaatgcagttatcagagctgttgttcattgtgctagcggtaaaggttgggaagtcttcggtattcggcaagcaactttaggattaatggcacgtccaccacaagtttctaaattagaaatcgaccaagttgatcctttattaacctctggtggcacaatgttaggaactaccaataaaggtgatccatttgcttttcccatgcctgatggtagtttttgtgatcgttcatcagaaattattgctggttatcatcaattagatttagatgcgttgattggcattggcggggatggtagtttagcaattctgcgtcgccttgcacaacaaggcgctatcaacttagtcggtatccctaaaactattgataatgatatcggtattactgaacacgccattggatttgatacagctgtcaatattgccacagaagcactcgatagattacatttcaccgccgcttctcatagtcgagtcatgattttagaagtcatgggtcgtgatgccggacacatcgccctcgctgcgggaattgctgggggtgcagatgtgattttaattcccgaaattctctacagcatggatgacatttgctaccacattaaacaccgtcaagaagaaggcaaaaactattgtttaattattgtctccgaagcagtacgaactcaagacggtgaaattctcaccctaactaatcgtttgggtcaatcacgatatggtggaattggcgaatatctagccgatcaaattagcgatcgcattggtgcagaaacacgagtcacagtcttaggacatatccaacgcggtggtatagcttcacctctagaccgattagtcgcatctgcttttggtgtagctgccgtcaatttgattgaggcagctaaatatgattacatggttgcttggcaaaatcgccaagtgattactgtaccaatagaggaagctatcgctcagtacaaagccgttaacccagaagatgctctggtcaaaactgctcgtggtttaggtatttatttagga

SEQ ID NO: 42641 - DNA, 606 bp, Anabaena PCC7120
gctgtttctgcgagagaagcacaaatacctttgaaggcgacgaacttccaagagtactataaccaaggagtgcaaaagcttgagcaaggcaacttcaatggtgcgatcgcagattttaactctgtagtacagatgaatccacggttttatgaaggtttttgccttcgtggtttagctaaatctcaattgagagacttcagtgcagccatctctgactttaacctagcgctgcggttaaatcccaagcatacagatgcttataatggtcggggaatttcttatgtagaactaggagattttcagaaagccattgccgactttaatcagacagtgaaaattgatccaaactcacaagatggttattacaatctaggactagcccattttagacagggaaatcatcagcaagcgatcgcagattttaataaagcactacaaatcaatcccaatttagctgatgcctatggcaaccgaggactggcacaatatgctttaggagacagtaagagtgctgttacagaccttcagcaagctgcaaaactgtttcttaaacaaggtgatacccaagcttatcaacaaacacaagccctgattcagcaaattcag

SEQ ID NO: 42642 - DNA, 2226 bp, Anabaena PCC7120
atagtttctctgcaaacgctacagctacaaattagcgggatggattgtggcagttgtgccaaaaccattgaggctggggtgcagaagatcataggcgtacaagaagcatcggtcagttttgccagcgaaagattgcatatatcctatgacccacaattggtgaatgagaaaacaatttatgaccggattcaagatttaggttacacggtcgaggagggtgttgaaacaagttccaatcatcacactgatgcttgtggtcatgaccacgagcatcatcacgaccatgactatagccataaccacgagcattctcagccaataaacaagtccaaacaaaaacaaaaatccgacttaacaagctggagattctggattgaaaatcgtcgaggacagagtgtcatacttgcaggtataggcttagttttaggtttacttactcagtatttagtactacccatctggattgcacgagctttttatggcattggtatagtaattgctggctatccgatcgcacgggctggtttgtttgagttgcgcttgcgccgcgccgatatgaatctgctgatgaccatttcggtgattggggcagtgattttaggagactggtttgaaggggggctggttgtctttttgttctctttaggcacaacattgcaagttttcacctttggtcgtacccgcaacgcaattcgctcactgatggatttgactccacctactgctacagttaagcgcgggaatcaggaatttacagttcccgtcgaaagtattcagctaggtgaaattttgacgattcgaccaggagggcgtgtggcgttggatggtgtggttgtttctggtaacagtgctattgaccaatctccaattacgggagagtcaatcccagaagataaagatgttggggatactgtctttgctggaacactaaatcagacaggttttttagaagttaaagttacgcacacttctagcgatacaaccgttgccaaaattattaatttggtggaacaagctcaagaaagccgcgcaccctcgcagcagtgggtggataagtttgcacaagtctacacaccgatagtgattttagcagcgattgccatcgccctaattccgcccttggcttttgctcaaccttttaacgtctggctttaccgcgcactggtcatgctagtaattgcttgtccctgtgccttagtcatttctaccccagtttccattgtcagtgctattggtgctgcaactcggcggggcgttttatttaaagggggtaatgcactggaaactgctggacatctgactacccttgcttttgataaaaccggcacaattacacaagggctaccgattgtgcagcaggtttatgacttgggggtggtgagtggagacatggtattattgcttgccgcttccttagaacaaaagtctgaacatcctttagcaaaagctattgtggtcaaggctcaagaactggggctagagttagaaactccccttaattttacagcattacccggtaaagggattcaggcaaactttggtgagcagttatatttagttggtaatcgacggttgttttcagaccaaggtatttgcttgtctgatgaagctgaatctttgttaactgaaattgaacaattcggtcaaattccggtgttggtagggacgaacggggggttattaggagcgatcgccctctctgatggcatccgcttagaagccaccgaagccctgcgacaattgcagagggttggattgaagcggttggtgatgttgacaggcgatcgcgcatctgtagcaaagcaaattgcccaacaagttggaattacagagtatcaggcagaactattacctgaagataaactccaagcaattcaacaattgcgtcgtcacggagtagtaggtatggttggggatggcattaacgatgcacctgctttagctacggcagatattagttttgctgtaggtggaattgatattgctttggagacagcagatgtggtgctggtaggtagtgacttgagacagctcgcttatgcagtagatttaagccgacgtactgtgtcagtgattcaacagaatgtggttttttctctggtaactaaggctttatttttactattggggacgtttgggtttgttggtttagcgatcgccgtcttagctgatacaggaacttctctgttagttactgcaaatggaatgcggctatttaaaaccaaa

SEQ ID NO: 42643 - DNA, 2238 bp, Anabaena PCC7120
gagaataccacactcaaactgcgtggcatgagttgtgcctcttgtgccagcagcattgaagacgcgattaattctgtccctggtgttaatgaatgtatcgtgaattttggagcagaacaggcaacaattgagtatgaccccagaagaactgatttagaagccattcaagaggcggtagatgcagcaggttattctgcctatccactccaaaaacaaaacctgatggcgggagacgatgatgcagagaaaagacatcgcttaagagaatcccgcgatttaatgcgaaaggtggcggtaggaggcatcattagcactgtgttagttataggttcattgcctatgatgacagggttgcacttaccctttatcccagtatggctgcataatccttgggtacagttgatactcactaccccagtccagttctggtgtggttactccttctacattaatggatggaaagccttaaaacgtcatgctgccacaatggataccctaatcgctttgggtacaagtgcggcgtatttttattcgctatttcccactttattccccagcttttttatcaatcaggggttaacgccagatgtatattatgaaactgctgcggtcgttattaccctaattctgctaggaagactatttgaaaatcgcgctaaaggacaaacttcagaagctatccgtaagctgattgggttacaagctaaaacagcgcgtttgattcgcaatggacgagaagtagatgtgccaatcgaagaagtacagattggtgatgtgatactggttcgtcctggtgagaaaattcccgttgatggcgaagtagttgacgggacatcgacaattgatgaagggatggtaacaggggaaagcgtgcctgtcaaaaagcaaccaggcgatgaagtgattggagctactattaacaaaactgggagttttaagtttcgggcaacacgagtcggaagtgatactgtgctggcgcagattgtccaattagtacagcaagcacagggttctaaagccccaattcagagattagcagaccaagtaactggatggtttgtacctgcggtaattgcgatcgcactgctcactttcatcatttggtttaattttacaggtaacgtgactttggcactgattaccactgttggggtactaattatcgcctgtccttgtgcgctgggtttagccacaccgacatctgtaatggtaggaacgggtaaaggtgcagaaaatggcattttgattaaaggtgctgaaagcttggaactggcgcacaaaattcaaacaatcgtgctggacaaaactggaaccatcactcagggtaaaccaacagtcaccgattttgtcaccgtcaacggtactgctaatggtaacgaaatcaggttggtgcaacttgcggcatctgtagaacgcaattccgaacatccattggcagaagcggttgtcagatacgcccaatctcaagaagtgacgttagcagatgtcaaggagtttgaagctgtagcaggtagtggtgtgcaaggtatagtttctgattctctcgtgcaaattggaacgcaacgctggatgtcagaattaggcattgacacccaagccttgcaacaggataaagagcgtttggaatatctgggtaaaactgcaatttggattgcggttgacagacaaattcagggattaatggggatttctgatgccatcaaacctacctccatacaagcaattagtgctttgcaaaaactgggtttagaggtggtgatgctcacaggtgataatcgccgcaccgccgaaaccattgcccgtgaagttggtatcaagcgtgttttggcagaagttcggcccgaccaaaaagccgctacagtgcagaaactacaatcagaaggaaagattgtagcaatggttggagatggtatcaatgatgcaccagcactagctcaagccgatgtcggaatggcaattggcactggtacagatgtagcgatcgccgcgagtgacatcacgcttatctccggtgacttgcgaagcattgtcacagccattcaactcagccgcgccacaattcgtaacattcgtcaaaacctattcttcgccttcatctacaacgttgctggcattccgattgctgcgggtattttgttccccatcttcggttggttacttaaccccattattgcaggtgcagcaatggcatttagttcggtttcagtggttacgaatgccctacgtctgcgtaaattt

SEQ ID NO: 42644 - DNA, 861 bp, Anabaena PCC7120
aaggttatgtccgttatgttcagtcccgatgggcagagattagctagcggtagtgctgacaaaactgtaagagtttggaatttagctaatgaagaaaccctcattcttaaaggacatggtaaatcgtcttggtctggaggagttaattctattgcttttagccccaacggcaagaccttagctagtgctagcgatgacaaaactattaaattatgggatgtcaatacaggagcagaaatcattgcttttacaggacatgaagaagcagtttactctgttagctttagtccagacggtaaaactttagttagtggtagtaaagataaaagtgtcaaactttggtcactagcaacaggaagagaactatattcacttaaaggacatttagatgatgttttatctgttgcttttagtccagatggtcaggttgtagctagtggcggtgctggtaatgataaaacaattaaaatttggcatctagctaaacaaaaagttcagactatcactgggcattccgaatggtttggaggtattaattctcttgcatttagtcccgatggtaatattttagctagcggtagttgggacaaaaatatcaagctatggcaatggcaaaatagtgaagaaatctgtaccctaacaggtcattctgatcacgtttgttgtgtatcttttagtccaaatggtaatattttagctagtgccagcaaggataagagtattaagttgtggcaagtagatactagaagtataataagtagtttcatagtacatgaagagtcagtttattctctcgcatttagcccagatggacagactttagccagtagtagcggagataagattatcaggattttacct

SEQ ID NO: 42645 - DNA, 846 bp, Anabaena PCC7120
aaaaccgcatgggtgttccccggacaaggttctcaagcactggggatgggaacagacttactagatataccaactgccaaagaaaaatttgctcaagctgaagcaatcttaggctggtctgtaagcgaaatctgccaaaacgaagaaaaattatcacagacactctacacccaacccagtctttatgtagtagagagtatccttgcagacctgacaaaagaacggggacaccagccagatttagttgctggtcatagtttaggagaatacatcgccctttacgttgccggcgtttttgagtggtcagctggtttaaaactagtcaagcgacgagctgaactcatggatagcgccgcaggcggcatgatggcggctatgatgaattttgaccgcgaacagttggaaacagtaatttcccagactcctgatgtggtgctagcaaacgataatagtccggcgcaagttgttatatccggtactccagaagctgtgcagacagttatgtctcaagtcaaagccaagcgtgctgtcccgttgaaagtttcgggagcatttcattcacacctcatgaatacggctgctgtagagttccaagaaattctggaaactgtagaatttcaacaggctagtgtacccgtattatcaaacgtcgagccagcgccggctgttgatgccgctattttaaaacaacgccttagccaacagatgactggttcagtgcgctggcgagaaatttctttaacattaccagccaacggcattgagaaagtcgtggaaatcggccctggtaatgtactaacaggtttgattaaacgcactactgctgatttaattttaaaaaacatc

SEQ ID NO: 42646 - DNA, 861 bp, Anabaena PCC7120
atccgccaacggcgtttagccctaccgactgaatcattaagcagtctggcggcggcggctagtagacaggcgatcgcctcggctggcattacagcatctgatatagatttgattttactggcaacttccacacctgatgatttgtttggtactgctactaaaatccaggctgaattgggagctaataaagccgtagcctttgatttaaccgccgcctgttccggctttgtcttcggtctagtcacagcagctcaatttatcagaactggcgtatatcagaatgtactgttgatcggggctgatattctctcccgttgggtagattggcaagacagacgtacttgcgtgttgtttggtgatggtgctggggcagttgtcttgcaggcgaactcaagcgatcgcttattgggatttgccctcaaaagtgatgggacacaaaaccattatctcaacctagcttatcaaggcactgccaaagaaattctccccaatgtcaagattactcaaggcacatatcaacccgtaaccatgaacggcaaagaagtttaccgctttgccgctcaaaaagtcccagaaatcattgataaagctctatttgaggctcaactaactgttgaccaaatcgattggctactactacatcaagcaaatcaacgcattcttgatactgtagctcaacgcctaaatattcctgcacacaaagtaattagtaatctcgctaattacggcaatacctccgccgcttccatccccctagccctagatgaagccgtgcgagaaggtaaaataaaaccaaacgatatcattgctacatccggctttggagcgggtctaacatggggtgcagcaattttccaatgg

SEQ ID NO: 42647 - DNA, 3282 bp, Anabaena PCC7120
atccccaaagtagggattcttttctaccgcgcccactatttggcgggaaatattcaggtgattgatgcgttgtgtgcggctttgtggcagagaaatttacagcctgtgccggtgtttatttcttctttgcgtgatcctgatgtgcaagcagagttgattgatttttttcagcctaaagattcccaacaaatttcacttttacttaacactacaagcttttcattagcccgtttagaaactgaagcaccccaaaccgaactttgggaaaaattagatgtcccagttttacaagtgattctcagtggcggatttgtcgaacaatgggaagcacagttaaacggactttctccccgtgatattgcgatgaacgtcgccttaccggaagtagatggcagaattattagccgggctgtctcatttaaggcaatacaaactcgcaatcccgatttagaaacagatgtggtagtttacgaaccaataagcgatcgcatcgactttgtagcccaactcgcagcaaattgggtacacctccgttcccaaccgccccaacagcgccgcattgctctaattttggcaaactaccccaaccgcgacggccgcctagctaatggtgtggggctagacacgccagaaagttgtgtagaaatcctcaaagctttacagcaatctgggtatgtcgtgtcaaacctacccgccaatggcgacgaattaattcaactgctcacggctggtgtaaccaatgacccagaaggcagagaaatacgcccagtacagcaaagcttatctagtgaggaatatcaagagtattttgctggtttaccagcaacagtgcagcagggtattaatgagcgttggggtagggattggggactaggagaacaagccagtaattttccctcgtcttcttgtcccattcctggtatccagttcggcaatgtcttcgtaggcatccagccatcacggggttatgatattgaccccaacttgaattatcatgcgccagatttagaaccgacccatgcttatttagctttttattattgggtgagagaatcttttggtgctgatgctgttgttcatgtgggaaaacatggcaacttagaatggctccctggtaaaagcttggctttatctagtaattgctatccagaagcagtttttggccctatgcctcacctatacccatttattgtcaatgaccctggtgaaggttcccaagccaagcgtcgcgctcaggcggtgattatagaccatcttacgcccccaatgacccgcgctgaactatacggcgctttgcaaaagctggaaaatttagttgatgagtattacgaagcagaaagtttagatccttcccgcttgggagtaatccgcgatcgcattcgtgatttagtcatccaagaaaatctttacaaagatttaggtattgaaaaggaagaagatatcgtcaattttgaatctctgattttgaactccttagatgggtatctctgcgaattgaaggaagcccaaatcagagacggcttgcacatttttgggcaatgtccccaaggacgacaactcagggatttaatagtagcgatcgctcgcatccccaaccgctactctacaggtatcaccagagccttagccaacgtttggggcttagacttcgaccccctcacagacaacttcagcaccccattatcaacacaagaccaaaaactgttagccgcaaaaaccccaaatccctgtcgcacagtcggcgatgccgtcacagccctagaagaacacgccgccctattagtagaacaactaatcaatccccccactgctcccgaagttcgcccggagggaaaccctccttgcgacttctcttcctgccccctgccctcctcctcatctccccctgccccacttaacacagtcctcaactggatcaaatccaaactcctcccatcccttcaacaaacccacgcagaaattaccaacctcctacatgggctagatggaggatatatacccagtgcagcttctggcgcacccacaaggggcagacctgaagttttgcctacagggagaaacttttatgctgttgatatacgcgccatccccacagaaactgcttgggatattggtagaaaagcagcagaaaacttggttgaatgttacacccaggagcatggcgagtatcccaaaacactaggcttatctgtatggggaactgcaacgatgcggactggtggcgatgatatagccgaagctttggctttattaggcgtacaaccagtatgggacggtgcagcacgacgggttgttgatttagatatactgcccttaagcatcttaggtagacctcgtgtcgatgtcaccttacgcatttccggcttcttccgtgacgctttccccaatttaatggatttattcgagcaagctgtcaacgcagttgcggctctggatgaacccccagaacaaaaccccctagccgcccaaatccgccaagacaccgatttttggatacaacaaggcttaactccagaaacagcctttgagcgatcgcgctatcgcctttttggttctaaaccaggtgcttacggagccggactccaaggcctaatcgaatcacaaaactggcaaaacgaccaagacctagccaacgcctatatcaactggagctgttacgcctattcttcaggcaaaagtcaagaagcagggacagaaattaatcccccatccccaatcccctctcccgaagcttttactcaacgtttaggacagatgcaaattgtcctgcaaaatcaagacaaccgcgaacacgacttgcttgattcggacgactattatcaatttcaaggtggtttaacggctgcgatacgttccctacaagggaaaaatcccgaaacatattttggtgataattccattccatcccaaccgcgtgtccgccaactgcgagaagaaattgccagagtgtatcgttctcgtgtggttaatcctaagtggattgagggaatgatgcgccacgggtataaaggtgcatttgaaatggcagccaccgtagattttctctttgcctatgatgccactaccagatgtgtagaagactatatgtatcaaggtgttatgcaggcctacttgcttgatccagtagtttgcacgtatattgagaataaaaatccccatgcactgcgtgatattgctgaaagactattagaggcaaaccaacgcggtttatgggaaaatgtgaatatagaaacacttgaaaacttgcgtaatttagtacatcaagctgaagcaaccatcgaa

SEQ ID NO: 42648 - DNA, 1134 bp, Anabaena PCC7120
ccaacaaataaacctcaagttactcatttctcctctggcccttgcgccaagcaccctggttggtctgtgtcgaatctggaaaacgcctgcttgggtcgttctcacaggtctgaagatggcaaagccaagctgtctgaagtgattgaacgttccaaacaaattctcggtttacctgctgattatcgtttaggtatcgttccggcttctgacacgggtgcagtggaaatggccttatggtcgctactgggacaaagacctctagacatcttggcatgggaaagttttggtcaggaatgggtcaaagatgttgtcgatgagttgaagttacctgatgtgcgtctgttgaaagcaccctatggcgggttacccaatttagatgaggttgattttagccatgatgtggtgtttttgtggaatggcacgacttctggtgtgagagtgccgaatggtgattggatcaaagacgatcgccaaggtctaaccatttgcgatgctacatctgccgtatttgcgatggatattccttgggaaaaaatagatgtattgacttactcttggcaaaaagtattgggtggagaagcccagcatggtgtgattgtcctctcaccccgtgctgtggaaagactcgaaacttatgaaccagcttggcctataccgaaaattttccgcctatcccaaaaaggcaaattaattgaaggcatttttaagggggataccatcaatacaccatcgatgttgtgtgtggaagatgccctagatgcgttgatttgggcggaaattgttggcggtttacctggtttaattagtcgtagtgaggccaacttagcagcgatcgctcaatgggtgaaacaaagcaattgggcagatttcttagctgagaaaccagaaactcgctcttgtacttcaatttgcttaaaaatcattgatgctgcctttgctagcttgagtgcagaagaccaaggcaaatttactaagaaactagcaaaacttttggaaaaacagcaagtggcttatgatattgccccctatcgtgctgcgcctccaggcttgcgaatttggggaggcgctacggtagaaactgctgatattgaagctctgcttccttggttagattgggcatacgtgactgtcaaa

SEQ ID NO: 42649 - DNA, 981 bp, Anabaena PCC7120
tcgacttggaatcgtcaccacgtcctttctttagctgactttactgctgctgaatacgatattgttttaaaaactgctgccagttttcaagaggtattatctcggcggacaaagaaagtaccagctttgcagggacaggtggtggcaaatttgttttttgaaccatctacgcgcactcggagtagttttgaacttgctgctaaacgcctcagtgcagatacgctaaactttgctgcgtctacttcttccatgaccaagggagagacaattctcgatacagcaaagacatatttggcaatgggtactgatattatggtgatccgccataaagaagcaggtgtaccaaatgcgatcgctcaagaaatggatcgtttaggtgtacgtgttagtgtcctcaatgctggcgatggtcaacatgagcatccctcccaaggactactggatttatttactatttgtagtttaatcgacccggccaatcctagattagagcttttgcaagggaaaaagatcgcgatcgttggtgatattcttcattcccgtgtagcgcgatccaatatttggagtttaattgctagtggcgcgcaagtgcatctagccgcaccacctactttattacccaaattttttgctgagtatatctttggagaagaaacagcacctcctggacaattatttatccattggcaattagaaccagctttgcaagaggctgattttgtcatgactttacgcttacaaaaagagcgtatgactgctaatttattacctagtttgcgagaatatcatcaattgtttggcattacccgcgctaaattgcaactatgtcagccaaatgtcaaagttttacatcccggccctgttaaccgtggtgtagaaatcagttccgatttgatggatgatccagaatttagtttgattcagtcccaagttaccagtggcgtagcggtacgcatggcattgttgtatttaataggtagt

SEQ ID NO: 42650 - DNA, 627 bp, Anabaena PCC7120
tttggtaaaaaattagcgttgcccacccctgaaaaagccttacctggaagggcgcaaattatgcctgtaccggctaaccactatgtcaacaagaacccactaaaacctccttttcctgacggttttgagaaagccttatttggtttgggttgtttttggggtgcagagcgtaagttttggcagcagcagggggtttacagcacagctgttggttatgcggctggttttactcccaaccccacctatgacgaagtatgtacaggcttgacaggtcacaacgaagttgtattggtagtatttgaccccaaggtaattagttacactcagctacttaaagtcttttgggaaagccacaaccctactcaaggaatgcgccaaggtaatgacgtggggactcagtatcgttcaggtatttacgtctattcagaggcgcaaaaacagctagcagaagcttcacgcgacgcttatcagcaagctctcagcagtgcagggtatgaaaagattacaacagaaatcctagatgcaccagagttctactacgcggaagcttatcatcagcagtacctagcgaaaaaccccaatggttattgtggtttaggtgggacgaatgttgcttgtcctgtgggt

SEQ ID NO: 42651 - DNA, 1659 bp, Anabaena PCC7120
caacaaaagaccctgaaaaattccgctttacaacaaacacctattgccattattggtatgtcagccttgtttgccaaagcagagaatttacaacaatattgggacaatatactagctagaatcaacggtatttctgaagttccagaaacagcttggagccttaaagattattatgatccagaccccagtacgcctgataaaacttacgccagagcagggggatttctcccagaaatcgattttgatcccttagaatttggattgccaccggatactcttgaagctttggattcagcaaatttattagcgttggtattggcaaaacaagcattgaaagatgctggttatagtgaaggaaaagaatttaatcgagaaacaacaggagtaattttaggggctagtggactttggaaaagtattactcccttaactgctcgtttacaatatcccgtttgggaaaaagttttaaaaaatagtggtctatccgcagaacagaccgaaaaaattattgaaaaaatgcaggcagcttttgtaccgtggacagaaaattctttcccaggtatgttgcctaatgtggtcgcaggaagaattaccaatcgtctagatttgggaggaactaactgtgttgttgatgcggcttgtgctagttctttaagtgctttaaaaatggcaattagtgaactgattgaaggtcgttgtgacatgatgttgaccgggggctttgacacagacaactccatcctcaactatatgtgtttcagtaaaaccccagctttttctaaaaaagactatcttaatccctttgatgctacatccgacggcatgatggtgggagaaggattaggaatgttagttatcaagcggttggcagatgcagaacgggatggcgatcgcatctatgcagtaataaaaggtattggcactgccagtgatggtcgctataaaagtatctatgcgccccgtgttgagggacaagtgcgagctttacggcgagcctatgaagatgcaggcttttctcctgcgactttaggattaatggaagctcatggtacaggtacgccagctggtgacttctgtgaatttaccgccctcaatcaagttttgacggaaaatcaggcaggaaaacaacaaatcgctcttggtagtgttaaatctcaaatcggtcacaccaaagctgctgctggcgctgctagtttaatcaaagcgaccctagccttacaccataaaatcctgccaccgaccattaatgtcacccaacctaatccgaaattcaaaatagaagagtctcccttttatatcaatacagaaactcgtccctggatacaaaatggcgacattcctagacgggcgggggtcagttcttttggatttggcggcactgactatcatgtggttttggaagaatataccccgacacttccccaaggaggcgatcgcatccattccacagcccaatctattttattgtgggctgatacgccacaacaattatctcaaaagtgtcaagcgactcttgagcaactgcaatctgacaacggcggcgaacaatataatcaactgcaaaatcacagcaaaacagccctcatccccgaaacatctgcccgtgtgggctttgtggctacctctctagaagaagcccaaaaattactaaaagcagcg

SEQ ID NO: 42652 - DNA, 3351 bp, Anabaena PCC7120
ggtcgagaacaggatattaataacttaattggcagaattagccgggctgaccaaaaattgattgtgattcacggtccctcaggggtggggaagagttccactgtgacggctggtttagtcccagcgttacaaaatcgggcgatcggtgatcaaattgccatgcctgtagtattgcaagtatacaccgattgggtgcgggaattagggaaggctttaactgaggctgtgactcatatttccggagatgtcagcattgcgccggagattttatcaacaccgacaccgccgatggatataggctatgctcgaccgatggcgatcgctgatatattaggacaattacgccaaaatgccaacaaccacctgatcacggtgctgattttcgaccagtttgaagaattcttctttggttatagcgatcgtcaacagaaaaaagaatttgatcaatttcttagtcaatgtctgaatatatcctttgtcaaaatcattctttccattagagaagattatttacatcgcttattagaatttaaacatctttcctacctggaagcgattaataataatattctcgataaacaaattcgttatcaattaaataatttttcgccagaatatgccaaagtcataattcaaaaattaacagcacgttctcaagtcaatttggaaccagctttaattgatgcggtggtggaagatttatcaaccgaactaggagaagtccgccccattgaattgcaggtggttggcgcacaaatccaagatgagcgcattaataccttaaaacaatatcagcaatatcgaccaaacaaactcatagaaagatatatcaaagaactaatcaaagagtgtggccctgaaaatgagcgtgcagctttacttgttttatatttgttaacagatgaaagcaacaaacgaccttttaaaacccgtgccgaattagctactgaattggcagagttagaagaccctgaaaaattagatttggtcttagatattttagttaattctggcttagttgtgttgtttcctgatattcccgaacgttatcaactaattcatgattatttagtcgatttaattcgttatctccaacaacaggaatccagcttacaagcacaacttgaccaattacgccgtaaagtccaacaaagtcaaagtgaaattgcccgcctcaaaagcgaactcagccaaaaaaagcaatctaaactcacagatactcatccccaacagggtttagatttagtcacggaattgcgggaattacgcaagcgagaggaactaactcaactagaaattgaacaattacgtggggaactgaaagaaaaggaattaaccgcccaactagccgaaagccagaaacaacaaaggctaagtgaagccaagctgaatcgttcactgaaaattgccctgactgcctcatgtctcgccattctggggttaagtgtttctattattacggcagtagacagcgaaattaaaaccctcagcgtctccagtgaagccctgtttgcttcccaaaaagggcttgatgcggtgaaagaaggtgtcaaagccgccagaaaactgcaacgggctatttgggtagacccttacaccagagaacaggtacagacagcactctatcaagccgttgtgggagtgagggaatacaaccgcttagaggggcataccgcaggagtaaacagtgcggtcttcagccccgatggttccctgattgcttccgccagcgccgataatactatcaatctctggcgtagtgatggcagcttaattaacaccttgtctaaacataccaatgtagtcaatagcgtcaacttcagccctgatgccttgttaattgcgtccgctagccaagacaaaacagtcaaactatggaaccgagttggtcaattagtgactactctacaagggcatggggatgtagtaaataatgctagttttagccccgatggttccctgattgcttctgggagtagcgacaagacggtaaaactatggagtcgagaagggaaattactcaacactttatcaggtcataatgatgcagttttgggcatagcttggacacctgatggtcaaactctcgcttccgtaggtgctgacaaaaacatcaagctttggaatcgggacggtaaactactcaaaacctggcaaggtcatgatgatgcaatcttgggtgtagcatggtcgcccaagggtgaaacaattgccaccgccagttttgatcagactattaaactgtggaatcgccaaggtaatttattaaaaaccttatcaggacacacggcgggagtcacagccgttaccttcagccctaacggtgaaactattggttccgccagtattgatgcaactttgaaactttggagtcctcaaggcctgctgttgggaaccttaaagggtcataacagttgggtaaatagtgtgagttttagccctgacggtcgcatctttgcctctggtagccgagataaaacggtgacactctggcgctgggatgaagtgctattacgaaatcccaaaggtgatggtaatgactgggtgacaagtattagctttagttctgatggtgaaactttggcggcggcgagtcgagaccaaactgtcaaaattttatctcggcatgggaaactattaaacaccttcaaggggcatacaggatcaatttggggcgtagcatggtcgccaaatcggcagatgatagcctcagccagtaaagatcaaacggtgaaattatggcatcaagatggcaaaatattacataccttacaaggtcatcaagatgcagttttagctgtagcctggtcgtcagatagtcaagttatagcttcagctggtaaagataaaatagtgaaaatctggagccagggagggcaactactccacaccttacaaggtcataccgatgcagttaattgggtcagttttagccctgacggtaagttgttagcctccgtcagcgatgataccaccgtgaagttatggagtcgagacggtcaactactccacaccctcaaggaacatagccgccgggtaaacggggtagcatggtcgccagatgggcaaattttagcttctgcaagtatcgacgggacagttaagctgtggaatcgagatggtagcctgtcaagaaatctaccgggtgatggtgatagttttattagtgtcagttttagccctgacggtaagatgttagctgctaatagtgatgatcaaatcaggctgtggaaccagaaagggacattgctcatggttttaaaaggcgacaaagatgaattaaccagtgttaccttcagtcctgacagtcaaattttggcagtaggcggcgggaatggtaaagtgattttc

SEQ ID NO: 42653 - DNA, 747 bp, Anabaena PCC7120
attgttttgattaccggcgcaagtagtgggattggtaatgcttgcgctaggatttttgctggtgcgggtgcaaaactgatcttggcggcgcgacggttggcaaggttgcagcagttggctgatgaactaaatcaagattttggtgtagagattcacttattacagttagatgtgcgcgatcgccctagtgttgaatctgctattgctagtttaccccctgcttggtcggcaatcgatattcttattaataacgctggtctcagtcgcggtttagataagctccatgaaggcgaccttcaagactgggaagagatgattgataccaatgttaaaggtctgctttatctgactcgttatgtggttccagggatggtaaatcgtggccgtggtcatgtcatcaaccttggttccatcgccggacatcaaacctatcctggtggtaatgtttactgtggaacaaaagctgccgtcaaggcaatttccgaaggcttaaaacaagatttgttaggtactccagtacgggtgacttctgttgaccctggtatggtagaaacggaatttagtgaagtccgctttcatggtgatacagaacgggcgaaaaaagtttaccaaggagtcaacccactgacaccagaggatgttgctgatgtcatctttttttgtgccacgcgatcgcctcatgtcaatattaatgaagtcatcctcatgcctgttgaccaggccagcgccactctagttcatcggcaa

SEQ ID NO: 42654 - DNA, 2947 bp, Anabaena PCC7120
gttagaaaagtgcatccaaggtttagaaattattgaaccaccaatcgccaaacaattttggcaagcggcgacagcatcggcggggatttatattgttcttgggggtaaagtcaggctattagatgacgctcacaacttaattacgaccgtttcaactggtgcatcctttggggaattgactctgtttcctgatgcagactttattccttatgtcgctagagcttcggtgaacttgaaattgggttatcttccccagacgattttacaagatttgatgggcgaaaattccagtgttggcgatcgcctgaaaaaacacgccgaaacttgggatttgttggtgttgtgttgtcaaaactctttgttgccgcaaaattcctcagttgaggagataatcaaagccttagctttatttgagcgacatagtttagatattggttccctaccatcacagatatttccagataccaagctgtggatattgcgtcgcggagaattggaaaataataacggacgcacattccaacccggaaccatctcccaatattcaaagcaaatcaattggcaagtcacacaatcagctattgtgtatattctcaagcaggagaattggcaagtagcacaggagtattggccggagttggggactggagattggggactggggactggggaaaacgcttctcagtcgcctttacctagtcttcgttctccggttgtgagggagccggaaccgcagccacagccaaaacaacgccgagcttatttccctagtcctcgtcttcaggttggtcattggtggggacgactgattaagcgctatcccatatttgagcaacaaagtgcggctgattgtggtgcggcttgtttggtgatgattagtcgctattggggtaagcgtttgagtgtgaaccgactgcgggatttaactaacgtcaatcgcagtggtgcatcgttgaagggtttaaccgccgccgccgaaaccattggttttactactcgtccggtaaaagctagctttgataaattagcacaacaacccttaccagcgatcgcccattgggagggtaaacactatattgtagtttatgagattaacaaaaaacaggtaattgtcggtgatccggcgatcggtcaacgtaacttgagtattgctgaatttaaagcgggttggactggttacgccttgttgttgcaaccgacaaccgagctgaaagaaaacgaagaagcaaatacatcattttggcaattatttgagttagtcaaaccccacacacgggtattagtagaggtattcagcgcttcggtattgattcaggtgtttggattaattacacccctatttacccaattattgttagatagggtgattgttcaaggaagcaccttaacattaaatgcagtcggtttggggttgatgatatttggcttatttcgtgtggtattgaacggactacggcaatatttgttagaccacacagccaaccgtatcagcatctcgctattggtaggttttattaaacataccttccgtttacccttgtcgttttttgagtcgcgttacgtcggggatattgtttctcgcgtccaagaaaaccaaaagattcaacgctttttaactggggaagcattgtcaatcattttagatttgttgacagtgtttatctatgtagctttgatgttttggtatagttcagcaatggcattgatgagtttagcgattgtaccgccttttatgttattggcaatcatcgctacaccctttttacgccgcattagtcgagaggtttttagtgctacagccaacgaaaatagttatctgattcaatccctttctggtattcgctcaattcgctcaatggcaatcgaacaaacagtacgttggcattgggaagaactgctgaataatgtcatcagaaaaaccttcagtggacagataattagtaacaaattacaaatttttagttctgccttagaaactctggtaactaccagcctactttggtttggggcatggttggtgattcaaaaccaactgactatcgggcaattagtcgcctttaatatgttgttaggtaatattatccgtccatttcaaaggctggtagttttgtggaatcaattacaagaagtggtgatttctacagaacgaattaatgatgttttagaggcagaaccagaggaagatttacaacaccaacatcggcaatttatcagtaatttacttggtcatatccgctttgacaatgtaacatttcgttaccatccagaaagcgatcgcaatattttagaaaacctcagctttgaaatcaagccagagcaaaccgtggctgtagtagggcgcagtggttccggcaaaaccactttatttaaactgattttgggtctataccctccgacagatggaaaagttctcattgatggcaaagatgtaactaatatagccctgcgatcgctccgttcacaaatcggcgttgtagaccaagatacatttttatttggcggcacaatccgcgaaaatatcagcattgctcacccagaggcttccttagaagaaattattgctgtcgcccgtttagcaggtgcggacgactttatcaaacaaatgccagcaggttatgaaacccaaattggtgaaggtggggggatgttgtctggcggacaaagacaacgtttagcgatcgcccgtgctttgttaggaaacccccgcctattgttgttagatgaagccacaagccatctcgattccgaatcggaacgcattattcaaaacaacctcaaaaccatcctcaaagggcgcacaagtgtcattattgctcaccgcctttccaccgtgcgccacgcagacttaattctggtattagatcgcggcttattagtcgaaagcggtaatcacgatcaattaattgccagaagagggcattacttttacctcaatcaacagcagttg

SEQ ID NO: 42655 - DNA, 1080 bp, Anabaena PCC7120
atgacttctgtaattaatgtgaatctaccaacgcagtcttatgagattgcgatcgcacctgcaagtttagatcagattggtcaaagcttggctgggttaaaactgggcaagaaagtattactggtttctaatcccacgatttttaagcatttcggcaaagttgctgttgattccttagaagctgctggatttcaagtagcaagttattctttgccagccggggaacgctataaaacccttaactctattcaaaaactatacgatatagccctagaaaatcgcctagaacgctcctccacaatggtggctttggggggaggggtaattggtgatatgactggctttgccgccgctacttggctacgggggattaatgtggtgcaagtacctaccacactcttagcaatggtagattcggctattggtggtaagacaggtgtgaatcatccccacgggaaaaacttgattggtgcgttccatcagccgcgattcgtgttaattgatccccaagtattaaaaaccttgcctgtacgtgaatttcgcgcaggaatggcggaggtaattaaatatggcgtgatttgggatgcagaattattcaaccagttggaacagagtaagcgtctcgaccaactgcgctacatcaaaccagaactggtggatgctatcttaactcgttcttgccaagctaaagctgatgttgtcggcaaagatgagaaagaaggtggactgagggcgattttgaattacggacacactgttggtcatgcggtggaaagcttaactaactatcggctactcaaacatggtgaagcagtaggtatcggtatggtagcggctgggcaaatcgctgtaaatttagaactgtggcaacaagcagatgcagaccgtcaaaatgccttaattgaaaaagcgggtttaccgacaaagttaccagtgggattagatattgaagggattattgaggcattgcaattagataaaaaagtcaaagatggtaaagtacggtttgttttaccaactcaaattggtgtagtgacagttactgatgaggtgacatcagatcacattcggcaagtttta

SEQ ID NO: 42656 - DNA, 1029 bp, Anabaena PCC7120
cggtctaatgttgaggctatggctagttatgtgcctggtgaacagccaccacaagggacacaggtgattaagctcaacagtaatgagaacccttaccctccttcacctgaggcattagcggcaataaaagatattgatggtgaatgcttacgacgatacccagaaccatttggggaagaatttagaaaggctgtaagtcaacttttaggtgttccttgtaattgggtgattgtgggtaatggcagtgacgaaatattaagcatagtcattcgtgcttgtgcagaaccgacgcgaaaggtggtttatcctgtgcctacttatgtgctttatcgcacattaaccgaaatgcaggcggcggacattttggagattccctatagggaatataacattttacctgtggcagacttgattgctgctcatggctctgtgacatttattgcatcgcctaatagtccatctggtcatgttgtaccaagtgatgacttacggaaattggctagtgaattatctggggttttagttatagatgaggcttatgtagactttgcggaagaaagtgccttgaatttagttcaagatcatgaaaatgtaattttgattcggacactttctaaaggatattccttagcaggattgcgtttaggatttggggttggaaatcctcaactattgaatggattgtttaaagtaaaagatagctataatgttgatgcgatcgcctgcaaagtagccacagcagccatcactgaccaagcttataaaaacgcttgcgtagccaaggttaaagcatcaagaactcggttagcaaaagacttaaagcaattaggtttttgtgtttgggattcccaagccaattttttactaactcaacctccccaggggaacgccgaatacctctatcaacaacttagagaaaagaagattttaatccgctacttcaaacaaccaggactagaagataagttacgtattactgtaggcactgatgagcaaaaccaaatcttgcttcaggcgttgagggatttg

SEQ ID NO: 42657 - DNA, 690 bp, Anabaena PCC7120
atgttaaatattcataatttaaataaatcctatggagatcgtcatgttcttcaagatttgactctcaatattattaacggtgaagtttacggtttactaggtgcaaatggctctggtaaaaccacaacaattaacattatttgtaatttactcaaagctgatagtggtgatattaaacttaataatcaggttatttctgaatcaaccaaaaagttaattggtgttgctcctcaagaaaatattttatataaaactttgacttgcgaagaaaatctccaattctttgcagaaatttatggcttaagtaaagaaaatattcaaaaacaaattaaagatattttagctgctgtcaacttatcagatagagcaaaaagtccggtagaaactttaagtggtgggatgcaacggcgattaaatattgctgtagcattagtacatcagccgaaactggtaattcttgatgaaccaactacaggtttagatatcgaagcacgttacgaaatttgggaattaattcgacaactgaaagctcagggaattacagttttactcactactcatttattagatgaagcagaacgcttatgtgaaaaaattggcatccttaaaaacggacagattttagtggagggtagtttagctgagttacgtaatttaattccagcacaagaaatattatcattgaaaact

SEQ ID NO: 42658 - DNA, 1389 bp, Anabaena PCC7120
accctgtttgataaagtttgggacttacacactgttggtacacttccttcagggctaacacagctatttattggactgcacctagtccatgaagtcactagtccacaagcctttgctatgttacgggaacgaggtttaaaggtactatttcctgagaggactgtggctacagtggatcacattgtacctacagagaatcaggcgcgtccctttgtcgatcgcttggctgaggaaatgatccaagcgctagagcagaattgtcaagaaaataacattactttttataacattggttccggtaaccaaggtatagtccacgtcatagcgccagaactgggactgacacagccgggaatgaccatcgcctgtggtgatagccacacttctagtcatggggcgtttggggcgatcgcttttggtattggtactagccaagtgcgggatgttctcgcctcccaaaccctatccctgtctaaactcaaagtccgtaaaattgaagttaacggcgcactcaaccctggggtttatgccaaagatgtcatcctgcatatcatccgtaccctgggagtgaaaggtggtgtaggttacgcctacgaatacgcaggtacgacctttgagcaaatgaacatggaagaacggatgactgtctgcaatatggctattgagggtggtgctagatgcggttatgtcaatcctgatcaagttacctacgattatctccaaggtagagactttgccccccaaggtgctgattgggaaaaagccgtgacttggtgggaatcgatcaagagtgatgctgatgctgaatacgatgatgtgatagtattcaacgctgcggatatccccccgaccgttacttggggaattacccctggtcagggtattggtgtcaatcagttgattcctcagccagaagaactattagaagaagaccgctttgtagctgaagaagcataccgttacatggatctatatcctggtcaaccgattaagggaacgaaaattgatgtttgctttatcggtagctgcacaaacggacgactcaccgacctgcaagaagcggcaaaaattgccaaaggtcgccgtgtggccgcaggagttaaggcttttgtggttcctggttccgaacgagtgaaaaaagctgccgaagctgaaggtttagataaaatctttgaggccgcaggctttgaatggcgggaacccggatgttctatgtgtttggccatgaaccccgacaaattagaagggagacaaattagcgcttcttcctccaaccgcaactttaaaggacgacaaggatcagcttccggtcgtactttgttaatgagtccggcgatggttgccactgcggcgattcagggggaagttgcggacgtgcgggagttgttg

SEQ ID NO: 42659 - DNA, 558 bp, Anabaena PCC7120
aaaaccattgttctcacaggtgcatcggcgggaattggccgaatgttggcaatttcgttgtcccaacaggatgcaaatttagtcttggctgctcgcaatcaagaagcattagaacagaccatgactgcttgcacaaactatccagggaaagtgattgcagtacatacagatgtaactcaagcagaagcttgccaacagttgatagaaagagcgatcgccacatttgggcaaattgatatcttaatcaataatgccggcattggaatgctcacccgctttgatgaggtgacagatatctctatttttgagcaggtaatgcaagctaactatctgggtgctgtttattgtacccattatgccctaccttacctgaaagcaagccaaggacaattagtggctatttcttcaatttgtggcaaaacaggtgtacccactcgtacaggttacgttgccagtaaacacgctatgcaaggcttttttgatacgttgcggattgaattgcattcaacaggagtggatgtattggttgtctcaccagggtttgtggcaactgatatc

SEQ ID NO: 42660 - DNA, 732 bp, Anabaena PCC7120
ctgattgtaggagctagccaaggcattggcttaggctttgtcaaaaaattgctacaagatgacagaattgccaaaatttatgccacctatcgccaaaaagactcagcatttgagttaattacactagaaaacgcatattcccaacgattaacttgtctatcattggatattactgatgagttacagatagctgaaatcttgcaacaaataaatattgaaactaatagattgcatttggtaattaactgtgtaggaatactacatgaaggagatttccaacctgaaaaaagtttgagacaacttaattcagaaaatttactccgttactttcaaattaacagcatcggtgctgttctcctagcaaaacatcttttacctttcttccgacataatgagcctagtgtttttgctagtatttccgctaaattgggcagcatcggtgataatcaacttggtggctggtacggctatcgcgcttctaaagcggcactcaatatgttcatgcgaactgtagccgttgagtatggcagaagttgccctaaaactacagtagtaactttacatccagggacaaccgatacacgtctttctcgaccctttcagaaaaatgtagccgccgaaaaactattttccattgaacgcactgttgaccaattattagctgtgattgcacaccttcgggaaggtgatagtggaaaatttttctcttgggatggaagtcaactgccttgg

SEQ ID NO: 42661 - DNA, 1536 bp, Anabaena PCC7120
atgcctcagaatccagaaagaactgtagaccacgttgatctattcaaacagccagaatacaccgagctatttgaaaacaagagaaagaactttgaaggcgctcatcctcctgaagaagttgaaagagtgtctgaatggacaaaatcttgggactaccgggaaaagaacttcgctcgtgaagctttaaccgttaaccctgctaaaggttgccaacctgtaggcgcgatgttcgctgctttgggttttgaaggtactctacctttcgtacaaggttctcaaggttgcgttgcttacttccgtacacacctcagccgtcactacaaagagccttgctccgcagtatcttcttccatgacagaagatgcagcagtattcggtggtttgaacaacatgatcgaaggtatgcaggtttcataccaactgtacaagcctaagatgattgctgtttgcaccacctgtatggcggaagttatcggagatgacttgggcgcgttcatcaccaactccaagaacgctggttctattcctcaagatttccccgtaccctttgctcacacacctagctttgttggttcccacatcactggctacgacaacatgatgaagggtattctgtctaacttgacagaaggtaagaagaaagctaccagcaacggcaaaattaacttcattcctggttttgatacctatgtaggtaacaaccgcgaattgaagcggatgatgggtgtaatgggtgttgactacaccatcctgtctgacagcagcgactactttgattcacctaacatgggtgaatacgaaatgtacccaggtggtacaaagctggaagatgcggctgattctatcaacgctaaagcaactgttgctctccaagcttacaccacacctaagacccgcgaatacatcaaaacccagtggaagcaagaaacacaagtattgcgccccttcggtgttaagggtactgacgagttcttgactgctgtttctgaattgaccggtaaagctattcctgaagaattggaaatcgaacgcggtcgtttagttgatgctatcactgactcctacgcttggattcatggtaagaagttcgctatctacggcgatccagatttgatcatctccatcaccagcttcttgttagaaatgggtgctgaaccagtacacatcctctgcaacaacggtgatgacaccttcaagaaagaaatggaagctatcctcgctgctagcccatttggtaaagaagctaaagtctggattcaaaaagacttgtggcacttccgttccttgttgttcaccgagcctgtagacttcttcatcggtaactcctacggtaagtacctgtggcgcgataccagcatcccaatggtgcggattggttatcctctcttcgatcgccaccacttacaccgctattctaccctcggctaccaaggtggtctaaatatcctcaactgggttgttaacaccctgttggatgaaatggatcgcagcaccaacatcactggtaagaccgatatctcctttgacttgatccgc

SEQ ID NO: 42662 - DNA, 1377 bp, Anabaena PCC7120
atgttgactcaattaccaaatcctattagtgtcccttcatggtggcaacttatcaattggattgctgatccgattggatttcagaaaaaatatagtaaaaagtatggcaacattttttccatgcagcttgctggaatcggctctttcgtaattttaggggagcctcaagctcttcaagaaattttcacccaagattctagatttgatgttggtcggggaaatacacttgcagagcctctcattgggcgaacttctcttatgttaatggatggcgatcgccatcgacgagaacgaaaattattaatgcccccctttcatggagaaaggctacaagcttatgctcaacaaatctgcttaattaccaaccagatcgccagcgaatggcaaattgggcaaccttttgttgctaggtctgccatgcagaaactgagtctagaggtgattatacaaattgtctttggtttagctgacggagaacgctatcaacaaataaagcctctattcacagattggctgaatatgactgattctcccttacgctccagtatgctttttctaaagtccctacaaaaagattggggaacctggactccttggggacagatgaaacataaacaacgttctatttatgatctactccaagcagaaatagaagagaaaagaacaaaggaaaatgagcagcgcggtgatgttctaagtttgatgatggcagcacgagatgaaaatgggcaagccatgacagacgaggaactaaaagatgaattgctaacaattttatttgctggacatgaaactaccgcaaccacaatagcgtgggctttctatcaaattttaaaaaatgtaaatgtgcaggaaaaattacagcaggaactcgacagattgggagcaaaccctaacccaatggaaattgcccagcttccttacctaacagcagtttctcaagaaactctgcggatgtatccagtcttaccaacactttttccacgcattaccaaatcatctataaatattgccggataccaattggaacctgacacaaccttaatggcgagtatatacctcatacattaccgggaagacttgtatcctaatcctcaacaatttcgaccagaacgttttatagaacggcaatattctccttcagaatacattccttttggtggtggaagtcgtcgctgtttgggatatgctctagctctgttagaaataaaattggttattgcaacagttctatcaaattatcaacttgctctagcggaagataaacctgttaacgtgcaacgacgtggatttaccctggctccagatggtggagttagggtaataatgactggcaaaaaatcattgaaatttgagcaaagtagcaagattttcaac

SEQ ID NO: 42663 - DNA, 1440 bp, Anabaena PCC7120
atgacacctcctgaaaacaagaatcttgtagatgaaaataaggaacttattcaagaagttctgaaagcttatcccgaaaaatctcgcaaaaagcgcgaaaaacacctcaacgtccacgaagaaaacaagtctgattgcggcgttaagtctaacatcaaatccgttcctggtgtaatgaccgcccgtggttgtgcttatgcaggttctaagggtgtggtttggggtcctattaaggacatgatccacatcagccacgggcctgtaggttgcggttactggtcttggtctggtcgtcgtaactactacgttggtgtaactggtatcaactctttcggtaccatgcacttcacctcagacttccaagaacgtgacatcgtgttcggtggtgacaaaaaactcactaaactcattgaagaactcgatgttcttttccctctcaaccgtggtgtttccattcaatctgaatgtcccattggtctaattggggatgacatcgaagctgttgctaagaaaacttctaagcaaattggtaagcctgttgtacccttacgttgcgaaggtttccgtggtgtgtctcagtccttaggacaccacatcgctaacgacgctatccgtgactggattttcccagaatacgacaagctcaagaaagaaaacagacttgacttcgagccaagcccctatgatgtagctctaatcggtgactacaacatcggtggtgacgcttgggccagccggatgctgttggaagaaatgggcttacgtgtagtagctcagtggtctggtgatggtacactcaacgagttgatccaaggccctgctgctaagttagtcctcatccactgctaccgttctatgaactacatctgccgtagtttggaagaacaatacggtatgccttggatggagttcaacttcttcggccccaccaagattgctgcttctttacgtgaaatcgcagctaagtttgattctaagattcaagaaaacgctgagaaggtaattgctaagtacacaccagtaatgaatgctgtactagataaataccgccctcgcttggaaggtaacaccgtaatgttgtacgtaggtggtctacgtcctcgccacgttgttcccgcttttgaagacctgggtatcaaagtagttggtactggctatgaattcgctcacaatgacgattacaaacgtaccacccactacatcgataacgccaccatcatttacgatgacgttaccgcctacgaatttgaagagttcgtaaaagctaagaagcctgatttaattgcttctggtattaaagagaagtacgtcttccaaaagatgggtcttcccttccgtcaaatgcactcttgggattactccgaacttggcgacggggtgcagatgtcagatgaggtaaggtttttttgtgaggggagaaaaaagagtctatttttagcc

SEQ ID NO: 42664 - DNA, 588 bp, Anabaena PCC7120
actgatgagaacaaagttattgcgattactggagctagtagcggtattggtgaagcaactgctagattgctggctcgccagggtttacgggttatgttaggggcgcggcgtaccgatcgattggaagcgatcgctgccgaaattcgctctaaaggtggcgaagcagaataccgcacccttgatgtcaccaacctcgaagatatgcaagcctttgtcgagtttgcccaagataaatttggtcgccttgatgttgtggtgaacaatgcgggcttgatgccgctttccaggctagaggtgctgaagatcgatgaatggaaccgcatgattgatgtgaacattcgcggtgtgcttcatgggattgctgctgcactacccctctttaagcagcaacgatcagggcagtttgtcaatctatcctcgattggcgggcataacgtctatccaaccgcagccgtgtactgcgccactaagtttgcagtttgggcgatttccgagggactgcggcaagaatcgacggacatccgggttacggtgatttcgcctggagtgacggaaactgaacttgccagcacgatcacggatgctaag

SEQ ID NO: 42665 - DNA, 645 bp, Anabaena PCC7120
caaggcgtgattttggacgtagatggtacattagttatcagtaatgatgctcatgctcaagcgtgggtagaagcatttgcagaatttggttatgaagtcaagtttgagcaagtccgtccactgattggtatgggaggcgaccaaattattcctcagtttgcgccggggttgtctgatgaacaaggaaaaggaaaggaaattgctgatcaacgcaaacaactaattatcaataagtttgccaaaaatttggctcctaccaatggtacgcggcaattaatattgaagatgcagtctctaggtttgcatctgatcattgccagttcagcttcaagtcaagaattgtcagttttgttaaaagctgcacaagtcgaagacctactcagccaggatgaagcaaccacatccagcgatgccgaagcttctaaacctgctcctgatattgttgaggtggctttgaacaggttgaatattgaaccatctgaggttgtgatgctgggtgatactccctacgatattacttcggcaaatcaagcagggattaaggtgattgctcttcgttgcggtggttttgatgatagccaactcaaggatgcgatcgccatttatgatgatccggcagatttgttaacacaatatcagcactca

SEQ ID NO: 42666 - DNA, 828 bp, Anabaena PCC7120
ccaagctctgtgggaacaattcttgctagtgctggtgctaaaagcattaagctttggaatcctaacacgggtaaactattgcgtactttatcaggacaagcttttactgtcagctttagcccagatggtcagattctcgctagtggttctcaggacggcagcctgaatttgtgggatgttcaaacagggaaactcatccgtacactccaacactcagaaccagtgcttggtgtagtttttagtccagatggacaaactttggttagtaatcttgatctcggatctatcatcaggctgtggaattggcgtactggagaaatcatccgcataaaggatgaccctgacgcttatcaaaaaggatttgagaacttcaaaactcaaccagccacttttagcctggatggtcaaacattatttgctacaagtggttctggttctatgctccagtcgtggaatctgaaaactagtaaacgaacaggcagtttcgatgcgaaatcatcaattaatgctgtcgctatcagcccagatggaaacaccctagctactggcattcgggataatgcaattaaactgtggaatattaatgatggtaaacttattcacactttaactggtcatcaaggtcaagtcagaactgttgcctttagcccagatggaacattactggctagtggtagctctgatggcactgtcaaattgtggaatgctactactggtaaagaaatcaacacttttacagcacacaaagaacaagtttggtctgtggctttcaatcctgatggcaaaacacttgctagtactggacaagatggcagtgttaagatttgg

SEQ ID NO: 42667 - DNA, 762 bp, Anabaena PCC7120
atgcaactaaaaccaatcaatcagcaggttgtttccgtcgttggggctgctagtgggattggacgagaagcggctattcgctttgctcaacgtggggctaaggttgttgtttctgcccgtagccaatcagggctagagtctttggtgagagagattacagactttggtggtgaagcaattgctgtagtcgctaacgtggaaaaatttgagcaagttaaggcgatcgctgataaaactgtagaggtatatggcagacttgatacttgggtacacgtttcagctattggactgtttgccaatttcgatgatattacaccagaagaatttaaacacgtcatcgatgtcaacctgatggggcaagtatacggtgcgatggctgcactcccccatttgaagcgtgagggacggggtgcattgattcacatatcttcaatggaagctaggcgatctctaccataccaaagtgcttattcctcatcaaaacatggggtagatgggtttattgatgctatgcgcctggaattgatccatgataaatggccgattagcgtcactagtattaaaccagccgtcatcaacacccctttctggaataatggtttaacaaagttaggagtcaaaccttcaggaacaccgccatactatgatcccaggttagtagctaacgccattctctatgcagccgaacatccaactcgtgatttattagttggagatgtagctaagatactggatttattacatcgcatctcgccagcgtta

SEQ ID NO: 42668 - DNA, 1134 bp, Anabaena PCC7120
gttgtcattactggtattgggctagtttcagccttgggtaagagcctagaggagagttggcaaggtttaattgcaggcaagtctggaataaaatggcatcaaccatttccagagttaccacctctacctttaggcttaattggtgaaaagccgactagtttgcacagcttgactcaggtggtggtggatgcggcaatcaaagatgcggggttagtaccacctttaactgattgtgcgctagtcattggttctagtcgcggttatcaaggatcgtgggaaaaactagcacggcaaatatatactggtgatgattctgcggatgaggcagaaaaattagagaattggttagatgttttaccccacatgaatacgatcgccgcagcgcgacaaattggggcgacaggggcagttatagcaccgatggcggcttgtgctaccggaatttgggcgatcgctcaagccgcaattcttatccagacagggcaatatcaacgcgtcattgctggagccacggaagcagcaattacacccttaaccttgtcagggtttcaacaaatgggagctttagccaaaaccggagcttacccctttgatttacagcgtgaaggtttagttttaggtgaaggggctgctgtatttgtcttggaatccagacaattagcaaaaaaacgtaaagccaagatttatggtcaaattttgggttttggcttgataaatgatgcttatcatagtactcaattagagccggaggggaagggggcgatcgcatctattcagcaatgtttagctcggagtcagctaacattgactgatatcgattacattcatgctcacggtacagctactcagctcaatgacagagtagaaagtcaagtaatcaaacatttatttccctcaaaagtagcagtcagttctaccaaaggcagtacaggccatactttaggcgcatcaggcgcattaggagtggctttttcacttctagctttagagcaaaaaataatacctccctgtgtgggattccaggaaccagaatttgatttgaatatagtaaaaacagcacaacacagccaaattcaacaggtgttgtgtctgagttttggttttggtggacagaatgcagctatagctttagga

SEQ ID NO: 42669 - DNA, 798 bp, Anabaena PCC7120
ccgcacaaatcgaatgtaaatactcacccttttcgcatactacaaggacacagcaatcgtgtcttttctgtagtcttcagttcaacaggacaattgcttgctagtggcagtgcagaccgtactattaaactgtggagtccgcatacagggcaatgtttacacactttacatggtcatggtagttgggtgtgggcaattgcttttagccttgatgataaattactcgcttctggtagctatgaccatacagtgaagatatgggatgtatcttctgggcaatgtttgcaaactttacaaggacatccgggttctgtcctggcagttgcttttagctgtgatggcaaaactctcttcagtagtggttatgaaaagctagttaaacagtgggatgtggaaacaggttattgccttcagacttgggaagcagattctaaccgagtttgggcagttgctgtgagtagggataatcaatatcttgctactggtggtgatgactcggtggtgcggttgtgggatattggcaaaggggtttgtgtgcgtacattctctggtcatactagccaggtcatctgtattttgttcaccaaagatggcagacgcatgattagcagtagtagcgatcgcaccatcaaaatttggaatgtctctacaggagagtgccttgctacgctacaagctcatgaccattgggtttggtcactctacctaaccccggacgagaaaactttgcttagtagcagttgggatgaaaccatcaaatgttggaatatttctacaggagagtgctggcaaacattg

SEQ ID NO: 42670 - DNA, 1501 bp, Anabaena PCC7120
atgtctaaaaaagttgcgattgtcggcgcaggccctggcggtttagctacagctatccgtcttgctggacttgggtatcaagtagaaatctttgaggcggctgaacgtgttggtggaagaatgcgcggttttgaagttgattcctacgcctttgatactggccccactattctccaactaccacacttatataaagagctttttgaggaggctggtttaaattttgccgactatgttcaactcaaacgtttagaaccatatacacgtttgaaattttgggatggtactcaactggatatcacttcggatctacagtcatttaaaacccaactggcaaccttacgctccgatttaccattagcatttgatcgctggtatagtgagcatatccgtaaatatgagttaggttacaaaccctatttagccggccctgcacgctctatttttggttacttgcgcccagatgaactgatgaagtttttgtcttttcgtccttgggaaaatttatatcaacacttttggcgattttttcaagatgagcgtttagtctatgctctgagctatccgtcaaaatatttgggaatgcacccaactgtggcatcaagtgtctttagcctgattccattcttagaattttcccaaggagtatggcatccagtcggtggatttcgtgcattagctcagggcttggctaatgccgctcaagacttaggagtgaaaattcatctgcattcgcctgttcaccaaatctggattgaacaagggcaagttcgtggtttggaactggctgatgcttctcgccatcagtttgatacagtagtgattaatgctgactttgcctatgctgttcgtcatctgttaccaacttcagcacgcggtcgttacactgataacaagcttgggcaaatgcaattctcatgctctaccttcatgctttatttgggtatcaatcgccgctacgaagatttacctcatcatcaaatctatttatcagacaatattcgccgacttgaacgtcccttgggttgatgattcagcactagatgaaactgatccaccattttatgtctgtaatcctacaattatcgaccccagtaatgcacctgccggccacagcactttatttgttttagtaccaattcccaacacttcttatgctgttgactgggatattaaacaaaaaagctatacagattttattcttaaacgtttacatttgctgggatatcacaatattgaacagcacattgttacccaaagttgttacacagcacaatcttggcttgatgattatcgcgttcatttgggtgctgtgtttaatctcagccacaatttgactcagcttgggccctttcgtccacccatccgttcggaaaatattgccggactgtactggattggtggcgctgttcatcccggcagtggtttactcactattttggaagcatctcgtagtgctgctggatttattcatcaagattttgcttcaactgggtcttag

SEQ ID NO: 42671 - DNA, 948 bp, Anabaena PCC7120
cccttacgcctgacagagttaccagtaccaaaacctaattctgagcaagtattgattcgtgttcatgcttgcgctgtctgtcgcacagatttacatatagttgatggagaattgacacacccaaaattacctttgatattggggcatcaaattgtggggacgattgaggcgttaggtgaaaaagttgatcaatttcatctaggtcaaagggttggtgtaccttggttaggtcatacttgcgctcattgtccttactgtctttctgggcgggaaaacctctgcgattatgctgagtttacaggttacaatctagacggaggctatgcagactatacagtagctgaccaccgcttttgttttcctttagaccccagttatccagatttacaagctgcacctctgttatgtggcggcttaattggctaccgggcttacaacatgactgggaatgctgagaaactaggtttttacggtttcggttcctctgctcatatcttaattcaattagcgcgttatcaagggcggaaagtatttgcttttactcgtcctggggatactgtaggtcaagaatttgcccgtcaattaggtgcaaattgggctggtgactcagatgtattaccgccagaacctttagatgcagcgattatttttgcaccagtcgggaaactagttcctaccgccttgcgtgcggttgctaaaggtggtgtagttgtttgtgctggtattcacatgagcgatattccctcctttccctacagcattctgtgggaagaacgggtgttaaggtctgtagctaatttaacacgccaagatggggaagagtttctgactatagcgccgcaaatccccattcgtactgaagttaattctttccccttaactcaagctaatgaggctttagatgctctacgtagtggcaaaatagaggggtctgccgttttagtgatg

SEQ ID NO: 42672 - DNA, 2064 bp, Anabaena PCC7120
aatcccttacttaaaggttctggcttgcctccatttacggaaattcaaccagaacaagtacaaccagcctttcaacaactattggcggaactggaacaagaactgactaccttagaggcaaatgtacagcctacttgggatggcttggtcgaacctttagaaaagttaagcgatcgcctgacctggagttggggtatagtaaatcatctagtgggtgtgaaaaatagcccaaaactacgtgtagcccatgaagctgtacaaccacaagtagtacaatttatcaacaagttgggacaaagccaacccatctacaacgcttttaaagaactccgcgccagcgatagttggaaaacgctcgactcagcccaacaaagaattgtggaagcagctattcgggatgctgaactatccggtgtgggcttgcaaggagaagcgcgggaacgtttcaatgccattcaaatggaattagcagaactggctaccaagttctctaaccacgtcctcgatgcaactacagcctttagtctcaccctcaccactaaagcggaagttgacggtttaccccaaagtttacttagtttagcagcacaagcagcacgggcagctggtgcagaaaacgccacaccagaaaatggcccttggcgcattactttagatattcccagttatagccccttcatgcagcacagcaccagacgtgatttgcgcgaaaagctttacaaaacttatattacccgcgcctcatctgatgaattagataacaaccccatcattgaacggactttagagttacgccaagaactggcaaacttattgggtttccaaaattatgccgagttgagcctagccagtaaaatggctcccaacgtggaagcggttgaagcactattagaagaattacgcagcgctagttacgatgcagccgttaaagacttagaagccttgaaagcctttgcagcctccaagggagcgccagaagccgcagacttacgacactgggatattagtttttgggctgaacgccaacgagaagaaaaatttgccttcaccgccgaagaactacgtccttactttcccctaccccaagtcctcgatggcttatttgcactggtgcatcggttgtttggcatcactgttaccccggcagatggccaagccccagtttggcacaaagatatccgttatttccaaatagctgatgaaacgggtagccccatcgcctatttctacctagacccctacagtcgtcccgccgaaaagcgtggcggtgcatggatggatacctgcatcaatcgcgccatcatcacagaaaatggtgtaacaactgtgcgtttacctgtggcttatttggtatgtaaccaaactccgccagtggacggtaaacctagtttgatgacattctatgaagtagaaaccctgttccatgaatttggtcatgggctacatcatatgctcaccaaggttaactacactggagccgcaggcatcaacaatgtagagtgggatgcggtagaactaccaagtcaatttatggaaaactggtgttatgaacgcaccacgttatttagcttggctaaacattaccaaactggggaaactctaccagaacattattatcaaaaactcctagccgcccgcaattatatgagtggtagcggtatcttgcgccaactccactttagcagcgttgatttggaattacactcccgctatcgcccaggtggtcaggaaaccgccgccgatgtgcgtcatcgagttgcccaaaagactactgtcttaccaccactaccagaagacgcttttctctgcgcttttggacatatctttgcaggtggttatgctgctggctattacagttacaagtgggcagaggtactaagtgctgatgctttcgcagcttttgaagatgctgggctggaagatgaagccgccattaaagctacaggtaggcgttatcgggatacggtgttagctcttggtggtagcaagcatccgatggaggtatttgcagcgttccgaggacgggaaccgagtacaacttctttgctcaagcataatggattg

SEQ ID NO: 42673 - DNA, 1194 bp, Anabaena PCC7120
gtctagtcaatgaagatattggtactaagttgggaatttccaccgagaatagttggcggtattgctcgtcatgtagcggaactataccctgaactggtaaagctagggcatgaaatccatctaattacggtagaagtcggtcaagcatcgatgtacgaagtcgtggagggaatacacgtacatcgagtaccagtttcttatagtcatgacttttttcactgggtggtcaatctgaaccaaagcatgggacatcatggtgggaagttaattgctgaggaagggccctttgatttaatccatgctcatgattggctagtaggagatgcagcgatcgctctcaagcataactttaaaattcccctgattgctaccatccacgccacagaatacggacgctacaacggtattcacaacgaaacccaacgctatatccacactaaagaaaacttactcgcctacaacgcctggcgaattatcgtctgtaccaactatatgcgccaagaagtagagcgcaccttagaaagtccctgggataaaatcgatgtgatttataacggtatccgaccagaaaagaaacagcaccacgaagattttcatgctcaagattttcgtcgtcaatttgccgaagaccatgagaagattgtctactacgttggtcgcatgacctatgaaaaaggtgtatcaaatttgctcaatgcagctcccaaagttctatcggagatgggcggctacgtgaaatttgtgattgttggtggtggtaatactgataatctcaaacgccaggcttgggatttaggaatttggcacaaatgttactttactggttttctttccgatgaatatttggacaaattccaaactgtggctgattgtgcagtatttcccagcctttatgaaccctttgggattgtagctttagaaagcttcgcctcgcgggttcccgtagtggtatccgatacaggcggcttccctgaggtagtgcaacatacccgaacaggtatcgtaacttgggtgaataaccacgattctttggcttggggaattctagaagttttgaaaaatccgggttatagtcaatggctgattgataacgcctataaggatttagaacatcgctttagctggccaaaattagcccaacaaaccgaagctgtttatcaacgagtggtgaaagagcgatcgcaagttgaatgg

SEQ ID NO: 42674 - DNA, 1119 bp, Anabaena PCC7120
agtgaagacagtgaatattttgctaaatgtgtagagcagttgggtattcccatcacactacatcctcatctggcgcaaatccaagtttcaggtaagggcggcgacatcccggcaaaacaagcagatttgtttgtgggtttagcgggtacagcagcaagatttatcacggcgttggtagcacttggtaatggggaatatcgcttagatggagttcctcggatgcgggaacgtccaatgggtgacttggtaacggtgctacaaaacagtggcataacaattaactttgagggcaactctggttttatgccctacactatttatggtcagcaatttgcaggtggacattttcgcctcaaagccaaccaaaccagtcagcaactttccgccttgctgatgattgcgccctacgcccaacaggatacaaccattgaggttgagggtacattggtttcccaatcttatgtaaaaatgacttgtcgcctgatggctgattttggtgtggatgtcacccaaactgacgacaaccaatttcatatcaaagcaggtcaacgttaccaagctcgacactatactatagaacccgatgcgtcgaatgcttcttactttttcgccgccgccgccgtcactggtggacgagtgcgggtgaaccatttaactaaacaatcttgccaaggtgatattttgtggctgaatgttttagaacagatgggttgtcaggtaattgagggtgcagattacaccgaagttattgggccagaacaattacaaggtatcgacattgatatgaatgatatgtcggatttggtgcaaacattgggagcgatcgccccttatgctagttcacctgttatcatccgtaatgtagaacatatccgctataaagaaaccgaacgcatccgcgccgtcgtcaccgaattacgtcgtttaggtgtgaaagttgaagaatttgccgacgggatgaaaattgaaccaacccccatcaccccagccgctatcgaaacctaccacgaccatagaatggcaatggcttttgccgttacaggcttaaaaaccccaggtattgtgattcaagacccaggttgtacagccaagacattccccgactactttacccgcttc

SEQ ID NO: 42675 - DNA, 1125 bp, Anabaena PCC7120
atggcccgcgactattatgagattctaggcgttgctcgtgacgctgacaaagaagaaatcaaacaagcctaccgccgtctagcccggaaatatcaccctgatgtgaataaagaaccgggagccgaagagcgttttaaggaaattaaccgtgcttatgaagtactttctgagccggaaacccgcgcacgttacgatcgcttcggtccggaaggtgtttcaggtgctggtgtcggcttccaagatatgagcgatatgggtggtttcgccgatatctttgaaagtattttcagtggttttgctggtggcggtatgggtggcccaacgcagcaaagaagacgcggcgggccagcgcggggtgatgatttacggctagacctaaagttagactttcgagaagcggtattcggtggggaaaaggaaattcgcatttcccatttagaaacctgtgaaacctgtagtggttcaggagcaaaaccaggaactcgtccccgcacttgttcgacttgtagcggttccggtcaagtccgccgcgtcaccagaaccccatttggtagctttactcaagtctctacttgtcctacctgtaatggtacaggcatggtaattgaagacaaatgtgatacttgtgatggtaaggggacaaatcaagttaccaaaaaactaaaaattaccattcccgcaggtgtggacaatggtacgcgcttacgtatcaaagacgaaggtgatgcgggtcaacgtggtggacctccaggggatttatatgtatacctattcgtcaatgaagacgaagaatttcaacgggatggcattaatgttatctcggaaattaaagttagctacttgcaagcaattttaggttgccggctagaagtaaacacagtagatgggcctgtggagttgattattcctgcgggtactcaaccgaatacggtgatgaaactagaaaatcgtggtgtacctcgcttggggaatcctgttagtcggggcgatcatctgttaacagtattaattgatatccccactaaagtaatccctgaggagagagaattgctagagaagctggctaaaattaagggagaccgtaccggtaaaggtggtctggaaggatttttgggaaatttgttt

SEQ ID NO: 42676 - DNA, 1826 bp, Anabaena PCC7120
atgggaaaagttattgggatcgacttaggcacgacaaatagttgtgtcgcggttttggaaggtggtcaaccgatagtgatcgccaattctgaaggcggaagaaccacaccgagcattgtggggtttggcaaaagtggcgatcgcttggtcggtcaactagcaaaacgccaagctgtaactaatgccgaaaacacgatttttagcattaaacggtttatcggtcgtcgttgggaagatacagaaacagaacgcgatcgtgtaccttatggctgtgtcaaaggtcgagatgatactgttgatgtgcagattcgtggacgaaattacacgccccaagaaatatccgctatgattctgcaaaaactcaaacaggacgcggaaaactttttgggtgaagcagttacacaagcagtaattaccgtacctgcctattttactgacgctcaaagacaagctactaaagatgctggtactattgccgggctggaagttttaagaattatcaatgaaccaacggctgcggctttagcctttgggttagaaaagcaagaccaagagcagctaattttagtttttgacttgggcggcggaacttttgacgtatcgatcctccaattgggggacggtgtatttgaagtcaaagccaccagtggtaataatcaactaggtggtgatgactttgacggctgtgtcgtgtgttggatgattgaacgattccaacaacaagaaaaaatcgacctagcccaagataagatggcgctgcaacgcttacgagaagcagccgagaaagctaaaattgaactctccagtatggcaagtacctcaattaacttgccttttattacggctgatgaaactggacccaagcatctagaaatggaacttagtcgttctaagtttgaagagttggtaggacagttaattgaagctaccatccagccaatgattcaagcccttaaagatgcagatctgaaaccacaagatatagataagattattttggtgggtggttctacccgtattccggcggtgcagaatgccttaatcaagttttttaacggtaaagccccagaccgttcggttaatcctgatgaagccgtagctctgggtgcagcaattcaagctggggtactaggtggcgaagttgataatctcttgctattggatgtcacacctttatctttagggattgaaactttaggagaagtattcaccaaaatcatcgaacgtaacaccacaattcctaccagcaaatctcaaatattttccactgctgttgatggtcaaacctcggtagaaatccacatcctccaaggtgaacggacaatggcacgggataacaagagctaaggcaaatttcttttggcaggcattcctccagcatcccgtggagtcccacaaattgaagtttcctttgaaaaatgatgtcaacggcattctcaaagttgctgctcaagataaaggcacagggcagagaacaaagtattagaattactaatactggtggattaagtaccaatgaagtggaaagaatgcggcaagaagcagaagtttttgcagaagaagataggagacgcaaagaactggtcgaattgaaaaatcaagcagataatttgttgattatttatgaatctactttaaaagataatggtgatttaattggagaacaaataaaagttttagccaacgaaaaagttgcacaaattcagagtgtaatgactaatcctgccatctccctcaaagagtttcaacaatgtttagatgatttccaacaaacactcttttctatcggcgctaatgtttaccagcgagctaacactcaaacagat

SEQ ID NO: 42677 - DNA, 930 bp, Anabaena PCC7120
ggggcttctctcactgcattaggcaatgcttaccgttacctgggagagtaccaacgggcgattgagttgttccagcagtctttggaaatatttagggatataggcgatcgcaacggcgtaagtaattccttaatcggtttaggcaatacttacaactccgtgggagagtaccaacgggcgattgagttgttccagcagtctttggaaatatcaagagatataggcgatcgcaatggcgtaggtggttccttaatgggtttaggcaatgcttacaactccgtgggagagtaccaacgggcgattgagttgttccagcagtctttggaaatatcgagagatataggcgatcgcaatggcgtaggtaattccttaattggtttaggcaatgcttaccattccttgggagagtaccaacgggcaattgagttccgccagcagtctttggaaatctttagggacatgggtgatcgcaatggcgtaagtatatccttaaacaatttaggcaatacttactacttcctgggagagtaccaacgggcgattgagttccaccagcagtctttggaaatatcaagggatataggtgattgcaatggtgtaggtagatctttaaacaatttaggcaatgcttactactctctgggaaagtaccaacaggcgattgagttccaccagcagtctttggaaatcaaaagggacataggcgatcgcaatggcgtaggtacatccttaaacaatttaggtactgcttactcctccctgggaaagtaccaacgggcgattgagttgttccagcagtctttggaaattaaaagggacataggcgatcgcaatggcgtaggtacatccttaatgaatttgagcaatgcttattatcggtgtggcaaaattcgagaagcatttgcagtctggcatcaagccgagtcgatt

SEQ ID NO: 42678 - DNA, 1272 bp, Anabaena PCC7120
caacatttaccttatacacctcgtttggtgacatccttaccggggcctagagctaaagcaattgtagaacgcgatcgcgctgttacttctccttcttatacccgcgactatcccttggtggtgaatcgtggtgaaggctgcatggtggaagatgtagacggcaatgtatttttagacatgacagcaggtatcgccgttacctccaccggacacgcccacccagaagtagttagggccattcaagaacagtcggcgcgtctcatacatatgtcggggacggatttctattatgagccgatggtggaactagccgaaaacctagccagccaagccccttttgttcacgatacaaaggtattcttcaccaattccggtgctgagtccaacgaaggagccattaaactagctcgatattacaccaagcgatcgctcatcattgcttttttaggcgcattccacgggcgcacctatggggctatgtctttgactggttctaaaactgtacagcgtgccaatttcgggccgttagtaccaggagtgactcacattccctacggcactcacgccagcctagattacctagaaaataatttattgactacaattatccctgcccatgaagtagcagccattgtcgttgaaccaatccagggagaaggcggttatatcgtgccagaggatggatttttgcagagaatccgtaatatctgcgatcgctatggcatattaatggtagttgatgaagtgcaatcaggcatggggcgcaccggacgcttatttgccattgagcattggaatgtcacacctgatattattaccaccgccaaaggtatcgctagcggtatgcctttaggcgcaattttagcccgtgctgaattgatgacttggcctcccggttcccacgccaccacattcggcggcaatccagtagcttgtgcggctggtattgtcaccctcaaactactagaaagtggcttgatggataacgccacccaaatgggcgaattattacaaactggtttaacccaactgcatgaacaattccccagaatgtccttacccagaggtaaaggattaatggtggcggtggatttattagatgaagacggtaattttgattctacattgcgcgatcgcattatccaagaagccttctatcacggactgttattactaggttgtggtaaagccgcaattcgtttttgtccaccgctagttatcaaccgcgaacaaatccaaaccagcctggatatcctcgcaggaattttaaga

SEQ ID NO: 42679 - DNA, 1326 bp, Anabaena PCC7120
cgcgatcgccgtcaaaaattagcccacctcatcgattttcccgcgattttatggtcaggtggtagcaatgcgcgcaattttcccgccaatcgttttccgtttcgggctagcagtcacttcctctattttgctggcttacccctacccaacgccgcaatttacctaaaagcaggtaagttaacattatttatcgatgatcctgcacccggtagcgccctatggcatggagaaacgccaaaacgtgaggaaatagctgaaactattggtgcggatgcagctcaacccttatcagaattaacgcctttcctggaaggtgcagccactattgccgtccaagatgctacaacttggacgcagcaatcccaactactgaacagatgggttttaccgcaaggtcagccagaaggaattgatttagaattagcgaaagcgatcgttaccttacgcctcacccacgacacaggcgcattagctgagttacgcaaagctgcaactgtgagtgtagcagcccacaaagccggcatggcagccaccaccaacgccaaaatagaagcagaaattagagccgcaatggaaagcgttttcctggctcacaacatgacgactgcttataacagtattgtcacagtccacggtgaagtcttacacaacgaacagtatcaccatcctctgcaaccaggggatttattactagccgatgtcggcggcgaaacagaattaggttgggctgctgatattacccgtacctggcctgtgtctggtaaattttctcccacacaacgggatatatatgatgtagtcttagcagcccatgatacctgcattgccaacatccgccctggtgtggagtatgcagagattcatctattaggggctagggttattgccgaaggtttggtaaatttaggcattttgcgaggtaatcccgaagatttagtagaaaaagatgcccatgctttatttttcccccacggtatcggtcatctcttgggtttggatgtccacgatatggaagacttgggcgatttagccggctatgaagaagggaagaaaaggagcgatcgcttcggcttaggctacctccgtttaaatcgtcccctacgtacaggaatgttagtcacaattgaacccggattctaccaagttcccgccatcttaaacgatgaaaaaactcgctcaagatatcaatacacagtcaattgggaacgcctatcacaatttaccgatgtccgaggaatccgcattgaagatgatgttttagttacagatacaggcagcgaagtcctcaccgccgccttgccaaatgacgctgataccatagaacat

SEQ ID NO: 42680 - DNA, 1557 bp, Anabaena PCC7120
cgttcaatatcgcgtcggctgttggcaatcttgatggcaacagtcgttctatggtggggatggacaccagaaatagcattagcacaaacgccaattgctctccaaccaagcaaaacaccaactgcaaaagttcctacttcaattcaaccctatctagaccgggtaattaaagatttgacggagttccggctggataatggcatgaagtttattgtcttagaacgccatcaagcaccagtagtttcctttctcacctacgcggatgttggaggtgtggatgaaccagatggtaaaactggtgtcgctcactttcttgagcatttggcgttcaaaggcactacacgcattggtacagaaaattatcaggctgaaaaacccttacttgagcgcttggagcagttagacacacaaattcgagcagcgaaagccaatggtaagcaagatgatgttgtgaggttgcaagcgactttcaaggaagtagaatcacaagctggcaaattagtcaaacaaaatgaactggggcaaattgtcgaacaatctgggggtgtaggtttaaacgccaatacctcaacggaagcgacacgttatttctacagtttcccgtccaataagttagaactgtggatgtcattggagtctgatcgatttcttgatcctgtaattcgccgggagttttataaagaaaaagatgtgattttagaagagcggcggatgcgggtggaaaattcacctattgggatgatggtggagaggttcattgatgctgcttataaagttcatccttacagacgaccggtgattggttacgaccaagatattcgtaacttaacgccagaagatgtacagacgttttttaacacttattacgtacccagtaatttgactattgctgttgtcggagatgtggaagtagctcaagtcaaacgcttggcgcaaacttactttggacgctacaaagcagcacctaagccacagtcaaaaattgccacagaacccaaacaaacacaaacacgagaagttactttagaactcgcttctcaaccttggtatttagaaggttatcatcgtcccgcaatgactcatccagataatgcggcgtatgatattattgccagcttgttaagtagtggacgcacatcaagactatataagtctttagtggaaaaagaacgtgtagcattaaacgctcaaggttttagtggttttcctggtgataaataccccaacttgatgctgttctatgctctcacggctcctaatcatacagttgatgaggtagcgctggctttaagtaaagaaattgacaagttgaaaactgaacctgtatctgcggtggaattagaacgggtaaaaactcaagccagagctggtttattacgcagcctcgattccaatatgggtatggcgcagcaacttctggaatatgaggtaaaaacaggttcttggcgcaatttgtttaaacaattagatgacattgtggctgtgactcctgcggatattcagcgagtggcaaaagcaacgtttacgccggaaaatcgcacaattggcaagttgtta

SEQ ID NO: 42681 - DNA, 1653 bp, Anabaena PCC7120
atggcaaaaattatttcgtttgatgaagaatcacggcgtgctttagagcggggtgtcaatgccctggctgatgctgtaaaaattaccttaggccccaagggtcgcaacgtgcttttagaaaaaaaatatggcacaccccaaattgtgaacgatggtattaccgtcgctaaagaaattgaattagaagatcctttagaaaatactggtgccagattaattcaagaggtagcatccaaaaccaaggatgtagctggcgatggcacaactacggctaccgttttagtacaagccctaattagagaaggtttgaagaacgtcgcggctggtactaacccagttagtctcaagcgcggtatagataaaactaccgaggctttggtagcggaaattgctaaggtcgccaagcctgtagaaggtagtgcgatcgctcaagttgccactgtctcatctggtaatgatgaagaagttggtgccatgattgcccaagcggtggaaaaagtcaccaaagacggtgtaatcactgtagaagaatctaaatccctgacaactgaactagaagtagtcgaagggatgcagattgacagaggttatatttccccctacttcatcaccaacaacgagcgccaaacggtggagttggaaaatgtgcggattttgattactgacaaaaaaatcagcagtattcaagaattagtccccgttctagaaaaagtagctcgtttgggtcaacccttactgatcattgctgaagatgtagaaggagatgccctagcaactttggtggtgaacaaagcacggggtgtactttctgtggcggcaattaaagccccaggatttggcgaacgccgcaaagcattgttgcaagatatcgctatcctcacagacggtcaactaatttcggaagaaattggcttaagcttagataccgcttctctagaagctttgggtacggcgcagaaaatcacaattgaaaaagacaacaccacaattgttgctggtaatactactaagccagaaatccaaaagcggattgcacaaattcgccgacagttggaagagactgactctgagtacgatagcgagaaattgcaagaacgtattgccaagttagctggtggtattgcagtgatcaaagtcggtgcagcaactgaaaccgaactcaaagaccgcaaactgagaatcgaagacgcactcaacgccaccaaagctgctgttgctgaaggtatcgttcctggtggcggcaaaactctgatttacttggcgagtaaggtagacgagattaagaaaaactttgacgaagaagaaaaaatcggtgctgacatcgttaaacgggctttagaagctcctttacgtcagattgccgataatgctggtgcagaaggttctgtcatcgtctccagagtcaaagacagcgatttcaacatcggttacaacgctgctactggggaatttgaagacctgattgcggctggtattattgaccctgcaaaagttgtgcgttcagcattgcaaaatgccgcttccattgccggtctagttttaaccaccgaagcgatcgttgtggaaaaaccagagaaaaaatctgctgctcctgctgatgccggtatgggtggcatgggcggcatgggtggtatgggcggtatgggtggcatg

SEQ ID NO: 42682 - DNA, 729 bp, Anabaena PCC7120
ttacgaggacaagttgccgttgttacaggcgcttcacgggggattggacgagcgatcgccttagaattagctaattatggtgctactgtagtggtcaattacgctagttctagcactgctgccgatgaggtagtagcagaaattacaggtgctggtggtgaagctgtagccttaaaagccgatgtttcacaagttgagcaagtagacaatctgatcaatggggcgatcgataagttcaaacgcatcgatattttggtaaataatgcaggtattacccgcgacacattgctattaagaatgaagccagaagactggcaagcagttattgaccttaacttaactggtgtatttttatgcactcgtgccgtcagtaaacttatgctcaagcaacgttctggcagaattatcaatattacctctgtagctggacaaatgggtaatcccggtcaggcgaattacagtgccgccaaagcaggtgtgattggctttacaaaaacagttgctaaagaattagcttctcgtggcattaccgttaacgccgtcgcccctggtttcatcgctacagacatgaccagcaacctcaaatctgagggtattttgcaatacatccctctaggtcgctatggtcaaccagaggaaattgccggtatggtacgtttcctagcagccgaccccgccgccgcctatattaccggacaagtatttaatgtcgatggcggtatggtgatg

SEQ ID NO: 42683 - DNA, 1419 bp, Anabaena PCC7120
tacatcaatggtcaatggttaaacgccgccacagaaaccaccctcaacagtcacaaccctgcggataagagcgaaatcgttgctactttcccccgttcccaggctgacgatgtagatagagccgtagccgccgcccgtcaagcctacggcagttggcgcaaagtcccagccccagccagagccgaatatatctttcgtgtcggtgaattattactccagcataaagaagaactagcccagttaattagtcgggaaatgggtaaacccttaactgaagccaggggcgatgtgcaggaaggtgttgactgtgctttttatagcgctggtgaaggacggcggttgtttgggcaaaccacaccatccgaaatgcccaacaaattcgccatgactatgcgaatgcccattggagtctgtgctttaattactccctggaacttccccgtagccattccttgctggaaagccatgccagctttggtttgtggcaatacggtgattctcaaacctgcggaagacacccccgcctgtgcgactaaattaattgagattttcgccgccgcaggtttaccaccgggcgtaattaacttggtgcatggagttggagaggaagtagggaaagctttagtcgaacatccaaatattgatttagtttcatttactggttcttccgccactggtgcctatgttggtgagacttgtggacgtacccacaagcgcgtctgtttggaaatgggcgggaaaaatgctcaagtggtgatggaagatgcagatttagagcttgcccttgatggggcattgtggggagccttcggcacaaccggacaacgttgtacagctaccagccgcttaattttacatcgtgacatcaaagaaaaatttacaaccatgctgcgtgaacgtaccagccaattacgcttgggtgcgggtactgagcctgagacagatatcgggccgataattaataaccgacagttgcaacgggtacatgaatatatgaatattgcccgtgaggaaggagctaaaattttaatcggtggcgaaattgccaccgagggacaattacaacagggttacttttttcaacccacgattttagataatgtcaccccacagatgcgcgttgcccgtgaagagatattcgggcctgtagtggcattgattgaggttagcacctttgaggaggcgatcgctatccttaacgataccaaatatggtctttcctcctcagtctacactcgtgacatcaatcgcgcctttgttgccatgcgcgacatcgaagccggtatcacctacatcaacggccccaccattggcgcagaagtacacttaccttttggtggtgtcaaacaaaccggtaacggacaccgggaagccggcaccaccgctttagatgtgtttacagaatggaaaagcgtttat

SEQ ID NO: 42684 - DNA, 1057 bp, Anabaena PCC7120
  unsure (1)..(1057): unsure at all n locations
ggtaatactttttttgaactacaacgatataaagacgcgttatctgcttatgaacaagcggttgatatcagaccagattatgctcctgcttggcagggcaaaggtaaaactttatttcggctcaaacaatatcaagacgcattgacagcttatgataaggcgattcaaatccaaccagattatgtagaagcttggagtggcaggggttttagtttgcaaaatttacagcgttattcagaagcgatnggcctcttttgataaggctttacaactcaatgaaaaatatccagaagtctggaatgctagaggggaagcttttagtaatttaaaacagtatgatcaagcaattaaatcttatgataaagccattgaatttaactcagatgcttatgagagtttttataacaagggattggctttgcaaagcatgaaagaatataatgaagccataaacgcctataataaagccattgaaattaaatcagattatgagagagcttggtataatttaggaaattcattagttaatttaaaccgttacgaagatgcttttaaggcttatgataaggcagtacaatataaaacagattatgctatagcttggttatcaagaggtaacgtattaattattttacgccgttatcccgaagcccttgaatcttttaatcaagtcataaaatttaatcctaataattatcaagcatggtatggcagaggttggtcacagcatcaaaatcaacgctatgcagaggcaatagaatcttataagaaagcggcaacaattaagcctagtaattatgagatttggtatagtttaggtaactcccaatacattttacagcaatatcaagaggcgatcgcatcttataacaaagcggtgcgttaccggccaaaacatattgaaagttggtatagtcggggaaatgccttatttagtttaaaacaatataaggaagcgatcgcatcctacgagcaagccattaaacataaaccagattatagccaagcaattaacgcccgtgacgaagcccagcgtcaactccaagccgcaacacca

SEQ ID NO: 42685 - DNA, 789 bp, Anabaena PCC7120
cttgttggaagataccaaattattagccacttgggaggagggggatttggtgaaacttttgtggcttgtgatactcatctaccagggttacctaagtgcgtagtgaaaaaactccaaccccaagcaaatgatccggctacgttggaaatagccaggcgattatttgatacagaggcgcaagttttatataagttgggaagttgcgatcgcattcctcagcttttggcttattttgaggaagatgcagagttctatctggtacaagaatttatccctggtcacgacctgagtaaagaattaacgccaggaaaggtctttactcaagatgaggtaacaatactattacaagagattctgaccatcttggaatttgtccatcagcaaaatgtaattcaccgtgacattaatccgcgaaatttgcttaggcgacaggatggtaagttaattctcatcgactttggggcagtgaagcaaatcaccacccaaatagtgacccccactggtgaaaataaatctactgtgattattggtacaccaggttacatacccggagaacaagcgcaaggtaatcccaaatttagtagtgatatctatgctgtggggatagttgcaattcaagcactcacgggattattaccccatcaactagaacatgatgccgatactcatgaaattatctggcaaaatcatgctcaagtctcgtcagagtttgccagatttatagacaaaatggtgtgttatgatttccgccaacgctatgcggcggcgacgactgcattacaagcactc

SEQ ID NO: 42686 - DNA, 1733 bp, Anabaena PCC7120
aaagcagagcgtgagtctctgtcatacggagagttgattcaaaaagttaatcaagagcaagtcaaaagagtagaactggacgaaactgaacagatagccaaagtttatttaaaaggtcaaaaaccagacgcaccaccaatacaggtgaggttgttggagcagaacaacgagttaattaatagactcaaagaaaaaaatgttgattttggcgagatttcttctgccaatagtagagcggctgtagggttattaattaacctgatgtggattttgccattggtggctttaatgctgctattcttgcgtcgttctacgaatgcttctagccaagccatgaactttggcaaatctagagcgcgtttccaaatggaagccaagactggggtaaaatttgacgacgtagcgggtattgaagaagcgaaggaagaattacaagaagttgtgacattcctcaagcagccagaaagatttacggctgtgggtgcgcgcatacctaaaggtgtgctgttggtggggcctccaggtactggtaaaactttactagcaaaagcgatcgctggggaagcggctgtgccatttttcagtatctctggttcggaatttgtggaaatgtttgtgggtgtaggtgcttcccgtgtccgtgatttgtttaagaaagctaaagacaatgcaccttgtctgatatttatcgatgaaatagatgcagttggcagacaacgaggtacgggtattggtggcggtaacgacgaaagagaacagaccctcaatcagttactcacggagatggatggttttgaaggtaacacaggcatcattattattgctgccactaaccgtcctgatgtattagattcagccttgttacgtcctggtcgttttgacagacaagtaattgttgatgcaccagacttgaaaggacgcttagagattttgcaagtccattcgcgcaataagaaagttgaccctagtgtatcactggaggcgatcgctcgccgcacacccggattcactgtgcagatttagctaacttactcaacgaagccgctatcctcacagcacgtaggcgcaaagaagcaattacgattctagaaatgatgatgcctgtgatagaatcctcgctggtatggaagggacacccctatgtgacagcaaaagcaaacgcttaattgcttaccatgaagtcggacaatggtttagtcgggacgctattaaaagaccatgacccagtgcagaaagttaccctcattcccagaggacaagcacagggtttaacttggtttactcccaacgaagaacaagggttaatctcccgttcccaactcaaagccagaattacttctactttggctggtcgtgctgctgaggagattgtctttggtaagccggaagtgaccacaggtgcaggggatgacctgcaaaaagtcacatcaatggcacggcaaatggtgacaaagtttggtatgtctgaattaggccccttgtctctggaaaatcaaagcggcgaggtatttttaggacgcgactggatgaataaatccgactattctgaagaaatcgccgccaagatagattctcaagtccgagaaattatcaacacttgctaccaaacatcaaaagaacttttgcaaactaatcgcgtggttatggaacggctagtagatttgttgacagaacaagaaactattgaaggtgatttgttccgtaaaattgttagcgaaagtcaaaatccagta

SEQ ID NO: 42687 - DNA, 1635 bp, Anabaena PCC7120
aagaaaatcgcagccgatgaacatttttatggttttggagaacgtacaggcttacttgaccaaatagccacaatcagaaccaactgggcttgcgatgcccttgattacgatgttctcacagacaatatgtatcaggcgattcccttctttatggcgttgcgtccagggttgggttacggtattttctttaacactactttttggagtcagtttgatctcggtgttcaggaacccggtgtttggcggatggaaacccaagaaggcgaactagactattacattatttacggccccgaaccagcaaaaatcctggctacttatacccagttaaccggacgaatgtcattaccaccaaaatggtcactgggttatcatcagtgtcgctggagttatgaatcacaggatatagtccgtcaactagctaaggaatttcgtcagcgtcaaattccttgtgatgtcatccatctcgatattgattatatggacgggtatcgggtgtttacctggaatcctaagcggtttagtgagccgaaagctttgatagatgacctcaagcaagatggttttcaggcggtgacgattgttgaccctggggtgaagtacgagccggaagccgattacccagtctttgatgagggattgcagaaggattattttgtcagaaaaaccaatggtcaattatttcatgggtatgtgtggcctgataaagctgtgtttcctgattttgtgcgcccagaagttagagattggtggggaagttggcacaaaaatctgataagtatgggtgtggctggtatctggaatgacatgaacgaaccagcattagatgaccgtccttttggcgaccctggtaataaaatttctttccctcttgatgctcctcaaggatcagcagatgagatgagtaaccatgcagcaacccataatttgtatggtttgatgatggcgcaagcatcttcccaagcaatgcaaaagttacgtccggtggaacgctcatttattttgacacgctctggttatgcagggattcagcgttggtcagcagtttggacgggagataatcaatctctctgggaacacctggaaatgtctttagcaatgttatgtaacttaggcttatcgggtgtagcttttgtaggggctgatattggtggttttgcggggaatgctacctcagaactatttgcccgttggatgcaggtgggaatgctgtatcccttaatgcggggacactcagcactaagtaccgccagacacgaaccctgggtatttggcgatcgcactgagaaaatttgccgcgaatatattcaattgcgttaccaactgctaccttacatctacacgctgttttgggaagctgcaaccactggtgcgccgattctccgccctttactttatcacttccccagcgatcgccaaaccttcagtatggctgatcaggtgatgcttggtgcttctttacttgcagcccccgtctaccgccctggtgtggaatatcgggcagtctacttacctgaaggttgctggtatgattggtggactggtgaagcttttacaggcccaacaaacatcttagcccatgcacccctagaaagaatgcccctatatgtccgtgctggtgcaattataccgatg

SEQ ID NO: 42688 - DNA, 1321 bp, Anabaena PCC7120
ctacccaacggccccagaataccccggttgttacggttgtttaagtttattactcaaccaatacagtatgtggaagattttgccaaagtctacggtgacaacttcactatctgggggagtggagaaagttattttgtctactttagccatccccaagcattggaacagatttttactaatgttagttgttttgagagtagtggtggaggtagtccgcttttagaacttttattgggtaagaattctttaattttactagaaggcgatcgccatcagcgccaacgtcaactattaaccccacctttccacggtgaaaggatgcgggcttatggtcaaactattcgtgaaataactcaacaagtcactcaagcatggcaaatgggtaagcccttcaatatccgggcttccatgcaggaaattaccatgcgtgtcattttgcgggtagtgtttggtgttgatgagggggaattgtttcaagaactgcggcaattgctaactaccctgttagatttcatgggttctcctctaatgtccagcaccttcttttttagtttcacgcaaaaggactatggtgcatggagtccttgggggcgaatggtgcgcctcatcaaaaaaattgaccaactgatttacgctttgattgctcaacgtcgggctgagtttggcgaaaatcgtcaagatatccttagtttattaatttcggcacgttatgacgacggacagccaatgtcagacgtagagttacgggatgaattaatgacaatgttggttgcaggacatgaaaccactgcttcagccttgacttgggcgttttattggattgatagcgtaccagaagtacgtgaaaagttatttcaggaattagatacactgaatgacgattcagaacccagtattattgccaaattgccttatttaacagcagtttgccaagaaaccctacgcttttatcctattgtgctgaatgctttcttccggcgaacaaaaaaccctatggaaattatgggctacaaactgccgaaagcaacattagttgttcctagtatttatttagcccatcatcgagaagaagtttatccgcaatccaagcaattccgaccagaacgctttttagaaaagcaattctccccttacgaatacttaccctttggcggcggtaatcggcgctggcatcggtctagcatttgcccaatatgaaatgaaaattgtcttagcaacaattttgtcacaattccaagtatctagactcagtaagcgtccggtgcagcctgtgcgtcggggattaactttggcagcaccaggaggaatgaagatggtggct

SEQ ID NO: 42689 - DNA, 798 bp, Anabaena PCC7120
ttagtgagtgctagcgaagatcaaactattaaagtttggaatctagaaacagcaaaggttacaaccacactgcaaggacataccgatacagtacgggcgatcgctctcaccccagatgaccagactttgatcagtgggagtgcagacaagacaattaaaatctggaatctccagagattaaggataaaaagaactctgagttctcatgctggtggtatttggtcactggctatcagcagcgatggacaaacactggtcactgctcacgaaaatggtagtatccaaatttggaactttcccacaggacaactactccgcacaattaagggacatcaaggtcggattttctctgtggcgatgagtcccgatggggaaacttttgctactggtggcattgataaaaagatcaaaatttggaacttatatacaggggaatgcctccacacaatcaccgaacatcaggacacagtaagagcgttggtcttcagccgtgatggtaagatgctggctagcagtagttgggataaaagcattaagatttggcaaatgcccacaggtaaattactacataccttgcttgggcatacttcacgagtggtaactctgaatttgggaattgatgaacaaaccctcgtcagtggcagccttgacaataagctcaaaatctgggatatgcaaacgggaaaattacttgacaccatatctggacatacagactggattttagcgatcgccgccaaccctgcaaagcaaatcctagtaagtagcgctaaagataaaacgatcagagtttggcag

SEQ ID NO: 42690 - DNA, 939 bp, Anabaena PCC7120
ttgacctttgttcctccgccaatacaaaaaatcaatagtgagattgctaataatgctggtgtagaaatttatgtattacgccttgatttaatgcacccgtgggtaaacggtaataagtggtacaagctgaaatacaatctcttagaagctaaggagaaaagttacacaaaattactcacctttggtggtgcatattctaatcacatcttcgctactgccgcagcaggtaatcttttaggattccagactattggtataattcgtggggaagaaaccttacccttaaatcccacactaagttttgcaacgcaacaaggtatgcagcttgtctatgtggacagggaaacctatcgacaacgaaacagcaccacattacacacagacctaaggaaacgctttggtgaggtatttatcattccagaaggtggtagtaatttgaatggtgtgcgtggttgtctagaaataataagtgccgcaacacaagtatttgatattgtttgtgtagcttgtggtacagccaccaccctagcaggtatcgctctggcactggaacctcagcaacgtgtgattggttttcctgtcttaaaaaatgggggttttttagcacaggatattgctcagttaatgaagaattatgtcgcggcggggttgcccatttcatctagttctcccgcctcttgggaattagtttgcgattaccattttggcggttacgccaaggtgaaagatgatctcatactgttcagtcaccagtttacccaaagctacggcgtacctcttgattacgtgtatacagcgaaaatgttttacggcgtaatggacttgttaaagcaaagatattttacgaaaggtgatggtctccgaccgaccgtaggtcatcgtatcttaatgattcacacgggtggcttacagggaaatatcgggatgagtgaacgattg

SEQ ID NO: 42691 - DNA, 2253 bp, Anabaena PCC7120
gtgaacatcaacgatatcactattccctttcaggtagacctcagtaactgtagcaaagagccaattcatattcctgggttaattcaacctcatggagtacttttagtattacaagaagtagacttaacgattctgcaagttagtaataatacattcaatattttgggaagacatcccgaacagttactcaatcaacatttaagctgtttactagaagcggaacaacttagtttattaaaggattgtttggcacaggaagatttacaaattattaatcccctggaatttattataaaatcccataacgaaagcattagttttgatgttattgcccatcgttctaataatttgttaattttagaattagaagctaatttatcagacaaaacccattcgtttttccgattttatcaccttgtaaaactagcgatgctaaaactacaaggtacagcaaccacaacagaaatcagccagatattagctcaagaagtccggaaaattactggctttgatagagtgatggtttatcgttttgatgaacagtggaatggtaaagttattgccgaagtaaaaccagaatatcttacatcttatttagggttaaattatccagcatctgatattccacaacaagctagaaaactctatagccaaaactggctgaggttaatcccagatgctaaatatcaaccagtaccaattgttcccattaataatcccctcaatgaccagcctttagatttaagtcgctcagttcttcgcagcgtctccccattacacattgaatatatgcagaatatgggcgtgacagcttctatgtcgatttcaatcatgaaaaatcagaagttatggggactcattgcctgccatcatcaatcaccaaaatatataccctatgaaatacggagcgcctgtgaatttttaggacaaatgacttctgtagaaatgagtgccaaagaagatagtgaggatacagaagataaaattcaagtgaaatcggtgcatagcaaattagtacaatatatgtcggctgaaaatgactttattaatgccttaattgaccatcagccgaatatacttgacctggtaaaagcacaaggagcagcagtttgttttaacggtaattcttgtacagttggtcaagttcctcccatgccagatattcaagttcttgtggaatggatgagtcaaaatatacatgaggagatttttgccacagattcactcgcaacagtttacccagatgccgaaaaattacgggatgtggctagcggcttgatagcgctttctatttctagaagtcagaaaaactatattttatggtttcggccagaggtggtaagaactgtagattggggaggaaatcctcataaacctgtagaagttatagcaaatggtgaaatacgcctatcacctcgcaagtcttttgatttatggaaagaaactgtacttttaaaatcacaaccgtggaaatctcatgaagtgaatgcagcactagagttaagaagcgcaattattggtatagtgttgcaaaaagcggatgaactagcacagctcaatattgaactggaacgcagcaatcaggaactagatgcttttgcttatatcgcttctcacgatttgaaagaaccactaaggggaattcataattattctaattttttgatggaagattatggcgaaattatcgatgcaccaggaaaggaaaagttactcaccctgattcgtctcacccaacggatggaagatttgattgattcgctgctgcatttttcccgtttgggacgggttgatttatccatgcaggacaccgacctcaatgaaattgtgcatcgcattctagatatgttaagtgggcgaattgaggagacaggggtggaaattaggattttacaattactgcctgtagtgtactgcgatcgcatccaaatcggcgaagtcttcagtaatctgattgccaactccatcaaatacaatgacaaagccaacaaatggattgaaattggctacatcgacaatccaccgctaccacccacattttacgtgcgagataatggcattggtattcgagaaaaacactttgaaactattttccgcatcttcaaacgactacacagccctagcaaatatggcggtggtacaggtgcaggactcaccatagccaaaaaaattgtcgaacgacacggcggtaaaatttgggtggagtcaacctacggcgaaggtagtacgttttatttcacgctgcaagatgtg

SEQ ID NO: 42692 - DNA, 765 bp, Anabaena PCC7120
attatgttatctaaaagaatcttaccttgtttagatgtgaaggcgggacgggtagttaaaggagttaactttgttgatcttaaggatgctggcgatcctgtagaactggcgaaggtttacaacgatgctggggctgatgagttagtgtttctggatattacggctactcatgaagaccgagatactatcattgacgttgtttaccggactgccgagcaggtctttattcccctgactgtaggtggtggtattcaatccttagaaaatgttaaagctttgttacgcgctggggcagacaaggttagtattaactctgcggcggtacgtgacccagaattaattgatcgagcgagcgatcactttggtaatcagtgcattgttgtagcaattgatgctagacgcagagtagatcctagtaatcccggctgggatgtttacgtgcgtggtggtagggaaaacactggtttagatgccttatcatgggcgaaggaagtagaaaagcggggtgcaggagaactattggtaacaagtatggatgctgatggtactcaagccggttatgatatcgagttaacacgggcaattgctgagtcagtagaaataccagtcgttgcctccggtggtgcgggtaactgtgaacatatatacactgccttaactgaagggaaagcggaagctgcgttattggcatcgctgctacattatggtcaactcagcgtggctgaaattaagaattatttgcacgagagccaagttcctgtccgc

SEQ ID NO: 42693 - DNA, 3399 bp, Anabaena PCC7120
gttgccctacaggatgaccagggacaaagtatggcaacaattagcgtcaatcgtgacattactgaacgcaagcacgctgaattattgctcaggcgtagcgaagaacgttttcaagcattcatgaatcatagccccacacctgcttggattacggatatagatggcacgattgtttatgtgagcgaaacttatcggcgtacttttcaattaccaacacaagaacttatcggtaaaaatattgttgacatttatccacccgaattgactcaaactttccgagaaactatccaaatagttgctcgtacccgtcaagttatggaaactgtagagtctgcaccctgtagtgatggcacaggacgagattttttggtttataaatttcccatatctagtaaacctgacgagtgtttaattggctgtattgctattgatattactgaacgcaaacaagccgaagcagccctgagaaaaagtgaagaacgttggcaattagtcattgaaggtaatcaagacgctatttgggattggaatatcatcaccaatgaaacttttcgttctgcgcggtgggcagaactgatcaaagaacaaaactatcaacccatagctgatcacgcagattgcgttagccgcattcatcccgatgattatgagcgggttatggcagttaagcaagattgtctcagtcggaaaattcctaattatgtagtggagtatcgtttgcgttgtaacgatgacagctataggtgggtattagttcatgccactggtcaatgggatgagcagggtaatccggtgcggatggttggttctatcaaagacattactgaacgcatagaagctcaagaagccttacaaagacaattacacagaaccttattactagaaaaaattacccaaaaaattcgccagagtctcgatagtaaagaaatttttgaaacagctgccacccaaattggacaggctttagcagtcgatcgctgcctcatacattcttacattagtcatcatgacccacatattcccttagtcgctgaatataacaacgttctcgattactgctcaatgcagaaatgggaatttactaccacggggaatcagcacattttaaaaatgatgtcccaggataaggcgatcgcctctgccaatgtctacaccgatcctttactacaaacagcagtacctagctgctgtgaaattggggtcaagtccatgctagccgtccgtacttcctatcaaggggaaccaagcggagctatttgtttacaccagtgtgggtattttcgccagtggactaacgaagaaattgaattactagaagccgtggcggctcaattgggtatagccttagcccaagctcagttattagagcaggaaacccgccaacgggaagaactcactatcaagaattttgccttagaacaagcaaaaagggcagcagaagccgccaatcgggcaaaaagcgaatttttggccatgatgagccacgaaatccgcactcccatgaatgctgtgatcgggatgacaggattactcttagatacggaattaacttcccaacaacgagactttgtggaaacagttctcacgagtggcgatgctttgttgagtattattaatgacatcctagatttctccaaaattgaatctggtaagttagaactggaagaacaaccttttgaggtgaggacttgtgtagaacaagtcatcgacctcttagccgctaaagctgcccaaaaagatattgaactcgcttacctgattcatcctcaggtacccatgcaaatcgctggagatttaactcgcctgcggcagattttgacgaatctcctcaacaatgcgatcaaatttaccccagaaggagaagttgtagtctctgtgcgtagccagccatcacccaaccaaaaaaacaagaactgctgcgaaattatctttaccatcaaagatacaggtattggtattgccccggaaacaatggatttgttatttcaaccatttgtccaggctgatgcttcgatgacaagaaaatatggcggtacaggactaggactcgttatcagtaaaagattgggtgagatgatgggcggctatctttgggtagaaagtcgggggtgcgttggtggcaaccctccccctggatggcaaactaaaaactcaatctcatccgcttctgtggctacaggttccaccttttatttttctatgactgtgcctgtggtggctcatgcagatttagagactcccatcacttccccagtccaactaagtggtaaacggttgctaattgtcgatgataatccgacaaatcgccagattttgagattacaagccgaaccttggcagatggaaacttacacagctccatctggtgctgaagctttagctctgatagaccagggaatggcctttgatattgccattttggatgtgcagatgccggaaatggacggtctgacactggcaaggcaaattcgtcagcgtcctagttatcaacacctacccttggtgattttaacttcttggggtcaaccagatactgacttgagtgatatcgaatttgcagcttgtttgaataaaccaattaaacaatctcaactttatgatgtcttagcttctactttgggcaatcaacctatccgtgctagcgttgttcctgatcgttccactgaaatcaattcatgcctggcacagcagatacctctacgcattttgctagcagaagatatagtggtgaatcagaaagtggctctgctgatcctgaaaaaaatgggttatcgagcagatgtagtggctaatggactagaagtgctggaagctttacagcgtcagttctatgatgtagtgctgatggatgtgaatatgccagaaatggacgggttgaaagccagccaaatcatttgtcaaacttggagtcctagttctcgtccatatattatcgctatgacagctaatgccatgcggggcgatcgcgaagcttgcttggcggcgggaatggatcactacattagcaagcctttacaacttgaggagttagccaaggcactgggcaaatgtcacccctcaggtagtgctatagagaaagcactggaaaaaaccagtagccaaaatcagacttttacagacattagtgatttaaaatttgccacaatagatacaaaaattttacaagcattacgggatatgttaggaggagataaagtagcatttgctgaattaatcaactgttacctcaccgaatccccaaaattgattcaaaatatagatgtagctattaatacgaaagatactcagggaatatggaagacagcgcacaaatttaaatctagtagtggctcagttggggcggtttttttagcacaactttgtaaattactagaaacgaaggggcgcaataacaatcta

SEQ ID NO: 42694 - DNA, 624 bp, Anabaena PCC7120
atgcgtgtgaaaatttgcggcatcactcaaccacaacagtcagtagcgatcgcctctttgggtgcaacagcgctaggatttatatgtgtaccttcttcaccgcgttacgttaccgccggacaaattcgagatgctgtcacacccttaccagaaaatattgataaaattggcgtttttgccaatagcagtattgcggaaatttatcaaacagtgattgattctgggttaactggtgtgcagttacacggtgacgaaaccccagagttttgcgaccaagtgcgtcaatcacttccccaagtagaagtattgaaagcgttgagagttcgtagtcttgagcatttggaacaagcagttatttacactaagtatataaatactttattacttgatgcctatcatccccagcaattaggggggactggtcaaactttagattggcaaatgttgcaaaaatttcgcccaagttgcccttggttactagccggaggactaacaccagaaaatatcttagaagctttaagccaactgaatcctgatggtatagatttatctagcggtgtcgaacttaaaccaggcgataaagatttagataaagttgcattactttttgaaaaattagagagt

SEQ ID NO: 42695 - DNA, 624 bp, Anabaena PCC7120
gaagccatcaataccagacctgaccgcaatacccataatggccgagaaccagaattgcaccaaccttcagaagaagatatggaatcaatgatgggtgcagttaggtcaatattagtgggtgttggagaagacccggaaagagaaggtctattgaaaacaccaaagcgagtggcagaggcaatgcgtttcctcaccagtggctacaaccaatctttagaagaattactcaacggtgctgtctttgatgaaggtcataacgagatggtattagttcgagacattaacttctttagtttatgcgaacaccatatgttacccttcatgggcagagcgcacgttgcttatatccccaaccagaaggtagtaggactaagcaagctagcccggattgtcgagatgtattcccgacgcttgcaagtacaagaaaggctaacccgccaaattgctgaagctgtgcagaccattttagaaccccaaggtgtagccgttgtgatggaagcaagccatatgtgcatggtgatgcgcggtgtacaaaaaccaggctcttggactgtaactagcgcaatgttaggcgtattccaagaagaacaaaaaactagagaagaattctttaacttgattcgt

SEQ ID NO: 42696 - DNA, 687 bp, Anabaena PCC7120
atgagtttggagcagaaacgacgcgctctgattactggggcaagtagtggaattggcaaagcaacggcgttagcctttgcaaaagcgggaatagacgtggctttggtgagccgttctttggataaattgacacctgtagtagaagcaacaaaacagactggagtagtagccaaagcgtatactgtagacttagcagacgtatcgcaagtagaggcaaaaatccaagcgatcgctattgactttggagatatagatattcttgtcaataatgcgggtgtagcatatacggctaccttgagcgaaacgcctttagcagactggcaacaagtaattaacttgaacctgacgggcgtatttgaatgtattaaaggaattttgccaacaatgcgcgatcggcatacaggcacaatcatcaatgtgtcttcgattgcagctaaacaatcttttccgcactggggagtttacagcgtcagtaaagcaggattaatggcactttctcaaaccttggcacaagaagaacgtgtccacggtattcgggtaactgcgatttgtcctggggcagtaaatactggactttgggatacagagacggttaaagctgactttgaccgttccaaaatgctcaccccggaaattgtggctcagtcaattctctacactgcattattaccaccacaagcagtaatt

SEQ ID NO: 42697 - DNA, 1134 bp, Anabaena PCC7120
tcagtgaaacatgggtttagaccactgctggtttaggggctggggactggggcctggggattaggaagaaaaatacaccctagtcacaagattgtacccaagacccaatccccaataccaattcctcatacccaatacctaatacccaatacctaatccctaactatggctacaactgagcgcaaaccactactgttggattttgaaaagccactagcagaactggcaaaccggattgatcaaattcggcaactggcagaggagaatggcgtagatgtgtctggtgagattcgcaagctagaaacacgcgctatgcaactgcgtgaggaaatttttagtactctgtctccatctcaacgactacaagtagcacgtcatccccgccgtcctagtactctcgattacattcaggccatcagtgatgaatggatggagttgcatggcgatcgctgtggtggtgatgatccggctctcatcggcggtgtggcgcgtttgggtggtaaacctgtggtgattttgggtcatcaaaaaggacgagataccaaagataatattgctcgcaatttcgggatggcgactccaggcggctatcgcaaagccatgcggctgatggaacacgccaacaaatttagtatgccgattttgacatttatcgataccccaggcgctttacctacggtggtagccgaacgccaaggcgcaggggaagcgatcgcctataatttgcgcgagatgttttctttagatgtaccaattatctgcaccgttatcggtgaaggtggttctggtggcgctttgggtattggtgtaggcgatcgcctattaatgtttgaacactctgtctatactgtggctacccccgaagcctgtgcggcgattctttggaaagatgctagcaagtctccccaagccgccgtcgccctgaaaatcgtctcccatgacctgaaaaatttgggcattattgaccagatattacctgaacccacaggtggcgctcactctgaccctttaacagctgctacaaccttaaaacaagccctgttagataacttggatgaactagaccgcttaacatcacaagaacgccgccaactgcgttatgataaattccgcaaaattggtgtatttacagaa

SEQ ID NO: 42698 - DNA, 1407 bp, Anabaena PCC7120
atgacactacaaagctttggtgtgattggtttagccgttatgggcgagaatatcgctctaaacgtggagcgtaatggcttcccaattgcagtttataaccgttccagagaaaaaaccgatgctttcatggcacagcgtgctggtggacgcaacgttaaagctgcttttaccctggaagagtttgtcgccgcactagaacgtccccgcaagattctggtgatggtgcaagctggtaaaccagtggatgcagtaattcagcagctcaaacctctactagatgaaggcgatatcatcatcgacggtggcaactcttggtttgaagatacccaaagacggactcaagaactagaaccagcaggcttacgcttcctggggatgggtgtcagtggtggtgaagaaggcgcacttaatggcccttcactgatgcccggtggtacacaaagttcttacgagtatctgtccccaattttcaacaaaattgctgctcaagttgatgatggcccttgtgtaacttatgttggccctggtggttccggtcactacgtcaaaatggtacacaacggtattgagtatggcgatatgcagttgattgcagaagcctacgacttgctgaaaaatgctggtgggctgaatgctaaacagctacatgaagtattcacagaatggaatactaccgacgaactcaattctttcttgattgagattacagccaacatcttcccctacatcgacccagagaccaagttacctttggtggatttgattgttgatgcagccggtcaaaagggaactggacgctggactgtacaaactgctttggaattgggtgtttctatccctaccattacagcagccgtgaatgctcggattatctcttccattcgagatgaacggattgctgcatctaagcagttgacaggccccagtggcaaatatgatggcgataccaaagagtttatcaacaaagtccgggatgcactttactgctccaagatttgttcttatgctcaagggatggcgctgttatctacagcctcagccacatttaattggaatttgaatctgagtgaaatggcgcggatttggaaaggtggttgtattattcgcgctggcttcttgaataagattaagaaggcatttaacgaaaatcccgcattacccaacttgctactcgctcctgaatttaaacaaacaattctcgacagacaagcagcttggcgggaagtaatcatcactgcggcaaaactcggaatcccagtacccgcatttagcgcatccttggattattttgacagctatcgccgcgatcgcctaccccaaaacctcacccaggcacaacgcgactacttcggcgcacacacctacttgcgtaccgataaagctggcgctttccacactgaatgggtt

SEQ ID NO: 42699 - DNA, 894 bp, Anabaena PCC7120
atagccatctctgcacagaatctcaatcgcgttttcggtgactttcacgccgttgtggatttgaatcttgatatccgctatggcgatgtttatggacttttgggcgcaaatggagccggaaaaaccaccgctattaaaatgctatgtggcctattaccaattagttctggcgaaatctccctggctggagaaacaggtgatcttcgcagtgcagaattgcggcaacgcatcggctatatgagtcagaagttcaccctctacgatgatttaacaattctggaaaatttgcagttctatagtggtgtttatggcattccaccccgtcagcagcgagaaaaaattagttgggtgttatccatttcgggattagaaggacaagaacatttactgacacgacaactccccggtggatggaagcaacgggtagcatttggcgcatccgtcatccatgaaccggaaattttgtttttagatgaaccgacttctggcgtagatgttttagcacggcagcaattttggcaattgattaatgattttgctcgtcatgggacggcaattttggtgacaacccattatatgaacgaagcggaacaatgtagccggatgtgttttatggttgcagggcggaaagttgccgaaggttctgccagtgagattaaagctgcacaacctggtcaattatttgagttaaaaattggcgaactgcaaggaagttacgatcgcttacggcaatttctcgaaccgtggcgcgtctccatttttggcgatcgcctccacgttgttctcgatcatcccaccgcagaactgccccaagtgcggtcatatctgcaatcggcaaatctctctcttacagatattcaacccatgccattttccttagaagatgcgtttatt

SEQ ID NO: 42700 - DNA, 690 bp, Anabaena PCC7120
ttaaacttaaatgaggtgacaatcgaggttcggggactctacaaacactatggtaaaaccattgcaattcgcggactcgatctgcaaatccgccgtggcgaattgtttggattgattgggcctgacggtgcaggtaagacaaccacattcaatattttgggtggcgtgatgcaggcaaccgcaggggatgctaaaattctcggattacctgcccgtgatgcgcgaaattacactggatatttaactcaacaattttctctttatcctgatctgagtgtggatgaaaatatctattacagtgcaggattgcgacttgtccccgaagatcaactggaagcacgacgcaccaagtatcttaagttgatgcaactcgattcattccgcgatcgccttgccggtcgtctttctggtgggatgaagcaaaagttagccttgtgctgtgcattaattgctgaaccgcaagtattattgctggatgagccaacaactggagtcgataccattgctaggcgtgagttttgggacattctggctggattaactgtccaaaatattaccgtgctggttgcaactccagatttagatgaagccgaacgctgcgatcgcgtggcattaatttacaacggacaaattcagcaaatgggttctcccacagaactcaaggggaatttaggcttaaatcggttaatt

SEQ ID NO: 42701 - DNA, 924 bp, Anabaena PCC7120
gcaacggattttaaagactattacgcagttctgggagtgagcaaaacggcaacccctgaagaaattaaacgcgcttaccgcaaacttgcccgcaaatatcatcctgacctcaatcctggagataaagacgcagaagcaaagttcaaagacctgaacgaagcgaatgaggtactctctgacccagaaaagcggcagaaatatgatcgctttggtcagcactggaatcacccagggtacactgacgcaccgccacccagttccactaatgttgatacaactgacttcgatcagtacggcgattttgattcgtttatcaacgatctgctgggtcgaacgagacgtaaaacctccactggtggctttgatgattttagtgggggatttcgttctcaagctcccgcaccggacacagaagccgcgatagccctgacattttccgaagcatttcacggtgtccaaaaacggctgcaactcgatgaggaaacaatcaacgtccgtattccccctggtgcaaagcctgggagtagaattcgcatcaaaggtaaaggtcgtcctagtccattctctcaacagcgtggcgatttatatttaactatcgaagttttaccccatcccttctttcgatttgagggcgataacttggtttgcgaaattcccattcgccctgatgaagcggttttaggcgcacaaatcagcgtaccaacccccgatggtagcgtgacgatgaaaattcccaaaggagtgcgatcggggcaatcgctcagactgcgcggcaaaggctggacattgccaaaagggggacgaggtgacttatttgccaaacttcagatggtcacgccgcaagacctgagtgcgatcgagcaagaatactacgaaaaaatccaggcaaatactagctttaacccacgtacccagttagaggag

SEQ ID NO: 42702 - DNA, 657 bp, Anabaena PCC7120
ctgtcaaaaaatactaacaaagtctactcagtcgcttttagtcctgatggtcgtatcttagccagtgccagtcaagatcaaacaattaaactttgggatatagccacagggaattgtcaacaaactctcataggtcatgatgattgggtgtggtctgtcacctttagtccagtcaccgatgatagaccgttgttactcgccagtagcagcgctgatcagcatatcaaactgtgggatgttgccacaggtaagtgtctgaaaactctcaaaggtcatactagagaagttcactctgttagctttagtcccgatggtcaaaccttagccagcagtggcgaagacagcaccgtcagactgtgggatgtgaaaacaggtcagtgctggcaaatatttgagggacatagtaaaaaagtttattctgtacgctttagccccgatggacaaaccctagctagctgtggcgaagaccgcagcatcaaactttgggatattcaacgtggtgaatgtgtcaataccctatggggacactctagccaagtttgggcgatcgcctttagtcccgacggacgtacactaattagctgtagcgatgaccaaacagccagactttgggatgtcatcacaggtaattcccttaatatcctgcgcggttatacc

SEQ ID NO: 42703 - DNA, 852 bp, Anabaena PCC7120
cgtgatgtttattcagtcgcctttagtccagatagtcagattctcgccagtggtcgtgatgactataccattggactctggaacttaaagactggagaatgtcaccccttacggggacatcaaggacgcattcgttccgtagcctttcatcccgatggaaaaatactcgccagtggtagcgcagataacaccataaaactttgggatatcagtgacactaaccacagcaaatatattcgtacacttacaggacatactaactgggtgtggacagtggtctttagtcccgacaagcacaccctcgccagcagcagtgaagaccgcaccatccgcctgtgggataaagatacaggtgattgtctccagaaattaaagggacacagccattgggtatggacggtagcttttagccctgatggcaggatcttagctagtggtagcgctgacagtgagattaaaatttgggatgttgctagcggtaaatgtcttcaaaccttgacagatcctcagggcatgatttggtcagtagcatttagtcttgatggaacattactcgccagtgctagcgaagaccaaacagtcaagttatggaatttgaaaacaggtgaatgcgtccacaccctcaaaggacacgagaaacaggtttactcagttgcatttagtcccaatggacaaattgcagctagtggtagcgaagataccactgtgaagctgtgggacattagcacaggttcatgtgttgatactctcaaacatggacatacagccgcaattcgttctgtagctttcagccctgatggcagattgcttgctagtggtagcgaagatgaaaaaattcaactgtgggatatg

SEQ ID NO: 42704 - DNA, 1455 bp, Anabaena PCC7120
atgtacattgtacagattgcctcggaatgcgctcctgtaattaaggcagggggtttaggggatgtcgtttacggattgagtcgagaattagagattcggggcaattgcgtcgagctaattctgcctaagtatgattgtatgcgctacgaccatgtttggggactgcacgaggcttacttaaacttgtgggttccctggtttggtgcagcaattcactgtactgtctactgcggttgggtacatgggcgagtatgttttttcattgaaccccattccgaggacaatttctttaatcggggctgctattacggttgtgatgatgatgatatgcgctttgccttttttagcaaagccgctttagaatttctccatcaaagcaataagcgccctgatattatccattgtcatgattggcaaacaggcttaattcctgtcatgctctatgagatctacaagtatcatggcatggacacccaacgggtttgctacaccatccacaactttaaacatcaaggaattggtggtgtcaaaactctctgggcgacagggttaaacagagaagcttattacttccaagatgacaagctaagggatgaccataacccctttgcattgaattacatgaaaggcggtatagtctactcgaacgctgtcaccacagtttcaccaaaccacgccttagaagcacaatatacagacgttggttgtggcttaggtcatactttgtatctacacaaagaaaaatttagcggggttctcaacggtattgattacgatttttggaatccagaaattgaccgtcacatccccgataactacagccaagacgattttgaacaaaaactatataacaaaaaagctttgcgtgagcgcttgttgttgcaagctgctgataaaccaatcattgcttacatcgggcgtttagataatcaaaaaggcgtgcatcttgtccaccatgccatttatcatgccttgaataaaggagcgcaatttgtattattgggttcagcaacagaagcaggaatcaatgctcattttcgtcatgaaaaacagtttttaaatagcaatcctgatgtccatttagaattgggctttaacgaagagttgtctcatctgatttatgccggggctgatatgattgttgttcccagcaattatgaaccctgcggtttaacgcaaatgattggtttgaagtatggtactgttcccattgtgcgcggtgttggtggactggtaaatacagtatttgaccgagattacgatcaaaatttaccaccagaaaaacgcaatggttatgtattttatcaatctgataaccaagctttagagtcagcaatgaatcgggcaattgatttgtggtatcagtctcctgaacagttccaacaattagcgattcagggaatgaaatatgactactcatggaataatccaggcacggaatatttaaatatttac

SEQ ID NO: 42705 - DNA, 1215 bp, Anabaena PCC7120
tctagcccctttagtacagatagctttgacgcatctgttatgtccacatacggacgctttcccctcgctttagaacggggtgcaggttgccgagtatgggatacccagggcaaagaatacctagactttgtggcggggattgccacttgtacactgggacacgcccacccagctatggtagaagcggtgacacgccaaatccaaaagctgcaccatgtatctaatttgtactacattcccgaacaaggtgaattagcccaatggattattcaacactcctgcgctgatcgggtatttttctgtaattctggcgctgaagccaacgaagccgctattaaactggctcgtaaatatgcccatacagttttagacatagaaaagcctattattctcaccgccaatgccagtttccacggacggacattggcaactattaccgctactgggcaagcaaagtatcaaaaatattttgaccccctagtacccggatttcactatgtaaattacaacgatatcagtgcggtagaagcagctattagcgagttagacgagggagattaccgagtagcggcaattctcatcgaaccattacaaggggaaggcggtgttcgtcctggtgatgtggaatacttccaaaagctgcggcaaatttgtgatgacaccggcattttgttgatgttcgatgaagtgcaggtcgggatgggacgcagtggtaaattgtggggttatgaatacctgggtgtagaaccagacattttcaccagcgccaaaggtttgggtggtggtatccccattggggcgatgatgagtaagaaattctgcgatgtcttccaaccaggagaacacgccagcacctttggtggtaatccctttgcttgtggtgtagcgttggctgtgtgtcagaccttggaaagggagaatattttgcagaatgtgcaagatagaggggaacagttaaggagtggcttaagagcgatcgctgctaaatatccccatcatctaactgaagttcgcggctggggtttaattaacggtctggaattagccgcagatattccattaactgctgctgatgtcgtcaaggctgctatcaacgagggcttattgttagtaccagccgggccaaaggtcgtccgctttgtaccaccattaattgtcacagaggcagaaatcaacaccgccttaaaattactggaaaaagcattagcaactgtg

SEQ ID NO: 42706 - DNA, 810 bp, Anabaena PCC7120
aagtcattgcgcctcagttggacaaacgtggcattttttaccacaattcacgctctagctttgttggctccttggtttttttcctggtcagcattgggtttgctgttgtttctccactggttgtttggcagtattggtatttgccttgggtaccacagattacttagtcacaagagttttcaagtacccaaatggctggaatatgcgatcgccactatcggtgcattggctatgcagggagggccaattttttggattggaggacatcgccagcatcatgctcacaccgaagatgtctatctagatccatactcttcccagcgtggattttggtggagccatatgttgtggattttatatcctcgctccgaatttttcgactatgaaatctatcaaaagtatgcgcctgatttagcaagacaaccattctatcgttggttagatcgttattttctcctgttgcaaattccttttggattaatgctttacgctatcggaggatggtctttcgtcatctatggtgtagttctcagagcagtattgctatggcactctacttggtttgtcaactctgccacccatatgtggggctatcgtacctttaacgctgatgataatgcacgtaatttgtggtgggtatctatagtaacctatggcgaaggttggcacaacaaccatcacacttaccccaacgtagccaaagctgggttccagtggtgggaagttgatgtcacttggtggagtattaaactgttgcagactttaggtttggcgaagaaagtagttttaccgccatcacaaagaatgaat

SEQ ID NO: 42707 - DNA, 1287 bp, Anabaena PCC7120
atgaataatattgtcgatacagccattgaggcgattgtcgcccgcgaaattctcgactcacgcggtagaccaacaatagaagcggaagtacatttattaagcggtgcggtaggcttggcacaagttcctagcggcgcttctacaggcacatttgaagcccatgaactgagagacaaggataaaagccgttacggcggtaaaggggtactcaaggctgtacacaacgttaatgagatactagccccaaagttaatagatttggatgctctcaaccaagaactcatcgaccggacgatgattgcccttgatggttctggtaacaaatcaaatttgggtgcaaatgcgattttagctgtttctttggcagccgctagagccggggctgagtctttggggattcccctatatcgttacttaggcggccctttggcgaatttgttgcctgtgcctttaatgaacgtaattaatggtggggcgcacgcttctaataacgtggatttccaagagtttatgatcgttcctgtgggtgcaacttccttccgtgaagccctgcgctggggtgcggaggtatttgctaccctcagtgaagtgctgcatgacaaaggcttgctgactggtgtaggcgatgaaggtggttttgcacctaacttggaatctaatcaggtagccttggaattgctagttgcagccattgaaaaagcaggatacaaaccaggggaacaagtagcactggcgctagatgtggcggctagtgaattttacaaggaagggcagtatgtctatgatggtagacctcatgcaccgacggagtttatcgattacttagggcagttagttgatcaatacccaattgtgtccattgaagatggtttacacgaagaagattggcaacattggcaattactcacccaaaaagttggttcacgggtgcagttggttggtgatgacttgtttgtaacaaacgctactcgcttacaaaaaggcatccaagaaaaagcaggtaacgccattctgattaaactcaatcaaattggttccctgactgaaaccctagaaaccatcgacttaggaactcgtaatggtttccgttcagtcattagccatcgttctggtgaaacagaagacaccaccattgctgatttagccgttgctacccgtgcaggtcaaatcaaaactggttccctctgtcgtagtgaacgggtagccaaatacaaccgcttgctacgtattgaagatgaattaggcgatcgcgccgtttatgctggggctgtgggtttagggccgaaa

SEQ ID NO: 42708 - DNA, 1056 bp, Anabaena PCC7120
atgggcaattttggacgcgtacccgttgggattgttggcgcgtcaggctatggtggggtacagttagtccgattactgatggatcatccagaaatcgaactagtttatttaggtggtgagagtagtgtaggtaaatcttttgcatctctctacccccatttagctcatgcagttaaattatcaattgaagaagtagacccagaagtgattgcgcgtcgctgtgaagtggtgtttctctcgatgccaaatggtctggcttgtcaaattgtgccaacattgttggaaaaaggctgtaaagtactggatttgagtgcagactatcgattccgtaacttgacaacttacaccacttggtatggtgtggaaaggagcgatcgcactacagccgacaccgccatatatggtttacctgaactttaccgcgatcgcatctccgaagcccaattagtcggctgtcctggttcctaccccaccgctagcctcttagcattatcgccactgttaaaacaaggtttaatcgtccccgaaactgctattgttgacgctaaatctggtacatctggcggcgggagggaagctaaaacttatctattactagcagaagcagataattctctcgccccttatagtgtcgtccgtcaccgtcacaccccagaaatcgagcaaatttgtagcgatttggcgggtcacgaagttacagtccaatttacgccacatcttgtccctatagtacggggaattttggcaactgtatacgctaccctgcgcgatcctggtttagttggagatgatttaactactatttatacagccttctaccgtaattctccctgggtaaaagtttgtgaaagcggcatttatccgcaaacaaaatgggctgcgggcagcaatctttgttatatcggtgtagaagttgacccgcgtactggccgggtaattgtcatgtcagtaattgacaacctgatcaaaggccaagcgggtcaagcaattcagtgtctcaacatcatgatgggttgggatgagacattgggtttaccaaaaatggggttttatccg

SEQ ID NO: 42709 - DNA, 687 bp, Anabaena PCC7120
ttaaaggcaattctgtttgatttcaatggcgtaatcattaacgatgagcgcatccacctacaattgatcgatgaaattcttattcaagaaaatctccaaccccaaaaagtgcaagagcgtcaagcttccttaggaaggagcgatcgcgcttgttttcaagaattgctagcaaatcgtggtagagtcgtcagcgatgattctttaactcagttactcaacagtaaagctcaagcctacgtgctggaagtggagaaattagaaaaactgcctatatatccaggtgtagaagacttgatatatcaagcgcgttcccgtcatctccatttaggcattgttagcggtgcggttcgtcaagaaatcgaactagtgcttaatcatgccaaactagccgagtacttcacagttattgttgcaggcgacgacatcaccaccagcaaacccaaaccagatggttatttactagcagtggaacgcctaaatcaagaatatccccaattaaatctcttgccccaagaatgcttggcaattgaagataccccagcaggtatcgcagccgctaaacgagcgcaaatgcaggtagtaggcgtagccaatacataccccttccatatgttacaacgctgctgtaactggactgtcgattatctgagtgacttggaactagaacgagtccaaaaaatattttct

SEQ ID NO: 42710 - DNA, 1056 bp, Anabaena PCC7120
aaacgaattggtatcctcaccagtggcggcgactgtccagggcttaactgcgtaattcgcgcagttgttagccatgcaacgcttacttatgattgggaggtattgggtataccttatgccactcagggtttacgggagcgtcaagcgatcgctctcaatatgcacggttgggatttgcgcggtatcgatcctctgctgaatatgggtggtacgattttaggcacaattaataagggtgataccttagcccatgtggatgaaatgcttgccagttatcaggctttggctttggatgctttgattgtcattggcggtgatggtagtctgggtatcctccatgaactggctagccgaggtaattggaatttagtggcgattcccaaaactatagataatgatgtggctttgacagaacgcgccgtgggttttgatacggcggtgaatacaattgttgatgccctcaatcgcttgacttttacggctgcaagtcacgatcgcgtgatgattgtcgaagttatggggcgcagcgccggacatctagccctacacgcgggtattgctggcggtgcagatgtaattttaatccccgaaatttcatacacaattagcggtttatgtcaacatatagctgaattgcgcgatcgctggcaacgcaaatttgcgatcgttgttgttgccgaaggtgcgaaactatgtctggaagatgtgcaagaaaatattgcctcttcttgtgcgccttctaaatgcggtcgcggtcaatatattgcggatcaaattgctcaatgtagtaaaaatctcatcgataccagagtttctgtattgggacacattcagcgtggcggtatcccatcagctttagaccgtttaacagcaacagtttttgggaaaacagccgttgatttaatagctcaaggtaaatttgggcagatggtagcttggcaaaatggcgaagctatcccagtacccattcaggacgttgtcgctcaaagtcctttacacgtaaatccccaaggttctttggtacagagcgctcgttgtttgggtatttatgtagga

SEQ ID NO: 42711 - DNA, 828 bp, Anabaena PCC7120
gcctttgaaaatgttgatatagttttagccagcgctggtggttccacatccaaagcttgggcatctgtagcggttgaaaagggtgcagtagttattgataactccagcgccttccgtatgaacccagatgttcctctgattgtgccagaggtaaacccccaagccgccgccgaccacaaaggcatcattgccaaccccaactgcaccactattttgatgaccttggcagtatggccattacatcaagttagaccagtgcaacgcattgtagcagcaacttaccagtctgctagtggtgcaggtgctaaagcaatggcagaagtgaaaacccaaagcagtgccatcttgagaggtgaggaaccagtcgccgaagtattaccttaccccttagcatttaatttatttccccataactctcccttgaccgattcagggtattgtgaggaagagttgaaaatggtcaacgagacccgcaaaatctttggtacacaagaaattagaattacagctacttgtgtacgggttcccgtactacgcgcccactcagaagcaattaatctagagttcgcagaaccattttctccagatgaagctagagaaattttaagtcaagcacctggagtaaaattgctagaagattggggaaaaaattacttccccatgcctattgaagctagtggtcgtgatgaagttttagtcgggagaatccgccaagatatttctcacccctgtggtttagaactctggctttgtggcgaccaaattcgtaaaggcgcagcgttgaatgcggtacaaatagccgagttgttggtagaaaagaatttactc

SEQ ID NO: 42712 - DNA, 877 bp, Anabaena PCC7120
tttggcacagttttaaccgctatgattacaccgttcaaagcggacgggagcgttaactatgctgtagcggcagaactagcagcgaatttagttgacaatggtacagatacattggttgtgtgtggtacaactggagagtcacccaccttgagttgggatgaagaatacaatttatttgtagaagttttgcagacagtagcaggcaaagccaaggtaatagctggatgtggttccaattccaccaaagaagcgatcgcagctacgcaaaaagcagctaaaataggagtacatggtactttacaagttgtaccttactacaacaaaccgccacaagccggactataccagcactttcaggcgatagcgcaagcctgtccagagctaccgctattgttatataacgttcctggtcgtactggtcaaaatctcagtccagagacagttgtgcggttagctgaaatcgacaatattgttggtgttaaagaagctagtggcaatcttgaccaagcgggtgaaatccgtcgcttgacaccaaaagaattccagatttacgctggagatgattcgttaactttacccttgttagctataggggcaaaaggcgtagtcagtgtggcttcccatctggtagggaaccaactacaacagatgattcaagctttttaattctgggcaagtgacagttgccagtgatattcatcttcgacttttgccgttgtttaagactttatttatcactacaaatccgattcccattaaacaagcactaaaacttcaaggttgggaagttggctcaacccgtccaccgctaagtgatgctgatgcagaagtcagtcaaaaactagaagcagtaatgaaacatctcgatttaatttaa

SEQ ID NO: 42713 - DNA, 1263 bp, Anabaena PCC7120
attcaacaacaacgtaatttttttcaggctggacaaactaaagatatcaactttcgcctggaacaactcaagaaactgagaaaattagttactgataatgaaacagcaataaccaaggcattaaaagcggatttaaacaaatcagaatatgaagcttactttgcagaggttggtgtaattaaagaaattgattatgcgatcaaaaatctgaaaaattggtctaagcccaaaaaagcagatgttcccctagacttcttttcttattcagcccgaatttatccagaaccgctaggagtcgttttaattatctgtccttggaattacccattcgcattaacaatttcaccgctagtaggggcgatcgccgccggaaattgtgccattatcaaaccttcagaacttgcacctcatacctctaatttagcagcacaactgattagtaaatgttttcccagtgagtatgtggcagtagtagaaggtggtgcagaaactagccaagagttactagccgagaagttcgatcatatattttttactggtggtacagccataggcaaaattgttatggaagccgccgccaaacatctcacaccagttacattagagttgggtggcaaaagtccttgtattgttgatagtaatattcatctagaatatacagctaaacgcattgcttggggtaagttcattaacgccggacaaacttgcatcgcgcctgactatcttttagttaatcagaaaattaaaaaagatttaattgctgctatacaaaaaaatctccaagaattttatggcgataacccaatagatagccctgattacgggaggattattagccatagacattttgagcgtttagctaaatttctcaaaaatggtcaagttattgttggtggggaaacgaactacgaagataaatatattgctcccacattactagataacgtttctttggcagatcctgtgatgcaggaagaaatttttgggccgattttacctatgattgaatacacagatataaaagatgcgatcgccctcattaattctcaaccaaaacccctagctttatacatattttcccaaaataaagccctacagcaacaagttctgcaagaaacttcatctggtggagtgtgtattaacgacacaatcatgcacgttggtgtttcatccctaccctttggtggtgtaggcgatagtggtattggtagctatcacggtaaagccagctttgacaccttttcccattacaaaagtgttttg

SEQ ID NO: 42714 - DNA, 1656 bp, Anabaena PCC7120
taccgttggaatcgggaaaactactctagcaagcggcgctttgtggacatttggtcttttgtgttgaccttaatgtttaagctttggcgatacaacaaatcttggagttatcctggtggtgtcacggaagcaaaacaggctgcaagacgtaaagctcaagcagtctggattcgtaatactctgctggatttgggcccaaccttcattaaagtcgggcaactattttctactcgtgcagatatattccctggcgaatacgtagaagagttagcaaagctacaagacaaagtgccagcatttggctatgagcaagtcgaaaaaatagttgagcaagaattgggtaaaaaaattcctgaactctttcacagttttgagccaatccctttagcagctgctagcttgggacaagtacacaaggctgtcttgcatagcggggaatctgttgttgttaaggtgcagcgaccaggattaaaaaagttatttgagatagatttacaaattcttaaaggcattgcccgttactttcaaagccatcccaaatggggacgaggaagggattggatggggatttacgaagaatgttgccgcattctttgggaagaaattgactatctcaacgaaggtcgcaacgccgacacttttcgccgaaactttcgcggctacgactgggtaaaagtccccaaagtttattggcgttatgcttcgccacgagtcctaactttggagtatctaccaggaattaaaattagccaatacgaagccatagaagccgcaggcttagacaggaaggtattggcacgtcaaggcgctcaagcctacctattgcaactgctcaataacggatttttccatgccgatccccatccaggtaatattgcggttagtgccgatggagccttaattttctacgacttcggcatgatggggcagattaaatcaaatatccgcgaagggctaatgcaaacgttgtttggtatcgctcaaaaagatggcgatcgcgtagtccagtctctcatagatttgggagcgatcgcacccgtagatgatatggggccagtgcgacgttcggtgcagtatatgctcgacaatttcatggataaaccctttgaaaatcaatctgttgccgcgattagtgatgatttatacgaaatagcttataatcaaccatttagatttcctgcaactttcacttttgtgatgcgcgctttttctaccctagaaggggtaggcaaaggtttagatccagagtttaactttatggaagttgcccaaccatacgcaatgcagcttatgaccgatatgaatggttcagatagcaatagcttcctcaacgaattgagccgacaagcagtccaagtcagtaccactgcctttggattaccacggagattggaagatacactagaaaaattagagcggggagatatgcgcttgcgggtacgttctatagaatcagaacgactcctacggcgacaaggtaatattcagataggcataggttacgcactgataatcagtggatttaccctttcagcaactattttgttagttaatcattatgtatggttagcactgctggctggtttaattgccgcagcagtttcagtgatactgattcgactgcttctccgcctagatcgttatgaccgtatgtat

SEQ ID NO: 42715 - DNA, 741 bp, Anabaena PCC7120
gttatgaaactcaacttcacgggtcatactgatccggggcttattcgttctaacaatcaggatgattactatatcgaccctgaggggcgattttttatcgtcgctgatggtatgggtggtcatgcaggaggtgaagaagcaagtcgcatcgccacaagggaaattaaggcgtatttgaccgctaattgggatgtttctaaaccctcgtccgaattattagaacaagctctatggcaggcaaatgaagccattctacaagaccagcagaatcaccctgaacgggctgatatgggtacaacagccgtagtcgttattttccgtaatgacgaacaatggtgcgctcatgttggtgactcccgtctgtaccgtttgcgagaaacacaactagaacaggttacggaagatcatacctgggtggccagagcaattaaaattggcgacattaccgccgaagaagcgcgagttcatccatttcgccacgttttatccaggtgtttaggtagagaagacttacatcaagtagatgtgcaaccactggatacgaagataggcgatcgcctattgttatgtagtgatggtctaacagaagaacttcccgatcaaaaaatcgctcataacttacaaattaattccttgttggatcaatctgctctttccttagtggaagacgctaaagagcaaggcggacacgataacatcaccgtcgttatcgtcgctttagaataacgttcccaaaatagc

SEQ ID NO: 42716 - DNA, 954 bp, Anabaena PCC7120
gtttccagtgctagacgcacaatccgtataggttctcgtaaaagtcaactcgctctagttcagacatactgggttagagagcaattacaaaacagtttccctgatatcaattttgaagtccacaccatgtctacccaaggcgacaaaatccttgatgtagcattagccaaaatcggcgataaaggactattcaccaaagaactggaagtgggaatgatcaatgaggagattgattttgctgtccattccctgaaagatttgccgactaacttaccggaagggttagcactagccgcgattacagaacgggaaaacccggcagatgcgctagtagtgcatgaaaattttaaggataagcaaattgataccttaccagccggcgcggtaattgggacatcttctttacgacgcttggcgcagttacgcaaccaatttccccacttgacatttaaagatgtacggggaaatttgaatacacggttagctaaactagatgcaggtgagtatgacggtctaattttagcggctgctgggttacagcgcttaggtatgggcgatcgcgtccaccaaatcctccccaaagaaatctctctccacgctgtcggacaaggcgctttagggattgaatgccgtgccgatgatgcggaattaatcaccgtactcaaagccattgaacaccccgaaacacgcgatcgctgtctggctgaacgctcttttttacgcagtttagaaggcggttgtcaagtacccatcggtgtaaatacagaaatcaatggtaatgaattaatcctcacaggtgtagttgctagtgtagacggtcaaaacttggtgaaagacactgtttctggtaatgctagtgatgccgaagcgatcggtataagattagcagaactcctccgtgaacaaggagcgcaagagattttaaatacaatctttgcagagatccaacgtggt

SEQ ID NO: 42717 - DNA, 1395 bp, Anabaena PCC7120
atgcggattctatttgtggcagcagaagcagcacccattgcaaaagtaggagggatgggtgatgttgtcggtgcattacctaaggtcttgagaaaaatggggcatgatgtacgtatcttcttgccctattacggctttttgccagacaaaatggagattcccaaagatccaatatggaagggatacgccatgtttcaggactttacagttcacgaagcagttctgcctggtactgatgttcccttgtatttatttggacatccagcctttaccccccggcggatttattcgggagatgatgaagactggcgcttcaccttgttttccaatggtgcggctgagttttgctggaattactggaaacccgacattattcactgtcatgattggcacacgggcatgattcctgtgtggatgaaccaatcaccagatatcaccacagtcttcactatccacaatctggcttaccaagggccttggcgttggtatttagataaaattacttggtgtccttggtatatgcagggacacaacacaatggcggcggctgtccagtttgcggacagggtaaatacagtttctcccacatacgccgagcaaatcaagaccccggcttacggtgagaaaatagaaggtttgctgtctttcatcagtggtaaattatctgggattgttaacggtatagatacggaagtttacgacccagctaatgataaatatattgctcaaacgttcactgccgatactttagataaacgcaaagccaacaaaattgctttacaagaagaagtaggattagaagttaacagcaatgcctttttaattggcatggtgacaaggttagtcgagcagaagggcttagatttagtcatccaaatgctcgatcgctttatggcttatactgatgctcagttcgtcttgttgggaacaggcgatcgctactacgaaacccaaatgtggcaattagcatcccgctaccccggtcgtatggctacttacctcctgtataacgatgccctatctcgccgcatctacgctggtactgatgcctttttgatgcccagtcgctttgaaccatgcggtattagtcaaatgatggctttacgctacggttccattcccatcgtccgccgcactggaggcttggttgacaccgtatcccaccacgaccccatcaacgaagcaggtacaggctactgcttcgaccgctacgaacccctcgacttatttacctgcatgattcgcgcctgggaaggcttccgctacaaaccacaatggcaagaactacaaaaacgcggtatgagtcaagacttcagctggtacaaatccgctaaggaatacgacaaactctatcgctcaatgtacggtttgccagacccagaagagacacagccg

SEQ ID NO: 42718 - DNA, 2988 bp, Anabaena PCC7120
gtggtattacaagtacaaaccagcacctacgaagcgaaaactcaagaaattgctagacaattattaggagcaactcaagaaaatcgctcgttttttgcttctttacgtgatcaaatgcgttgggatgacaaattactggcttgggcgatgagtaatcccggtttacgggtgcaattatttcggtttattgatactttacccgcattgcatagtaaagcggaaattgctgcacatttacaagaatatttaggggatgaatctgtcgaacttcccgccgctttaaagggaatgctcaattttgctaaccctgactctgtgccgggacaagtggctgcaactaccgtctctacagcagttgagactttagctcataaatatatttctggtgaaaatattaaacaagtcatcaagacagttgaacgactacggaaagaaaaaatggccttcaccattgatttacttggtgaggcggtaattacagaaacagaggcgcaatcttatctagaacggtatctagaattaattgctcaattaacagaagcatcgaagaattggggaactattgcggctattgatgaagcagatggcgaacagctagcaaaagtccaggtttctgtcaaactaacagcgttttattcccaatttgacccattggatgctaaaggtagtgaggagaaagttagcgatcgcattcgtattttattacgtcgtgctaaggagttaggggcagctatccattttgatatggaacagtatgcttataaagacttaactttaaatattttgcaaaaaatcttattagaagatgagtttcgtcaacgcacagatattggcatcacaattcaagcatacctaagagatagtgagcaagatgccagaaatgcgatcgcttggttgaaacagcgcggttatcctttaactattaggctggtaaaaggggcgtattgggatcaagaaactattaaagctgcacaaaaacattggccgcagcctgtttttaatgataaagcagcgacagatgccaattttgaggcgataactcagttattactggaaaatcaccaatatgtttattctgccattggtagccataatgtgcgatcgcaagctttagctatggcaattgcggaaactttgaatgtcccccggcggcggtttgagatgcaggtgctgtacgggatgggggataagttagcgaaggctttggttgatcggggttatcgggtgcgggtttattgtccttatggtgacttattaccggggatggcttacctgattcggcgattgttggaaaatacggcgaatagttcgtttttacggcagaatttggagaatcggccggttgaggagttgctggcagcgccgaaagttgatttagcccaggcaaaggtgcattcgccggaggcattcccacagggtaaacactttgtgggggctgcggatacagattatgcagaggaggaggacagaacaaaggcggcgcgggcttttgctgtggtacgtggggagttaggcaagacttacttacctctaattaatggggagtatgtgcagactgctgaggtgattgattctgttaatccttctaattttagtgaggtgattggcaaggttggattgattagtgtggaacaggcagaacaggcgatgcaggcggcgaaggcggcttttcctggttggcggcgcacgtcggtgaaggaacgggcggggattttgcgtcgggctggtgatttgatggaacagcgccgggcggaattgtcggcttggatagttttagaggtggggaaacctgttaaagaagcagatggggaggtttcggaggcgatagatttttgccgctattatgctgatgagatggaacggttgcatcaaggtataaattatgatgtagatggggaaacgaatcgttatatttaccagccacggggtattgtggtagtgatttctccttggaattttcctttagcgatcgcctgtggaatgactgttgcagccttagttacaggcaattgtactctgctaaagcctgcggaaacttcttctgtcattactgccaaactaacggaaattttggtagaggctggcattcctaaaggtgtctttcaatacgtccctggtaagggttctcaagtcggtgcttacttggtaagtcatcctgatactcatctgattgcttttacaggttctcaggaagttggttgtcggatttacgccgaagccgctaccctgaaaccccaacaaaggcacatgaagcgggtaattgcggaaatgggcgggaagaatgccatcattgtggatgaaagtgctgatttagaccaagctgttgttggggtagtgcagtcagcctttggttacagtggacaaaaatgttctgcttgttcgcgggtggtggtagtagaagcaatttatgatgcttttatccaccgggtggtggaagcgacaaaatccttaaatattggcgaggcggagttaccaagtacccaagtcggccctgtgattgatgctaatgcgcgcgatcgcatccgcgagtatattgagaagggtaaggcagaatctcaggtggcgttggaattaagcgcacccaaccacggctattttgtcgggcctgtcatctttggggaagttccacctcatggcacaatagcccagcaggaaattttcggccctgtgctggcggtaatcaaagccaaagattttgcccaagctttagctattgctaatgataccgactacgccttgactggagggctttattcccgcacaccttcccatattcaacaagcccaggaagagtttgaagtgggtaacttatatatcaaccgtaacatcacaggggcgatcgttgcgagacagcctttcggtggctttaagctttccggtgtcggttccaaagcaggcggccctgattatctgttgcaattcctcgaaccaaggacaatcacagaaaacattcagcgccaaggttttgcacccattgaaggtgcagaa

SEQ ID NO: 42719 - DNA, 717 bp, Anabaena PCC7120
atgacaattattcatggaacaaatagcaatgactatctctatggtggtgatgagagcgataccatcaaaggatttgcgggatatgactatctatatggcggcttaggtgatgactatctatatggcggcttagataatgacaaactctacggcggcttaggtaatgacaaactctatggtggtgaaggtaatgataatttaaacggagaacaaggtaataatagcctatacggtgaagcaggcgatgatactttagatgcaggtaactccactgggaacaaccttttagatggtggagagggaaatgatgaaatttacgtttatagttccagtggaaataacaccctcaagggtggagtgggaaatgatattttagatgttcgcttttcctatggaaagaatatcttagatggtggttctggaaatgatcagctttatgctcgctattcccaaggaaacaatactctccggggtggaagtggagatgattatctcggagttgatttgtctgcggggaataacgtccttaatggagatgatggaaatgacatccttgatgttagttatcaatggaaaggcaagaatatagtttccggtggaaatggaaatgatattttttatgcctatggagttcagggtgctaacactctcaatggtggtagtggtgacgactctttctacatcagtagcccaagtgcagacaccgttgtgcatccc

SEQ ID NO: 42720 - DNA, 1167 bp, Anabaena PCC7120
atgaaagcagtttgctggcacgggacaaatgatgtcagggtagaaactgtacccgatccaaaaattcttaacccgcgcgacgcaattattaaaattacttctacagctatttgtgggtctgatttacatatatataatggctatattcccacaatgcaaagtggcgatatccttggtcatgaattcatgggggaagttgtcgagttaggtagtgctgtaaaaaatgtgaaagtaggcgatcgcgtcgttgttccttttaccatttcctgcggttcttgcttcttctgtcaacgggatttatggtctttgtgcgataactccaaccccaacgcctggctggtagaactgcaaatgggtcattctccagcaggtctatttggctactctcacctatttggtggctatgctgggggtcaagcagaatacgcccgtgtaccttttgcagatgtcggcttgcttaaaattcctgataatctaccagatgaacaggtattatttttaactgatatttttcccactggctacatggcggcggagaactgtaatatcaaacccggcgatattgtggctgtgtggggttgtggccccgttggacaatttgctatcaaaagtgcatatatgttgggtgcggaaagagttatcgcctttgaccgcatccccgaacgcctacaaatggctaaagaacaatgtaatgccgaagtcctcaattacgaagaggtaaatatcggggaagcactcaaagagatgactggtggacgcggccctgatgcttgtattgatgcggtaggcatggaagcccacggtacagacttaatggctttctacgaccaagtcaagcaagctgtaagactagaaacagacagaccaacagcattacgacaagtgattgtgtctgcggctaaaggtggtcatgtttctctggcgggtgtatatggcggtttcctggacaaaatcccgatgggttcagcgatgaataagggtttaaccttcaagatgggacaaacccatgtccataaatacttaaaacccttactagaacgtattcaaaacggtgaaattgacccctcatttgtcatcacccacaccatcccgctagaacaagcaccccacggctacgaaatttttaaacacaaaaaagataactgcatcaaagttgtactcaaaccc

SEQ ID NO: 42721 - DNA, 1335 bp, Anabaena PCC7120
ttttttaatctagcggtagaaattaatcctaattatgcccaggcttactatcatcgggcgaatgcgcgttactgtctagcagactttacagcagcgatcgctgattatgatcaagcattacaaataaatcctacattcgcagaatattattattgtcgaggtaacgcttacttagctcaaggtgactacgatcaagcaattgccaactatatcagcaccattgagtttgatcctctgttagccagtaatattaatgaagatattgcgaatgcctattattaccggggcttgaataacaacgaccaaggtaattatcaggaagcaattatagatttacaacaagcgttgcaatggcatccttactttgccgcagcttacagcattcgcgggaacatttactataaattgggagagtaccgacaagcgatcgccgaccatgaacgggcggtacaattagaccccaacctagccgaagcttaccaaaacagaggtaacgctcactacgccttaggcgcctatcaaaaagcgatcgccgattacaaccgcacactagaaattaatcctcatcaagtaggagcatattataatcgcggtctgattagtttttatctacacgaatatcaacaagccttcgcagatttcaaccaagtcttaaatttcaaccccaacgatgcacaagcatattaccaacggggattaatttatgaggcttggcaagactatcaaagtgcattagcagactacaaccaatcattacagctaaattctgaattagctgtagtctatggtgtgcgcgccaatatctaccgccatctaggagactaccccagcgccttagcagatggtaatcgtttactagaactacaacccaatttcgccgccggatattgcgatcgcgccacatcccgccgttgcttaggcgattatcggggagccattgctgattacaatcaggcattacaaattaatcctaatattgctgaagcatattacggtcgagccattgcccacgaagccttacgggactttattggcgcaatagcagactatacacaatccattcgcatatccccagattttgcccccgcttactgcaatcgaggcaatgcccgccgtcagttgggagataccaagggagccgtaacagactacaatcaagccctaacaatcaatccccaacttagcgaagcctactataaccgaggttcgctgcactacgatcaacaaaattatcgcagtgcgatcgccgattatacccaagccttggaactacagccagaatctgcaagatattacagcgatcgcgcccatgctcgttacgccttacaagattat

SEQ ID NO: 42722 - DNA, 2094 bp, Anabaena PCC7120
gatggtactttagcttgctttgtcatgttgagtcagtactttaatatccccttgcgtcgagatgtattgcggcgagttctgacaaagcaacaggaacacaaaggtagtatatctctacaattttgtgcagccgccgcagaattaatgggattaacaacgcaaatggtgaaagttcccgccgttgcgcttagtcgcttgcaattaccaataatgattgcttggcaagatagttttgcaattatttacaaaaatagcaatcaagagttacttgttgctgttccagagatggggctgttgcgctacaaattgcaagactttgctgaaaactggggacaagaaggagaagttttgctcctgcaaactactaaaaatactcccaagtcgcggtttaatttgagttggtttgtacctgcaatcaaacgccatcgtaaagtacttattgaagtgctaattgcttcgattgtcattcaaattttcgggctggtaaatcctttagtcacacaagtaattattgataaagtattagttggtaatagccctgatactttggaagtttttgggatatttttgctcgtaatagcggtaattgaagccatacttaccacagttcgcactcatttatttgtggataccactaaccgcattgatctttctctgggttcagaggtaattaaccacttgttgcgtctgccattatcttattttgagcgtcaccctgtgggggaattggcaacgcgcattcacgaattagaaaatatccgttcttttttgactggtacagccctaactgtggtgatggatgcagtgttttctgtagtctacattgtggttatggcattttatagcccaattctcaccttagtagcattggtaacagtacccttgtttggcttgcttaacttgatagtatcgcctttaatgcggcgacaattacaagaaaaagccgaacgcaatgctgaaactcaatcttacttagtagaagtgatgggagggatgcagacagtcaaggcgcaaaatttagaaatgcgatcgcgttggcaatggcaagaacgttatgctcgttatatcagcgctggtttcaaaacagtctctactcaaactactgctagttcttttagcagctttcttaacaagttttccagtatgttagtgctgtgggtaggtgcttatctcgtcctcaatcaacaactcactctaggacaactcatcgccttccgcatccttgcaggttatgtaactagtccactattacgcttaatgcaactatggcagaacttccaagaaacagctttatctctgcaacgccttgctgaaattttagattctcctcaagaaacagaaacagagacacaaaatattctcatgcctagcattcaaggtaatgtccggtatgaaaatctcagtttcagcttcttggaacacgggccattacaactttccaatattaacttagatttcccggctggctcttttattggcattgttggacaaagcggttctggtaaaagtacattgctaaaattactaccgcgcctttacgaacccaaatctggcaaaatcttgattgatggctatgatatcgccaaggttgaactttattccttacgccgtcaaattggaatggtgttacaagataccttattatttgacgggacagtgcgggaaaacattgccttgggaagttccgaagccagtgatgaagaaattattgccgccgcaaaggtagcatttgcccacgactttattatggacttgccaatcggctacaatacccgtgtaggcgaacgtggttcggggctttctgggggacaacgccaaagaattgcgatcgctcgtaccgtcctccaaaacccccaattacttatccttgatgaagccaccagcgccttagactacaacgccgaagcccaagttggccgtaatctggcaacagcatttcaaggaaaaacagtatttttcatcacacatcgcctcagcacaattcgccatgccaacatcattctcatgatggaacaaggtgctgtagtagaacaaggcactcatgaagaattaatggcacgtaaaggttattactactgcctatatcaacaacaa

SEQ ID NO: 42723 - DNA, 996 bp, Anabaena PCC7120
ttgcaagatatcatcacgcagatgcgccaagtatcagattgggatgcagtgttaagaattactgtggcgaaagttagagaaaaaattgcttgcgatcgcgctttaatttatcagtttacttcacctgagtctggaacggttttagcagaatctagaactcttggttggacaccaacaatgggggaaattctgccagggattacctttggtttagatactaatcgagactatatagagccgataactattaataatgttgctcaaatccaacttaccccttatcaaaaacagttactggataaattccaaattaaagctagtttaagtttaccaatagtagcaggtggtaaagtttggggtttgttggtagtgactggctgcgttagtgctagaaactggaaagaaacagaaataactctattaactcaagttagtacagagttaacctatagattgcagaattttgagtttcaaactcaattaaaactgcaaaatcaggctaaacaagccgtatctaaagtgatggagaaaatcttacgagtatcaaatatcgataagatttttcaaaccactactcaagaaatccgtcaattattgaagtgcgatcgcgtcgctgtttatcgcttcaatcctgattggagtggggaatttgttgcagaatctgtaggtagtggttgggtaaaactggtaggccctgatatcaagactgtttgggaagatacccacttacaagaaacccaaggtggacgttatcgccatcaagaaagttttgtcgttaatgatatttatgaagccggtcatttttcttgccatctagaaattttagaacagtttgaaatcaaagcttacattattgttcctgtgtttgctgcggaaaaattatggggtttattggcagcttatcaaaactctggtacccgtgagtgggtagagtgggaatctagttttttgactcaagttggtttgcaatttggcatagctatttctcatgcagaa

SEQ ID NO: 42724 - DNA, 2193 bp, Anabaena PCC7120
gctgggggtggtttaccagtgattcagtattgggtagaacaaactctctcaccacagggattacagttatggcaaactctgaatcataaaagtgcgtgtttatcctgtgcttggggtacgggtggacaaaaagggggatttgtgaatgaagcgggagaatatttacaacgctgtgctaaaagtgtagaggcgatcgctgcggaattgcaaccaggaattaaacaagagtttttccaagaacatagcatcagtgaattacaaaacctcacttctcaagagtgcgatcgcttgggtagactaagttatcctttaattctcagatcaggctcatcccattatcaacgtattagctgggaagaagtttaccaaatcgctacacaagcctttaatttcccaccagcgcgagttgctagttatagttctggacgttcatccaatgaagctgcctatctactacaattattcatgcgatcgctaggtagcaataatctagcagactgctcagatttgtgtcacgctccctcaacagtggggttaaaaaaggtttttggctcaggtacatcaatggtcagcctagagagcctaaaacatagtgattgtcttgttttaattggttctaacgcaccagcaaaccatccgcgcttgatgaacgaattaatcaaattgcgggaaagaggcggaaaagtaattattattaacccacaagtagaaatcggactagttaaatttgcctctcctgcatttcctattaaatctttactcactggtggttcagatatatcttccttatatttacaaccaatccctgggagtgatgtagcgttatttgtagggttgcaaaaatcactcatagaacagaatttaatccaaacagaatatctcaatgcctatactcaaaattggcaaaaagttgtagattacgctaatcatatatcttggaacgacattactaatacctgtggcatatcccaagaagaaatcacagccactgcttatataattgggaaatcagcacgtgtagtttttgcctgggcaatgggcgtaactcaacaagctaacggtgtagataatatttttagtattgctaatacagctttaattacaggtaacgctggtaaaattggcgctgggactatgcccattcgaggacattccaatgtgcaaggatttggttcgatgggtgtgactgtaaatttgcgagaagaaatcaaacaagcactatcccaagtattaggaaaaactctgaacgaaactcctggttatcatacccgtgatttaatagaagcagcagaaacaggaaagatagatacactattctgtttagggggaaatctgtatgcagccaacccagacttagagcaagcaaaacaggcattatcacaaatagatactattttttatgtagcgaccaaaccaaacttaggacatttccacggattagctaaacagcaaactctaatattacctgtattcaatcgctttgaaaatcctcataaaaccacaactgaatcaggcaataattttgtgaggttaaatgatgaaggcaaaagtcatttacaaccacgtaatgctgacttgatttcagaaatagaattaattacagaaattgctcatcgtttacatagtgaaacaccgataaattggcgtaaactgcaagatacaacttatatcagagaattaattgctaaaactattcctggttatgaaaagattgccacaatagaccaaaccaaacaggaatttgtaattgagaggcggattttagaagaaccgaaatttacaacatctgatggcaaagcgcagatgtttgttacacctttaccacaattatcagtaccaactaaagccgaatttggtgtgtcagagaatcagccaggaattgtgctaattttgggaacaggacgcagctatggtcaacataatactgtagtttatcgtagtgaagataaatacagaggaatgcctcatcgtctctgtattttaatgaattattttgatgtaaaaaaagcaggattacaggaacatcaacgagtaacagtgaaaggagataagggaaaattagacaatattgaaattatttgtggggcaattcttgaaggtgtagcttttatgttttatcctgaggctaatgttttatttaaagcaaaaattgatccacaaagtggtacacctgcttataaaagagtgccggtt

SEQ ID NO: 42725 - DNA, 2403 bp, Anabaena PCC7120
atgcacgaactatttcaccctatttttgctaatggtgaggaaaaagctgctctgcaacagttgataattgcattagatgcctcaggtaaacgttacttcctgagaaatgagatcctgcatactttttcccaatactgtcagcaagcccaaaagcccacatatttttactattcttcatccgtgggtaagctgattcaatatacccatgaaatcgttttagcagaggacggtacctggtttgtggtgcgtccaaggattgctagccaagaagtttggcgactgacatcagacttggctaagtttgattctatgtcaattgatgcgtttttagatgtaagcgatcgcctagtcaatgcctatgaacccaacatcttagaaattgacctcaattccttttacgaagcttcccccagtattagcgaccctagaaacattggtcaaggtttagccttcctcaatcgttatctatgcagtcagatagcgaccgacccccaatattgggtcgagttagtgtacttagctttacggggattgcaatacgatgggattaacttaatgattggggatgctattccctcaggtatccacctagctaaacaaattcacgcagcgattaaatttctctcggcactacccccggaagaaccatacgaaaaattctacattgaactgcaaaaactcggctttgagccaggatggggtaatacagcccagcgcatcctggagactattacgctgctagataaattgattgattctccccaacctgccgtattagaagcatttgtcgcccgtgttcctgctgtttttcgggtcgtcctagtttccattcacggctgggtagctcaagaagatgtcatgggacgggatgaaaccttaggccaagttatctatgttttagagcaagcacgcagtttagaaaacaaactacagcaagagattaagcttgccggactggaagtgctaggtattcaaccccacgttattattctcacccggcttatacctaactgtgagggtacatactgtaacctgcgcttagaaaagttacacaacacagagaatgcttggattttgcgggttcctttcggggaatttaatcccgaaattaccaataactggatatctaaatttgagatttggccttatctagaaacttttgccttagatgccgaaaaacaactactagcccaattccagggcaaaccaaatttaattatcggtaactacagcgatggtaacttagttgcgttcctcctcgcccgtcgtctcaaagtcacccattgcaacattgcccactctttagaaaaaccgaaaaatttatttagtaatttatattggcaagactctgaggaaaaatatcacttctcagtacaatttaccgccgatttaattacgatgaatgcggctgactttatcatcacatcatcctaccaagaaattttcggcacacccgaaagcataggacagtacgagtcctacaagttctttaccatgccccatctatatcatgtagtcgatgggatagacctgtttaatcctaaattcaacatggttccgccaggggtaaatgagcaagtctttttcccttatagccaaacagcagatagagaccccaatgtcagtaaacacgtccacgacttattatttcatcgtcaagactcgcaaatcttcggttatttagaccaaccccaaaagccacccatctttgcagttgcgcctattacttccatcaaaaatctgactggcttggctgaatgcttcggcagaagtcaggaattacaagcacactctaacctaattctgcttactagtaagttaaacatagatgaaagcaccaatcccgaagaagccagggaaattgaaaaactgcacaacattattaaccaatatcagctacatgggcatattcgctggttagggttacgacttcctaaccaagaagtcggcgaagcttatcgcttagtggcagattatcggggaatttatatccactttgctcggtttgaagcctttggacgcagtattttagaagccatgatttctggcttacctacctttgccactaaatttggtggttctttagaaatcatggaggatcaaaataatggatttcggattaatcccacggacttagagggaacagccgagaaaattttggcattcttccaagagtgcgatacccatcccgaacattggcaagaagtgtctcaatggatgagccaacgcattcatcaaaaatacaactggcaattacacaccagtcaattactagcactgactaaaatctacagtttctggaactttatccgcccagaaagcagcgaagctagagtccgttacatggaaagcctatttcacctaatttataaacccagagccgagcaaattttagcgaagcac

SEQ ID NO: 42726 - DNA, 1200 bp, Anabaena PCC7120
atgggtcgcgccaaaaaggttgttctggcatattctggtggagtagatacctccgtttgcatcccctatctcaaacaagagtggggagtagaagaggtaattaccctagcagcagatttaggccagggagatgaattagaaccaatccgagaaaaagcactaaaatcaggtgcaagtgaatccctcgtagcggatgtcaaagaaagttttattaaagattatgcttttcccgcgatacaggccaacgccctctacgaaaatcgctatccgctaggaactgctttagcccgtccgttaattgctaagatattggtcgaagctgcggcaaaatacggtgctgatgcgatcgcacatggttgtacaggtaagggtaatgatcaggtgcgctttgatgtctcttgtactgcactcaatcctaatttgaagatcctcgccccggcgcgggaatggggaatgagcagagaagcaaccatcgcctatggtgaaaagtttggcatcccctcacccgtgaaaaagtcttcgccttacagcattgataaaaatttacttggtcgtagtattgaagctggtgcgttggaagatcccaaatttgagccaccagaagaaatctatgaaatgacaaaggcgatcgccgacacccccaatgagccagaatacattgaaataggttttactcaaggtctgccaactacactcaacggtatacctaaagaccctgtagcactcattcaagaactcaatcaggtggtaggaagtcacggtgtcggacgcatcgacatgattgaaaaccgattagtgggaatcaaatcacgagagatttacgaatctccggcaatgttggtgctaattccagcccacagagacctagaaagcctgacattaaccgccgatgttagccactacaaacgaggtattgaagagacctacagccaaatagtttacaacggtctgtggtacagccccctgaaagccgccttagatgcctttattcaaaagacccaagaacgggtgtcaggaactgtcagagtgaaactattcaaaggtaacgccaccatagtcggacgctggagcgatagttcactctacacccccgatttagcaacctacggcgctgaagaccaatttgaccacaaagccgccgaaggcttcatttacgtttggggattaccaactcgtatctgggcgcagcaggatagaggt

SEQ ID NO: 42727 - DNA, 1077 bp, Anabaena PCC7120
atgactcagaactatcgaattaccctactccctggcgatggtattggccctgaaattatggcagtggcggtagatgtgctgaaagtcgtagggcagcaatttgatattcagtttgatttccaagaagctttgattggtggtgcagcaattgacgcgacaggcgaacctctgccatcggctactttagatacttgtcgccacagtgatgctgtattactcgctgctattggtggttataagtgggattccttaccccctcaccaacgcccggaagggggtttgttgggattgcgtgcgggattagaattatttgccaatttacgcccagcccaaattttaccgcagttaatcgacgcttcgactttgaagcgagaagttgtggaaggtgtagatattatggtggtgcgtgaactcactggtgggatttactttggtaaacccagaggaatctttactactgagactggcgagaaacgtggcgttaatacgatggtttatacagaatcggaaatcgacagaattggccggatagcttttgagactgcgcggaaacgtcggggtaaactctgttcagtagataaagccaatgtattagatgtatcccaattgtggcgcgatcgcatcaccaatctttcccaagaatacccagacgtggaactttcccatctatatgtagataatgccgccatgcaattggtacgcgctcccaagcagttcgataccatcgttacaggcaacttgtttggggatattctctcggatgcggctgccatgcttacaggtagtattggaatgttaccctcggctagtcttggggcttctgggccgggagtctttgaaccagtccacggttctgccccagatatcgcaggacaggataaagccaaccccctcgcccaagttttgagtgcggcgatgatgttgcgttacgctttagaccaaccacaagcagcagacaaaatagaacaggctgtattacaagttttagagcaaggtgatcgcacaggggatataatttcagtgggtatgaatcttttgggttgccggggtatgggtgactccctcataaaggcatta

SEQ ID NO: 42728 - DNA, 1206 bp, Anabaena PCC7120
attaccagaaatattcgccggacactagatttagaccttatttggcaacaaacagttgacagtctaggtaaagcactcagactagagcgctgtattatttgtccttaccagccctctagctccaaagtgcgagtaattgccgaatatcatcaaccagaccgtccttccatgctgggtttagaaatagatgtaacttctgaaccagcttttgctcaggcgttgacaaccttggaaccaatcattatggaagttccgggttatgaactttgcccacaacagaaaattctagtagtagccacttgttaccaagaccaagctaatggcttaattgcgatcaatttacggcacgaatgttatcccctaactaatgccgaactagaactagctaaagaagtagcagatcagttgggaacagcgatcgctcatgctaccttatataaagaattagaagcagcacgacaaaaagctgaagaagcttcccgcctcaagagtgagtttctcgctaatgtctctcacgaaatccgcacccccttgaatgggatgattggtttcctcaagctgattttagaaggtatggcagacgatgtcgaagaaaaaaatcagtttttatccgaagcccatcaattatctttacatctactcaacattattaacgacatcttagatatagctaaaatcgaagctggcaaaatggagttagtgtgcgctcccatcaagctggaagaactattctctgatgtagataacttcatgcgcccacaagcagaggtcaaaaacctcagtttccgaatgcaattgccaccaacctcggatgaaatcgttgtgcaaggcaattaccaacggcttttacaagtcatgttaaatatagtcggcaatgccattaaatttactcatgaaggtggtatcactgttactgccgacgttgtcctgaaaaaagggaaactccaagaacagaacttccccggtatggtgagagtgagaatagccgatacaggtattggtgtttccttagaccagcaagacaaattatttcaattattctctcaagtagatggttcccgcacccgtcaatacggtggcacaggtttgggattggcaatatcccaaaaacttgtagagacgatgggtggggaagtgcatttttacagtcttggtgagggacttggttctacagtcacattcaccgtacctctataccagcagcca

SEQ ID NO: 42729 - DNA, 966 bp, Anabaena PCC7120
ggcggtattgagttagtagtggggttactaacagatgagttagtccgacgtggacacgaagttacactgtttgcatcgggagattctatcagtttagcaaacctagtatcagttcatccccgtgcgctaaggcttgattccagtgttaaggaatacggcatttatgaaatgctccaactaggcacattatatgaacgtgcagatgagtttgatatcattcattcacacatggggtgtgcatccctgccctatacaaagctagtcacaacccccactgttcacactctacacggcatttttacccctgataacgaaaaaatgtttaggtatgctaaaactgagccttttgtgagtatttctgatgcacaacgggatctgagattaggacttaattatgtaggaacagtttacaacggcattgatgttagtagttacaagttttatccccaaccggatgaaccaccatatttagcttttttaggtcggatatctcccgaaaaaggtacacatttagcaatagaaattgccaaaaaagctggttggcatttaaaaattgcaggtaaagtagatgttgttgatgtggaatattttgaaaaggaaattaaaccattaattgatggcaagcaaattgaatatttaggtgaagcagaccacacacaaaaaaatgtattgatgggaggtgcagtcgccaccttattccctattacttggagagaaccatttggattagtaatggttgagtcaatggcatcaggtacgcctgtgattgcgatgaatcttggttcaactacagaggtaattgcccacggtaaaacaggcttcctgtgcagtaatgtagaagaatgtgttagtgcgatcgccaaagttgcagatttagaccgctatacttgtcgagagtatgtgcagaaccgttttagcctgcaagcgatgactggcggctacgaagaagtttatcgacaaattctg

SEQ ID NO: 42730 - DNA, 615 bp, Anabaena PCC7120
atgaaggcttggcattctgcggggaaagttcacggagttgcagccgacgtttccacttctgagggtcgtcaaatgatgcttgattacgttagcaagacctttggagaacttgacattttggtgaacaacgttggcacaaatattcgtaagaaagcgactgattacacagaagaagaatttgctgcgatatttcaaattaatctaacttctatatttgagctttcccgactgttttatcccttactcaaaacaagtaaaaacagcagtatcgttaacatcggttctgttgctggattaatttccgttcggactggcgcaccctatggcatgaccaaagctgcactcgtgcagttaacgcgatcgctggcggtagaatgggcagatgatggtattcgcgttaatgcgatcgcaccttggtttatccaaactcctctgaccgagcctctactcaacaatcccgaaactttaagcgcagtcctttcacgcacaccaatgaaacgcgtgggtcaacccgaagaagtagccagcctgacggcttttctctgtatgcctaccgcatcctacatcacaggacaatgtattgctgttgatggaggatttctggcatttggtttt

SEQ ID NO: 42731 - DNA, 903 bp, Anabaena PCC7120
gatattcccgttccggaagcaccaccgggagaagcgcttgtacgggttctgcgtgcgggaatttgcaacacagatttggagttgctgcggggctattatccctacacaggaattttaggacacgaatttgtgggactggtggaacaagggccagaacatctactaaatcaaagagtcgtcggggaaatcaacgctgtctgcggttattgtcgtttttgtcgccgaggacaaccaactcactgtgaaaatcggacagttttaggtattgtcaaccgtcatggagcatttgcagagtacctttgtttaccagtagaaaatctccatgttgtacctgaaaatgtaccaacagacgcggcaacttttaccgaacctttagcagccgccctagaaattcaacaacagataatattgagtagagatgaccgtgtgctagtagtcggagatggcaaattgggacaattagtagcccagacattagctctaactggttgtgaactattggttgttggtcgtcaccaagaaaaacttgctaatttaaaagtacggggtgtgcaaacgggtttagttgatgctgtccaagatagagcttttgatattgtagtcgagtgtactggtaatccagaaggatttgcgatcgctcgtcgggctttgcgtccccgtggtactctagtgctgaaaagcacctatgctggcaatctcagcttagatgcttcttctttagtagtagacgaaattactctcatcggttctcgttgtggtgtttttccccctgcactggagctattagctacaggaaaagttgacgtagaacccctgattcatagccaataccccctcactcaaggacttttggcctttgaggaagcacaacgccgaggcgtgttgaaagttttgctggaaatg

SEQ ID NO: 42732 - DNA, 699 bp, Anabaena PCC7120
aaaacccaaacaaacgaatttaatttagatgaattaaatcaacagtttgaaactgccactcctaaagaaattctggcatggtctatagagcatatccccacagggttggtacaaactagcgcctttaatgtggatgacttagtaattacccatatcctttatagtgaactcaagcaaccagtacctgtaatctttctcgatactctgttccactttcaacaaactttagaactcgttgctaaagcgaaagaaatatataatctagatttacaaacctacaaaactccagatgtagatacccgtgaagcctttactgctaaatacggcgaagcgctttgggataaagatattacgcaattccaccacgttaccaaaattgaacctctacaacgtggtttagatgaacttaataccgttgcttggattactggccgtcgtcgcgatcaagccgttacccgcgcgaatatgcctgtatttgaattagatggcaaaggtcgtttgaaagtaaatcccttagcagcttggacacgtcaagatagctgggattacgtagctgaacataaagtaatttataatcctctacacgatcaaggttatcccagtattggcgatgaacccatcaccaccaaggtaggcgaaggcgaagacgaacgcgccggacgctggagaggaagcaataaaactgaatgtgggattcac

SEQ ID NO: 42733 - DNA, 3408 bp, Anabaena PCC7120
gatttaggggtgtgtccttacatgggtttaaatgcttttgcggaagcagacgcagcctatttttacgggagagaaaccgtcacccagcagttaattcatcatctgcgggataattcatttctcgctgttatcggcgcttctggtagtggtaaatcttccgtagtgcaagctggacttattccccaactgcgacaagggaaacacatccccaatagtgaacagtgggggataaaaactattcgtcctggtgtcaatcctttggaggctttagccaggaagttgggggaatggggagaaacccatcttttgattgagggaatgttacatcaaggagtggagggttttgtttactggctgcgtagccttccccagggggtgacggtgttggtaatagaccagtttgaggaattatttacccttgcgccaacaccagatagggagttatttctagaattattattgggggctgtacagtatgcaggcgatcgctttaaattaattattactttaagggctgattttatcgctccttgtttggaagtaccagctttagctgaggcgttacaggtagctagtgtgttagttcccccaaaactgagtttggatgattatcggcgggtgattctccacccagcacagcaggtagggttgcaggtggaagcggaactggtggaagtgctgttacgggagttaaatcaatccgtgggggatttacctttactggaatttgttttagaacagttatggcaacaacgaacggctggtaaattaactctacaaagctatcaagaacaactagggggaattaaaggagcattagagcgatcgtgtcaaggggtttatgaaagtttaccaccacaactacaagaatgtgcgaagtggatttttctttcattaactcagttaggggaaggtacagaagataccagaagacgcatatataagtcagatttaatagttaaaaaatatccggctgggttagtagaacaaactctcaatgttttgactaacgccaaattagtagtaattaacctagaagcagagatagaagcacaaggtaaaagtttctctcccactccccctaatctctccactcccttcgtgacagtagaggtcgcccacgaaattttaatacgtcattggtcaactttgcgctggtggttagaagaaaaccgcgatcgcttgcgtaaacaaaggcaaattaatcatgcttgtcagttgtggcaacaaagcggcaaacaagcagactttttgttacaaggtgctaggttagcggaagccgaagacatttatatttactggactgatgaactaggggcggatgtgcaagaatttataggcgcttgtttagcagaacgcaagcatcaacaattacaagcaaaaaatcgcctcaaacaagcacaaagggctgtagtcgccttgagtgttttaggtattgcatctgtgagttttgggggtttagcttattggcaaggtagggaagcccaatttagggaaattgcggcgttaaattcttcatcccaggcaaatttgttatctcatcaacaattagcagcacttattgccagtctcaaagctgcacaacaggttaatcatgtgatagcagttcccaataatctcaaattagcaactgtcactaccttacaacaagccttgtttgagatgcaggaacgtaacaggctagaaggacataaggacggcgtgattagtattagtatcagtcgggatggtcaaactatcgcctctggtagcttagataaaactattaaactttggagtcgagacggtcggttattcagaactctcaacggacatgaagatgctgtttatagtgtcagtttctctcccgacggtcaaaccattgcttccggggggagtgacaaaaccattaaactttggcaaaccagtgatggaaccctactcaaaaccatcacaggtcatgagcaaacagtcaataatgtctattttagtccagatggtaaaaatctcgcctctgccagtagtgatcacagcatcaagttgtgggatactacatctggtcaactcttaatgaccctcactggtcatagtgctggagttatcaccgtgcgtttcagtcctgatggtcaaactattgctgccggtagcgaagataaaaccgttaaactgtggcatcgccaggatgggaaattattaaaaaccctcaatggacatcaagattgggtaaatagcctcagttttagccctgatggtaaaactctcgcttccgctagtgcggacaaaaccatcaaactttggcgcatcgctgatggtaaattggtcaaaaccctaaaaggtcacaatgattcagtttgggatgttaattttagctcagatggtaaagcgatcgcctctgctagtagagataacactatcaaactgtggaaccgtcacggcatcgaactagaaacctttacaggccatagcggtggtgtttatgctgtgaattttcttcctgatagtaacatcatcgcttccgctagtttagacaacaccatcagactttggcagcgtcccttgatatctcccttagaagttctcgccggcaatagcggtgtttatgcggtcagtttcctgcatgacggtagtatcattgctacagccggtgcagatggcaatattcaactttggcacagtcaagatggtagtttactaaaaaccctaccagggaacaaagcaatttatggtattagttttacaccccaaggtgatttaatagctagcgccaacgccgataaaactgtgaaaatttggcgtgttagggatggtaaagctttaaaaacactcataggacatgacaacgaagtcaacaaagtaaattttagccctgatggtaaaaccctcgcttccgccagtcgggacaacacagttaaactttggaatgtgagcgatggtaaatttaaaaaaaccctcaagggtcatacagacgaagtattttgggtcagttttagccccgatggtaaaattatcgcctctgctagtgctgacaaaactatccgactctgggacagttttagcggcaacttaattaaaagtttgccagcccataatgacttagtatacagcgtcaacttcaatcctgatggtagtatgcttgcctcaactagcgccgacaaaaccgtcaaactctggaggagtcatgacggtcatctactgcatactttctcaggccatagtaatgtagtttatagtagtagcttctctcctgatggtcgttacattgcatcagccagcgaagataaaacagtaaaaatttggcaaattgatggtcacctgttaaccaccctaccccagcatcaagccggagtcatgagtgcaattttcagcccagatggtaaaactctcatctccggcagtttagacactaccaccaaaatttggcgttttgat

SEQ ID NO: 42734 - DNA, 813 bp, Anabaena PCC7120
atgacagatactcaattggttgtttcatcgagttggcttttgcaaaaccttcacaatatagatgttgtgattgttgactgtcgcttttctctagccgacccacagttaggaaaacagcagtaccaaacaagtcatatagaaggagcctattacctagacttaaacttggatctctcaagtcctgtgggtgagcatggtggaagacatcctttacccaacccggatgagttagcgcagaagttagcaagtatggggatagagtttcaaaaaactttggttgttgcttatgatgactcccgctttgcttttgcttctcgtctttggtggttattgcgctatttaggacatgagcaagttgcagtattaaatggaggttttagccaatgggaacaagctggctatcctattactgatgttattcctcaactcaaaacagctaattttgtgccgcaaatacaaacacaactgttagtagatattgaagatgtcaaaaatcgtaaagatttaccgacggtcgttttggtagattcaagagagagcgatcgctaccgaggtgaacgagagccaattgataaaattgcaggccatattgctggcgcagtcaattatccttggatggaagttacagatagtagcggctactcaattcctctaacaaaacatcaacaaagatggcaaaatctggcgaccgccgaagaaattttagtttactgtggttcgggtgtaacagcttgtgtgaaccttctctctttggaagtagccgggattcatacaggtaaactgtacgcaggtagttggagtgattggattagt

SEQ ID NO: 42735 - DNA, 1437 bp, Anabaena PCC7120
attattctggatgtcggagggatgaagtgtgctgggtgtgtaaaggcagtagagcgacagctcacccaatattcaggtgtgaagaacgcctgtgtgaatttggctacagaggtagcggtggtagagtcggaagtcggtctggtagatccagatatgttggcacagcgattgacatctgctggatttcctactcaaccgcgaaaagccaacagtaaggcaagtgaatcaacaatagaagactcagccgcaagacaacgccaacaaatgcagacagcattccggcagttaatgattgctgctgtgctgctggtcttttcggggatcgggcatttgggcaacattggcaattcaattctgcccatattaaataacatttggttccactttggactagcaacagttgccttactaattcccggtcgccctattttagttgatgggtggcttggttggcggcggaatgcacctaacatgaataccttggtgggattgggaacgctgacagcctacacagccagcgttgtggcgctgctgtttccgcaaatgggttgggagtgcttctttgatgaaccagtgatgatgctggggtttattttgttgggcagaaccttagaacaacaagccagaggtaaggcggcggcggcatttagacaactgttagcactgcaaccacaagtagcacgattgattgctaacccagacctagagaagatggggctgggaacaaatactgtagaaatcccggctgaacaggtaagggtgggagaatggttgcaagtattaccgggtgataaaatccccgtggatggggaggtacgttttggacagacaactttagatgagtcgatgttgactggggaagctgtgccggtcatgaagcaaccaggggatatagtcacagccggaacgattaaccaatcaggggcgatcgctatccaagccacccgcacaggtaatgataccaccctcgcccacatcgtcgccttggtagaagcagcccaaactcgcaaagccccaatccaaaaattagccgatacagtagcaggttactttacctacggcatattaacagcatctttattaacattcatcttctggtattgcttcggcactcacatctggccagatatcaccgtatccggtggtgatatggaaatgatgatgaaccacgccgctcatattaccaacaactccccactcttaattagtttaaaactagcgatcgccgtcatggtcgtcgcctgtccctgtgccttgggactagccacacctacagcgattctggtaggcacaggtataggtgcagaacggggtttattaatcaagggtggcgatgttttagaaaaagcccatcaactagacaccgtagtttttgataaaaccggcactctcaccacaggtaatcccgttgtcaccgattgtcttgtatttgcagaa

SEQ ID NO: 42736 - DNA, 909 bp, Anabaena PCC7120
gttttgtgcctcggcgaagttctattcgattgtttagctgatcaattagggctaaagctggaacaggtaaagtcttggactgcttatccaggaggagcgccagctaatgtggcttgtgctttagtgaagttgggaactcccgccggatttattggtgctgtcggtgaggatgagccaggaaatgtgctggttaagctattacaagaagtaggtgtagatacaacgggtgtacaacgtcattctactgccccaactaggcaagtctatgtggtcagggatctagcaggcgatcgcactttcgctggcttcggtcagtatgatacatctgaatttgctgatacgcatttgcaagccaagcaattaccagagtcagtgtttcaagaagcggatttcctgattttgggtacattggaattagcctatcccgacagtgaaaaagctattcaccgagctttggaactggctgaacagtatgacctgaagattgtgctggatgttaactggcggccggtattttggcatgatgaaaatattgctaggcaaaaaattcaggaaattttcaaacgcgttgatttcctcaagcttgctaaagaagaagctgaatggctattcgacacctctgatccaggcgctattacttaccgtttaggctctattgagggggtattagtaactgatggcgaaaacggctgtggttattgcttgggtgagaatgaaggtaaaatacctgcttttgctgtttctgtagtagataccacgggcgcaggagatagctttctggcagggtttatccatcaactgagtgaacatggcattcacaacttgaatgatgcagagacagcaaaacgcattattacttatgctagtgctgtaggggcgttgactactactaaagcaggtgcgatcgct

SEQ ID NO: 42737 - DNA, 780 bp, Anabaena PCC7120
atgaaaattgctacttggaatgttaactcgattcgcactcgtctagagcaagttttggattggttaaaacaaaatcccgttgatgttctgtgcttacaggagacaaaggttatagatgatgattttccacgatcgccttttgaaaatttgggctatcactcatatatatcaggacagaaagcttacaatggcgtagctttaattagccagcaaccccttacagatgtgaccacggggttcacaccgattttgccagatatagaaccgatatgggacgagcagaaacgagtaattacaggggtgatagatggtgtacggattgtcaacctctatgttcccaatggttcagcgatcgccagcgaaaagtatgaatataagctacgctggttgactgtattgagagagtatctgcgatcgcttctcttattacaacctgccatctgcatctgcggtgactttaatatagccttagaagacaaagatattcacgaaaaagtcaaagctgaaaatcacatcatggcatccctagccgagcgccaagctttacgagatgttttagaactaggctttgctgatgcttttcgcaaattcaccaccgaaggcggacactttagttggtgggactaccgcgcggcttctttccgccgcaaccaaggctggagaatcgatcatcactacctcacaccagtactatacgcacaggcaaaaagttgcactattgatgtctcccccagaaaattaactcaacccagcgatcatactcccgtcattgtcgaaatt

SEQ ID NO: 42738 - DNA, 960 bp, Anabaena PCC7120
ggaggtattgaactagtagtaagtcacttgacaaacgaactagttcgtcgtggtcatgaggtaacattatttgcctctggcgattctcaaaccttggcacatttagaaacagtttatccgcgtgcattacgcttagacaaaaatgttcaagactatgccgcttatgaaactttagaactgagccaagtctaccagaacgcgacaggattcgatattatccattctcatttagggattgcggctttacctttagcgagtttggtaaaaactcctacagtacatacgctgcatggtcattttaccaaagataaccaaaacgtctttagtcatcatcatcaacaaccatacgttagtattagcaacgcccagcgtcaaattcatctcaattatataaaaaccgtttataacggtattgagccaaaagattatccgttcatttctcaaccaaaagagccgccatatctagcatttttaggacgcttttctccagaaaaaggcccacataaggcgatctcgatcgccaagcagagtggttggcatttaaagatggcaggaaaagttgatacagtagatgccaagttttttgaacaagagattctccctcatatagattgtcagcaaattgaatatttaggcgaaattaaccatacagaaaaagctgaactactaggcaatgctgctgctactctttttcccatcaattggcaagaaccttttggtttagtgatgattgaatcaatggcaactggtacgccagttatagggatgaattttggttctgtacctgaggtgatcgaccaaggtaaaacaggttttatctgccaaaattatgaagaaatgattcagatgatacctgctactttggaattggatcgtcgagattgtagagaatctgtagaaaacaaatttagcgttagccaaatggttgatgggtatgaagcggtatatcaacaaattatc

SEQ ID NO: 42739 - DNA, 1248 bp, Anabaena PCC7120
attcatcgcactgtactagacaatggcattgtcgtgctggtagcagaaaatccagccgcagatattattgctgggcgaatttttatccgtgctggtagctgctacgaaaagcgagaacaggcggggttagcccatttgctggctgctgtaatgactaagggatgtgaaggactttccagtttggaaatagccgaacaagtagaatctgtgggcgcaagtttgagtgcagatacttctactgattactttctcgtgtcattgaagacggtaacatcggattttcccgaaattttagcattggcggggcggatattgcgatcgcctacattccccgaaactcaaattgaactggaacggcgtttagcactccaagatattcgctcccaaaaagaacagcctttcactcttgcctttgagcaaatgcggcaggtaatgtatcaaaatcatccctacgccatgtcagtgctaggagatgaaaccaccctgaacagcatcaccagaacagatttagtcgagtatcaccaaacttatttccgtccagataacttagtcatcagtgttgctggtcgcatcactctacaagaagtagtagccttagtagaacaaatattcggtgattggcaagcaccaaccatagccccagcagtagttaacttaccagaaatctcagtcaacccccagcaccgcttaaagcctgtacaaacccagcaatctatcgtcatgttgggttatttaggcccatcagtcagttctcctgattatgcccccctcaaattactttctacttacttaggcaatggtctttctagccgcttgttcgtagaattgcgagaaaagcgggggttagcctatgaagtatcagcattctacccaactaggctttatccagcatcatttgtagtgtacatgggtacagcaccagaaaataccagcatcgctttagaaggattacggacagaagtagagctactctgtagtgaagaagtatctacaaccaatttacaagctgctaaaaacaaaatattgggacaatatgccttaggtaaacaaactaatggacaaattgctcaaatctacggttggtatgaaattttgggtttaggaattgactttgacggagaatttcaagaactgattgcttctgtaactgctcaagacgctttaacatcggcacagcagtatttgcagcaaccctatgtgtctttagttgggcaggaagaggcaattaatcgagcaattaattaagta

SEQ ID NO: 42740 - DNA, 3420 bp, Anabaena PCC7120
gatttaggtatttgtccctacagagggttacaagctttccaagaagaagatgtccaatatttttacggtagagaaaccctcacccaacaacttatagcagacttagcaaataagtcatttatggctgtggttggtgcatcgggaagcggtaaatcttccgtcgtccaggcgggtttaattgcccaactccgccggggtcagcaattaccagggagtcaagaatggtggatgaaaagctttcgtcctggggaatatcctctagtcagcttatcccattgcttagtggatagtggtactgaaaaagaaaaagcgtatcaacaaatgcagctagaggggatgttatatcaaggggcgcaaggatttgtccattggctacatcatcgccgcgaaccaatggtagtgttggtattagaccagtttgaagaattatttaccctggcggctagtgaagataggcagagatttctagacactgttttgggtgcgttggagttatcaccagacaagtttaaattaattgttactctccgggcagattttattgctccttgtttagaaatacctactttagcgaagcttttacagcagtcaagtattttgctaccgccttgcttaactcaagaagagtaccgccgaattattattcaccccgccgaaaaagtaggattaacagtagacccggaattagtcgaggtgctgttacaagagttacataactcccctggagatttaccattactagaatttgttctcgaacaattgtgggaatatcgagacaaaggtgtaattaccttacaagcttaccagcaatacttgggcggaattaaaggcgcattggagaagaaagcccaaggcgtttacgatactttagattcagaagcccaagaatgcacccggtggattttcttatcactgacacagttaggtgaaggaacagaggataccagacggcgggtactcaagtctgagttaattgtcaaaaaataccctgttgctttagtagaaagaacattacaagttttgactgtggctaagttagtggtagtgaatggggagtgggaagagggaagagggaagaggcagggggcagggggcagggggcagggggaaaatatcttgctcacaactccctccgtgacgatagaagtagcccatgaggtgataattcgttactggtcaactctacggtggtggttagaggaaaatcgtagtagattgcgatcgcatcgacaaattgaacaatcggcggctttatggcagcaaaacaaccaacagcctgattttttattacaaggtgtccgactagcagaagctgaggaaatttatcttaattacactgatgaattatcttgggatgtccagcatttcattgaagcttgtctccatgaaaggcgacgtaaacaaaaccaagaacaaagccgactcagacaagcacaaagggccgtcagtattatcagtactttgggtttaacggcgtttggtttagcggtttttgcttatcaacaaacccaaaacgcccaactcaaagaaattcaagctttaaattctctgtcggaaaactttcttctctcccacaaacaattagaagcactcatgactagtgtgcaagctgggaaggaagtacaaaacattagtttgggaatccccccagatacccgcacgcaaacggcaacaattttacaacaagcagtctacaacactcaggaacgcaaccgtttactgcataatgcttgggtaactagcgtcagttactcaccagatggtgaagtcattgcttctggtagtgtagataacaccatccatctttggcgtagagatggcaaattgcttaccactctcactggtcataatgatggggtaaatagcgtcagtttttcccccgatggtgagattttggcttctgccagtgcagacagtaccatcaaactttggcaacgcaatggtcaactaattaccacactcaaaggacatgaccaaggtgtcaagagtgttagtttttcccccaatggtgaaattatcgcctctggtagtagtgaccataccattaatctttggagtcgtgcaggtaaattactacttagtctcaatggacatagccaaggtgtcaatagcatcaaattctccccagaaggtgataccattgcctctgccagtgacgatgggacaattagactgtggagtttagacggtcgccctttaatcaccatcccctcccacacaaaacaagtgttggctgtcacatttagccccgatgggcaaaccattgtttcggctggtgcagacaataccgtcaaactctggagtcgtaacggtactttgctgacaactctagagggacataatgaagctgtttggcaagtaattttctcccccgatggacggttaattgctaccgccagcgctgataaaactattaccctttggtcgcgtgatggcaatatcttaggaacttttgctggacataaccatgaagtcaatagtctcagttttagtcccgatggcaatatattagcttccggtagcgatgataatactgtcagactgtggactgtgaacagaacactacccaaaaccttttatggacataaaggtagcgtcagttacgtcagatttagcaatgatggtaagaaaattacctcactcagcaccgacagcacaatgaaaacctggagtctggatgggaaattattgcaaaccttgtcgtctcctctacctgatgtcaccagtatcagtttcacaccagacaataaaatcgtcgccttagctagtcctgaccatactatccacctttacaaccggcaaggcggtttgctgcgtagcttaccaggtcacaaccattggataacgagcttaagtttcagtcccaacaagcaaatattagcttctggtagtgctgacaaaaccatcaaactttggagtgtaaacggtcgcttgttgaagactctgttaggacataatggttgggtgacagatatcaaatttagcgctgatggcaaaaacattgtctccgctagtgctgacaaaactatcaaaatttggagcttagatggtaggctaatcaggactttacaaggtcatagtgctagtgtgtggagtgtcaacctttcacccgacggtcaaactctagcctcaactagtcaagatgaaactatcaaactctggaatttaaatggggaattaatctacaccctccggggtcatagtgatgtagtttacaatttaagtttttcacctgatggtaaaacaatagcctcagctagtgatgacggcacaattaagctatggaatgtccctaatggcacattactaaaaaccttccaaggacatcgcggcggtgtcagaagcgtgagttttagtcccgacggtaaaattttggcttccggtggacatgatactacagtcaaagtctggaacctggag

SEQ ID NO: 42741 - DNA, 768 bp, Anabaena PCC7120
cctttatacggaaaacggattttagtgacagcaccaagaaactacgcttctaggttgtctgcacaaattatctgcaagggtggtttaccgattcttatgcccacgatagaaacctgctatttatctaacttttctaaattagatgctgttatcagcagtataaatgaatttgattggattgcatttactagcagaaacggcattatagcattttttgagcgtctacataatttagatatttctataactaaattgcaaaattgtcaattatgtgcgttaggaaaagatatagatattttattatctttgtttggtaaggttgatttgattcctgatgaatctagcccggcggggattgtagctgaattttcgcaaatatgtggaattagggaacaaaaaatactagtgcctgtgccagaagttataggcatacctgagcctaatattgtgcctaattttatcaaggatttagaagaattgggtatgcaggtgattcgtgtacctgcatatatcactcaatctttagacaaagatatttactctgtagagataaatttaatccagcaaggcttaattgatattatcgcctttagtagtacggcagaaatagaaagttttctcgcaatgtttaactccaagagtgagtttcagcattgtgttgttgcttgttttggcccttacacagccgcaaacgccgaacagttaggtctaaatgtttctattgtgtcaacagactttagttcttttgaaggtttcgtagaagcaata

SEQ ID NO: 42742 - DNA, 540 bp, Anabaena PCC7120
atctttgatatggatgggttgctttttgatacagaaagcattgctcgctgggcatggcagcaggccctagccagtcatggatatataatgagtgataatttttatagtgaatttgtcgggcgtgatttgtcatggcgagaaaaaattctcaaacaaaggtatggcaatgattttccttttgatgccataaaaagacaccgaattgaaattggcgatcgccgagaactgcaagaaggtttgccaatgaaagtcggtgcgttaaacttattgtgtcaactaaatagtttaggaataatcattgctttaggaacaggcacatcccgcagccgcactatccgccgtttaagcaatgctggcatcttgccttactttacaacaattgtcaccagcgaagatgtaccacaaggtaaacccgcaccagatatatatttagaagttagtcgcagaattcatgttgcacctgtgcagtgcgtagtttttgaagactcatgcgtaggggtagaagcagcctttagcgctggtatgtatccgattatggtt

SEQ ID NO: 42743 - DNA, 951 bp, Anabaena PCC7120
cctggcatgggttgtggaacttgggcgtggggaaaccaattgctttggggatataacgaaagcatggacgcgcaattacaagctgtctttaacctctgtgtaagtaatggtgttaccttgtttgatacgggagattcttacggcacgggaagattaaatgggcgtagtgagttgctgctggggaaattttctcaagaatatcaaggtgtcaatcaagaaaatatttgtattgctactaaattggcggcttacccctggcgatggacacgccaatcaatgataaatgcttgcaagtcttctgctcaacgcttgggtagaaatgttgacttagtacagatgcactggtcaactgccaattatgcgccttggcaagaagtagggctattagatggtttagcggatttgtatgagcagggtttagtgaagggtgtgggactatctaattacggaacaaaaagactgcaacgtgtacatcagaagtttgcagagcgaggagtaccaattaagacactgcaagtccaatattccttattgtctacctatcctgtgactgagttggggttaaaagacgtttgtgatgaactggggattaagctgattgcatacagccctttagctttgggaatattaacagggaaatattcagaaaaaggcccgtttccaagaggtgtccggggtttactgttgagacagttgttgccaggagtgcgatcgcttctccaatgtttacaagatgtggcacaatccagaaataaaaccatgtctcaagtagcgcttaactggtgtattgctaaaggaaccatgcccatccctggtgcaaggtctgtcaaacaagcccaggagaatatcggtgcgttaggttggcaattaaactctggcgaaatagccgagttagataaagcggctgctagttctgataaaaaaatggtgcaaaatatttttcagactaaa

SEQ ID NO: 42744 - DNA, 1584 bp, Anabaena PCC7120
aatcaaatattacgttacgtagtaattattatcttgcttagttctgccatgttgctcatccgtatggcttcgcggatttggttatttggagtgggtagacaagtagaatttgaccttaaacaacggatttttgaacatttactcaagctagaaccagcttattttgctaccaatacaattggtgatttaattagcagagcgactagtgatgtcgataatgtcaggcgcttattaggttttgcggtcttaagtttggccaacaccctatttgcttacgttcttaccttacctgtcatgctaagaattagtgtcgatttgacactcgcagctttggcagtctatccctttatgtttgttttagttaatttatttagcaatcgtttacgtcaagaacaggcaaaagtacaagaacaactctctgacattagtgagctgattcaagaagatattagtggcatcgctttaattaaaatttacgcccaagaagaaaacgagcggcgcgcttttgcccaacaaaatcaaaagttattaggggttaacttggaactagccaaaagtcgtaatattctgtttcctctaattgggggtttagccagtctgagttcactaatagttatttggttgggaacatcacgaattgcggagggaaccttagctgttggcgattttttggcgcttctcatatacatagaacgtctagtctttcccacagcgctattaggttttacgatttctgcttaccaacggggtgaggtgagtgtagatcgtttggaagctatcctcagcgtagaagctaaaattcaagatgctgatgcagccatacatttagaattaggtgaggtaaaaggggaattaaccgccaagaatctcagttacacttatccgggtgttgaaaacccagctttgaacaaagttaactttactattgctcctggggaaactgtggcgattgtaggagcaatcggttctggtaagtctaccttagctaatgccttgcccagattgttggaagttgctccaggacaattgtttttagatgggcaggatattactcagatagctttggccgatttacgtagtgcgatcgcttatgttcctcaagatagctttttatttagtaccacaattaaaaataatatccgctatagcgatcctgtcagtcccccagaaaatgtagagtatgttgctaaactagctcaaatccatcccgaaattattaattttccccaacagtatgaaactatcgtgggagaacgtggtattaccctttctggcggtcaaagacaacgtactgcactagctagagcaatgttagttaatgctccagtcttaatcttggatgatgccctctctagtgtggataatcaaacagctacacaaattctcaataatctatctagtggtactgaacgtaagactgtagtttttatcactcatcaactttcggcggcggcagcagcagaccggatttttgtcatggataaagggcaaattgtccaggtgggtaatcacttggaactcttgcagcaagcaggtctttaccggaaattgtggagccagcatcaggtggcagaattactaagt

SEQ ID NO: 42745 - DNA, 1242 bp, Anabaena PCC7120
atgtctttttctcatctcggcttgtccaatgaaattatcaatgctgttactgagttggggtacaccaaacccacacccatccagatgcagtctattcctgctgtcttatcaggacgagatttgctagctggcgctcaaactggaactgggaaaactgccagctttactctccccctcctacatttattatcccaagatagtcttaaaagcgcctccaatgcttcctcacccattcgggcgctaattcttaccccgactcgtgaactcgccgcacaggtggagtcaagcgtgcgtgactacggcaagtacttgaagctgaactcaatggtgatgtttggtggagtcagcattaatccccaaaaacagcgtttaaagggtcgtgtagatattctggttgctaccccagggcgactgctagaccatgtgcagcagggaacggtaaacctttcacagattgagattctggtgctggatgaagccgaccggatgttggatatgggctttattcgtgatatccgtcgtatcctctccctgttgcccaaacagcgacaaaacttgctattcttcgctacattctcagacaaaatcaaggaactcgccgccggtctactgaatcgcccgcagatgatcgaagtagcacgccgtaacgttacagccgatactgtgacacaaaaagtctacaaaatagagcgcgatagaaaacgagatttactggctcacctgattcggaaagataattggtatcaagtactagtatttactcgtaccaagtatggtgctgaccgtctagttaaacaattaggccatgagcgcattcaagctctagctatccacggtaataagagccagtcggcgcgtacccacgctctggcaaagttcaaaaatggtagtttacaagttttagtagcaactgacattgctgcacgaggactggacatcagcgaattgccttatgtggtcaatttcgatttgccctatgtaccagaagattatgttcatcgtattggtcgcactggtcgcgctggtgcatcaggtgaggctgtatcgctggtgagcgccgatgaatatcatttgttggcagatattgaaaaactgattgaaaagcgattgccttttgaattggtagcgggtattggagctaattcccaagctaaacccgaaccaactcaggatgaacgcaagcaaaaacccaaagatagtcagcatcagcctcgctctgctgctcaaggtgtgccaaagaaa

SEQ ID NO: 42746 - DNA, 516 bp, Anabaena PCC7120
gaatgtcctgtgcgtgaaggtttgctagatactcctaagcgagttgtaaaagctttgcagtttttgactaagggatataatgaatccttggatgaactgttaaatggtgcagtatttacagaagatgccaatgagatggtattgattcgggatatcgacattttcagttcttgcgaacatcatattttaccaattattggtcgcgctcatgttgcctatattcctaacggtaaggtgatagggttatctaaaattgcgcgagtttgtgagatgtatgctcgacgtttacaagtacaggaacgtctgacactacaaattgctgatgcactgcaaggtttactcaaacctcaaggggtagcagtggtaatagaagcaactcatatgtgcatggtgatgcgcggtgtacaaaagcctggttcttggactgttactagtgcaatgcgtggtgtatttgcggaagatgctcgtactcgtgaagagtttatgaatttggtacgacacaatgctaattttcac

SEQ ID NO: 42747 - DNA, 1281 bp, Anabaena PCC7120
tcttccttgaatgacatcgctcaacaaactcgccaagctgcaagtttattggcgatgctgtctaccgaggcgaaaaatcaagcgatcgctgctgtcgctcaagccttagaatctgcaaaggaggaaattttacaggcaaatattgatgattgtgaagcggctacggctgaagggatagccaagccattatacaagcggttgcagttggatgaacataaattaagagatgcgatcgctggggtgcgggatgttggtaaactagcagatcctatcggacaagtacaaattcagcgtgaactagatacaggtttagttctcaagcggataacttgcccgttgggagtgttggggattatttttgaagcccgtccagaagcagccattcaaattatctccttagctatcaagtcgggtaatggcgtgattctcaaatgtgggaaggaagctgtacgttcttgcgaagccatagtaaaggctgtgaaacagggattatcaaccacagatgtcaatcctgaggtagtacagttactcaccaccagagaagaaaccttagaacttttacgcctagataaatatgtagatttaattattcccagaggttctaactcttttgtgcggtttgttcaggaaaatactcgtattcctgtacttggtcacgccgatggcatttgccatgtatatatagataagtccgcagatatagagaaagcaattgctgtgagcgtcgatgcaaaggtgcagtatccggctgcttgtaacgccattgaaaccttacttgtccaccaatcaattgcggcggaatttttaccaaaagtagcccaagccttagctgaacgtgaggtggaattgaaaggggatgaacggactttgcagatattacctgagattgcggccgccacagccatagattgggaaacagaatacagcgattttatcttgtccattaagattgtagactcattaaccgaggcgatcgctcatatcaatcaatatggttctcgtcataccgatgccattattaccgaagatgtggcagccgttaaaaccttctttggcttagttaattcagccggagtctttcacaactgttctactcgcttcgccgacggtttccgctatggctttggcgcagaagtaggtattagcactcaacaaatgcccccccgtggccccgtgggtttagaaggactggtgacatataaatatcagatgacaggtgcaggacatattgtcgccacttacacaggggaaaatgccaaaccttttactcacaaggatttc

SEQ ID NO: 42748 - DNA, 1110 bp, Anabaena PCC7120
gaagtaatatcggcattaggtgtacgcttgacacgacaagcagacatcatagacatcaatgccagcgaaattaagacatcaaaagctccctatgagctagttacccagttacgagcgagcttctttgccattggagccatcttggcaaggctaggcgtagcacaaatgccattacccggtggttgtgccattggagccagacccgttgatttgcacgtccgaggactgcaagcaatgggtgcagaagtgcagattgaacatggcatttgtaacgcctatgttcctggtagcggtggtaggttgaaaggagccaaaatttacctcgacactcccagcgtgggagcgacagaaactttaatgatggctgctaccctcgccgatggcgaaaccatcttagaaaacgctgcgcgagaaccggaagtagtcgatttggctaatttctgtaaggcaatgggagcaaatattcagggtgctggcactagtacaattactatcgttggtgttcctaaattacactctgttgactacagtattattcctgatcgcatcgaggctggaaccttcctcgttgctggagctatcacccgttccgaaattaccctttcctcagtagtaccagagcatttaatcccgttaattgccaagttgcgggatattggcgtaaccatcatagaggaaagtccagattgcttacgcattcttcctgccgaaatcctcaaggctacagatattgataccttgccccatcctgggtttcccacggatatgcaggcaccatttatggccttgttaactttggcagaaggcgacagcattattaacgaatcagtatttgaaaatcgcttgcgccatgcctcagagctaaatcgcttaggggcagatattcgggtgaaaggcaacactgcttttgtacgaggagtgccacttttatccggtgcgccagtcatcggtaccgacttacgcgcatcagccgcgttagtcatagccggattagcagccgagggtaaaacaaccattcagggcttacatcatcttgatcggggctacgatcaaattgatgtaaagttgcaacaattgggagctaaaatcctccgagtacgggaggagcca

SEQ ID NO: 42749 - DNA, 1641 bp, Anabaena PCC7120
attgaatttcgccaagaaactatttactttctagtagttgatcgcttttatgatggcgaccctgaaaatagcgaaggctataatccagaactttatgacccaaatggagaagattggggtaagtattggggaggcgacttacaaggagttattgataaattagactatctaaaagatatgggagtaaccgcactttggttaactcctttatttgaacaagtcgaagaattatttgttggtaacgccgccatgcacggctattggacaaaagattttaaacggctgaatccccgctacattggtaaggatgaaaatccttctttaaacaatactcaagaaaccagaaatactacttttgaccgcttagttacagaattacacaagcggaaaatgaagctcatacttgatatcgtctgcaaccatagcagtcctgatactagtggtagcaaaggcgaattatatgatgatggggtaaaaatcgccgactttaataatgatgtgaatcattggtatcatcactatggtgaagttgaagattgggaagatgattggcaagtccaaaactgtgaactttcaggactggcaacttttaacgaaaacaatactgaatatcgtcaatacatcaagttggcaattaagcaatggctagaccggggtgtggatgcactgcgggtagatacagtcaaacatatgccgatttggttttggcaagaatttactggtgatatgtataatcacaaaccagatgtgtttatttttggtgagtggatttacaatcatcccagtgacgatctttcggtggaatttgccaataattccggcatgactttacttgattttggtctgtgcgtagcaattcgcggcgcactagcccaaggcgcagaagggggattccacctcatccaagaagtatttgaccaagattatcgctacaacggagctacagagttaatcacctttgttgataaccatgatatgccccgctttcaatccctcaatcctgatccggcgatgttgaaagtagcgatcgccctgattatgacatcacggggtattccatgtatctattacggtacagaacaatatctgcatgatgatactaacggcggtaatgacccctataaccgccccatgatgggaaattgggatactgatactgaggtgtatagatacctccgattgttgtctggtatccggcggttaaatccagccatctctatgggtagccagtggcaaaaatacctcacatctgatgtttactgttatgtccgccgttatcgttcttctgtttgcttcgtcgccctcaaccggggtgcagaactcatcttaccagaagtccaaacagacttaccagatggtgaacatacttgcgccgtgactcggaataaatttgaggtaaaagacggtaagatttacaatctgcaactcgaagaacggggagtcatggttttaagtcatgtaggtgaacgggtaaaagcgcaaacaatagtccgcgttcaacttaatggtgtacatactcaacccggtgaaactatcgtagttgtcggcgactgtccagaattgggtaactgggatattagtaaagcctatcccctggaatacatcaactctaatacttggtttgccgaaataccatttgat

SEQ ID NO: 42750 - DNA, 717 bp, Anabaena PCC7120
gaaaacgtctataaattttataacaacacccctgtagttaatgacttgtcattcaacattgaggctggagaaatatttgcacttctcggccctaacggtgcaggaaaatctaccactattcggatgctgactacactaacaaaaccatcccaaggaaagatggaggtagctggctatgatgtagtacgccaacctatgctagccaagcagagtattggcgttgtcttgcagcaaactagtgtagatggcgatttaagtgtgtgggaaaatatggaactacatgggaggctacatcacatccctaacccacaacgacaacgactaattaatcaatggctggattatgttgaattagcagacaggcgggaaagcttggtaaaaactctgtctggagggatgaaacgaagactgcaaatagctagagctttattgcatcaaccacaaatcttgtttttggatgaaccgacggtagggctagacccccaaactcgtcgtcggttgtgggaaattattggggatttaaataaacaaggtatgacgatgttattaacaactcattacatggatgaggtggaatttttatgtgatgcttttggctctgctaaaccaggacgcataggtattatggatggcggtaagttaatttctttggggactttacagcaattgcgttctgctcacggcgaaggcctagtcatgaaacagttgagggtgacc

SEQ ID NO: 42751 - DNA, 852 bp, Anabaena PCC7120
tccctagccattagccctgacgggaataaactggctagtggtggtgatgacaaaatcatcagattgtgggaattaaatacgcaaaaattactcgcctgtttctcaggacattctcaggctgtcacctcagtaagttttagtccccagggcgaaattttagccacggctagcgacgataaaactatcaaattgtggcatctgccaacatctagtgaagttttcaccttaaatggacatacaaaccctgtcaaatctgtaagttttagccctaatgggcaaattctcgctagtgggagttgggacaagcaagtcaaactgtgggatgtcaccactggtaaagaaatttatgccctcaaagcacaccaattacaagtgagtgcagtagcatttagtccccagggagagattctagccagcgccagttttgacagaacaattcgcctatggcagataacacaaaaccacccaagatataccttaatcaaaacactttcaggacatacaagggcggttttggcgatcgcatttagcccagatggcaaaattttggcaacaggcagcgatgacaatactataaaattgtgggatatcaacactggtcagctaattgccactcttttaggccattcctggtctgtagttgcagtgactttcaccgccgataacaaaacactgattagtgccagttgggataaaaccattaagttgtggaaggtaagcacaacagaggaaattgtgactcttgccagtcatttagactcagtgtgtgctgttgctgttaaccctgttacccaagtgattgctagtagcagcagggacaagaccatcaaattgtggcaacttgtaatacag

SEQ ID NO: 42752 - DNA, 1797 bp, Anabaena PCC7120
cccaaaaaatcagctgttcccggtttgtggggagtgctggcttatttctggcctgatattcgtccccagtatggattacttttagtttcggcgatcgctttaattgcagatgtcggactgagagtattagaaccttggccactcaagtttgtctttgattacgttctgctgcgcggcgaaaggctcaatactgttcccctcatagctaatctagaaccaatcacattactgacattctcagccgttgcagtcttaattattacaggcttacgcgccctggctgcctatgggagtactgtaggattagctatagtcggtagccgagtcatggcgaaggtgcggaatcgtttatattgtcatctgcaaaatttatctttggcttatcacaccaaagcccgtagcggtgatttaattatccgtgtcagtagcgatgctagtcgtcttcaagaaatcatgattacggcagcattaccgctagtagtcagcattctctctctatttggcatgattggggtgatgttctggatgaatcgtagcctcaccctgctgtcattaatcacactaccgttcttttggttagtcactaaccgactcagccagcgcatcaaagattcctcattaaagcaacgtcaacaagagggggctgtagcagcaacggcggctgaatcgattgcggcgattaaattagtcaaagccctctccctacaggatgcttttgcgcgagtatttgctcaacaaaatcaaagtagtctgaaagaaagcgtcaaaacccaacggctggcggctcacttggaacgtactgtagatggggtgattgcaatgggaacagcaattattttatggtatggctcttggttggctctgcgagatgctttaacccctggggatgtgctggtattccttacctacctcaagaacgcctttaagccagtgcagaacttggctaaatacacgggacgactcgctaaagcggcggcttctggtgagcgtatcttagatgtgttaaatcagaaaccagatatcagtgattcacctgaagccttccccgccccaattttccggggtgcggtgcgttttgatcgcgtccactttgcatataactcaggacgagtgctactagaagacatcaatttaaacattcaatcgggacagcaagtagcgatagtagggacttctggtggtggtaaatcgacgttagtcagtcttttattacggctttatgatcccacatctgggcgggtgatgattgatgggcgggatattcgagagtatacattggcatcattccgttcccaaattagtgtagttttgcaagatagtctcttgtttgctgccagtattaaagaaaatattgcctacgggattgctggggtgtctgatgcggaaattgaagaggcggcgcgtttagctcatgctcatgattttatccaagctttaccgcaaggatatgacaccctggtgggggaaagaggctcgactctttctgggggacaaagacaacggattgcgatcgctcgtgcggcgattcgtcaagctcctatcttgattttagatgaacctactacggggttagataaggaaagtgagaaggctgtaattgatgctttgcaaaggttgtcagcaaatcgcacgacttttttgattactcatgatcttgattttgctactcgcgcagatatgattatttatctggaaaatgggcggatagctgaacaaggttctcatctggagttgatgcggaaacatgggcgttatgcggctttgtatgaggtgcaggcttctttgagggtttagaga

SEQ ID NO: 42753 - DNA, 1524 bp, Anabaena PCC7120
atgtccaattcagaattagatagagtcatcgtccgcccagtggatgagtataatcagaaattggtggcttatgtgcatccgcccgattgggtgaacccccaaccggctgataattatgacttggtggtcattggtgcggggactgctggcttagtcgtggcggcgggtgcggctggtctgggtttgggtttaaaagtggcgctaatcgaaaagcatctcatgggtggagattgcttgaatgtgggttgtgtaccttctaaaactattattcggtcttcgcgggtggtgggggaaatctggaatgggaaaaatttgggggtgaatattcccagccagattgatattgattttcccgcagttatggcacgaatgcgacgagtgagggcaggaattagccacaatgattcggcggaacgctttgcatccctgggagttgatgtatttttaggtagtggtagatttgctagcagcaacaccgtagaagtagctggtaaaacccttaaatttaaaaaagcggtgattgctactggtgctagggctacaaaaccagcaattatcggcattgaacaagctggatatctcaccaatgagacggttttttccttaattcaaagaccggaaaagttagcagtaattggtggtggccccattggttgcgaattagcccaagccttccgacgtttggggagtgaggtggtgctgattcatagcggttcccatgtcctcaacaaagaagataacgacgcggcgcaaattgtccaacagactttaattaaagaagggattcgcttagttttaaatgccaaggtagaagaagtagtgacggtaaccgagggtaaacggttgtatttttctaccaacggtcatcgtgattcggtgacggtagatgaaatattagtgggtgcagggcgatcgcctaatgtggaagggttgaatttagaagctgtcggggtaaaatacgacaagcgtcggggtgtggaagtgaatgattacctacaaaccaccaaccccaagatttatgctgctggcgatatctgcatggactggaaatttacccacgccgccgatgcagccgcgcgcattgtgattaaaaataccctgttttctccctttggtttaggcaggtcgagactaagtagcttagtcatgccttgggtgacttatactgacccagaagttgcccatgtgggactgtacgaaagtcaagacgtagagacaattaaaatcccttttagtagtgtagaccgagcgatcgccgacggacaagaagatggttttctgaaaattcaccacaaaaaaggctcagatgaaattgtcggtgcaaccattgtggcaagtcacgccggcgagatgatttcggaagtcacaacagcgatagtcaataaaatcggtttaaacaaactcagtaacgtgattcatccctaccccacccaagccgaagccatcaaaaaagccgcagatacctatcgccgcacccttctcacaccaagaacaaaaaaactattgggatttttaaccaaattt

SEQ ID NO: 42754 - DNA, 831 bp, Anabaena PCC7120
caaccaccacagcaacagcaaccaccgggtacagaatcaaaaatgcagccaaaacctcaagctgatgatgctcagtatcgaggtagcggtaaattaaaagataaagttgccttgattactggtggggatagtgggattggtcgggctgtggcgatcgcctatgctaaagaaggtgcagatgtagcctttgtttacctgagtgaacacgacgatgcggaagaaaccaaaaatttggtagaagaacaaggaagacgtgctgtatctattgccggcgatataactgatgaggctttttgtcagcgtgcgattcaacaaacagtagatgagttcggtaaattggatattctcatcaataatgcggctgaacaacatccccaagaaagcattgaagatattactaaagaacagttagaacggacattccgcacgaatattttttcaatgttttacttgaccaaagcagcaatcaaacacctgaaaaaaggtagcgccattatcaatactacttcagttacagcttataaaggtagtccacagttacttgattattcttcaactaaaggtgcaattgttgcctttactcgttccttatcacaaaacttaattagtaaaggtatccgggttaatgctgtggcacctgggccaatttggacacctttaattccctcaacatttcccgcagaaaaagtagaaacctttggtaaacaagtacccatgcaacgagccggacaaccagaagaagttgcacctagttatgtgtttctagcttctgatgactcatcttatatgtctggtcaagttttacatcccaatggtggggaagtagttaat

SEQ ID NO: 42755 - DNA, 1182 bp, Anabaena PCC7120
ctcaaaaaaatacaatctttgcaacagaaatctcaaaatttaggtatttctaatcaggaattggagcggactaatcaactgaaaaatcagtttttagccaatacaagtcacgaaattcgtacacctctaagctcgattattggttttactcacctgcttctagcccaaggttacgatccaacaagagaacgtcatcatgaatatttaaatattattcaatctagcggtaaacacctattggctctgatcaacgatattttggatctctccaagattgaagccaatcagttagaagtacagtgggaaaaagttaatgtaccagaactttgccaaaatgtattaacgctgatcaaggagaaggccgcaaataaaggggtgaaattatctttggaattagatcccaatatcaagacctttgttgctgaccctctgcggctcaaacagatgcttttgaatttgttatttaatgctctcaaatttaccaatcaaggcaccgttggcttaaaggtgacacagcaagattcatttatccactttacagtctgggacactggtagtggtatttctccagaaaatctggcgttactgtttcaaccatatttccaaattcctaattcttccgttgctcaacatgaaggtactggtttaggtttagtggtgactcgtaaactggcagaaattcacaatggttctgtagaagtagaatcccaagttgctcacggttcccgctttactattattttgcctctacaacagaatgagcaagtattagtaggagaagatgtggaggatgaagaaacgaaatctgctgcatctttgacacctaacagttcaaaagaaattttgttagttgaggatgatttacccaacggtgaattgatgcaaactcacttgtctaagttgggatataacgttacttgggtcaagaatgcccatgaaatgtgggctaaacttgacgaacaacaagcagcagttatcttaatggatgtccggttacccgatggagatggtttagatttagtcaagcagttgcgagaaaaatctcaatatcaacagattcctattattgcccaaacggcgatggcgatgaaaggcgatcgcgccgtctgtctatctgctggggtcaacgactatatttctaaacccatagatttaaatctcttggccagtctggtggctaag

SEQ ID NO: 42756 - DNA, 1275 bp, Anabaena PCC7120
atgaccgcaacttctccccgattaaagcacgaggttaaagacctcgccctcgctcccttgggaagacagcgtattgaatgggctggacgggaaatgccggtattgcggcaaatccgcgatcgctttgcccaagaaaaaccctttgctggacttcgccttgtggcttgcgcccacatcaccacagaaacagcacatttggcgatcgccttaaaagctggtggtgcagacgctgtattgattgctagtaaccccttatcaactcaagatgacgtagctgctagcctcgtcttagaccacgaaatccccgtatttgctcaaaaaggcgaagataacgccacctacaatcgccacgtccaaatagctttagatcaccgtcccaatatcatcattgatgatggtagtgacgtagtggcaactttggtacaagaacgccaacatcaaattgctgatttgattggtaccactgaagaaactactaccggtattgtccgtttacgcgccatgtttaaagatggcgttctcaccttccccgcagtcaacgttaacgacgcagacaccaagcatttctttgataaccgctacggtactggtcaatctaccttagacgggattatccgcgctacaaatattttgttagctggtaagaacgtcgtcgttgtcggttacggctggtgtggtaagggtacagccctgcgcgcccgtggcatgggtgcaaacgtcatcgttaccgaaatcgaccccatcaaagccattgaagctgttatggatggtttccgcgtcctgccaatggcggaggctgcgccccaaggtgatatctttatcactgtgactggtaacaagcacgttgttcggggtgaacacttcgatgtgatgaaagacggtgcgatcgtttgtaactctggtcactttgatttggaacttgatttaaaatacttggctgctaacgccaaagaaatcaaggaagtccgtcctttcaccgaagaatataaattgacaaacggtaaatccgtcgtcgttctaggacaaggacgtttgataaacctagctgcggctgaaggacacccaagcgcagttatggatatgagttttgctaaccaagctttagcttgtgaatacctggtgaagaataagggtaagttagctcctgggttacactcaattcctgttgaggttgatcaagaaattgctcgcttgaagttgcaagcaatgggtatttacatcgatagtttgactcctgagcaaattgagtacattaattcttggactagtggaact

SEQ ID NO: 42757 - DNA, 771 bp, Anabaena PCC7120
atgaatattcgaggtaaagtagccctagttactggggcttcccgtggaattgggcgagcgatcgctttagaattagcacaacaaggaatacacagattaattttagtggcacgcgatcgccaaaagttaagagaagtcgcccaggaagttgaggcgatgggagtcgaagccacaacattggcaattgatttaacgcaagcgacagaagtaaacattgccatagcgcaactatggcggaattacggccccattcacttacttgttaactgtgccggcgttgcataccaaagttcattcttgcaatcaaaacttccccaagtacaagaggaactttctgtgaacttactgggaatgtataccctcaccagcctcatcgccaaacgtatggcgagtcaaagacaaggaactattatcaatgtttccagcttaatggggaaagtggctgcaccgacaatggcgacttattcagccacaaagtttgctatcttaggctttactcaagccttacgccgtgaactcgctgagtacaacatccaggtgaaggcgttattaccatccctcaccgacacagatatggtgcgtgacttaaaactatttcgctgggtgattcccatgacaccccaggaagtagccaaagcgctaattgctggactagaaaaagatgcaccagaaattttagtaggatggcaaagtcatttagccgtgtggtgtcaacgtttagccccttggttactggaattggttttaacaattgccacaccaccagctatt

SEQ ID NO: 42758 - DNA, 897 bp, Anabaena PCC7120
tactggcgagatccttatcatttactgctaactattccttggactggctttttattactaatttgtctttcttatctagcaattaatctcatatttgccctagcttattggctgggaggagattgtatagccaatgctaaacctggtaattttttggatctattcttctttagtgtacagacacttgcatctattggctatggtgcgatgtatcctaaaacactatatgccaatactgttgttaccatcgaagcaatgattggtttggtaggaattgctgtgatgacaggactggcatttgctcgcttttcccgcccttctgcccgtgttatatttagccgtgttgcagtcatcacaccgtacaatgatgtaccaacgctgatgtttcgcactgctaaccagcgacgcaatttaattctagaagcccagatgcgcgtctatttaatgcgtgacgaaatcacagcagaaggaggatttattcggcgtttccacgatttaaaactattaagaaatcagacacctagttttacattaagctggctagcactgcatcctatagatgaattcagccctttatatggaatgtcagcagagtcgctaatacaaacaaacacaaatataattatctcggtcagtggcattgatgaaacagtagcccaagtagttcatgcccgttatacttatacggctagtaatattttatggaacagtcgctttgttgatatttttcaccatacatctgatggacatcgctacatcgactataaatattttcatgatgtcttgcctttagataaaataggctaagaaattcaagatttaaaacccgattacctattttaccccttgatcaaaaactgtcgcaatatctctcctggcttgcgatcccaagtatct

SEQ ID NO: 42759 - DNA, 270 bp, Anabaena PCC7120
gggtttgccttattttttcataattactctaccttcctcaccaagccaggcatttatctagaagacttgtttgtcctacccgactatcgacgacaaggcattggtaaagcactcctcactaaattagcccaaatagctgtcgagcgtgattgtggacgactagaatggagcgttctggactggaatgaatcagcccaagcattttaccgccacatgggagcaaccatattagacgattggcgaatttgccgcgttacagaagacgcaatg

SEQ ID NO: 42760 - DNA, 1230 bp, Anabaena PCC7120
tttgatcaagcttgtagctacttggaagcagccgcaaaagagttgaggctagatcaaggggcgctggaaattctcagtcacccacgtaaagttgtgacagtttctatacctgtgagattagataacggtgacatccgggtgctagcaggacatcgagtacagcattctgatatattaggcccctacaaaggtggaacgcgttaccatccagctgtgacactgcgggaagtatctgctctagcaatgctaatgacttggaaatgtgcgctattgggtattccttatggtggtgcgaagggaggtattgctatagatcccgaacactacagtgtaggtgaattagagagaattactcgtcgttatacaagtgaattgattaaagatatcggcccttccgtagatataccagcgccagatgtgggaacttccgcccgtgagatggcttggatgatggacacttattctatgaatgttggtcacgcagtcccaggggttgtcacaggtaagccaatttctatcggtggttcacggggacgggaaatggcaactggacgcggtgtaatgattattgtccgtgaagcactggcggatatgggcagaaccttagagggagtcaaagtagttattcaaggttttggcaatgtaggcggtgctgcggctgaattactgtaccaagctggagcgaaaattcttgctgtttctacaggtgcaggaggtttatttgcgtctgatggtctggatattccggcattaaaagcctacgctgcggaaaatcatcggagtattgtgggttttccccaagcagtaccaattagtaatgcagagttgctaactttaccttgcgatgttttgatacccgcagctttggaaaaccaaatcactgaggaaaatgtagaccagatacaggcgcaaattgtggcggaagctgctaatggcccggtgactttggaggctaaccgagttctagaagggcggggtgtgactgtactaccagacatcttggcgaatgctgggggtgtggtggtgagttatttagagtgggtgcaaggtctttcttacctattttgggatgaggagcgtgtcaatcgggaaatggaacacttgatggtgcaagcttatcatcaagttattaaacagtcacagatgcggcaagttcctttgcgattagccgcttataccttgggtgtgggtagggttgctcaggcgttgagcgatcgcggtctttatcct

SEQ ID NO: 42761 - DNA, 1424 bp, Anabaena PCC7120
ttaattgatgcccaagccaaggtagtagttacagctgatggtggttggcgtaaagatgcgatcgttcccttgaaagaacaggtagacaaagccttggctgatgacgctgttcccagtgtggagaatgtcctggttgtcaagcgtaccggacaagatatttatatgcagttgggaggacgagatcattggtggcacgatttacaaaaaggtgcatcggcagattgtcccgccgaaccaatggacagcgaggatttactctttgtcctctacacttctggtagcacaggcaaacccaaaggtgttgtccacaccactggcggttataacctatatactcacatgaccaccaaatggattttcgacctacaagacacagatgtatattggtgtactgccgatgtaggctggattaccggacacagttacattgtttacggccccctctccaacggtgcaaccactctgatgtatgaaggtgcgcctcgtgcctctaatcctgggtgtttctgggatgtaattgaaaaatacggcgtgaatattttctacaccgcacccaccgcaattcgcgccttcattaaaatgggcgaacaccatcccaacgcccgtaatctttcttctttaagattattaggaaccgtcggcgaacccatcaacccagaagcttggatgtggtatcacaaagtaattggtggtgaacgctgccccatagttgatacttggtggcaaacggaaactggcggtatcatgattacgcctctaccaggggcaatttccactaaacccggttccgctacccttcccttccccggcatcctggccgacatcgttgatttagaaggtaacactgtaccggaaaacgaaggtggttacttagcagtgcgttatccctggcctgggatgatgcggactgtctacggcgatccggaacgcttccgccgcacctactgggaacacatccccccaaagatgggaattatacttactttgccggcgatggtgcaagaaaagatgaagacggctatttctgggtaatggggcgtgtggatgatgtattgaatgtgtcaggacatcgcctcggtacaatggaagtagaatcagctttagtgtctcacccagccgtagctgaggcggcagtagtgggcaaaccagatgacttaaaaggcgaagaagtggtagcttttgtcaccctagaaggaacttatcaagccagcgaagacttgagtaaagccctcaaacagcacgtagttcaggaaattggggcgatcgctcgtcctggggaaatccgctttactgacgcattaccaaagacgcgatcgggtaaaatcatgcgccgcttactacgaaatctcgccgccggacaagaagtttctggcgatacttccactctggaagatagaagtgtcttagataaattacgcgaaggt

SEQ ID NO: 42762 - DNA, 435 bp, Anabaena PCC7120
attaaaacgacttttacatctgaagaaattcagaaattattaccccaccgctacccgttcttgcttgtagacaaaattattgactacacaccaggaaaacaggcagtaggtattaaaaatgtcactattaacgagccacatttcaccggtcatttcccagatagaccactaatgccaggagtactaattgtcgaagcaatggctcaagtaggtggtattgtgatgacgcaactgccaggcttagaaggtggtttatttgtattcgcgggtattgataaagtccgtttccgccgtcaagtagtaccaggagaccaactggtaatgacagtggaactgttatggattaaacaacgtcgtttcggtaaaatgcaagcccgtgcagaagttgacggtcaactagcagccgaaggcgaattaatgttttcgctgatcaac

SEQ ID NO: 42763 - DNA, 999 bp, Anabaena PCC7120
accactacactgccatttactcttcaggatttaaaagcggctattccggctgagtgttttcaacccaatgtcagcaaatcactattctacttttttcgtgatgttctgattgtcggtttgttatacgcagtcgcccattacctagattcttggtatttttggccaattttctggttaatccaaggaacgatgttttgggctttgtttgtggttggacatgactgcggacaccaatctttttctaagcataaatggctcaatgatttaattgggcatctgactcacaccttcatattagtcccttatcacggttggcgtattagtcacagaactcatcataaaaatactggcaatatcgataatgatgaaagctggtatcctgtgactcaatcgcaatacaaggaaatgccattagggcaaaagataggccgttattacgtatttctactggcttatccagtgtatttgtttaagcgttctcctaataaggaaggctctcattttttacctagtagctctcttttcaagccatcagaaaaatgggatgttatcaccagtaccgtactgtggagttgtatggttggtttgttaggtttcctaacttatcaatggggctggatgtggttgttaaaatactatgctgcaccatacatagtgtttgtaatttggcttgatttagtcacattcctacaccacactgaagctgatcttccctggtatcgtggcgaagattggactttcctaaaaggtgcaatttccagtattgaccgcaattatggtttagtcaatcacatccatcatgatattggtactcatgtagcacaccacattttcttgaatattcctcactataatttgctgaaggctaccgaggcaattaaaccagtcatgggtgagtattaccgcaagtcagaagaacctatttggaagtcattgtggcgttcttgcgtgagttgccattttgtccccgatacaggcgggaaagtttactacacttct

SEQ ID NO: 42764 - DNA, 1050 bp, Anabaena PCC7120
atgactacatcaatcatcaaaaatcaggaaataaaaaataagcttagtaatcccgaactaaggctcaaagatattattaaaactctgccaaaggaatgttttcagcagaaccgtcgcaaagcgtggacacaagcactacttagtgttgtgatggtgggtttaggttactggagtttggcgatcgcaccttggtttctgttacccattgcctggatttttacaggtacagccttaacaggtttttttgtgattggtcacgattgtggacaccgttcatttgccaaacgtcgttgggtaaatgacttggtagggcatatatttatgatgccgttaatatatccctttcacagttggcggattaagcataatcatcaccacaaacacaccaacaagttagacgaagataatgcttggcatcctatcagaccagaagtttttgccagttggggtaaaactcgtcagtctgcctttaagttgtttatgcgtcaaaggctttggtgggtaggctcagttggacattgggctgttgtgcatttcgattggcggaaattcaaagttaaagaccaagctgatgtgaaactttctgttgctgtagtagttttatttgccgcagttgcttttcccaccctcatcgctacaactggtatttggggatttgtaaaattttggtttgtgccttggcttggttatcatttttggatgagtaccttcaccattgttcaccacacatatccagatgttccttttgaagcagagaacaaatggcatgaagctatggcacagttatttgggactattcattgtgattatcccaaatgggtagaagtgttgtgtcacgatattaacgtccacgttcctcatcacctttctacagctattccttcttataatttgcggctagcttacagcagcattcaagaaaattggggtgattatctacatgatgaacttcgcttttcttggtctttaatgaagctcattactgacgaatgtcaactgtatcaaactgatgttggctatcagccttttaaagattattacgcaggacga

SEQ ID NO: 42765 - DNA, 816 bp, Anabaena PCC7120
atgacaattgctacttcaactaaacctcaaatcaactgggtaaataccctatttttccttgggctacacatcggcgctttgtttgcctttatccctagtaacttcagctgggcggcagttggtgtggctttattgctttactggatcactggtggtttgggtattaccttaggctttcatcgccttgttacccaccgcagttttcagactcccaagtggttggaatattttctagtgctttgcgggactctcgcttgtcaaggagggccaatcgagtgggtcggtacacatcgcattcatcatttacattccgatactgatccagatccccatgattctaataaaggtttctggtggagccatattggttggctaatttatcactctccctcccacgctgatgttcctcggttcaccaaagatattgccgaagacccagtctatcagtttttacagaaatatttcatttttatccagattgctctggggttgttgctgttatatctaggcgggtggtcttttgtggtctggggagttttctttcgcatcgtttgggtttaccactgtacttggttggtaaacagcgctacccataagtttggctaccgcacctatgatgctggtgacagatccactaactgttggtgggtagctgtcctagtgtttggtgaaggttggcacaacaaccaccacgcttttcaatattcagctcgtcacgggttggaatggtgggaagttgatctgacttggatgacagtgcaattgctgcaaatactcggtttagcaactaatgtcaaactagcagacaaaaagcag

SEQ ID NO: 42766 - DNA, 1944 bp, Anabaena PCC7120
ggtttacgggcgcaattagccgtagttcctgccattgctatcagtcgcttgcaaaccccagtcatgctgcaatggcaaaaccgctttgctatcctctacaaagctaccgatagcgaactggtgttaggtgtcccaggaaagggaatacaacgccacaaacccaaagccttcattgaaacttggggagaacaaggcgagattctcctcctccaaccaaccaaggaaaccccccgtaaacgcttcggcttaagttggtttttacccttcgtttcccagtatcgccgcgtcttgagtgaggtattaatttcctccttctttgtccagttgttcggcttggcgaatcccctaattacccaggtaattatcgataaagtcctaattcaaaactcccccgccaccttgaatgtgttggggacattgttagttgctacagccctatttgaagccgtcctcaccaccctacggacaaatttattcgtagaaaccaccaaccgcatagacatggccttggggtcagaagtcattaaccacctgttacggctacccctgggttactttgaaaagcgtcctgtaggcgaactctcaacccgcattaacgaactagagaacatccgccaattcctgacaggtacagccttaacagtagtcctagacgcgatattttccgttatttacatcgtcgtcatgctgtactacagttggctattaaccttagttgccttagctacagtccccctatttgccctgttaggtgtaattgtcgcccccgtcatccgccaacaaacccgcacccgcgccgaacgcaacgcccaaactcaatcttatttagtcgaagtcgtttccggtattcaaaccgtcaaagcccaaaatattgaattgcgatcgcgttggcaatggcaagaccgttatgctcgttatgtggctgatagtttcaaaaatgccctcacctccaccacagcaggttctatcagtaaatttctgaaccaactctcagggttattactcctctgggtcggcgcattcttagtattacaaggaacactcaccctcggtcaattaatcgccttccgcatcatcgctggttacaccacaagccccctactgcgtctagtgcaactgtggcaaaacttccaagaaacagccttatccctggaaagattgagtgatattttagacacaccccaagaagaagcagtgcgtcaagatatccccttaccagatattcaaggagcagttaaatacgaccatatcaccttccgcttcaccaatagccccaccccccaactagacaacattagtttagatattccccctggtaaattcgtcggtgtagtcggacaaagtggcgcaggtaaaagcaccctcaccaaactcttaacacgtctctatgatcccgaagttggacgcatcctcatcgacggttacgacatccacaaagttgaactgtattccctacggcgacaaatcggcatggtattacaagataccctgttatttgataccacagttcaagaaaatattgctctcaataaccccgaagccacaccagaagaaatcatcaacgctgccaaaattgcctacgcccatgagttcatcatgagcctaccgatgggatataacacccgtgttggggaaagaggatcagcactttctgggggacaaagacaaagaattgcgatcgctcgtaccgtcctgcaaaacccccgtctcctaattatggatgaagccacaagtgccttagattacaacagcgaacgccaagtctgtcaaaacctgcaacaagcactagaagggcgaacagtcttcttcataactcatcgtttaggtactattcgccatgctgacattatcttaatgatggaacaaggccgcattgccgagcaaggcacacacgacgaattaatggctctcagagggctgtattactgtttataccgccagcaa

SEQ ID NO: 42767 - DNA, 2031 bp, Anabaena PCC7120
ttcggccccttctacgattacaccccaaccatccgcgatcccaagaatattggcaagggtgtacaatatctcaaccgttatctctccagtaaactttttcaagactcgcaacaatggctggaaagtctgtttaatttcttgcgcctacataattacaatggtattcaactactaataaaccatcaaattcaatcacagcaacaattatcacagcaagttaaaaacgcgcttaactttgtgagcgatcgccccaatgatgaaccctacgaacaattccggctgcaactacaaactatgggttttgagccggggtggggtaatacagcttctcgtgtgcgggataccttaaacattttggatgaattgattgactctcccgacccccaaaccctggaagcttttatctctcgcatcccgatgattttcagaatcgtcttagtttcagcccacggttggttcggacaagagggggttttaggtcgtccagatactggtggtcaagtagtgtacgtccttgaccaagctaagaatttagaaaagcaactgcaagaagatgccatacttgcaggtttagaggtattgaacgtccagcccaaggtaattatcctcacccgtctgattcctaatagtgacggaacgctttgtaaccaaaggttagaaaaagtctacggtacagagaacgcctggattttgcgtgtacctctgcgggagtttaaccccaagatgacgcagaactggatttctcgattcgagttttggccttatctagaaacctttgccattgactcagaaagagaattgttggcagaattccaaggtagaccagacttaatcgtgggtaattatactgacgggaacttagttgcttttctgttgacgcgacggatgaaagttacccaatgcaacatcgctcatgctttagaaaaatccaaatacttgtttagtaacctctactggcaagatttggaagaaaaatatcatttctctttacaattcacggctgatttaatagctatgaatgctgctaacttcgtcatcagcagcacctatcaagaaattgttggcacaccagacagtatagggcagtatgagtcttacaaatgctttaccatgccggaactgtatcatgtggtcaacggcattgaattatttagccccaaatttaacgttgtaccgcctggtgtgaatgaaaattcctactttccctacacacaaactcaaaacagaatagaaagcgatcgcgatcgcctagaggaaatgctgtttaccctagaagattctagccaaatcttcggcaaactcgacgacccaaataagcgtcctattttctcaatggcgcgacttgaccgaattaaaaacctcacaggtttggcagaatgctttggtcaaagtcaagaattgcaagaacgttgcaacttaattttagttgcaggtaagctgcgtatcgaagaatcagaagataacgaagaaaaagacgaaatcgtcaaactttaccggattattgacgaatacaacctgcatggcaaaattcgctggttaggtgtgcgcttatccaaaaatgactccggtgaaatttatcgcgtcatttgcgatcgccaaggcatttttgtacagccagcattatttgaagcctttgggttgacaatcctggagtcaatgatttccggattgccaacatttgctacccaatttggggggccattggagattattcaggataagattaatggcttctacattaaccctactcatctagaagaaacagccacaaaaattcttgatttcgtcaccaaatgcgaacaaaatcctaactattggaacataatttccgagaaagccattgacagagtatatagtacatacacctggaaaatacacacaactaagctgttaaccttagctcggatttacggcttctggaattttacctcgaaagaaaaacgcgaagatttattacgctaccttgagtccctgttctacttaatttacaagcccagagcgcaacaactattagaacagcataaatatcgg

SEQ ID NO: 42768 - DNA, 864 bp, Anabaena PCC7120
ttggtaactggagcaacaggagacattggccgccgagttataagactcctacgcgaacacaatcattctgtacgaggttttgcacgtcttacctcgcgttacggtgaactggaacaccgaggagccaacatctttattggtgatttgcggcgcgaacaggatatagaaaaagcttgccaaggtgttcaatatattatcagcgcccacggctctgataacgatgcactcaccctcgactatcgtgctaacatcgcactgatcgaccaagcgaaagctaacggagtgcagcactttgtctttatttccgtattaggagccgaacgggggtatgaagacgctcccgtatttaaagccaaacgagctgtagaaaattatttggcagctagtggcttgaattacaccattttacgtccggctggattagcatctaacttgctacctttagcagaaaggtttcgggaaacagggttatatttgctaattggcgaccctaaaaaccgtacctccattgtgagtacagatgatttagcaaggatagtagtggattcagtgaccgttccagaggctcgtaatcaaatcttttccgtcggggggccagagattctattacgtgaggacattccccaaattttcagtcatatctttaagaaagaaccaatagtggttaactcaccattattggtcattgatggattgcggggtgtcttgggtttaattaatcccgaagcacaacaggctttaggaactttccgcacattactgtccaatgaatttttctgtagaaaagatgaaatagctaaattagagcagacctttaacttccccttggaaactttggaaagtttcttaaggcgctatttagct

SEQ ID NO: 42769 - DNA, 1920 bp, Anabaena PCC7120
cctccaaccactggccgtaaaccttctaaagtcgaagggcttaaagaaaacagtaattttttacgtgaacctgtagcaacgcaaatccttgaggatactactcattttactgaagatgcggtacaaatcctgaagtttcacggttcttatcaacaagataatcgtgacaatcgcaccaaaggtcaagagaaagattaccagtttatgctgcggacaaaaaatccgggtggcttggttccgccgcagctttacttggctttagacaagctagctgatgaatatggcaaccataccttacgagctaccactcgtcaaggtttccaaatgcacgggattttaaagaaaaatctcaaagcagcgatcgctacaattgtgagaaacttaggttcaactttgggtgcttgtggcgatatcaaccgcaacgtcatggctccaccagcccccttcaaaaaccgggctgaataccagtatgcttgggaatatgcccaaaatatcgctgacttactctcaccccaaacaggtgcttattacgaaatctggctagatggagaaaaagccatcagtgcggaagaaagtccagaagtaaaagcagctagacaaagcaatggtaacgggacaatcattcacgacaccgaagaacccctctacggcacttattatatgccgcgtaagtttaaggtgagtgtgactgttccaggggataattccattgatttatattcccaagacctgactctggttgttctgactgataaaaaaggcaacctagaaggatttaatatctttgctggtggtggtttaggacggacacacaacaaggaagaaacttttgctcgattggcagaccccattggctatgtagccaaggaagatgtgtatagtgccgtcaaagctattgttgcgactcaaagagattatggcgatcgcactgaccgccgtcacgctcggttaaaatacttaatcaatgattggggtgtggataagttccgcgccaaggtggaagaatattttggtaaacccattgcccctttcaagcaactaccagagtttaaatatcacgatttcctgggttggcatgaacaaggcgatggcaatttatttttaggcatttccatcgataacggtcgggtaaaagatgaaggcgcgtttcaactgaaaaccgccttacgggaaatcgtcgagcaatttaacctacccatccgcctgacacccaaccaaaacctgattttctacgaaatcaccccagagaacaagccagcaattcaagccattctcgaccgttgcaatgtggtttccgaccccaccaccattgagcctttagtccgttatgcaatggcttgtccagccctacctacctgcggtttggcaatcacagaatcagaaagagccatccccggcattttggagaggattcgtactctcttagataaattgggtttacaaaatgaacattttgtggtaagaatgacaggctgccccaacggttgcgcccgtccttacatggcagaactaggctttgttggtagcgcgccggaaagttaccaagtgtggttagggggttcacccaatcaaacacgcttggcacaaccttatgtagagaaactgcacgataacgacatagaaagcttcctagaaccgatttttgtgtatttccgcaaatatcggaagtctggggaaagttttggcgatttttgcgatcgcgtcggctttgatgccattcgtgaatttgttgccgagtatcaaccggaaacaacaccagtcaccatagaaccagaacagcctgaagttgtatctaagtcacgtaaagctcggtatcgggtcagcctgcacgatgatttgtataacaaagtgaaggcgacagcgacaagtcaaggccggtcgatgactgatttagtcaaagatgccctagaggcttacttc

SEQ ID NO: 42770 - DNA, 1122 bp, Anabaena PCC7120
atgcgtatagcttggattggaaaaaaatcacccttttgtggcaatgtcacttacagtagagaagttacaaacgccttgctagataggggacatgaagtcagttttctccactttgctcaagaagaaactgaacctgacaactggccgaaattccaagaagtgcctctacccttcatttataagtctcaggtttacactattccaacgttcaaagcgacaaagcttttaactgattcactgcgagaaatcaagccagatattgtccatgcgtctctgactttatctcccctggacttttttctaccagaaatttgtgaccaactgaacttgcccctaattgccacatttcacactccatttgcaggcaaaggcgcaaaactgatatcaggaacacaacttttagcttatcaactatacgcgccttttttgggcaactacgatcgcgtcattgtcttttcccaaattcagcgagaactattggcgagtatgggggtgcgggagaaaaatatcgcagtcatccccaatggtgtggataccagcaaatactcgcctgggtcttctcttgtgaaaaaagaatttcaagcggaacgattgtttgtctaccaaggaagaatcgccccagagaaaaatgtagaatccctgttaagagcttggaagcaagccaacatgggtgctgatagtaagttattaatggttggagatgggcctttgagagctactttagaacccttttatggttctgagtatggcattatctggttgggatttgtcgctgacgaagaccgacgcatacagattctccagggtgcagatgtatttattttaccttctctagtcgagggtttatccttatcgctgttagagggtatggcttgcggactcgcttgtttagcaaccgatgtgggcgcagacggcgaagtgttggaaaaaggtgctggtgtagtcatgaataccaaaactgtgcgatcgcaattacgcacccttttaccactattccaagaccatccagagttaacaacagtgctgggacaaaaagctagaaagcgcgttgaagaacgctacacactagagaagaatattactcatttagaagaactttatcgtgaagttttagcacagcag

SEQ ID NO: 42771 - DNA, 1524 bp, Anabaena PCC7120
cctgtggtgctagtcattttagacggatggggctactgcgaggagacgcgaggaaatgctattgctgccgccaaaactccagtaatggaaagcttatggacggcttacccgcataccctcatccacacatcagggaaagccgtaggattgccagaaggtcaaatgggtaactcggaagttggtcatttgaacattggtgctgggcgagtcgtgccacaggaattggtacgaatctccgatgcggtggaggatggttctatcctcagcaactcagctcttgtcaaaatttgccaggaagttcgcaatcggaatggcaagctacatttagtagggctttgttctgaggggggtgtacactcgcatatcacccatctattcggactacttgacttagccaaagaacagcgaatttctgaagtttgtattcatgccattactgatggtcgtgacaccgcgccaaccgatggtataaacgcaatctcagccttagaagactacatcaatcatgtaggaatcgggcgcattgtcactgttagcggtcgttactatgcgatggatcgcgatcgccgttgggatcgggtacaacgcgcttatgatgtaatgactcaagacggtgtaggtgatggacgcaaggctgttgatgtcttgcaagcatcctatgccgaaggagtgaatgatgagtttattgttcccgtgcgaattgctcctggtactgtcgagccaggagatggggtgatattctttaatttccgtccagaccgttctagacaactgactcaagcttttgtcagccctgaatttacaggctttgccagacagcaaatcaaaccactgtcttttgtcacatttacccaatacgattctgatttatcagtatctgtagcctttgagccacagaacttaaccaatattctgggtgaagtcatcgccaatcagggtttaaatcagtttcgtaccgccgaaaccgaaaagtatgcccatgtcacctatttcttcaacggtggcttagaagaaccctttgctggggaagacagggaacttgtcagcagtccaatggtagcgacttacgacaaagccccagccatgtcagcaaccgcagttaccgatacagcgatcgccgcaattcaaaaaggtatctactctttaattgtcattaactatgccaacccagatatggtagggcatactggtcaaatagaacccacaataaaggccatcgaaacagttgatcgctgtttaggtcgtttgttagaaggtgtaagcaaagccgggggaacaacaattattaccgccgatcacggcaacgccgagtatatgctagatgaagcaggtaattcttggacagctcacacaactaacccagtccccttaattttagtggaaggcgaaaaagttaaaatccctggatatggtaccaacgtcgaactacgtagcgacggcaaactagccgacattgcacccacaatcctcgacattttacagctaccccaaccaccagaaatgacagggcgatcgctcctgcaa

SEQ ID NO: 42772 - DNA, 1011 bp, Anabaena PCC7120
atgaaagttcgtgttggtatcaacggatttggtaggatggggcggctggctttgcgggctgcatgggattggccggaactggaatttgtgcatattaatgaaataaaaggtggtgcagttgcagcagcccatttgctcaaatttgattctgttcacggacgctggacaccagaggtagaagcagagggggaacgtgtcctgattgatggtactcccctgagttttagtgagtatggcaaaccagacgatgtaccctgggaagactttggtgttgatttagtcctagaatgttctggcaaatttcggactcctgcaaccctcgacccctatttcaagcgcggggtgcagaaggtaattgtggctgcacctgtgaaggaagaagccttaaatattgtcatgggagtgaatgactatttatatgagccggaaaagcatcatcttttaactgctgcttcctgtacaaccaactgtttagccccagtggtgaaagtgattcatgaaggtttggggattaaacatggaattattaccaccatccatgacaacaccaatactcaaaccctcgttgatgcgccccacaaagatttacggcgcgcacgggctaccagtttatcactgattccgaccactacaggatcagcaacagcgatcgccttaatttacccagaactcaaaggtaaactcaacggtatcgctgtacgagtaccactgctcaacgcttccctcacagactgtgtgtttgaagttacccgaccaaccacagtcgaagaaattaacgcactcctcaaagctgcatctgaacaagcaccactccaaggcatcctgggctatgaagaacgtcctttagtctccatcgactacaaagatgaccctcgttcttccatcattgatgccctttccacaatggttgtagacgaaacgcaagtgaaaattctggcttggtatgacaacgagtggggttacgtcaaccgcatggttgaactcgctcgtaaggttgcattaagtctcaaa

SEQ ID NO: 42773 - DNA, 810 bp, Anabaena PCC7120
atgactataaaatttggtttaattggtggcggggtaatgggagaagcgctcttatcccgccttattgcgcggggaatttatcaaccatcagaagtcatagtcagcgaaccgcaaacagcgcgacaagcttttttacaacaaaaatatcatgtgggtgtgaccacagataacagtttggtattcacacaagctcaagacgttgtattcttggcggtgaaaccacaagtgtttagtgcgatcgctcaagaattagcagatacagtattcacagaccattccccccttgtcgtctccattcttgcaggggtgtctctaagccagctagaagcggcgtttccccaatcaccagtcattagagccatgcccaataccccagccactgtaggctcagggatgaccgctatctgctctggtgcctacacttatgcccaacaccaaaaattggcgcaacaaattttttccgcagtaggggaagtagtcgaagtttccgaaagtttgatggatgcagtcaccgggctttctggcagtggcccggcttacgtagctttattggtagaagccctcgctgatgggggagtggcatcgggtttacccagaggaatagccaatcaactagcattacaaactgtgctaggaacagcccaactattacacgaaagtaaactccacccagccgaactcaaagaccgagttactagccctggcggtactaccatcgcggggattgcccaactagaaaaagcgggattccgttcagccttaatcgaagccgtcaaagcagctacatggcgatcgcaagaactaggaaaa

SEQ ID NO: 42774 - DNA, 3316 bp, Anabaena PCC7120
aacccaacgactatgccccgccgtcaagacatccagaagatattattattgggatctggcccaattgtgatcggacaagcctgtgagtttgattactctgggactcaagcctgtaaagcactgcgagaagaaggttatgaagtagtgctggtgaattccaatcctgcgaccatcatgaccgatccggaaacagccgatcgcacttacattgaaccactaacaccggaattagtagagaaagtcatcgctagagaacgtccagacgctttactacccacaatgggcggacaaactgccttgaatatcgccgttgctttagcaaaaaatggcgtactggatcagtataatgttgaattaatcggtgctaagttgccggcaattgagaaagccgaagacagaaaattattcaatgaagcaatggataagattggggtcaaagtttgccccagtggtacagcctcatctttggatgaatcgaaagcgatcgcccgtcgcattggcacttatcctttaattattcgcccagcttttactatgggtggtacgggtggtggtattgcgtacaaccaagaagaatttgaggaaatggcgcaagtcgggatagatgcaagtcccgtttcccagattcttattgaccagtccctactcggctggaaagaatacgagttggaagtgatgcgcgaccttgcagataacgttgtaattatctgttccatcgaaaatatcgacccgatgggtatccacaccggcgattcaattaccgtcgcccccgcccaaaccctcaccgataaggaataccaacgcctgcgggacatggcgattaaaatcatccgtgagattggcgtagaaactggtggttctaatatccagtttgcagtcaatccggtaaatggggatgtggttgtcattgaaatgaacccccgcgtttctcgcagttcggctttgtcttccaaagctaccggcttccctattgccaagatggcggctaagttggctgtgggctacaccttagatgaaattagaaacgacatcaccaagaaaacccccgcatcctttgaaccgactattgattatgtagttaccaaagttccccgctttgcctttgagaagttccccggttccgaaccagtcctgactacccaaatgaaatccgtcggggaagcaatggctatcggtcggacttttaacgaatccttccaaaaagccctgcgttctctagaaacaggccgcgccggctggggttgcgataaagccgaaaaattacccagtggtgaacaaattcgcgcccaactgcggacaccaaacccagaccggatttttgcagtgcgtcatgcgttgcaattagggatgagtccggaagaaatctacgaactcacagctattgacccctggttcctagataaaatgcagcaactgttggaggtggaaaaattcctcaaacgcacacctctaaaacagttgacgcgagagcagatgtatgcagttaaacgggatggatatagcgatcgccaaattgcctttgccaccaaaaccacagaagatgaagtccgcgcctaccgcaaagaactaggagtcacaccagtttacaaaaccgtcgatacctgcgcggctgaatttgaagcgtttacaccctattactactccacctacgaagaagaaaccgaagttatccccgcgagcaaacccaaggtaatgattttgggcggtggccccaaccgcatcggtcagggaatcgagtttgactattgttgttgtcacgccgcctatgcactcaaaggggctggatacgaaacaatcatggtcaactccaacccagaaacagtatccaccgactatgacaccagcgatcgcctctacttcgagccattaaccaaagaagatgtcctcaacatcatcgaagctgagaaccccgtaggtatcatcgtccagtttggtggacaaacaccgttgaagttagcattgcctttacaggactatctcaggcaggttggtaacgggtcattggtaataggtaatgggaatgaagaaacagcaattaccgatgaccaattaccaattaccaagatttggggtacttcccccgactcaatcgacagtgccgaagaccgggaaagatttgagaaaatcctccagaagttgaatatttcccaaccaccaaacggaattgcccggagttacgaagatgcactgattgttgccaagcgtattggctacccggtggtggtacgtccaagttatgtgttgggtggtagggcaatggaaattgtctactctgatacagaattggaacggtacatgacctttgcggtacaggtggaaccagaacacccaattttaattgacaagttcctggaaaatgccattgaagtcgatgtggatgcgatcgccgaccatacagggaagagtcgtaattggtggcatcatggaacacatcgaacaagcggggattcactcaggggattccgcctgttctctaccttcaatttccctaccaccagccgttctcaatcaaatccgtacttggacagtacaactagcacaagagctttctgtggttggattgatgaatattcagttcgccgtcattggtgctagctcttattcaccccaagtgtatattttagaagccaatccccgcgcctcccgtaccgtacctttcgtatccaaagctactggcgtacctctcgcaaaattggcatccttaattatgtcgggaaaaaccttggaagagttaaactttacccaagaagttatccccagtcacattgccgttaaagaagctgtattaccctttaataaattcccaggaactgatacaatattaggcccggagatgcgttccactggcgaagttatgggaatcgacagcgactttggtcgcgccttcgccaaagcagaattaggtgctggagaacgtctgccactaacaggaactgtctttgtatcgatgagcgatcgcgataaatccgccgccgtacccgtagttagggaatttatcgacttaggctttaaagtgatggctacctttggtacgcgtcgagttttgttagaaaacggcttgaatgtggaattagtcttgaaacttcatgaaggccgtccccacgttattgatgccatcaaaaaccaaaaaatccaactgattattaacacaccttctggagaagaagcacaaaccgatgccagattaatccgccggacaggtctagcttataaaatccccatcattacaactatcgctggggctaaagcaactgtcgcggccatccgttccatgcagaataccaccttggacgtaaaaacaatccaagagtattgc

SEQ ID NO: 42775 - DNA, 1059 bp, Anabaena PCC7120
ttacatcaacttggacaggcttatttaagtcatataaaaccagaaaaagctagggaatatttagaagaagcagaaagaatttctgaaaatttacaagatgagttatttcaagcagaagttattaacactttaggcgatacctactctctacaaaggcaatttaatctaggaatcaagtattatgagaaatcattactaattgctagacgcttagagaatcgccttagtgaaattaatgctttatttaaactaggtaatgcttatttagatttgaggcaattttcacaagctgctaaattttatcagcagtgtttagacattgagcaagagataggcgatcgctatagccaagcaagcacttaccacgaattgggaagagtcgcccaaaatttacgggaatgggaacaagccaaaacctattatcaacaagctttagatatcacaatcgaatttggcgatcgctataaccaagcaagcacttaccaccagttgggaatggtagcccaaaaattaaggaaatgggaacaagccaaaacctattatcaacaagctttggatatcacaatcgaatttggcgatcgctataaccaagccagaatttaccaccagttggcaatcgtagcccaaaatttacgagaatggcaacaagccaaaacctattatcaacaagctttggatctcaaaattgaatttggtgatcgctataaccaagcaagcacttaccaccagttgggaatggtagcccaaaatttacgggaatgggaacaagccaaaacctattatcaacaagctttagatatcacaatcgaatttggcgatcgctatagccaagcaagcacttaccaccagttgggaatagtagcccaaaatttaagggaatgggaacaagccaaaacctattaccaacaagcgttggatctcaaaattgaatttggcgatcgctatagccaagccagcacctatggacaattaggaacgcttgcagaagcgcaggaaaattatgtagaggcgaggctgaatttgcagacagctttagaaatatacgttgagtataaagat

SEQ ID NO: 42776 - DNA, 693 bp, Anabaena PCC7120
atgaaaggtagacaagttctacttacaggcggtactggtggactaggtttaggagtcacaccagtcgtcctcgcccaaggtgcaaatctgaccattacttaccgcaatctcaaggaagttgaacgcctcaaagaggttctcccgccggcggattttgccagagttaactttcttcccgctaatttggaagaagaatcttctgttgataatctcatcacccgcatcggtagggtagatgtattaattcatcttgtgggtggcttttcgatgggcaaaactcacgagtacagttattacagttggaaacgagaatttgagatcaatttaaatacaacttttttggtttgcaaatatagcctcaaaagtatgttagaccacggctacggacgtattatcactatcggttctaaggctgctgtggaaccatccggaggattagccgcctattctgcggcgaaggcgggtgtggtagctttcacaaaagcgatcgctgatgaaacgaaaggtacaaacatcaccgctaatgttatcctccccacagttattgatacccccgctaaccgtcaagcaatgggtacagaaaatgccgacaaatgggtaaagcctgagtctattggcgaattaatctgctttttagcctcggaaaaagccaaagatattcgcggcgcggctattccgatatatggaggggtg

SEQ ID NO: 42777 - DNA, 885 bp, Anabaena PCC7120
gtcgaaccaatagttgttcctggtggagaagcggtgaagaatgaccctctgttgttaaataaaattcatcaattggtggaagcggcggggatatgtcgtcactcctatgtgttgggaattgggggtggtgctgtgttggatttgataggatatgcagccgctacagcacataggggagtgagattgattcggattccgacaacggttttagcgcagaatgattccggtatcggggtgaaaaatggtgttaatgcttttggtaagaagaactttttaggtacatttgccccaccttatgcggtaatcaatgattctgcattcttgagtacattatgcgatcgcgattggcgttgtggaattgctgaagctataaaagttgcattaattaaggatgtgggtttctttgattttatccatgaacacactacagcccttgtccgccgcgatatggatactatgcaacagctaatctatcgttgcgcccagctacatttggaacatattgctggtggcgacccttttgaaaaaggttcatcccgtcctctagattttggacattgggcagctcataaactagagcagttgacagattataatctacgtcatggtgaagctgtagctattggtattgctttagatagtacctattcttacctgctgggatggttaacttatgcagagtggcaacaaatattaaatacattagcagggctgggcttcaagctgtatgtaccagaactagctgcaacatcatctctatttgcaggtttaactgaatttcgtgaacacttgggcggtgaattaaccttgactctcttacaacatatcgggaaaggagtcgaagtccacgaagtcaatatgtctttgtaccaacaagcaatttct

SEQ ID NO: 42778 - DNA, 1053 bp, Anabaena PCC7120
atgattgtcatacttaaaaatggtacacctgctgaagaaattactcgcatcagcgaaggtctaagtgaagtttgggaagtcaaagtagaaaagagcatcggcaaacataaagtgattctgggaatcatcggtgacaccgccactatcgacacattgcagattcaagagttcagcccttggattcaacaagtcatgcgagtgcagaaacctttcaagcgggtgagtcgagaatttcgttatggagaagccagcgaggtaattgtcaatacaccaaacgagcgtgtttactttggtgaacatcatccaatagttgtagtggctgggccttgttccgtggagaatgaggaaatgattgtggagacagccaagtgtgtaaaagcagctggcgctaagtttctcagaggtggagcctataaaccccggacttctccctatgctttccaaggacatggcgaaagtgcattaggtttgttagcggcggcgcgtgaggcgacaggtttaggtatcatcactgaagttatggatactgccgacttagcagccgtggcaagggtagccgatgtgattcaagtcggtgcgcggaatatgcagaacttcgccttgttgaaaaaagtcggcgctcaagataaaccagtgctactcaagcgggggatggctgcaactattgacgagtggttaatggctgctgaatatatcatggcttcgggcaattctaacgtgattttgtgtgaacggggaattagaacttttgatagtaaatatgcgcggaataccttggatttatctgtgattcccgtattgcgatcgctcactcatttacccattatgatagaccctagtcatggtacaggtaaatctgaatatgtgccaccaatggcagcagctgcgatcgcagccggtacagatgctttaatgatagaagttcatcccaatcctgccagagctttatctgatggtccccaatctttaactttcgagagatttgaccgattagctcaagaaatgtcagtcattggtaaagtagttggacgctggcctcaacctgttttagct

SEQ ID NO: 42779 - DNA, 960 bp, Anabaena PCC7120
ctgctgattactggaattgatgaatttatcggtttgcgtgcagctgagttggcgatagcacagggaatgaaagtgcgtggactgcaaagttctactaataaagataaagcacaaaaattaggcgctgaggtgattgttggtagtataactgatgcagcgatcgcccaaaaagcctgtcaaggagtagacgttgttctacatacagcgcaattgtccgaagaagcaggccccctcaaggattttcgggaaattaatgtggctggtgcagtcaatatggctaaggctgccaaaaatgctggtgtgaaatgctttgtgcatctttccagcgttatggtgtatgggtttaattatagcgatcgcatcaccgaatccggcccactttctagtgataacaatccctattgtcaaaccaaaatcgaagctgaaaccgaacttttacccttaaattctccacccgattttggcttaattatcattcgtgctggagatatttacgggccgggaagtattccttggatagtcaggccaatattgatgatgcggcaaaaattatttgcttatgctaacgaaggtcaaggagttatcaatcatgtttatatcgataacttaattgatgccatctttttagcagtagcaaaagatgcgtatggtgaaatatttaatatcaccgacggcgaagaaacttcttggaaggaatacttcatgcgcctagctgcaatggaaggtgcatctgctcccatgtctatcccaaaagatgaaatgaagttgtttttaaaactgcgaaatcagggacaaaaactatttcgcaaaaaagctgatattctgccagaatcagtggatttcatgactcgtccccatgcctattccattgctaaagcccaaagactattagactataaaccaaaagttgacctagaaaaaggcttaagtcaaacaaaaaactggttgcaaaataccgat

SEQ ID NO: 42780 - DNA, 4539 bp, Anabaena PCC7120
aacaaaattaatagacagctacaacataatcctattgccattattggtatggcttctctactccccgaagcgagaaatttacgggagtattggcaaaacatagttaacaaaattgattgtatcactgatgttcctgccactcactggagcgttgaagattactacgaccccaaccccagaaccaccgaagataaaacctattgtaaacggggtggctttattcctgaggttgattttaacccaatggaatttggcattcctcccagcatcttggaagtaaccgatgtttcccaactattaagtttagtagttgcgaaagaagcgatggaagatgctggttacggcgaatctcgcgaatttaaccgcgatttggtgggggtaatcttgggtgtggctatggccaagcaattgggtatgccattgtctgcacggttagaatatccaatttgggaaaaagtcctcaaaaacagtggactttccgacgaagacaccaagaaaatcgtcgataaaatcaaaagtgcttacgtcaagtgggatgagaacgccttccccggtatgctggctaacgtcgttgctggacgtatcgccaaccgcttgaactttggcgggatgaactgcgtcgtggatgcagcttgcgctagttccttcggtgctttgaagatggccattagcgaactagtggaacatcgtgccgatatgatgctgactggtggtgtagacacagataacaccatcatggcttatatctcctttagcaaaaccccagccgtatctcctagtgataacgtcaaacccttcgatgcaaaatccgacgggatgatgttgggtgaaggtatctgtatgctggtgctgaagcgtttggaagatgcagaacgtgatggcgatcgcatttatgcaactattaaagggatcggtacttctagcgatggtcgttacaagagcatatatgctccccgcaaggaaggacaagtcaacgccctacgtcgcgcttatgaagatgcgggcttctctcccgcaaccgttggtctgatggaagcccacggtactgggacaatggctggcgaccccaccgagttcggttctttaagagattactttggcgaacacgacaagaaaaagcagcatattgctttgggtagtgtaaagtcccaaatcggtcacaccaaagcggcggctggtgcagcaagcttgattaaaacagccttggcactgcaccataaagtattaccagcgacaattaatattactgagcctaaccccaagctcaacatcacagaatccgctttttacctcaacaccgaaaccagaccttggattcgcccagaaggagaagcaccaagaagggctggggtgagttccttcggttttggtgggacaaactaccacgtagttctcgaagaacacgaagccgaacaaaatcgcccttaccgcttacacaacagcgccagcgaaatcttactgtttgctgcaaacccggcggaactcctcaaacagtgtgaggaagttttaggtaagttgcaatctgcgggtggtaacaagcactattcccaattggtacaagattgtcaatcagtcgaaattccccaaaatgcagctagattaggctttgtcgctgaaaatatgcaagaagcttgcaagttcatgcaaaccagcattgactggctgaaacacaaagcaggagcagctaactgggaacatccccaaggtatttactaccgtgcttccggtatggaattaaacggtaaagttgtctccctgttctccggtcaaggttctcaatacctggaaatgggacgggaactggtgatgaacttccccaccttgcgccgtctgttcggttacatggatgggttgttactcaaaaataacctccgccccctatctgagattgttttccccaatcctgtgtttgatgaagcccagaaaaatgctcaagttgctgcactgcaacgcacagaatacgcacagccagcaattggggcatttagcgccgggttgtattctatcctcaagcaagctgggtttaagtctgactttgtagccggacacagcttcggggaaatcaccgctttgtgggctgcgggtgtgttgagtgacgcagattatatgtacctagtgaaagctaggggtcaagcaatggctgcgccagaagacccagaccatgatgcagggacaatgctggcggtgaaggaagacctcaacaaaattgaaccaatcctcaagcagttccctcaagttagcattgctaattacaattctcccacccagattgtcttggcagggccgacaggcgaaatcgcaaaagtccgtcaagctctacaagcccaaggttacgcggctgtacccttaccagtctccgccgccttccacacctcactgattgctttcgcccaaaaatcctttgcgatcgccacaaaatcagtccaattcaacgagccaaaaatccctgtattcaccaacgttacaggtaagccttatcccaaagacccccaagcgattcaaaaaatcctggaaacccacctggctaactcggtgttgttcaagcaggaaattgaaaatatctacgctgctggcggtcattgcttcgtagagtttgggccgaagcggattctcaccaacttggtgaaagatatccttggcgatcgcccccacatcaccgtctccttgaaccccagcacccagaagaacagcgatcgctctttgcgggaagcagccgtacaaatgcgtgtgattgggatgcagttgcacaacctcgacccataccaagcaccacctgcactacccccagccgagacaaagaaaggtctgaatgtcaccttacggggtatcaactacaggtcagaaaaaaccaaaaaggcatgggaagacgcaatgaacgatgggttcaaagtctccctaccctctgcacctactgtcacagttccccctgtcatctctgaacctgtaacaccagtcaaagagactaacggtaacggacatggcaaaatcgccgaactacccaagattttaaataactctactagtattacccctgccaaacctgaaatgaattctgcgatcgtttcacccaaactagtcgaagaaaagaagatgcaaacaccagaaaaactggacaactacaagcgagtgctagaaagcttagagtacctgacaactcagttccaaaaaaaccaaactgagaacctccaagttcacggtacttacctcaaccatcagatggaatataccaaagcgttcttccaactgatgcagcaacaaaacgccttgtttgcaaacgccaaatcttcccaagaagctgcacagctaaaactagtggtgatggaaagcttggatcgcagcatgatgcagtttcactcccaacaaggtgaaaccctccgcatccatgagaaatacctccaagaacaggtggcttatgctagaaacttttttgaactgattcaacaacaatattcaatggtgttgtctggtcaagtgaatacgccagtcattgagacaccagtcaaggaaactcctgctttcaccattgaagcacccgtaactcccacagcaaaaatcgttgagcctcaacctgagtctgtggtcaaaaatggcttcaacattgttgatgcaccagttaccctcgcacccacagcttggcaaattcagtctgaacctgtagttgcagcaaccgcttctgtcgtctctaccattgagcctgagccagtaattgaagcacccgtagctgcacccgtagtcaaccaagttgtagaatttacttccgcacctgcacctgtagccgcaccagccattgatgttgctgacttggataagaacctcctagcaattatcagtgataagactggttatccagtagagatgctggaactggaaatggacatggaggcagatttagggattgactccatcaagcgggtagaaatcttagggggattacaagaagtgtatcccgacctacccaagcccaacttagaagaactggcagaaaaacgcaccatcgggcagattgttgattatctcaaagctaacaccgctattagccaatctgtaggcatagcaattcagcaagcgcaacaagcagccgagataccagcaccagtagttactgcaagtatagctgcaccggaacctgtagttgctcctacacccattgcacctgagccagtcgctattcctgcaacaccagagccggaagcagtcgcagacaccaccgactacgcagacttagcgcaaaccctactcaacattactagcgataagactggctacccagtggaaatgctagaactcgatatggacatggaagcagacctggggattgactccatcaaacgggtagaaatcctgggagcaatgcaagaaacttaccccaacctacccaagcccaacattgaggaattaggcgacctccgcaccattcggcaaattgttgactacctccagaagctggcgggaggtgaaaaaaaaagtctcagtctgagcgggactggcagccagtcagtataatcgggaacgtcccacgccgtccagccaaactcaaat

SEQ ID NO: 42781 - DNA, 1404 bp, Anabaena PCC7120
  unsure (1)..(1404): unsure at all n locations
tttgatncgattagtcatataggcnctgtgtagggacatgggngcagccntacaggggtaagttgcggcttaaagacggcgattatcgagcaagctgacatggggggaacctgtgtcaatcgaggctgtattccatcgaaggcgctgttagctgcttctggacgtgtgcgggaattacgcgatgcccatcacgtgaagtctctggggattcaaattggtaatgtggagtttgatcgtcaagcgatcgctaatcatgctaataatctcgtctccaaaattcaaggagatttaacaaatagcctgaaacgtctgggagtcgatatcatcaggggttggggcaaaatcgcggggacacaaaaagtcaccgttacaggcgatggtggtgaaaaaaccatcaccgctaaggatattatcctttcccctggttctgtccccttcgtacctccaggtattgaagtagatggcaaaaccgtcttcaccagcgaccaaggcgtaaagttagaaaccttacctgaatgggtagcaattattggtagtggttacattggtttagaattctcggatatttactcagctttgggctgtgaaatcaccttgattgaagccctcgaccagttaatgccaggatttgaccgcgatattgccaaactcgcggaacgagtgctgattacaccccgcgacattgaaaccaaagttggcatatatgccaaaaaagttattcctggttcgccagtagtaattgaattggcagatttcaaaaccaaggaagttgtcgatgttatcgaagtagatgcttgcctagtagcgacaggacgcatcccagctacaaaaaacctgggtttagaatctattggtgtcgaacttgaccgccgcaactttattcctgtagacgatcgcatggcagtgttatcagcaggtgaagtagtaccccatttgtgggcaattggtgatgccaacggcaaaatgatgctggcacacgcggcttcagcccagggcattgtcgccgtggaaaatatcatcggtagggaaagaacagtagactatcgcagcattcccgccgccgcatttacccatccagaagttagctatgtcggcttaacagaaacaggtgctaaagaattaggccaagctgaaggttttgaagtcgccaccagcagaagttacttcaaaggcaattccaaagccttagctgaaaacgaagccgacggtatagccaaagtcatctaccgcaaagataccggggaagttttaggcgtacatatctttggtttacacgcctccgacttaatccacgaagcatccgccgccgtcgccaatcgtcaaaccgtccaaaccctagcccatatagtccacgcccacccaacattatccgaagtgttggatgaagcgtataaacgagcgatc

SEQ ID NO: 42782 - DNA, 1463 bp, Anabaena PCC7120
gagttaatgaaagctggtgcaacagattacctatctaaatttagagtctcatcagaaactttagctcaagttttacgcaatgcgatacggctttatcgtgcggaaatgcagactactattgcctaccaacaactgagagaaagtcatgagcaactggtgcgaaaaaatcaagaattagaacgacaacggcaacaaatccaaattcaaaacttaaaattgctcgaagcatcgcggctgaaatctcaatttctcgctaccatgtcccatgaattaaggacaccaatgaacgcgattatcggttttgctcagatactatcacgccctaaattcggtaatctcacaggtcagcaagccgacatggtagaacgtattttgaataacggcaaacatttactgatgctattaaacgaagttttagacttctccaaattggaagaaggaagattagaactgaagccagaattatttgatttaactaaagtcattaacgccgtagttatggaaatgcgttctctagctgaggcaaaaaagttgtctttgctagtgcagattgacttacaaaattctttgctagtaaatgatccagtacgaattaaacaaattttaataaatttattatctaatgccattaagttcacagactctggtagtatttggatcgacgtaaaagacttaccaggaagttgggtggaaattaaagtaaaagatacaggtattggtatagcagctaaagattttaaatatatttttgaggcttttcgacaagttgatcaaagcattactcgcaagtatccagggacaggtttgggattggcaattatcgactcattagtgcaaatgatgagtggtaaaattttcctagaaagtcaattgggagtaggttcaatttttaccattacattgccaagacaattgccattatcaaattcatctctatcttcatcatctgtgcaagatgcgaaagaaatgatgcagccagatcacaaagtacaccaccctacggctaaatccaacccaaccgccagaaaatatcataatcttaagttataaatttatatatataaaacaaatttattatcatgtctgttgtggaaaatcatcaaattgatcgaattttggctgttgacgacactagagataatctgattttagtgcaaacaattttagaaagtgaaggctatgaaattgatttagccagtgatggcatttcagctttgcaaaaagtagaacagtctccaccagatttaatcttattagatgtaatgatgccggggatggatggttatgaagtgacgcgacgcattcgcaataacccagccctcagttatataccaatattgttgattacagcttttcacgaatcgagtgttgtggaaggtttggacgtaggcgcggatgatttcattcgcaaaccatttgatacagatgaactattggctagagtgcgatcgctcctacgcctc

SEQ ID NO: 42783 - DNA, 1842 bp, Anabaena PCC7120
gaattagcgcaacaattgcgaatagatagtattcgcgccacaactggcgctacttcaggccaccctacttcttccatgtcccctgccgatttaatggcggttttattaactaattatcttcactacgattttgacaatccacatcaccctaataacgatcgctttattctctcaaaaggacacgctgcacccttactttacgccatgtataaagcggctggggtcatcactgatgaggaattaatgtcactacgacaaatgggcagccgtctggaaggtcatcccacaccggtattaccttgggtggatgtggcgactggttccttagggcaaggattacccatcggtgtggggttggggttagcggggaaatatttagaccagctaccttataacgtctgggtgttattaggtgacagtgaaacagccgaaggttcagtgtgggaagctttcgaccatgccgcacactacaccctagacaacctcattgccattatcgatgttaaccgccttggtcaacggggtcagacagaactaggctggaatactcaagcctatgctaatcgtgccaaggcttttggttggcaagcaatagaaatagatggtcacgatttgacggaaattgaccaagcctttagcgctgctgtcagtattaacgatcgccccactgtaattattgcccgtaccaaaaaaggtaaaggcgtagcatctttggaagatttgggtgggtggcatggcaaagctttaaagcctgatgcagcaaaacaagcgatcgctgaattaggtggtgaacgtcagattactattcaagtagccaaaccggagccagaacaacccgcattagctaacccccaacccttccaactaccaacctatgaacaaggtgcagaagttgccacccgtcgcgcctatggtgatgctctcaaagccttaggtgctgctcaacctgatgttgttgccctggatgcagaggtgagcaattccacttacactgaagattttgccgaagcttacccagaaagatactttgagatgtacattgccgaacagcaaatggttgcagctgctgttggcttgcaagtacgccagtataaaccctttgcttcgaccttcgccgccttcttaagtcgtgcctacgactttgtgaggatggctgctgtctctcgcgccaatattaaattagtgggttcccacgcgggtgtatccattggtcaagacggcccttcacaaatggcattggaagacttagccgcctttcgagcagtgtggaatagtaccgtactctacccctgtgatgccaatcaaacagcgaaattagtagaacagatgagcgatctccagggtattgtttatctgcgtaccaccagagaaaatacaccagtgatctacggaactgaagaagattttcccatcggcggcagtaaagttattcgtagttccgaccaagaccaagccaccatcattggtgcaggtataactttacacgaagccatcaaagcaggcgatcacctcaaaaacgaaggcattatagtccgcatcatcgatgcttactctgttaaacccattgacgtaaagactctgcatcaagcagccaatgacacagaaggcaatttagtagtcgtcgaagaccattggcatgaaggcggattaggtgcagccgtactggatgcctttgctggtgttggtaacctttctagctacgatggccctccattgcaactaattaagttagcagttcataatatgccaggttctggcacaccagaagaattactccatgcagccaaaattgacgctgatgcgatcgtcgaagccgtaaaattgcaagtcagacatcctatt

SEQ ID NO: 42784 - DNA, 1095 bp, Anabaena PCC7120
ctccctagtatgagtgaagccattggcggcgtgatgatttctgctagtcataaccctcccgaagataacgggattaaaatttttggtgctaatggtggtaagttatcccaggctttacaggcagaaattgaaaaaggtctgcggggaaatctgccaattacaagtaatgtcagtaattgtggacggcattactcacgttgggaattggtgaagaattacggcgaagctttaaaacgaccctggcaaaataaagtgaatcttcagggaatgaaggttgtgctggatttagcttggggtgcagccgtgggattagcaccatcagtatttgcagagatgggggcagaagttatttccctgcataatgccgcagatggcgatcgcatcaacgttaactgcggctccacccacctagaaatgttgcaagcggctgtgcaagaacacaacgccgatttaggttttgcctttgatggcgatgccgatcgcgttttggctgtagatcccacaggtcgtcctgtaaatggcgactatatcctgtacctgtggggattgtacctcaaacaacaaaaccaactcccagacaacttgattgtttccacagtcatggcaaacctgggctttgagaaagcttggcagcaacagggtggtaaattaattcgcaccgccgttggcgatcaatatgtgcaagcagaaatgatcaaaactggggcaatgttgggaggtgaacaatcaggacacatcctgtgtagccattatggaatgactggggatggcttgttaacagccttacacttggcaagtttggtcaaacaatctggtgtttccttagccgaattgatagaccaaagcttccagacctatccccaattattgcggaacgtgcgagttgtagaccgcgatcgccgcctgagttggcaaaactgcacaccagtacaacaagcgatcgctcttgccgagaaagcaatgggtgatactggtagaattttagttcgggcatccggtacggaacccgtcatcagagtcatggtagaagccgccaacgccgaactagctaactattggacaaatgaactagtagcccaagtacaacaacaccta

SEQ ID NO: 42785 - DNA, 3603 bp, Anabaena PCC7120
atggtgcatattaagcgcgtagaacttaccaatttcaaatccttcggcggtacgacctctgtcccattgctgtcggggttcactgtcgtatctgggcctaatggttcgggtaagtctaatattttggatgcgctgttgttttgtttgggactagccagttctaaggggatgcgggcagaccgcttacccgatttggttaataatactcaaacggcgaaaagtcgctcggctgtggaagctgtggtgacggtgacatttgatttatcggatttggtggatgcgagtgatcagtttttatctgtcagtgatgatgcagaattatctcagaatgaagcgcctacagtaaatgggaatggtcacagagctacagaatggagtgtgactaggaaattgcgggtgacgcatcagggtagttatacctcgaattactacatcaatggggtttcggcgacgcagacagagttacatgaggagttggagcggctgcggatttaccctgaaggttataacgtggtgttgcaaggggatgtcaccagtattatctccatgaagggtaaggaacggcgagaaattattgatgagttggcgggggtggcgacttttgataggaagattcatcaagccaagggaactttagatgaggtcaaggataaggaagatagttgtaagattattgagtctgagttaactttacaacgcgatcgcctttcccaagacagagcaaaggcggagaggtatcaaaagttacgcacagagtttttagaaaagcaatgttgggaagcggtattatcttggcgttccctacaagcacagcaagagaagttagttacagatattcaagcaggcgatcgccattatggcgaactgacaactcagcttgcaagcttaaatacagaaatttctcaaaaaacggctgaactcgaacagctaaatgctcatgtgaaagcaatgggggaggaggaactgctggcggtacagtctaccttagctacccaagaagcggaacggaagcaactccagcgtcagcaaacggagttagacacggctttgcaagaaactaccaaacgtttggcgcaaactcagcatgatattcaacagcatcagcaaggtttgggtgaactggcgcaagcacaggatttagaaagacaatcgattgtttattgtcagcagcaacgggatgaagcacaacaagctttggaaaagtcccgcgaagccgcagcagaaatagcttcagcgtcggaagcatgggtacagcaacaaacggcgttgaaccgtcaaattgaggctgtgttgcaaactttggagccgcaacgcacagaacaagcgcaactgagggaacggaataatcagttacagcagttaattggggaacaaaccgagttaattgctggattagaaccgcaattagctgagaaacaagccgattgtgaacgcatagaaacagaatttaactcctctggcgaacccatccaagatttagcccaaaatcttgcagccacagaacaggaattacaaatccagcaagatacccaaaagcggctattacaagaacaacgggacaaacaacgtcagctagatagaattgaggcgcaagcacaagcacagcaagaggtacaaggaacccaagccagtaaagtgattatccagtcgggaatgcctggggtatgcggcttggtggtacatttgggacgggtagaacccaagtttcaattagcgttagaaattgcggctggggcgcggctgggacacattgtggtagaagatgatggtatagcagccgccggaattgaactactcaaacaaaaacgggctgggagagcgacgtttttaccgttaaataaaattcagtctcacaaatttacccaggatgcgacgctgcgtttagctaatggttttgttaactatgccgtgaatttggtagactgcgatcgccgttataaagacatcttcaattacgtttttggtaatactgtcgtcttcgccaacctggaagcagcgcggaaaaatctcggcttatatcgcatcgttactttggatggagaactactagaaaccagtggcgcgatgactgggggaagtagtaaccagcgttcctccctccggtttgggaatacagaagccgcagaatcagatgaagccattggcttaaaacagcgtttagccgatattgatcggattttaaaccgttgtggtgatgcgatcgctaatttagtcatcaaaaccaaacaactatcccaagaactcactgaaactcgacaagcacggcgagaacagcagttacagttggaacagttgcgaaaagatattcagagtttaacagcccagttgacagggacgcgatcgcaactcacccaaaacaccgagaaatttaccacagcccaatctcgcctggagattttagatagggacttaccaggacaagaaagccaattacaacaactacgccacaccctagccgagttagaagcctcccaaacccccagcgaatggcaacaaattcaggcgacaattaaaacccaagaacaacaaatacaacaacgggaaaccgcctttagggaagccgaacaacgcttaaaaaatctagaaaatcaacaacagcgtttacaagaacgcatccaagaagcccaacagcgcatcaccgaatatcaaacccaacaaaccacttgtacagaagcgattaatcgcgtctctcaacaaaccacaaccataaacgcacaaatcacccaaacccgcgccaaactcagcgaacttgaacaacacctcggcgcagaaaaacaaaaacgcgacacaattgaacaagaagtgcgatcgcacctcctgcgtcagcaacaattagaatgggaaattcaaaaactggaagaaacccaacttaaacgccgggaagacttaaccgccttacaaagccagttacaggaactagtcccagaactacccaaccctttgccagaagtcccagacaaggtagacttagaagaattgcagaaagaattgcgatcgctcgccaaacgcctccaagcaatggaacctgtgaatatgctggcgttggaagaatacgaacgtacccaaaagcgcctagaagaactatcccaaaaattacagaccttagaaggagaacgcaccgaactactcctacgcattgaaaacttcaccaccttgcgccaaatcgcctttaaagaagccttcgacgctgtaaatgaaaatttccaatcaatcttcgccaccctttccgacggcgacggctacctgcaattagataacccagaagatccctttaacagtggcttgaacttagtcgcccaccccaaaggtaaaccagtccaaagactcgcctccatgtccggtggtgaaaaatccctcaccgccttaagctttatcttcgccttgcaacgctaccgcccctcgccattttacgcctttgatgaagtagatatgttcctcgatggggcaaacgtagagcgattatcaagaatgattaaacaacaagcccagcaggcacaattcatagttgtgagtttgcgccgtccgatgatagaatcagccgaacgcacaatcggcgttactcaagcacgaggagcttatactcaagttttgggaattaagtta

SEQ ID NO: 42786 - DNA, 690 bp, Anabaena PCC7120
tttaaaagtgtcgatggacttgagctttattatcagaattggtatccagaagttaaagcaaaagccatcttggtgattgtgcatggactgggaggacacagtgataaatatagtaatatcgtcaaccatctaacagccaaagattatgccgtttatggcttagatttacgcggtcatgggcgatcgcctggacagcgtggtcacatcaacgcctgggctgattttcggggagatttaagtgctttcttagagctaattcagacccagcagccacaatccccgattttcttattagggcatagtttaggtgcagtagttgtctgcgactatattttacgctgtcccaaagaagccgcaaaattgcaaggtgcgatcgccttagcaccagccataggcaaagtcggcgtgtcgaaattccgcttacttgtaggtaaattgctttcgcaaatatggccgcgcttctccttaactactggacttgacctgagtgcaggttcacgagacgagaaagttgtagccgcttatgctcaagacaccctacgccataatcttggtagcgcccgtttagccacagaatactttaccaccgtcgcctggattcatgctcatgcacctgactggcaaatccccttgctgattcttcacggtagcagcgatcgcatcgcctcacctaaggcgagcagatcgtat

SEQ ID NO: 42787 - DNA, 3015 bp, Anabaena PCC7120
atctcagacacaattgaacaattacgcagttgttgtcaagttaatgttcaatctacttggttataccaggactcgaccagggaaattaatggcgttgctacatctagtgtatccaattggcaatctgtagagttagacaccaagggtaacattgcttggagtggtggacagcaagtactttggctagaacagaaattcgtagttccccaaaatttacatgattatcctttagcggggttatctttgcggctgtccctgctttggtgggcggactctgccaaaatctacgtgaatggggaattagtgctagagggagatttatttgattgttcacccagggttttactcagtcgggaagtatcaccagggcaagaatttgtagtggctttgcggctagcaagtcccggacattgtgatggtgctttagtgcgatcgctccttgtctacgagtccacagattataattatcctgacccaggttttattgccgatgagttagcgatattacaactgtatttagaaaagtccgcaccagaaaagttaaatatcctcacagcagcaatcccagaaattaatccctccaatccagaatctctaattaccatccgccaaaatctgataaatcatctctctatcagcgacccaaaatttaaaatctatttattaggtcacgcccacttagatttagcatggctatggccagtcagtgaaacttggaatgcagcccaaaacacttttgcatcagtcctcaaactacaacaggattttccagagttaatcttttgtcattccaccccagccctgtatgcttggattgaagaacatcgcccagatttatttacagcaattcaacaagctgtagctgcaaaaacatgggaaattatcggcggtttttgggtagaacctgacctcaatttaatcgctggggagtccatagtccgtcagttactatacggtcaacgctactttcaagaaaaattcgacaaactcacgactgtagtttgggttcccgacacctttggtttttgtgcaaccctaccgcaatttttggcgaatgcaggtattgagtatttcgtcacccaaaaattacgatggaacgacactactaaatttgattatggcgctttttggtggcgatcgcctgacggtagtcaagtattcagtgttatgtctgcacccataggcgaaggtattgaccccatcaaaatggcagcctattctctagaatggcaaacccaaaccaacttaactgaatccctctggcttcctggtgtcggcgaccacggcggcggccccacccgtgatatgttagaaaccgcccaacgctggcaaacctcaccatttttcccagacttagaatttatcaccgccgaaaagtatctccagcaaattcagtcaacagtcaacagtcaacaatcaatagttcccacatggaacgacgaactatacttagaattccatcgtggctgctacactacccacgcagaccaaaaacgctggaatcggcattcagaaaatttactataccaagcagaactatttgctaccttggcaacttttatctgtggcgtgacatatcccaaaacagcgatagaaacggcttggaaacaagtattatttaaccaattccacgatattttacctggttcttccattacccaagtatatatagatgccttacacgaatggcagcaagtagaacaaacaggaaccaggatattaaaggaatcattacaggcgattgcttctcactttaccttaccagagccaccaaaagccgatagtttccccattttcgttttcaattctctcaactggcaacgctctgaggtagtatcagttaccttacccccgccaccaactaaccaacaatggcaagtctacgatacgactggcgaacaaataatttcccaattaactgaaccatcaaccttactatttctcgccaaggatattccatctgtaggctatcgcctcttttggctttcccctacatcgcccccatcgcccacatcacccacatccctagactatgttctcgaaaatgaacacctgcgcgttatcgtagatcctgatactggagatttatcaagcatctatgacaaaactcatcaacgagaaatattgtctggtgcgggtaatcaactacaggcttttaaagacagtggtcaatattgggacgcttggaacatcgaccccagttatagtcagcatcccctaccagcaaccaacctcaaatctatccagtggttagaacaaggcgctgtacagaatcgcctccgcgtagtgcgtcaattaggcgagtcggaattttgccaggattatatcttgcaagtcggttcaccccaattaaaaatagcttctagagtcaattggcgagaaaagcaggttttagtaaaagcagcgtttcctctcaacctgacagccgactttgccacctacgaaattccctgcggtgcaattcgtcgcccgactcaaccccaaaacccacaagataaagcaaaatgggaagtcccagctttacgttgggctgatttaaccgcagacacagacaagggtatttacggtgttagtttactgaatgattgtaaatatggttacgatagccaaccccagctattaaggctaaccttacttcgtagccctacctggcctgacccagaagctgacacaggcatacacgaatttacttatactgtgtatcctcacgctgatagctgggaatcagcccacacagtacaaaagggatatgaattaaacatccccctgcaagtaatattaaacccggttcccaactcccaactcttaacctctcactacccgcccaacatgagagacagagtaagttttgtaaatttaccagccgaaaatttagtcttaatggctataaaaccatcggaagacgaccagcaacaattaattctgcgcttttatgaatctcatggtgtgactacagagttatctttgcagaccgatttaaacttaactttgggtactccagtagatttactggaa

SEQ ID NO: 42788 - DNA, 1392 bp, Anabaena PCC7120
attatcaaagcatttgaggctgtcctgggtaaaaatggtgtagtccaacgccgtgaggaacttatcacctatgagtgtgatggtttaactagctatcgccaacgtccggctgtagcggttttacctagaactacggaacaagtggcggcggtagtgaaaatatgtaatcagtattctgtccccttcattgcacggggttctgggactggcttatctggtggtgctttaccatcggaagattcagttttaattgttacttctttaatgcgacaaattctgagcgttgacttagataatcagcgtattattgtacaaccaggggtaattaacagttgggtgacacagactgttagtggtgctggattttattatgcgccagacccttctagtcagattatctgttccattgggggtaacgttgcggaaaactctggtggggtgcattgtttgaagtatggtgtcacaacaaatcacgttttgggtttgaaaattgtcacgccggaaggagaaatagttgatttaggtggacaaattcccgaaagtcctggttatgacttaactggtatatttgtcggttcggagggtactttagggattgctacagaaattaccttgcggattctcaaaagtgcagaatcgatttgtgtgttattagcagactttaccagtgtggaagcggctggggcgaccgtttccgacatcatcagcgcggggataattcctggtgggatggaaatgatggataacgttagtattaacgcggtggaagatgttgttgctactaattgttatccgcgtgatgcaacagcaattttgttagtagaaattgatggtttagaagttgaagttgcggtgaataaacaacgcgttatagatatttgtaaacagaatggggcgcgtagtgtgacttctgctagtgacccagaaatgagattgaaattatggaaagggcgtaaggcggcttttgctgcggctggtcatttaagcccagattattatgtgcaggatggggtaattcctcggactcaattaccttatgtgttgcaggaaattgaggtgttgagtcaaaaatttggttatccaattgccaatgtttttcatgctggtgatggtaatctgcatccgttgattttgtttgataatgccattcctggtgcattggagaaagtcgaggaattgggaggagaaattctcaaactttgtgtgagagtcggcggtagcatttctggagaacatgggattggggcagataaaaaatgttatatgcctgatatgtttagtgatgctgatttagaaacaatgcagtgggtacggcaggtatttaacccccaaggtttggctaatccgggaaagatattccccacaccgcgcacttgtggcgaagcggctaac

SEQ ID NO: 42789 - DNA, 1251 bp, Anabaena PCC7120
cctccttcaaaaccaccggttccaaaatatatttcctgggattgttgttcggccctgggcccccagtttgtcgttgaggccctggcccctgaatttccccctctgaaaattcactttatggccaatacggaccccgccggcattgacaggattttcacacccttggggaatcatcttgccagcactttggttttggtcatctccaaatctggaggtacacaggaccttgcaaccggcatgattgaagtcaaaaaagcctacgccggacaaaatttagattttgctcagtatgcagtagctattactagtactggtagcaacctagacaaagtagctcaatctgaaggctggctagcaacatttcccatgtatgattgggtgggtggacgtacctcggaaatgtcctctgtagggctagttcctgcggcattacagggcattgatgtccgtgccatgctagaaggtgcaaaagaaatggatgacgctactcgcgtcccagaagtgaaaaataaccctgcggctttactggctttgtcttggtactactctggtaacggcaagggtgaaaaagacatggttgttttaccctataaggacagcttgctgttatttagccgttatttgcaacagctagtcatggaatctttgggtaaagaaaaagatttagacggtaatactgtttatcagggtatcgccgtttatggtaacaaaggctcaacagaccaacacgcttacgtccagcagttacgcgaaggcgtaccaaatttctttgctaccttaatcgaagttttggaagaccgtcatggcgcatctccagaaatagaccccggtgtcacatctggtgattatctgtctggttttctgctaggaacccgccaagctttgtatgaaaatcagcgcgattccattacagtgacgattccccaagttaacgcccgtactgttggggccttagttgctttgtatgagcgtactgttggtttatatgcgagtttggtcaacattaacgcttaccatcaaccaggtgtagaagctggtaaaaaagctgctgctgtcattctggatctacaaacaaaagtagtaggattactccaaaaggaaaaaaccgccctttctttagagcaaattgctgagaaaataggtgcagccgaccaagttgaagcaatttacaagattttacgccaccttcaagcaaatcaacgcggtgttgtattccagggaaatttgggacaaccaagcagcttgaaaatt

SEQ ID NO: 42790 - DNA, 974 bp, Anabaena PCC7120
tttgtcacgggggctacgggttttgttggtgctaatctagtgcgattgctgctgcaacaaggatacacggtcaaaaccctagtccgtcctcagagcaatctgggtaatttacgcggtttagatgtggaaattgtcgaaggagatttcgataatcagttcctttggcaacagatgtctggttgtcgctatctgtttcatgtcgcagcccaatactccctgtggcaaaaagaccgtgatttactctatcaaaacaatgtcctcggaacttttcaggtgttagaagcagcccaaaaagctggaattgaacgtactgtttacaccagttccgtagccgctattggggtcaacccctctggtgaaattgcagatgaacttatcaaagtcccgtagataagctaattggacattacaaaaagtccaagtttcttgcagaacaggaagctgtacaagccgcagccaagggacaagatatcgtcatcgttaaccccagcacccccatcggcccctgggatatcaaacctacacccactggcgatattattctgcggttcctgcggcgacaaatgcccgcttatgtgaatacagggctgaatttaatcgatgtgcgggatgtagcttggggacatttactagccttggaaaaaggcaaaagtggcgatcgctatatcttaggtcatcaaaacctcagcctccagcaactacttgagaaactggcagaaatcacaggtttacccgcaccccaatggactgtcccaggctggttacccctaagcgtcgcctggatggaagaaaagattctcgcacccttgggaaaaactccctcagtccctatagatggtgtccgtatggcacaacaaaccatgtactacgatgcctcaaaagccgtcaaagaattaggtttaccccaatctcctgtcgatattgccttgaaagatgcggtgaattggtttgtttcccaaggttatgtcaagtga

SEQ ID NO: 42791 - DNA, 685 bp, Anabaena PCC7120
ctcgttgcccaatctcaccctaatcaccagacaattgttcaaatctcagaaacagttgcttttggtgggaaagaattagtaattatcggtggcccttgtacagtggaaagcttagagcaaatggagacggtcgctcaacatttagaaggctcgtctgtacaggcgttgcggggtggtgtttacaaacctcgtacatcaccctacgctttccagggtatgggagaggctggattagatgttttagctcaggtgcgatcgcattacaatatgcctgttgtgactgaagtgatgtcaattgctcaaattgaggcaatcgccacccatgttgatatgttgcaggtgggtagccgcaatatgcagaacttcgatttactcaaagccttaggacaagcgggtaagcccatacttctcaagcgtggtttagccgcgacaatagaagaatttgtgatggcggctgaatacgtcgtcagtcatggtaatcctgatgtggtgctgtgtgaacggggtatccgtagcttcgataattacacccgcaacgttttagatttagcagcagtagtagcactcaagcaaattactcatttacctgtgattgtcgatccttcccatgctgtgggtaaacgggaactaggttgcacctttagctaaggcggctgtggcttgtggtgcaaatgggtttaattat

SEQ ID NO: 42792 - DNA, 1314 bp, Anabaena PCC7120
gcggcatcaagccactatttagagcgtcagcaagcacgagagtccaacgctagaagctatccccggcggattcggattgccattagtgaggctcagggtatttatctcaaagatgctgatggcaatgtatatattgattgtttggctggtgcaggtactttagcattaggacacaatcacccagtagcaatagaagcgatgcgccgggtgctagatacgggtttacctttgcatactctagatttgactacaccagttaaagatcagtttgtcgaagaaatttttgctagtttacctgcggaatttgctcagaatgccaagattcagttttgtgggccttcgggagcagatgctgtagaggcggcgattaaactggtgaaaactgctactggccaccgcagtgtgttgtcatttcatggtggttatcatgggatgactcatggagcattgagtttaacaggcaatctcaatcctaaacaagcggtgacagggttaatgccagatgtccactttttgccttatccctatcattatcgttgtccctttggtttgggtggagaagctggacaaattaccagcagccgttatatagaatcgattttggatgatcctgaaagtgggattgtcacaccggcggcgatgattttggaagttgtgcaaggggaaggtggggtgattcctgcacctgatgattggttgcgagagatgcgccggattacccgcgatcgccatattcccctcattgttgatgagattcaaacaggcttaggacggactggtaaactctacgcttttgagcattcagggattgtgccagatgtgttgttactctccaaagctattggtgggagtttacctttatcggtggttttgtacaacaaggcactagataaatggagtccaggcgcacacgcagggacattccggggtaatcaaatggcaatggcagccggaacagcgacactacagtatattttagaaaattccttgactgaacacgcggcagcgatgggcgatcgcttgttgaaacatctgcaccaaattcaaggggaaacttactgtattggagaagtgcggggacgcggtttgatggttggtgtggagattattaatccccaagcatcggctgatcggcgtgggaagtatcctgtacatccgcagttggctagttgtattcaggctgagtgtttgcgtcggggtttgattgtggaattagggggtagatttggtagcgtggtgcgctttttgccgcctttgattgtgactccagcgcagattgatagtattagtgagattttttcgtcggcggtacag

SEQ ID NO: 42793 - DNA, 1437 bp, Anabaena PCC7120
gagggtttgcgggaggcgatcgctgctgctggagaggtgttgattgattattttgctactcaagaaaaaccctatagtggtaggagtccccaggatttaactaggactattgcagatatcgctgtgtgtcctgatgagggggtggctttgagtcaggttttggctgaggtgggggagaatatcatcaagcattcggtggtggtaactcatcctacttgtatggctcatttgcattgtccaccgttattacctgctgtggcggctgaggtgttgattagtgggactaatcaatctctggattcttgggatcaaagtccggctgctactgttttggaacagcaggtggtaaattggctgtgtgcaagttttggttatgatgctgatgctgatggtatatttaccagtggcggtacgcaatcgaattttatggggttgctcctagcgcgtgatgcttacgcacgtcatcagttaaactggtctgtgcagcagcaaggattaccaccagaagctcaacgttttcggattctctgttctcaagctgctcatttcaccattagtcaagctgcttctttactcggtttgggacagcaagctgtggtaacggtggagactgatagtgattatcagctttgtgcggcggcggtagaacagaagttagaagaattgcagcaacagaatttattacccattgctttagttgcaactgcgggaactacggattttgctagtattgacaaattaccagaattagccgcctgtgctgagaaatatggcctgtggtttcatgtggatgcggcttttggtggtgcattggtgatgagcgatcgccatcgagataaactagatggtattgctttggctgactcgattacagtcgatttccataaactgttttaccagccaattagctgtggtgcttttttagttaaacagcgtcaaaactttgatttaataaagctacacgctgattatctcaaccctgaaaccaacgaagtagccagcattcccgacttagtaactaagtccatacaaaccaccaagcgattcgacgcgctcaaattgtttgtttctctccgcactctggggaggaaacaatttgcacagatgattgatacaacaattgaactagccaaggaaaccgctagtttaattgacgctgaacctgcattggagttggcaaacaatcctaccattaacgctgttgtttttcgctatcttcctagtgaaacaccagcacacatagatagtacaacttgggcaaatcaaatcaatagccatattcgcatgagtttactgcaacaaggtatcgcagtcatcgcacagaccaaaattggtcaacttacctatctaaagtttaccttgctgaatcctcagacggcgatcgctgatattcaagaggttctcaactctatcacaacgataggtgagaagtattta

SEQ ID NO: 42794 - DNA, 768 bp, Anabaena PCC7120
gcattagttaccggaggctcacgcggtatcggtagagcaatcacattaaaactagccgaacaaggggtgaaagtagctatccactaccacaaaaatgatgaagcggcgaacaataccctagtacaaatacgagaacaaggtggagacggctttatcgtgcaagccgatgttttacagcctcaagatattaatcggatgtttagtcaggttaaggataaatttggcagtctagatatctttgtcaattgtgccagaccagacttagcaactttctacagttctcccatgaagatgacattagaccactggcgtgcggctatggattctcaagcgcaggccttcctattgggaactcaacaagccgccaatctgatgcgagatggaggcagaatcatcgccatcacctattcaccaagtgggcgtactggtagctggcagccttggatggcaatgggaacggctaaagctgctttagaatcgctttgtcgctattttgccgttgcccttggttcccgtggtattactgttaatggaattagccctggagttatctttggtgaaccaaaccccttggaaggaggagtcttgcgttctttaccaacagcagcacaggaagccactcaaaattggcatgagagtggatggacacccatgagacgggtgggaactccagatgatattgctaatgcagctatgctcttatgtatgcaggaagctagctttattacaggtcaaatcattcatgtggacggtggtgcttccattatg

SEQ ID NO: 42795 - DNA, 1818 bp, Anabaena PCC7120
atggcgcttatagttcagaagtttggtggttcatctgtcggttcagtagaacgtattcaagcagtggcacagcgtgtctacaaaacagtgaaagcaggaaattcactggttgtagtggtttctgcaatgggcaaaaccaccgatggactcgtcaaactagctaatgaaatttctcgcaatcctaatcgtcgggaaatggatatgttactgtccacaggggaacaagtcaccattgctctactcagtatggcattgcaagaacttggacaaccagcgatttccatgactggcgctcaagtaggaattgtgacagaagctgaacacacccgcgccagaattttacacatcgaaactgaacgagtagaaggccatattaaggaaggtaaggtagtggtagtagctggttttcaagggatatccagcaacggctcactagaaatcaccactctagggcgcggtggttccgatacatcagccgtggctttagcagcagcattacaggcggatttctgtgaaatttatacagatgtgccaggaattttaactacagacccccgcatagtgcctgaagcccagttaatgggtgaaatcacctgtaatgaaatgctggagttggcaagtttaggggcaaaagtgttacatccccgtgcggtggaaattgcccgtaactatgggatgcctttggtagtcaaatctagctggacagatgatcctggtacgtgggtaactacaccaaaaccccaagggcgatcgctcatcaatttagaactagcccggccagtggatgatgtagaacttgatacagacccagctaaagtcgctctgttacgcgtacccgataaaccaggagtagcagcaaaattatttggggaaatttcccgtcaaaaagtagacgtagatttaattattcaatcaatccatgaaggtaacagtaacgacatcgcctttactgtcaccacacctatattaaaacgagcagaagccgtagccgccgcgattgccccatccctccgcagtccatctcatcccaaatcagacgaggctgaggtgatggtagaacaaaacattgccaaagtcagtattgctggtgcagggatgatcggccgtcctggggtagctgcccaaatgttcgccaccttagccgaagccggggtaaacattcaaatgatttccaccagcgaagtcaaagttagttgtgttattgatgcccaagacggcgatcgcgctatcattgccctccgcaaagcctttgaaatcgaaacccctctccactcacaactccccacgccctcttccctctccactcacaactcccctcccgttcgcggtgtcgccttagacttaaaccaagcccggctggctattcgtcaagtcccagaccgtccagggatggcggcgcagttgtttggtattctctcccagcacaatatcagcgtagacatgatcattcagtctcaacgttgtcgcattgttgatggtgttccccgtcgggatattgcttttacagtcccccgcatggatggggaaactgcccaaaaattgctctgtcaagtagccccagagttgggttggggtgatgtggttttggatagtgcgatcgctaaagttagtattgtcggtgcggggatggtaggtcaaccaggtgtagccgccaaaatgtttgaagcattagctaaacaccaaatcaacattcaaatgattgccacctccgaaattaaaattagctgtgttgtctctcaagaacaaggtgtacaagctttacaagttattcacactgcttttgagttagcaggtaccgagaaatttgttgtacctgcg

SEQ ID NO: 42796 - DNA, 1884 bp, Anabaena PCC7120
atgaaattctcttggagagtcctagtactctggacattgccagctttggtaattggttttttcttttggcaagggacgtttgctggcgctcctgcggacatgagcaagaatgcagctaacactcgcatgacttacggtcgctttttggaatatgtagatgctggacgtgttaccagcgttgacttatacgaaggcggcagaacagctattgtggaagcccaggatcaagatatcgaaaaccgtgtccaacgttggcgggtggatttgccagttagcgctcctgagttaatcagcaaacttaaagacaagaaagtaagttttgatgctcatccagcacgtaatgatggcgctatctggggattgttgggcaatctagtgttccccatcttattgattactggattgttctttttgttccgtcgctctaataatcttccgggtggccctggtcaagccatgaactttggcaaatccaaagcgcgtttccaaatggaagccaaaactggggtgaagtttgacgatgtagctggtatcgaagaagcgaaggaagaattgcaagaagttgtgacattcctcaaacagccagaaagatttacggctgtgggtgcgcggattcccaaaggtgttctgttagtagggcctccagggactggtaaaactttactagcaaaagcgatcgctggggaagctggtgtaccattctttagcatttccggttcggaatttgtggaaatgttcgtgggtgtgggtgcttcccgcgtgcgtgacttatttaagaaagctaaagataacgctccctgtatcatcttcatcgatgaaattgacgcagttgggagacaacggggtgcaggtattggcggcggtaacgacgagagagaacaaactctcaaccagttactcaccgagatggatggttttgaaggcaatacaggcatcattattattgctgctaccaaccgtcccgacgtattagatgcagcgttgttacgtcctggtcgttttgacagacaagtaaccgttgatgctccagatattaaaggacgcttggaagttctgcaagtccacgcccggaataagaaattagatccgagtgtatcattagaagcgatcgcccgtcgtactcccggattcactggtgcagatttagcaaacttgcttaacgaagccgctattcttaccgccagaagacgcaaagaaggtattaccctcagcgaaattgatgacgctgttgatagagttgtcgccgggatggaaggcacacccctagtagatagcaagagcaagcgcttaattgcttaccatgaagtcggacacgccttggtcggtactttattaaaagaccatgacccagtgcagaaagttaccctgattcctagaggacaagcccaaggtttgacttggtttactcctaacgaagaacaagggttaatttctcgttcccaactcaaagccagaattactggcgctttgggtggtcgtgcggcggaagaaatcatttttggttctgcggaagtgaccactggtgcaggcggagacttgcaacaggtgtcaggaatggcacggcaaatggtgacaagatttggtatgtctgatttaggccccttgtccttggaaagtcagcaaggagaagtattcttaggtcgtgactggatgaccagatccgattattcagaatcaattgcggcaagaattgactctcaagtccgattgattgttgatgaatgctatcaaaacgctaagaagattatgcgtgaacatcgcaccgtgacagatcgcatagttgatctgctgattgaaaaagaaaccatcgacggcgaagagttccggcaaattgtcgctgagtacactgatgtgcctgataagcagcagtttgtaccacaactg

SEQ ID NO: 42797 - DNA, 402 bp, Anabaena PCC7120
gtgagtagtttattgcagggagttaacctatacttaatcggcatgatgggcgctggtaagactacagtaggacatttactcgccaaagaattgggttatggctttttagatactgataatgtgattgcccaagctactaaaaaatctatcaatgagatatttgccgaagcaggggaagccggatttcgccagatagaaagcgatgtgttagcccaggtttgttcctatactaagttgactgtagcgacaggtggcggcattgtgttgcggcgagaaaattggagttacctacaccacggtttaattttgtggctagatgtgccagtagatatactctatgcacgtttagcggcagatacaacaagaccacttttacaggatgatgacccaaaaggcaaattg

SEQ ID NO: 42798 - DNA, 2652 bp, Anabaena PCC7120
atgcagcctacagatcccaataaatttactgataaagcctgggaagtcattgtcaaatctcaggatatagttcgtgcatatcaacaacaacaactagacgttgaacatttaattcttgctctgatagaagatcctactagtttagctgtgcggattttgggtcgcgcagaaattgacccgattcgcttacaacagcaattagaagcttttacccagcgtcaaaccaaagtaggcaaaagtgaccaactttacctcggtcgtagcttggatgttatgcttgaccgcgccgaggaaattagggagcggatgaaggatggctacatttctgtagaacatatgctcctagcttttgtggatgatgaacgtgttggtaggaaggtactcaaaggttttaatgtagacagtgccaagatagaagcaagtatcaaagccgttcgtggtagccaaaaagtgacagaccaaaacccagaatcccgctatgaagcattacagaaatttggtagggatttaacagaacaggcaaagtcgggtaagttagacccagtgattggacgagatgacgaaattcgtcgggtaattcaggtgttatctcgtcggagtaaaaataatcccgtcttgattggtgaacctggggtgggtaagacagcgatcgctgaagctttggcacagcgtatagttaatggggatgtcccggaatctctgaaaaaccgtcaattaatctctctcgatatcggtagtttgattgctggggcaaaatatcggggtgaatttgaagaccgattaaaagccgtcctccgggaagttacggaatcaaacggtaatattgtattatttattgatgaactacataccgtcgtcggcactggttccaaccaacaaggggcaatggatgcaggtaacttgctcaaacccatgctggcaaggggtgagttgcggtgtattggggcgacaactttagatgagtttcgtaaattcattgaaaaagacgcagctttagaacgacgttttcaacaggtgtacgtagaccaaccgagtgtggaaaatacaatctccattttgcgcgggttgaaggaacgctacgaagtccatcacaatgtgaaaatttccgattccgcactagtagccgcagcaactttatcagctcgttacattgctgaccgcttcctaccagataaagccattgatttagtcgatgaagccgcagcccaattaaaaatggaaatcacttccaaaccagcagacttggaagccattgaccgccgcttgatgcagctagaaatggaaaagctctccttggcgggagaggagaaagtagcagcgcctactaaggaacgtttgcagcgaattgagttagaaatcaccaatttaactgaaaaacagcaggatttaaacaatcaatggcaaggtgaaaagcaggtactagaagccattagtttgttaaagaaagaagaagacgctttaagggtgcagattgagcaagcagaacgggcttacgatttgaataaagcggcgcagttgaagtatggcaaactagaaggagtacagcgcgatcgcgaagctaaagaagcgaaactcttagaactacaaagtcaaggttctaccttgttgcgtgaacaagtcaccgaagccgacatcgccgaaatcgtcgctaagtggacaggtatccccgtaaatcgtctgttggaatcagaacggcaaaaactcctacaactcgaaagccacttacatcaacgggtgataggacaacaggaagccgtggaagcagtatcagccgctattcgtcgcgcccgtgcgggaatgaaagaccccaaccgtcccatcggttcatttctatttatggggccgactggtgtaggtaaaaccgaactcgcccgcgctttagcccagttcctctttgacgctgatgatgctttggtgcgcttggatatgtctgagtacatggaaaaacattctgtctcccgcttagttggcgcgcctcctggttatgtaggctacgaagaaggtgggcaactttccgaagcagtccgccgacatccttattctgtggtgttattggatgaagtcgaaaaagcacaccccgatgtgttcaatattttattgcaagtattagatgatgggagaattactgattcccaaggcagaacagtagattttcgtaataccgtcattgtcatgaccagtaacatcggtagcgaacatattttagacgtttccggtgatgatacccagtatgagacaatgcgaaatcgggtcatggatgccttgcgatcgcacttccgccccgaatttctcaaccgtgttgatgatacaattcttttccacgccctcagccgttctgagatgagccacatcatccgcattcaactaaaacgagtggaaagtctcctcagagatcaaaaaatctcctttgaaatctctccagccgcctgtgatttcctcgtagaaaaaggctatgacccagtttacggcgcacgtcccctaaaacgagccattcagagagaaatcgaaaaccccctcgccaccaaaatcttagaaaatacctttatctccggtgacaccatttacatagaccaagatgaaaacggtttaagtttcactaacaaagcaccagtaaaagtttcggtaacacaaatcacaacctagccaatttta

SEQ ID NO: 42799 - DNA, 645 bp, Anabaena PCC7120
gtcaaaggactctatgaagaaaaggaaaaattaaggaagctgctaaaactgcaatcgcaaggatacaagggagcggttggtggtattcttttctatggtttacctggatgtggtaaaaccttactagctaatgcttttgctaatgaatcagggcgatatttctttaaattttcacctgctgatattgtgagtgtttggataggtcaaagtcagaagaatattcgagatatttttgctcaagctaagaaaaaatcaccttcagttttatttatagatgagttagatagtattgggtttaatcgtcatgaagataatgcccacactgaccaaaaagccacaattaatcaattattaattgaactgaacaatattaaagatagtgatgttatagtgattgctgctactaattatttaagtgggattgatagtgcattgaaacgttctgggagactggattggaaaattcccattttcccacctaatcaagcagagagagtggagttatttcagcactacttatcacaaattaatttaaatcagttggttaattttgagatgttagccgagaagagtgtcagatttacttcatctgatattgagttagtatgtcgagaggtgaataatgctattttactggaagaaatc

SEQ ID NO: 42800 - DNA, 822 bp, Anabaena PCC7120
atgggaatttgtcgaaatctgggtgtagcggcgttggtggcgttgattgtcgggtgttcgcctgtccaatcccaagtgccaccattaactgaactttctccatcaatcagcgtgcatttactcttgggaaatcccagtggtgcaacgccaacaaagcttacaccagataattacctgatggtcaaaaatcaatatgcactttcctacaacaacagcaagggaactgctaactgggtagcttggcagcttaactcctcatggttgggagatgcagacaggcagaataacttccgcccagataacacattgcctgctggttgggtgcgagtgactccttctatgtactctggaagtggatatgacagaggacatattgcaccatcgggcgatcgcacgcgaacagcagaggataatgcggctactttcctcatgacaaacatgatgccccaaacacccgataacaaccggaacatttggggtaatttagaagattattgtcgagaattggtaagccaaggtaaagaactttatattgtcgctggccctagcggtagttaaggtcaacccctcaaaggtaaagtgacaattcctcaatccacttggaagattattgttgtactagatagcccaggctcagggcttacgggtattacagctaatactcgcgttatcgcagtaaatattcccaacgaaccagaattaaataatgattggagggcttataaagtcagtgttgatgaattagaaacgttgacgggttacgattttctttctaacgtttcccccaatattcaagctagtattgagagtaaagttgataac

SEQ ID NO: 42801 - DNA, 588 bp, Anabaena PCC7120
atcaaacaattaaacaaaaaataccccaacggcatccaagccctaagagatatatccttaaaaatagattacggcatcttcggattactcggcccaaacggtgcagggaaatctagcctcatgcggacactagccactctccaagatgctgattctggctcaatagaattagacggcgtaaatttcctcaaaaatccccaatctgctcgtagtatcttaggttatttacctcaagattttggcgtttatccaagtgtttcagctgaagatttactagatcaattagccgtcttcaaaggatttattcatcatcaacaacgacgagaaatagttgcacaacaactgcaacttgtcaatctatacgaacagcgtcaacagaaattaggcactttttccggtggtatgcgccagcgtttcggaattgctcaagctttactcggttcacccaaactcgtaatagtagatgagccaaccgcaggtttagatccagcagaacgcatccggtttcataatttgctttcagaaatcagcccagacagagttttactactctctacccatattgtcgaagatgtcgccgaaatatgc

SEQ ID NO: 42802 - DNA, 825 bp, Myxococcus xanthus
gctctacagatggccagctatttgataaaagcaggtgcaggaacgtgctacttagctggaggcgttgaaagtacaagcacttctccttttgaaaaaagagcacgtttttctcctgacaaaattggtgatcccgacatgggaattgcagcagaaaacgtggcccagcgatacaacatatctaaagaccagcaggatagatatgctcttttaagtcataaaagaagctgggagtcttttgaaaagagattgtttgaagaagaaacgcttcctcttcgaaatgtgatgcaagatgaagcatttatgaaaaaacgaaacctaacaaagctgctgcaaaaagccagccccgtctttttaaaaaatgaaggcaccgtcaccgcagccaacagctgtggaattaacgacggagcctgcattacgcttgtgatggaagaacaaaaagcacgcgctttaggctttcagcccgttttgcgttttattgacgctgatatttcaggagtgtcacctctttaccctgctattgcgcccgtttctgcgattaaaaatatcttgaagcgaaattcgcttacggtagatgatattgatttatttgaaatcaatgaagcatttgctgttaaagttgtcgcttgcatgcaaaaactggggatatcagaagagaaagtaaatatttgcggaggagcattgacgctaggacacccatacggagcatcaggagctattttagctacgcgtcttttttatgaaagtaagcgccgtgacgtgcgatatgtaatagctgctttaggaagcggaggcggaataggaacagcggtattatttgaagtaatc

SEQ ID NO: 42803 - DNA, 1382 bp, Myxococcus xanthus
ctcattggcatcgacctgggaacgacgaacagcatcgtcgccaccgtccaggacggccagcccgtcgtcatcaagaaccgcacgggccaggggctcacgccctccgtcgtggccatggcgaagaacggcaagcggctggtgggcagcattgccaagcggcaggccatcaccaatccgcaggagacggtgtacgcggccaagcggctcatcggccggaagttctcctcgcacgaggtgcaggactcgctgcgcgcgctctcctacgaggtggtggccgggcagcacgacgacttgcgcatccgcatgggcggcaaggacctgtccgtccccgaaatcagcgccatgattctccaggagctgaaggcggacgcggaggcgcacttcggccggcccgtctccaaggccgtcatcacggtgccggcctacttcaacgacgcccagcgcccaggccaccaaggacgcgggccgcatcgccgggctggacgtgctgcgaatcatcaacgagcccacggcggcggcgctggcctatggcttcggccgcacggtgaacgggcgcgtggcggtgctggacctggggggcggcaccttcgacgtgtccgtgctggatatctcccagggcgtcttcgacgtggtgggcaccggcggtgacacctatctgggcggcgaggactgggacaaccgcatcatcgaatggctcgttttcggcttcgcgaaggagcacggcatcgacctgcgcaaggaccgcatggcgttgcagcggctcaaggacgcggcggagaaggccaaggtggagctgtccagtgtgcgtgaggcggggctcaacctgcccttcatctgcacgccgcctggcggtggtgcggcgctgcacctgcaagccacgctgagccgcgacaagctggatgacctgacgtccgacctggcggagcgcgtggtggggcttaccaccgaagtgctcggcgaggcgggcgtgcgcgcctccgagctcaaggaagtcatcctcgtgggcggcatgtcgcgcatgccgaaaatcgtggaggccgtgcgcggctacttccgccgcgagccctgcaagggcgtccatccggacgaggtggtggcgctgggcgccgcgattcaggcccacgcgctggtgcagccggagcatgagctgctcttgctggacgtgacgccgcagagcctgggcgtggccatcgccgggggcaccgtgcgccggctcatccccaagaacaccacggtgcccacgtcggccacggaggtcttcgccacgtcgaaggacttccagcgcgtcgtgaagatcatggtgctccagggggagcacgacctggcgcaccagaacgagctgctgggcgagttcgtcctcaccggcctgcgggaggcgcctc

SEQ ID NO: 42804 - DNA, 834 bp, Myxococcus xanthus
gggacggatgcgcacaacgagcatatcctggcgcccttcgcccggggcgagaagctgggctgcttcggcctcaccgagcccgaggccggcagcgacgccgccgcgcagaatacggtcgccgtgcgcaagggtgacgagtacgtcatcaacggctcgaagaactggatcaccaacggccccaaggccgacgccatcgtcctgatgacgatgaccaacaaggaagcgggccacaagggcatcaccgcgttcatggtccccacggacacgccggggttcatccgcgccgagccggacaagaagatgggcatcagcgccgcctggtcctgctccatgttctttgaggacatgcgcgtgccggccaagtacatgctcggcaaggaaggcgagggcttcaagatcgccatgagcacgctggacggcggccgcatcggcatcgcgtcgcaggcgctgggcatcgcgcgcgcggcgtacgaggaggcggtgcgctactccggtgagcgcaagtccttcggcaagcccatccgcgagcaccaggccatccagttcatgatcgccgacatggccacggagatcgacgcggcccggctgctcgtgtggcgggcggccctgcagaaggacaagggcgtgcgccacagcgcggagagcgccatggccaagctgtacgccagcgagatggccagccgcgtggcgaacaaggccctgcaggtgcacggcggcatgggctacagcaaggagatggacgtggagcgccacgtgcgcgacgcgcgcatcaccgaaatctacgaggggacgagcgaaatccagcgcatcgtcatcgccgccaacctgctgagg

SEQ ID NO: 42805 - DNA, 867 bp, Myxococcus xanthus
ggcgaccacgtcattccgctctacaccgcggagtgcggccagtgtctgttctgtaagtccggcaagaccaacctgtgcgtggcggtgcgtcccacccagggcaagggtgtgatgccagacggcaccacgcgcttctcgtacaacggcaagcccgtctaccactacatggggtgctccaccttcagcgagtacaccgtggtggcggaggtgtcgctggctcgcatcaacccgaacgccaaccccgagcaggtctgcctgctgggctgcggcgtgacgacgggcctgggcgcggtgaagaacacggcccgcgtgcaggaaggggattcggtggcggtgttcggcctgggcggcatcggcctggcggtcatccagggcgcccagatggcgaaggcgggtcgcatcatcgccatcgatacgaaccccgccaagttcgagctggcgaaggccttcggcgccaccgacttcgtcaaccccaaggaccatgaccgtcccatccagcaggtcatcgtcgagatgacgggctggggcgtggaccactccttcgagtgcatcggcaacgtgggcgtgatgcgcgctgcgatcgagtgctcgcaccgcggctggggccagtccatcatcatcggcgtggccggcgcgggacaggagatctccacccgtccgttccaactcgtcacgggccggacctggaagggcaccgcctttggtggcgtgaagggccgctcggagctccccggcatggtggaggacgcgatggccgggaagattcagctcgcgccgttcgtgacccacacgcgttcgctgaccgacatcaacgaggccttcgacctcatgcacgagggcaagtccatccgcaccgtcgtccgctac

SEQ ID NO: 42806 - DNA, 864 bp, Myxococcus xanthus
aaggagcggatgacgggcttcatccggtcgctgcaggacgacatctgcggcggcctggagcggctggacggctcgacgcgtttccgcgaggactcctggacccggccgggcggcggcggtggacgcagccgggtgctggaggacggcgccgtgctggagaaggccggcgtcaatacgtccgtggtgtacggcgaactggaggagcagttcgcgcagaagctccagggcgagggccgccacttctgggcgggcggcatctccctggtgctgcacccgcgcaacccgcatgtgcccaccgtgcacgccaactaccgcttcatccagcagggcgggaaggcgtggttcggcggcggcgcggacctgacgccctactacctctatgaagaggacgcggcgcacttccaccgcgtgcaccaggccgcctgtgacaagcacgacgcgggctactacccgcgcttcaagagcgcctgtgacaagtacttctacctgcgccaccgcgaggagacgcgcggggtaggcggcatcttcttcgagaacatgggcggggagctggagaaggagttcgccttcgtccaggactgcggccgggccttcctggacgcgtacctgcccatcgccgagcggcgcaaggacacgccggcgacggaggggcagcgcttctggcaggaggtgcggcgcgggcgctacgtggagttcaacctcgtctatgaccggggcaccgtcttcggcctggagacgcgcgggcgcaccgagtccatcctcatgtccctgccgccgcaggtccgctggcgctacgactaccaccccgagcccggcacgccggaggcacggctggtggaggtgttgcgccagccacgcgactgg

SEQ ID NO: 42807 - DNA, 756 bp, Myxococcus xanthus
ctgctccacaagcacctcacccccgagctgaaatcccggctcgaacggctcacgacacgcaacggctggacgctccggaagaccatccagagtggcctggaccacggagactcccagatgggtgtctacgcgggtgacagcgagtcctacgcgctcttctccccgctgctgcatcccatcatccgggaccattcgggccatgacctgagcggacacacgagtgacttctcactcgacgggctgccccagggcgacctggaccccacgggcgagttcatcctctccacgcgggtccgcgtgggacggaacctggcccggtatgcctttcctccggccattggcgccagggacagggccgcgctggaagccgaggtcgtccaggtcctctccggcctgaggggccacctcacgggcaaataccatcccctggccagcctctccgaggcggagcggctggagctggtgcaccaccacgtcctgttgcagcagtcggaccgcttcctggacagcgcgggcgtcaaccgcgactggcctcgcaaccgcggcatgttccactccgcggacatgcgcttcatcgtctgggtcggggaggaagacgccctgcgcatcatcagcatgcagcccggctcggggctggcgcagacctacctccggctgcagacggggctcgagcagttcgacgggcaggtcgacttcgcccaggactcacgggtgggcttcctcacggggtgccccaccaacctggggacccgcatg

SEQ ID NO: 42808 - DNA, 1284 bp, Myxococcus xanthus
gtggccgacgtgctcgcgaccaacggagacacgcacctgggcggtgacaacatcgacctgcggatcatggactggctgatcaccgagttcaagaaggacaccgggctcgacgtcagcaaggacaagatggtcctccagcgcctgaaggaggcggcggagaaggcgaagatcgagctgtccgccgcgatggagacggacatcaacctgccgttcctcaccgcggacgcgacgggtccgaagcacctcaacgtcaagctcacgcgcgccaagttcgaggcgatgattgacgacctcatcgagcgctcgctggagccctgccgcaagtgtctcaaggacgcgggcgtggagccgaaggacctcaacgagatcgtcctcgtcggcggcaccacgcgcatcccgaaggtgcaggaggccgtgaagcgcctgttcggcaaggagccgaaccgctcggtgaacccggacgaagtcgttgcggtgggcgccgcggtgcaggccggcgtgctctccggcgaggtgaaggacatcctcctgctggacgtgacgccgctgagcctgggtgtggagacgctgggcggggtgatgacgaagctcatcgagcgcaacaccaccatccccacgcgcaagtcggagaccttctccacggccgcggacggccagacgcaggtggagatccacgtgctccagggcgagcgtgagatggcgggcgacaaccgcagcctcggccgcttccacctgacgggcatgccgccggcgccgcgtggcgtgccgcagatcgaggtgacgttcgacatcgacgcgaacggcatcctcaacgtcagcgccaaggacaaggccacgggcaaggagcagaaggtcaccatcacccactcgtccggtctggcgaaggacgaggtggagaagatggtcgccgacgcccgctccaacgaggcggccgacaagggccgccgcgagctggtggagatgaagaaccaggcggagagccagtcctacgcggccgagaagctgctgaaggagaacaaggacaagctgtccgcggacacggcgaaggcgctcgaggacgccgtggcggagctcaacaaggtccgcgacggccaggacaaggacgccatcaagacggcgctcgatgcgctccaggccgccagctacaaggccgccgaggagatgtaccgcgccacgggcggcgcgccgggtgccgagggcgctccgggtgctggtccttccgcggcgccgggctcgcaggccagcgccaagaaggacgacgtggtggacgccgagttccgccag

SEQ ID NO: 42809 - DNA, 937 bp, Myxococcus xanthus
  unsure (1)..(937): unsure at all n locations
ttcgcgttggcccccgcgcagatgcccgtgacgnagtcgggcattcccattggcccggatgctccgcacggctacatcccggagaaggtcggcgtcatcgtcggctcgggcatcggcggtatctcttcgctggaagagcagcaccgcaaggggttggagaaggggttcgaccggttgtcgcccttcttcatcatccagatgatcatcaacatggcgccgggcctcatctccatgcggtacaactgcaaggggccgaactgggcgccggtgtccgcgtgtgccaccagtgcccacgccattggcgaggcctggaagtccatccgcctgggtgagacggacgcggtcatcgccggcggcgccgaggcggccatcaccccgttggggctgggtggcttctcggtgatgaaggcgctgtccacacgcaatgatgatccggccggggccagccgtcccttcgacaaggaccgtgacggcttcgtcatgggcgagggcgcgggcatcctggtgctggaggagatggaggccgcgaagaagcgcggcgccaacatcctcgcggaggtggtggggtacggtgccaactcggacgcgtaccacgtcacccagccggcgccggaaggcgagggcgcggcgcgctgcatgcggctggcgctccagtccgcggggatgaacccggaggacgtgggctacatcaacgctcacggcacctcgacgccgttcaacgacgcgaatgagacgaaggccatcaagacggtgttcggcgaccacgcgcggaagatcgccgtgtcgtcgaccaagtcgatgacgggccacatgctcggcgcggcgggcggcttcgagggcgtggtcagcgcgctggcgctggcgcgcaacatcctgccgcccaccatcaaccagacgacgcctgatgccggactgcgacctggactacgtgcccaag

SEQ ID NO: 42810 - DNA, 585 bp, Myxococcus xanthus
atgtccttcatcaattactcatcccgcgaaatcaactgcaagattgtctattacgggcccgggctctgcgggaagacgaccaaccttcagtacatctacaacaagaccgccgcagagacgaagggcaagctcatctccctctccacggagacggaccgcacgctcttcttcgacttcctgccgctgtcgctcggtgagattcgcggcttcaagacgcgcttccacctgtacacggtgcccggtcaggtcttctacgacgccagccgcaagctcatcctcaagggcgtggacggtgtcgtgttcgtggcagacagccagatcgaacgcatggaagcgaacatggagtcgctcgagaacctccgcatcaaccttgcggagcagggctacgacctgaacaagattccgtacgtcatccagtacaacaagcgcgacctgcccaacgcggtgacggtggaggagatgcgcaaggcgctcaaccaccgcaacatcccggagtaccaggccgtggcgcccacgggcgtgggcgtcttcgacacgctcaaggccgtggccaagctcgtcctcaccgagctcaagaagggtggt

SEQ ID NO: 42811 - DNA, 826 bp, Myxococcus xanthus
ttcggcaccgacgcgcagcgcgagaagtacgtgacgcggctggcgtccggcgaggccatcgcgggctcgttcgcgctgtccgagcccccatgcgggctccgaccccggcgcgctgcgcaccaccgcggtgcggcgcggggacgtgtgggtcctcaacggcagcaagcagtggatcacctccggcgcgtacgcgggggtgatggtggtgtgggcacgcacgtcccccgccggcaacaagggcttgtcgtgcttcatcgtcgaaggcgggacgaaggggctcatcatcggcaagcacgaggacaagatgggcctgcgctcctcgaacacggtgtcgctcacgttcgaggactgcgaggttccggcggagaacctgctgggcgccgaagggcagggcttcaagctggccatggtggcgctggacggtgggcgcattggcatcgcggcgcaggcctgcggcgtggggcgcgcggcgctcgaggcgaccgtggcctacgtgaaggaccgtcaggcgttcggccagcccattggcgagttccagggcccgcgcttcatgctcgcggacatgcagacgcagttggaggcggcggagctgctgacgctgcgtgcggcgtcgatgaaggagaagggacagccgttctcccgcgaggcctccatggcgaagctcttcgccagcgagatgagcaacaaggtggccgacaaggccgtgcagctccacggcggctacggctacatcgacgagttcccggtggagcggttcttccgcgacgcccgcgtgcagaccatctacgaaggcaccagcgaggtgcagcggatggtgatcgcccgc

SEQ ID NO: 42812 - DNA, 507 bp, Myxococcus xanthus
  unsure (1)..(507): unsure at all n locations
acgccntatgaaaacgtgcgggtgttgctgctgggccaggacccctaccacgggccgggacaggcgcatgggctggccttctcggtgaagccgggggtggcgccgccgccctcgctggttaacatgttcaaggagctggagagcgacgtgggcgtgccccgcccgaaggacggctctctgattccctgggcccggcagggtgtgctgctgctcaacgcggtgctgacggtgcggcaggcgaagcccaacagccacgcggggcacggctgggaggacttcacggacgccgtcattcgcgcggtgagcgccaaggacgacccggtggtgttcctgctgtggggccgctacgcgcagaagaagaagaagctcatcgattcgaagcggcacgtcgtcatcgagggcacacacccctcgccgctgtcggccagcaatggcttcttcggcagccgtcccttcagcgccgtgaatgaggcgctggagtcccacggccgtccgcccatcgactgg

SEQ ID NO: 42813 - DNA, 2031 bp, Myxococcus xanthus
gccaagcagtaccccatggcgccgggccgcacgggcatccccgagcggcgtgagtacaaggtggtcccggaccacctgggccgtggccgcgaactggtggacgtctccaagaacaaggagcgtggccagcgcaagcgcaccagcggtgatacgcagagcgtgtccaagcaggaactgacggacatggtctggggccgcgtcaccatccccatccgtggcaagaagcgcaagcccacgaagaagggcgccaagacgcagatcacccagatggccgaggagaagaaggtcatcaagctgcaggagggcatctccgtgtccgacctgggccagcgcatgggtgtgcgcagcgccgagctcatcaagaagctgatgggcctggggaagatggccaccgcgaaccagttggtggacgcggacacggcggagatgatcgccggcgactacggctggaagatcgaccgcgtgggcttcgaggtggaggactacctgcccgaggtggagacccgtcccgaggacgagcgtccccgtccgccggtcgtcgccatcatgggccacgtcgaccacggcaagacgagcctcctggacgccatccggaaggccagcgtcgcgcagggcgaggcgggtggcatcacccagcacatcggcgcgtacagcatcaccaccgcgcgcggtgacgtgacgttcctcgacacgccgggccacgaggccttcacgtccatgcgcgcccgtggcgccgacgtgacggacatcgtggtgctggtggtggcctcggacgacggcgtgatgccccagacggtggaggccatcaagcacgcgaaggcggcggaggtgcccatcgtcgtcgccatcaacaagatggacctgccgaccgcgaacctggaccgcgtgaagaaggacctggccacccacgaactcgtgccggaagagtggggcggggacaccatcatggtgcccgtctccgcgaagacgaaggagaacctggaactcctgctggagaacctggccctccaggccgaggtgctcgagctggcctccaacccgctccgtccgtcggtgggcgccatcatcgaggccaagctggaccgcggccgtggccccgtcgccacggtgctggtgcaggaaggcacgctgaagctgggtgacgccgtcgtcaccggctcgcactacggccgcgtccgcgcgatgacgaacagccgcggcgagcaggtgaaggaagtgaagccgggctactgcgccgaggtcgtcggcctgtccggcgtgccgggcgcgggtgacgccatcaacgtggtggcggacgagaaggcggccaagcagatcgccgagcaccgcaacatgaaggagcggcagaccgagctgtcgaaggtcagccgcgagtccctggagcagctgttcgccaagacgaaggcgggcggtggtcccaaggagctgcgcgtcgtcatcaaggcggacgtgcagggctcggccgaggccgtcaagcaggccgtccagaagctctccacccacaaggtcaaggtggaggtggtccactgccgtgtgggcgccatcaccgagggcgacgtgatgcgggcggcggcctccaagggcgtcgtgctgggcttcaacgtcaacccggagtccggggcggaggccgcggccaaggcccaggaagtggtgctcaagagctactccatcatctacgagctcatcgacggggttcgtacggagatggagggcctgctggagcccatccgcaccgagcgcaagctgggtcgcgcggaggtgcgcaacaccttcaacgtgccgcgtgtgggcaccatcgccggtgcggcggtgctggatggcgtcatgaagcgcggcgccatcgtccgcctcatgcgcgagaacaagcagctgttctccgggaagatggcgtcgctgcggcgcttcaaggacgacgtcaaggaagtcgcgcagggcttcgagtgcggtatcggcatcgagagcttcaacgacctcaagcccggtgacatcatcgaggcgtacgagatcgtagagactcggcagagcctcacc

SEQ ID NO: 42814 - DNA, 855 bp, Myxococcus xanthus
aagaagaagatcggcctcatcggcggcggtcagatcggcggcaacctggcgctgctcgccgtgcagaagtcgctcggtgacgtggtgctgtacgacatcccggcggccgagggtctggtcaagggcaaggcgctggacatcaaccagctggccgcggtcgacggttacgactgccgcgtgaagggcaccacggactggaaggacgtggctggctcggacgtgatcatcatcacggccggcatgccccgcaagccgggcatgtcccgcgaggacctgctcgagatcaacctgaagatcatgacggacgtggcgggcaacatcaagcagcacgcccccaacgccttcgtcatcaacgtggccaacccgctggacgcgatggtgttcgcgctccacaagatcgccggtctgcccaagcacatggtcgcgggcatggcgggcgtgctggacaccagccgcttcaagtgcttcgtcgccgaggcgctgggctgctccatccgcgacgtggaggccctggtgctgggcggccacggggacgacatggtcccgctcgtccgccacaggacggtgggcggcgtgcccctgacggagctgatcgccaaggacaagctggacgccatcatcaagcgcacccgtgagggcggcccggagctggtcggtctgtacaagacgggcagcgcctacttcggccccgcggcgtgcgccatcgccatggcggagagcttcctgcaggaccgcaagcgcgtgctgccggccgccgccctcctggagggccagtacgggatcaacggctacttcttcggcgtccccgtgcagatcggcgcgggcggcgtggagaagatccacaccgtcgagctg

SEQ ID NO: 42815 - DNA, 1494 bp, Myxococcus xanthus
gcgcagttctatttcatgggcctgttcgcgcagcgcgtggtgaaggacctgcggcgcgacctgttccagcgcctcaccgcgctgtcgcccgcccagctcgcgcgcgagcggatgggggacctgctcagccgcttctcctcggacgtcagcgccgtggaagcggcggccatgtacacggtgggctcgtacctgcgcgacaccctccaggtcatcatcctggcgggcgtggcgctggcgatgagcccgatgttgggcggcctcatgttgctggtgattccgctggcggcgctgccggcctcgaagctgacgcgcaaggtgctcaagcgcacgcgggaaggccagacgcagctcggcaacctggcggggcagctccacgaagggctgggcggtctgcgcaccatccaggccttcaacgggcaggcggcggagctggctcgcttctccgccttcgcgcaggcgcacgagaaggcggtggtgagcgcggcgtgggcgcgtggcgcggtgccagggctgatggaggtgctggccgcggcggcactggcgggcgcactggcgtatgcggcgagcgcgcggctgatggagccggaggcgctgctctcgctgctgacggcggtcatcctggtgtaccagccggtgaaggacctgggccgggtgacgcagttcgcggtgcaggcgggcgcggcgggtgagcgacttttctcgctgctcgacatgaagcacccagtggaggacgcgccggacgcggtgcccgcgccgaccctgtcgcggagcatccagttcgagggcgtgcgattcgcctatggagagcggcccgcgctggacggcctgacgctggagctgaaggcggggcaggtgacggcgctggtgggtggcagcgtcggaggcaagagcacggtgacatcgctgctgctgcgcttcgagcggccacagaagggccagctcctcctggatggtgtggacgcggaccggtacacggccacgagcgtccgggcccagttcgcgctggtgacgcaggagccgctgctgttccacggcacggtgctggacaacctgcgctacgcgaggccggacgccacgcgggaagaggtggaggccgcggcgaaggtggcgcacgcggacggcttcatccgcgcactacccgaaggctatgacacgcgcatcggcgagcggggcgtggcgctcagtggaggccagcgccagcggttgtgcatcgcccgcgcggtgctggcgcaggcgcccgtgctggtgctggacgaagcgaccagcagcctcgacccggagagcgagcgcgaagtgcaggcggcgctggcggcggtccttccaggccgcacggcgctggtgattgcgcaccggctgtccacggtggtgaacgcggacgtcctcaacgtgatggaggcggggcgcgtcgtcgagagtggctcgcacgcggagttgctccagcgaggcgggcggtatgcggcgctgtggaggatgcagacggagggctcctcggag

SEQ ID NO: 42816 - DNA, 1485 bp, Myxococcus xanthus
tgggactcggggctgatgtacttcgccttcacggaccgcttccacaatggtcggctggagaacgacgcgccggtggcggacgtggaccccatcgccaactatcttggcggggacttcgcgggcatcacccagaagctggaggaggggtacttcgacgcgctgggcatccgcacgctgtggatctcccccgtggatcagaaccccgaggggcgcttcatcggcaccggcggtaagtactacaccggctatcacggctactggccgtcgaagccccgcgagacgcagcaccgcttcggctcgctggaggagctgcgcacgctcactgcggccgcgcacaagcggggcatccgcgtcatcgccgacctggtgctcaaccatgtccacgaggagcacccgtattgggcgaaccatgcgcgagacggctggttcaacacggccgccagttgcgtgtgtggaacgcaggactgcgactgggaagccaagcgcctcacctgcaagttcacggactacctgccggatttcaactggcgctcgtcggacttcgtggaccagttcgccgcggacacgctctggtggctggagcaggcagacttcgacggcttccgcatggacgcggtgaagcacatggagcaggtggccgggcgcaccctccgcgggaagctgaaggagatcaccgcgatgacgggcaccgagttctacctggtgggcgagacgtacgttttcacggatgggcgccctcagattgcccgttacatcagcccacgcgagctggacggtcagttcgacttccccctgtactggcccgtgcgcgaggccttcgcggacggcaagggcttgcagcgtgtggacgacgccgtgcgcgccaacgaggaggcctatgtgccgggaacgctcaattcgcccttcctgggcaaccacgacgtggcgcgcttcatctcccaggccgcggggcaactgcacgagggagggagtgatcccttcggtcccaaccgcccgtccacggtggtgacggatccggccgccttagagaagatgaagtacggcttcgccttcgtgctgacgcagccgggcgtgccgctggtgtattacggcgacgaggtcggcctgccgggcgcggcggatccggacaaccgccgcttcatgcggttcggcagcacgcttgcgccgctggagcgggagttgctcgacttcgtgcggaagctggggcaggcgcgccgggcgcacgaggcgctgcagacgggcgcgcggcggaccctgcgcgtggagaacgacctctacgtgttccagcgcgatctgccgaacgggaagggtgctctggtggccatcaaccggagcgccgtggagcgctcactggtgttggagttgatgggaagcctggccgcgagcagcggcacctacgtggacatcttctccgggcagacgctgcagctcaccggcacggagacggtgctcgtcgtcccgccgcgcggcgtcgctgtctacgtg

SEQ ID NO: 42817 - DNA, 1524 bp, Myxococcus xanthus
acctacaagaccgaccttcgagagatcttcttcacgctgttcgagcagttcggcttcggccaggtggccggccaggcgccgttcgatgcctggggtccggacgaagcgaaggcggtgctgtcggagacgtatcgcttcgcgcgcgaggtgctcgggcccctcaactcggtgggtgaccgggagggatgccgggtggagaacggcgccgtcttcacgccgacgggcttcaaggacgcgtggaagaagctctacgagcagggcttcaagacggtgggcgtgagcccggagcacggcggccagggctcgccgatgatgctccaggtgacggtggaggagctgctgtcgggcgccaactcggcgttcaacatgtaccccggcctggccttcggcgcggcggaagttgtcgcggagtgcggcacgcccgagcagcagaaacagttcgtggagcgcatgctcaacggcacgtggggcggcaccatgtgcctcaccgagccgcacgccggctccgacgtgggcgcggccaagtcgacggcccgccgcaacggcgacggcacctacaacatccgcgggacgaagatcttcatctccggcggcgaccacgacatgggggacaacatcatccacctcgtgctcgcgcgcattgacggcgcctcgccgggcaccaagggcctgtcgctgttcatcgtccccaagctgcgcatcaacgcggacggcagctcgggccagcccaacgacgtgggcgtgggctccatcgagcacaagatgggcatcaacggctcggccacctgtgtcatcaactttggtgagagcgacaactgtgtcggcgagctcgtgggcaccgtcgagcacgtcggcatgagccagatgttcaagatgatgaacggcgcgcgcatcgccgtgggcatccagggcattggcctggcgtccgccgcgtactacaacgcgctggactacgcgaaggaccgcaagcagggctcccacttcaccaagtggaaggaccccaccgcgccccgcgccgccatcatcgagcacccggacgtccgccgcatgctgctggacatcaaggcgcatgtggagggcatccgctcgctgatcatcaagctggccatgcacctggacaaggcgcgccaactggccggcaaggatgacgacgcggccacctaccacaagggccaggtggagctgctcaccccgctggtgaaggcctacagctccgagcaggcgttccgcctgtgcgcgcaggccatccagatctacggcggcgccggctacatccaggactacccggtggagcagtacacccgcgactcgaagatcttctccatctacgagggcaccacccacatccaggccatggacctggtgggccggaagatgggccaggcgggcggcatgcacttccagcagttcatgggcgacgtgggctccttcatcgaggcccaccgcgagcacgccgtctacggcgaggccgtgaagtccctggccgcggcgcaggaggccctgatggccagcgccatggtggtg

SEQ ID NO: 42818 - DNA, 198 bp, Myxococcus xanthus
gtaaagttgatcgtcaaggatcattcgggtgccgatttcgaatcgatcacccccgaagcccggctcatcgaggacctggggatggactacctcgaccacattgagttcgtcatggatctcgaggacaccttcgtcatcgaaatcccagacgaggaagccgagaagatcataacggttggggacgcgtgcgattacgtc

SEQ ID NO: 42819 - DNA, 1410 bp, Myxococcus xanthus
gcacccatgaccacgcactcaattcgcacccgccttgtcgcgcccgcgctgatggtgctcgggatgctgtccacgcctgccttcgcggccgctcccgcctcggcgcccaccaaggaagcgcctccggccgccgccgcgcccaagcccttcaaagtccccgtccgcacggagttcacgctcgacaacgggctggaagtctcgctgctgccctacggcgacatgccgaaggtcgccatccaactggccatcgacaccggcaacatccacgagaaggccacggagacgtggctggcggacctgacgggaaagctgctgtcggagggcaccaccacccgttccgcggagcagcttgcccaggcggccgcgcagctgggtggttcgctcaacatcggcacgacgatggaccagacctatgtcggtctggaggtcctctccgagtcggcgccggacgccgtggccctcatcgcggacgtcatccagaacccggccttcccgccggcggaggtcgagcgcgtcaagggcgacctcgtgcgggagatggccatctacaagagccggccgggtacgctcgccgacgagcggctgctccagtcgctctacggtgaccacccgtatggccgctacttcccgccggaggcccagctcaagggctacacgccggaggccgtccgcgcgcactacgacgccaacatcggcgcggcccgggcgcggctgtacgtcgtcggccggttcgagccggcgccggtggaaaaggccatccgggacgcgttcaccggctggaaggccggcgcggcgcgcctccggaacgtgcccaagcagaaggtggcgaaggcggtccagttcatcgaccgccccggctcggtgcagtccacggtgcgcgtggcggtgaagggcctgccgccctccagcccggactacgtcaagcagacggtgatgaacacgctgctcggtggctacttcagctcgcgcatcaccgcgaacatccgcgaggcgaagggctacacgtattcgccctacagcgatgtgtccacgcacctggaggacgcctactgggtgcagaacgcggacgtgacgacggccgtcacgggcgagtcgctgaaggagatcctcaaggaggtggccaccctgcgcaagacgccgccgcccgcggacgagctgagcgctgtccagagctatctggcgggctccttcctgctccagaactcgtcgcgcagcggcatcatctaccagctccgcttcgtggacctgcacggcctgcctgattcgtatctgcagaactacgtgcagtcggtgatggccgtcacgccggagcaggtgcagcagctggccgcgaagatgctgacgcgtgaggcgatgaccttcatcgtcgtgggcgaccagaagttggtggcgccgcagctgaaggtcgta

SEQ ID NO: 42820 - DNA, 729 bp, Myxococcus xanthus
ctgaccgacgtcggccgcaggcggcagcacaacgaagacgcgatgctggtggatgcggcactcggtctctacgtggtggctgacggcatgggcggtcactcggccggcgaggtcgcgagcaaccgggccacggaggtcgtcaagcagcacatctccgccaaccgccatctgttgaaggacctgggcatcaacccgacgccggacagccgctccgcggcggcggcgctcgtcgaggtgtccgtccagcgcgcgtgcgcggacatctaccggacggcgatgtcggacgcgaccaagcgcggcatgggcacgacgttcgtgtgcctcgcggtaggcggcaacaaaggcgtcatcggccatgtgggtgacagccgtgtctacctggtgcggcatggccagtgtcaccggctgacggaggaccacacgctggtcgccgcgcagctcaaggccggcacgattaccaaggaccaggccgccaactcgcagtaccgcaacgtgattacccgcgcggtgggcatccaggagtccgtccaggtcgacacgctcatcgtggacctggtgcccggggacatgttcatcctctgctcggacggcctgcacggctatgtcgaggacgaggaggtccttccgctcatcgccggcatcgcgcccgcggacctgcccaagcgcttcatcgacgtcgccaacgagcgcggtggcaaggacaacatcaccgcggtggtggtgaaggtc

SEQ ID NO: 42821 - DNA, 1191 bp, Myxococcus xanthus
tacgtggacatcgaagacctggcccgggcacgcggcgtggacccggccaagtacacggcgggcctgggcgccagggagatggccgtcaccgaccccggagaggacaccgtggccctcgcggccactgcggcggcccgcctcatccgtcagcaggacgtggacccgtcccgcatcggcatgctggtggtgggcacagagacgggcatcgaccactcgaaacccgtcgcctcgcacgtgcagggcctgctgaagctgccgcgcaccatgcggacctatgacacgcagcacgcgtgttacggcggcaccgccgggctgatggcggcggtggagtggattgcgtccggcgcgggcgcgggcaaggtggccgtggtggtgtgttcggacatcgcgcgctacgggctgaacaccgcgggcgagcccacccagggcggaggcgcggtggcgctgctggtctccgagcaacccgacctgctcgccatggacgtgggcctcaacggcgtgtgcagcatggacgtgtatgacttctggcggcccgtgggccggcgggaggcgctggtggacgggcactactccatcacctgctacctggaggccctgtccggcgcttaccggggctggcgcgagaaggccctggcggcggggctggtccgctggtcggacgcgctgcccggcgaacagttggcgcgcatcgcctaccacgtgcccttctgcaagatggcccggaaggcgcacacccaactgcgcctgtgcgacctggaggatgcggcggacgcggcggcttcgacgccggagtcgcgggaggcgcaggcgaagtcggccgccagctatgacgcccaggtggcgacttcactgggactcaactcgcgcatcggaaacgtgtacaccgcgtccctctacctggcgctggcgggcctgctgcaacacgaggccggcgcgctggcgggacagcgcattggcctgctgtcctacggcagcggctgcgcggccgaattctactccggcacggtgggcgagaaggccgccgagcggatggcgaaggcggacctggaggcggtgctggcccggcgcgagcgcgtctccatcgaggaatacgagcgcctgatgaagctgccggcggatgcgcccgaggccgtggccccgtcgcccggagccttccggctgacggagattcgcgaccaccgccgccagtac

SEQ ID NO: 42822 - DNA, 1267 bp, Myxococcus xanthus
gacgtccacgaggccacgcttcccaacggcctccaggtgcggttgctcgccaaccaccaggctcctgtcgtcagtctctacaccgtgttccaggtcggcagccgcaacgagcggcccggcatcaccggcatcagccacctgttcgagcacatgatgttcaacggggcgaagaagtacggccccggtgagttcgaccgcgtcatggaggccaacggcgggcgccaacaacgccttcacctccgaggacgtcaccgtctacatggactggttcccgcgctccgcgctcgacgtcatcttcgacctcgaggccgaccggctccagcacctggccatcgaccccaaggtcaccgagtccgagcgcggcgtcgtgtactcggagcgccgctccgccatcgacaacgacaacatgggcgccctgatggagcaggtgcaggccaccgccttcgtggcgcacccgtaccagttccccgtcatcgggtggccgtccgacatcgagtcgtggcgcatcgaggacctccagcgctactacaagacgtactacgcgcccaacaacgccacgctcatcttcaccggcgccgtgacgcccgcggaaatcttcgcgctcgcggagaagtacctggagcccatcccctcccagcccgcgccggagcccgtccgcaccaaggagcccgagcagcagggagagcgccgcatcgtcgtgaagaagcaggcccaggccccgctcatccaactggcctaccacggcatctccggcaaggacgcggacgtggaagcgctcacgttgctcctgagcatcctcaccaacggcgactcctcgcggctgcaccgccgcctcgtcgaggaggagcgcgccgccctccgcgtcaacacccacttcagcccgggcttcgacccctcgctcgtctgggtctacgcggacttgccgcccggtgctgacgtcgccaaggtggaaggcctgctcactgaggagctggcccgcgtcgtcaaggacggcgtcagcgacgccgagctcaagaaggcgcgcaacatcaccctgtcccagttctggcgcagcctggagaccaacaacggccgcggccgcgcgctgggcgccgcggagacgttccgcggtgactaccgccagctcttcgacgcgcccgaccgctatgagcgcgtgacgcgtgacgacgtccgcaaggtcgccgcgcgcatcttcaactcgcagcgccgcaccgttggttggctcgtgcccgccgacgcgcaggccgccacccccgactcccgcaag

SEQ ID NO: 42823 - DNA, 1044 bp, Myxococcus xanthus
atccgtgccgtggggcgagcactcccgccgcactacgccagtcaggaggagctcatcgccgcgttccgcgagctgtgggccacgcgccacttcaacctggagcggctggaggacctgcaccgcgccgtccaggtgggaggacggcatctggcgttgcccctggaggcttatccgccgctgctgacattccaacagcgcaatgacgcctggattcgctcggccacggagctgggcgaaacggtggtgcgcaaggccttggacgcggcggagctcacgcccggggaggtggaccacgtcttcttcgtcaccgtgacgggcatcgccacgccgagcatcgacgcgcggctggccaaccgcatgcgcttccgggaggacttcaagcgcacgccgctcttcggactgggatgcgtggcgggcgcggcgggcgtggcccgggcggcggactacctgcgcggctttccggagcacacagcggtcgtcatcgccgtggagttgtgttcgctcacgttgcagcgcgaggacctgtccataccgaacatcatcgcgtccggcctctttggcgacggcgcggcgtgcgcggtgctccgcggcgcggcggccccaggtgcgcgagggccgcgggtggtggcgtcgcgctccgtgttctacccggacaccgagcgcatcatgggctgggacgtggtggacaccggcttcaaggtggtgctgtccgcgaaggtgccggggctcgtgaaggaccacatccggggcaacgtggatggcttcctcgcgcagcatggactgaagcgcggggacatccggcactgggtggcgcacaccggcgggcccaaggtgctggaggccttcgaggaggcgctggagctggcaccctcggcgctggagcgctcgtgggcctccctgcgcgaggtgggcaatctctcctccgcgtcggtgctcttcgtgctcggagagacgctggagtccgttcgcgcgcagccgggggagtggggcgtgatgatggccatggggccgggcttcggcgcggagatggtgttgctgcgatgg

SEQ ID NO: 42824 - DNA, 1599 bp, Myxococcus xanthus
cctccgtcccgcgcagcacgcctgcgggccctggccacggagaccttcgacgtcctcatcatcgggggcggtgtcaccggcgcgggctcggcgcgggatgccgcgctccggggcctcaaggtggcgctcgtcgagcgtgacgacttcgccagtggcacctccagccgctcgtcccggctcatccacggcggccttcgctacctggagcacggccacctgggcctcgtcttcgaatccagcatcgagcgccaacgtctgctgcggctcgccccgcatctggtgcgtccgctcgccttcatctggcccgtgtacgcgggcgcccgcgtgcctcgctggaagctcaacgcgggcctcatgctctacgacgccctctccctcttccggaacgtgaagggctaccggcggctcaacgcccggcaggtccacgcggccgagccaggcctgcgcaccgaccacctcaagggcggtgcccgctactacgacgcggccacggacgacgcgcgcctcaccctggccaatgccgtgggcgcgtccgaggcgggcgccgtcgtcctcaaccacgcgtccgtgaaggcgctcgtcctggagcagggacaagcgcacggcgcgacggtggtggaccacctcaccggcgaggaggtcaccgtgcgcgcacgggccctcgtcaacgccacgggcccgtggagtgatgaaatccgccggctggatgcgccgaatggggcgagcccggccgtgcgcggcagcaagggcgtccacctcgccgtaccgcgcgagcgcatcaaccaccgcgacgccttcacgctgctgtcccccaaggacggccgggtgatgttcgtgctgcccgccgacaacttcaccatcattggcaccacggagacgtccacgcgcgcgcaccccgcggaggtccgcgccagcgagtccgacgtggcctacctgctggagtccgccaacgccttcttccccgaggcgcgcctcactcgcgcggacgtggtgagcgcgtgggccggcatccgccccctggtggccagcggctaccacggcacacaggccgacgcgggcagtgccagccgcgagcacgccatcgacgtgagcccctccggcgtgctcgccatcagcggtggcaagctcaccacctatcgcgtcatggcgcgcgacgtggtggacgctgtggagcgccgcctgggccagcctcgccgccgctcgcccacggatgtgttgcccctgccgggtggagacatccgcgcgctggacgccgagttcgccgcggcgcgcaccgaggtgggagacgacgccacagccgtccacctggtgcgcgcctatggcagccgctggcgccgcgtgtgggccctgacgcgagaggacgccgcgctgtcccggccgctcgccgaggggcttccctaccgggccgccgaggccgcctggggtgtcacccacgaactggtgcacaccctgtcggacctgctcatccgccgcctcaaggtggcgttcgagacgcgcgaccaggggcaggcggccgcgcgtgtggcggccgaggtcatggcgccccggttgggctgggacgccgcggagacgcagcggcaactggacgtctatgccgcc

SEQ ID NO: 42825 - DNA, 393 bp, Myxococcus xanthus
tacgacgcagtcatgacgcccctgggctggctgggcctcaccgccgcccggcgcaagctggtgcgcggcctgtccggccacgtgctggaggtgggcaccggcaccggcctggcgttgcccggctacccggacaccgtcaccgccgtcaccgccatcgacgtggacgaagcggcgctcgcgcgcgcccagcgacggcggcccgacgcgcggctgctgtatgccagcgtggagtccctgcccttccccaccgcctccttcgacgccgtggtgtccagcctcgtcttctgcagcgtggaggccccggcgcaggcgctgacggagattttccgggtcctgcgcccgggcggcgcgctgcgcatgctggagcatgtgcgcgcgccctcgccagcgctg

SEQ ID NO: 42826 - DNA, 1590 bp, Myxococcus xanthus
ctccctggctgccccacctggccggaggcctacgccgcccgctaccgcgaggctggctactggcgcagtgaaacgttcggccagctcctccacgaacgcgcccagcgtcacggcgagcggaccgcactggtggccggagagcgtcgcctcacctacgccaacctggacgcccgcgtcagccagctggccgccggcttccatgccctgggcatccaggctcgggaccgggtggtggtgcagctgcccaacgtggccgagttcttcgaggtcatcttcgccctcttccgactgggcgcgctgccggtgttcgcgcttcccgcgcaccgcgcttcggagattggctacttctgcgccttcacggaggcggtggcctacgtcatcgcggacaagcaggccggcttcgactaccgcaccctggctgagcaggtgcgcggcacctgcccgacgctgaaacacgtcatcgtcgccggtgacgcaggccccttcacggcactgagcagcctgtacgccgcgcccacggcgctgccgccagggcccgcgcccagcgacgtggccttcttccagctctccggcggaagcacgggcgtgcccaagctcatcccgcgcacgcacgacgactacatctacagcctgcgcggcagcgtggacatctgccagctcgacgagacgagcgtgtacctgtgcgcgctgcccgcggcgcacaactttccgctcagctcgccgggcgtgctgggcaccttctacgcgggcggcacggcggtgctggcgcccaactccagcccggacacggtgttcccgatcatcgagcgtgagcgcgtcaccatcaccgcggtggtgccaccactggccatggtctggatggacgcggccaagacgcgccggcaccagctcgccagcctgcgggtgctccaggtcggtggcgcgcgcctcagcaccgaggcggccatgcgggtgaagcccacgctgggctgcacgctccagcaggtgttcggcatggccgagggcctggtcaactacacgcgcctggatgaccccgaggacgtcatcgtcagcacccagggccggcccatctccccggacgacgaaatccgggtggtggacgaggacggcgaagacgtagcgccgggcgagacgggccagttgctgacgcgcgggccgtacaccatccgcggctactacaaggcggaggcccacaacgcgaaggccttcaccgacgacggcttctaccacaccggtgacgtggtccgcgtgacgccccagggctacctggtggtggagggccgcgccaaggatcagatcaaccggggcggcgacaaggtcgcggccgaggaggtggaaaaccatctgctggcccaccccgacgtgcacgacgccgcggtggtcgccgttccggacgcgttcctcggcgagcgcacctgcgccttcgtcatcgcgcgcggcacgccgccagcgcccaatgtgctcacggccttcctgcgccagcgtggtctggccgccttcaagattcccgaccgggtcgagttcgtcgaggcgttccccaagacgggcgtcggcaaggtcagcaagaaggcgctgcgcgacgtgctcgcc

SEQ ID NO: 42827 - DNA, 1989 bp, Myxococcus xanthus
  unsure (1)..(1989): unsure at all n locations
gccctcaagcgcttcgccacgtccttcaccggccgggtgcgcgaggggaagatcgaccccatcttcggccggcaccgcgaaatccggcagatggtggacatcctctcccgccgccggaagaacaaccccatcctggtgggcgagcccggcgtgggcaagacggcgctggtggagggcctggcctgggccatcgtccggggcgaggtgcccgacgcgctgaagaacgtggagctgctggggctggacctgggcctgctccaggcgggcgcgggcgtgcgcggcgagttcgagaaccgcctcaaggccgtcatctccgaggtgaaggcctcccccacccccatcatcctgttcatcgacgaggcgcacaccatcatcggcgcgggcggctcgcagggcggcacggacgcgtccaacctgctcaagccggcgctggcgcgcggtgagctgcgcacgctcgcggtcaccacctgngccgagtacaagaagtacttcgagaaggacgccgcgctggagcggcgcttccagccggtcaaggtggaggagcccagcgaggaggacgcggagctgatgctgcgcggcctgcgccccacgtaggaagcggcccacggtgtcatcatccgcgaagaagccgtcgccgccgcggtgcgcctgtccagccggtacatctccggccggcagctcccggacaaggcggtggacctgttggacacgtccgcggcccgcgtgaagattgagctgtccacccggcccgaggagctggtgcaattggaccaggagatttcggcgctggagcgcgagcgagacacgcgcaagcgcgacctcgccgagggcacgggcggcccggacgaacagacgtccctggaggccgccgaggcgaagctgagcgccacggtggatgcacgagccacgctgcatgcgcgctgggagacggagcgtacggccgtcgcggcgctgatggaggcccgcaaggccctgcgcgaggccgctccggacacggactccgcgccactgaaggcggccgtggacgaagctgcggcgaagctggcggccacgcgcggcgaggtgccgctggtacacgcggacgtggacgcggacatcgtcgcgcgggtggtggcgggctggacgggcgtgcccgtggggaagatgcgcagcgacctgctggagtcggtgctcaacctggaggacaagctccggggccgggtgcggggccaggaggcggcgctgaagaaggttgcggaaatcatccgcatctcccaggccggcatccgcaacccggacacgcccattggcgtgatgctcttcgtgggccccagcggcgtgggcaagacggagacggcgctggcgctggcggacgcgctctatggcggcgagcgcttcatgacgacgctcaacatgagcgagttccaggagaagcacacggtgagccggctcatcggctcgccgccgggctacgtgggatacggcgagggcggcctgctgacggaagccgtgcgtcagcggccctactccgtcgtgctgctggacgagtgcgagaaggccgacctggaggtgatgaacctcttctaccaggtgttcgacaagggctcgctgacggacggcgagggccgcgcggtggacttcaagaacaccgtgctcatcctcaccagcaacctggcctcggacctggtgatgcggatgttcgaggacggcgcgcagcccacctccgatgaggtgctgtcggtgattcgccccgcgctcagccagcacttcaagccggcgctgctggctcgaatgacggtcgtccccttcgggccggtgcagcgcgacgtgatgcgccagattgccgagatgaagctggccaagctggtgagccggctgcgcacggcgcacaacgtggagacgacgctggcgccagagttgctggacgagcttgcgcgccgctgcacggagtcggagatgggggcgcgcaacatggagcagattctccagggctcgctgatgccggcgctg

SEQ ID NO: 42828 - DNA, 1368 bp, Myxococcus xanthus
ctgctcgacttcatgatgaagtcgtggaagccgcgctcgaagaagctgcccccgaaaatcaagcaggcggaggccttcaaagcccgccgccgggcgctctccaagctgttccccggcgagacgctcatcattcccaccggccacgagaaggtgcgcgccaacgacaccaacttccgtttccggccgggcagcgacttctactacctcaccggcaacctggagccggactgcgtcctcgtcctccagcccaaggagaagggtggccacaccgacgtgctcttcgtggagccgaacccgggccgcaccgacgccacgttcttcaccgaccgcgtgaagggggagctgtgggaaggcccccgcctgggcgtgaaggagagtcaggcccgctacggcgtggaccaggcccggagcctcaacgagctgccggccttcctctccggcctcagcggcgcggagagccgtcccacgcgcttgctgcgcggcctgtcgcccaaggtggacggcgccgtcccggcgccgggtgagaaggacaaggggctggcccaagcgctgtcggagatgcggctgctcaaggacgcgcaggagctgcgtgaactccagacgtccatcgactccacgcaccgcggcttcgaggacgtcatccgtggcctgaagacggcgaagacggagcgctacgtggagggcatcttcaacctccgcgcccgcgtggaaggcaacgacgtgggctaccgcaccatcgccgcctccggcgcccatgcgtgcatcctgcactggcaccacaatgacgggccgctcgttcccggcgacctgctgctgctggacgcgggcgtggagggccagacgctctacaccgcggacatcacccgcaccctgcccatctccgggaagttctccaaggagcagcgcgaaatctacgagctggtgctggaggcgcaggacgcggccttcgccgaggtgaagccgggcaacgacttcatggagcccaaccgcgcggccatgcgcgtgctcgcggagggcctggaggccctgggcatcctcgaggacgccgaggaggcgctcaaggacgagcaccagttctacaagcgctactcgctccacaacgtcagccacatgctgggcctggacgtgcacgactgcgcccaggcgcggcaggagacctacaagtacgggaagctccaggccggcatggtgctgacggtggagcctggcctctacttccagatggacgacctcaccgtgcccaagcgctaccggggcatcggcgtgcgcatcgaggacgacgtcgtcgtcaccgcgcgcggctgcaaggtcctctccgccgacatcccccgcaaggcgaaggatgtggaggcgtggatgaagtccctc

SEQ ID NO: 42829 - DNA, 1446 bp, Myxococcus xanthus
agggtgcctgtgctgctcaggcagcaacggctgctccgggggcttgccgccaccgaggcacgcgtggtgtgtctggacgcggatgccgccgccctcggcgccgagccggaggtgaaccccgggcgtgtcacgacgcccgattcgctcgcgtatctcatctacacctcgggctccaccggcaagcccaagggcgtgatgattgaccaccggaacgccgtggccttcttgcagtgggcccagagtgtcttctcgccggagtcgttggcggggacgctggcgtcgacgtccatctgcttcgacctgtccgtcttcgaaatcttcacgcccctgtgctgtggggcgaaggtcatcgtcgcgaagaatgcgctggagctgcccgaactgcccgcggcgaaggaggtgacgctcgtcaacaccgtgccctcggcgatgggcgcgctgctgcgagggggcggggtgccggcgtcggtcaccatcgtcaacctggcgggcgaggcgctggcgggagcgctggttgactccatctacgccctgggccacgtgagagatgtcttcaacctctacggcccgagcgagacgacgacctattccacgttcacccgtgtgaaccggggcgagacgccgaccatcggccggcccgttggaaatacccaggtctacgtgctggatgcgaaccgggagcccatgcccgtgggggtgccgggcgaggtctacatcggcgggcatggtgtcgcgcggggctacctgggccggacggagctgacggcggagcggttcgtcacgtctcccttcgccggggacgcgggcgcgcacttgtaccggacaggagacctggcgaggtggctgccggacgggcaactcgaatacctgggccggatggaccaccaggtgaagctccgcggcttccgcatcgagctgggtgagattggcgcggcgctgcaggagcacccaggcatccgcgacgcggtcgtcgtcgtgcgagaaggcccgggcgctgacaagcagttggtggcgtatgtggtgggccgcgacgggaaggcccccgagccgggtgcgctgcgcgaccacctcaagtcccggctgcccgagtacatggtgcccttcgtgttcgtgggcctggaggccttgccgctcacgccgaacgggaaggtggaccgcgccgcgctccccgcgccggaccgtgtgggctccgggacggcgaaggcccacgtcgcgccgagaacgcctggggaagccacgctggcggacatctggcgccaggtgcttggggtggagcaggtgggcgtgcacgaccacttcttcgagctcggaggccactcgctgctgctctaccgggtgctcgtcctcgcgcgggccgcgtcgggcgcggacatcccgctgagggccctgttgcagtcgccgacgctggaggagatggcgcgcaccatcgaggccgcgaagacgggc

SEQ ID NO: 42830 - DNA, 1671 bp, Myxococcus xanthus
cccaccctgcacttcccccccgagctccccatctcgagccgggtggaggacatcaccgcggccatcaccgcccatcaggtggtcattgtcgcgggggccaccggctcggggaagacaacgcagctaccgaaagtcctgctcgccatggggcgcggccgcccgcgccagattggcgtcacccagccccggcgcatcgccgcgacgagcgtggcggcgcgcgtggcacgcgagctcggcacggagctgggcacggacgtcggctaccagattcgcttcgaggaccgctcgtcccggcagacggccgtgaagttcatgaccgacggggtcctgctcgcgcagattcacagcgacccactcctgcgccgctacgacacgatcgtgctcgacgaggcccacgagcgcagcctcacgatcgacttcctgctcgggtggctcaagcgcatcctccccaggcgccccgacctcaaggtggtggtgagctcggccaccatcgagaccgagcgcttctcgcagttcttcgggggggctccggtcatccaggtggagggccgtacctttccggtggacgtgctctacgagccgcctcccgaggacaccgagctcgcagactccgtcgccgatgcggtggcgaacgtgatctcgctcgacccggatggggacgtcctcgtgttcctccccggggagcgggaaatccgcgaggccgagaatgccctgaacgcgcgcgagctccgcggcacggtggtgcaacccctgtacgcgcgcctgtcggcctccgagcagtcgcgcgtcttcgccaccatcccccagcgccgggtcatcctcgccaccaacgtcgcggagacgtcggtcaccatcccggggatcgtgtacgtcgtggacacgggggtggcgcgcctgtcgcgctacgagtcgcgctcgggcaccacgcgcctgcacatcgagccggtctcccaggccagcgccgaccagcgcaaagggcgctgcggccgcgtgcgcgaggggatctgcgtgcgcctctacgacgaggtgagcttcaccacgcggcccgccttcaccgacccggaaatcaagcgcaccgggctcgcgggggtcatcctgcggatgaagtccctcggcctcggtgacgtcgaggacttccccttcctcgacccgccccagccgagggccatcgccgagggctggcgggtgctcgaggaactcggggccatcgagggcaaggagcgcaccttgacgccgctcgggcagcagctcgcgcgcttcccggtggacccgcgcatcgcgcggatgattctcgccggcgccgagtacgggtgcctggacgaggtgctcatcgtcgccgcggcgctcaacctgcaggaccctcgcgagcgaccacgcgagtccgcgcagaaggcggacgagctgcaccggcgcttccgtgacgagcactcggacttcacggggctcctcaagctgtgggcgttcgtgcgcgaggccgagggccgggggacgtcccatctgcggcgcgtgtgccgggacaacttcctgtccttcctgcgggtgcgcgagtggcgggacgtccagcgccagctcgaggagaccgtccgcgagctgcgcataccgcgcaagggccggggcgccccggcgcgcgggtacgtcctgcaccaggcgctcctcaccgggctactttcc

SEQ ID NO: 42831 - DNA, 1581 bp, Myxococcus xanthus
gtcatcggcatcgacctgggtactaccaacagcgccgtggcgaccgtggaagacggacgcccgcgcatgattcccccgcgcgcgggtggccggttgacgccgtccacgctgggcgtgaacaaagctggcgagcgcgtggtgggcgtcgcggcacaatccctgggcgaggagcacccggactccgtggtgtgggccaccaagcgtttcctggggcgccgctacacgccggagctggttcaggaggcgaaggcgctggtgccgtatccgctggtggccgggccctctggcgacgtgcgcgtgcggctcgccgggcgggtgatgcccgtcacgcaggtgtccgcgatgattctgggcgagctggccctggacgcgcaggcgcacttcggccgccccgttaccaagtgtgtcatcacggttccggccaacttcgacgacaaccagcggcaggccacgcgcgaggcggccagcatcgccgggctggacgtggtgcggctggtgaacgagcccaccgccgcggcgctggcgtatggcctgtcacgcggcttcgaaggcaacgcgctggtgttcgacctgggcggtggcaccttcgatgtgtccatcctcgaggtgaagtccggtgtcttcgaggtgcgcgccaccggcggcgatccgcggctgggtggcgaggacttcgaccagcgcatcgtccagtggctcctggcgcaggtggacgatgagctgcggcacgtggtgtcgcaggacgcgcagagcctgcgccggctgaaggtggccgccgagtccgccaagcgcgagctcaccgagaaggaagaggcgtccatctacgtcgccgggttgggcgaccactcggcgcccggcaagcggatggcggagctggagacggtgctgacgcgctccttcttcgaaacgctgtccgagccgctgtcgcgccgctgcctcgatgtctgcgagtcggtgatgcgcgaggcgaagatggacccccacgcggtggacgtggtgctgctggtgggcggcatgacgcgcgtgccgctggtgcggcggttggtggcggactttttcggccgcgcgccctccacggacgtgcacccggaggaggccgtcgcgctgggcgctgcggtgcaggccgacgagctcgtccgccagtccggtcaggcgctgctgctggacgtcgccgcccagagcctgggcgtgggcgtcatgggtgggcgcgtgaagcggctcatcccgaagaacaccggcgtgccggtggtggcgcgggacatcttctatccgggcagctccggccagcaggaagcgcgcatccccgtgtatcagggcgagagcgagttccaggacgagaactacaagctgggcgaggtggtgctgaagcgcctccacgtcgccgcgcgcggagaggtgccgctggaggtcgtcttcgagctgtccagcgaggccatcctgtccgtcaaggccacggacctgacctcgggcaacatggaggccgtgcggctggaggcccgtgcggggctgccgcagggcgaggcggagaagctgggcgcggagcaggcccactacgcgcgctcgcagggcgtggtggacgcgaag

SEQ ID NO: 42832 - DNA, 1350 bp, Myxococcus xanthus
atgaacgcgcacatcttccgcgaatacgatatccgaggcttggtcgataaggacctcaccaccgaggtggtggagctgctgggcaagggcctgggcaccatcatccgtcgccagggcgggcgctccatcgcggtgggccgcgactgccgcgagtcctccacccgcttccgggacgcgctctgcgcgggcctcacctccacgggcctcaatgtgttcgacgtgggcgtggtccccacgccgctgacgtacttcgccgccaacaccctgccggtggacggcctggcgatgattaccggcagccacaacccgcccgagtacaacggcttcaagattggcgcggggaagacgaccttccacagccacgagattcaagccctgcgcaagctcatcgaagcgcgggacttcgaggtgtctcccaagccgggcaccgtgacgccgtacgacatcatcacgccctacaaccacttcgtccgccagacggtgaaggtgggccgcaaggggatgcgcatcgtcatcgacgccggcaacggcacgggcggcgccatcgcggtgccgctgttcgagagcatgggcttcgacgtggtgcccctgttctgtgagatggacgcgacgttccccaaccaccacccggacccgacggtggtggagaacctggaggacctcatcgcggcggtgaagcgcgagaaggccgaggtgggcatcgcctacgacggcgacagcgaccgcatcggcgtcatcgacgaccagggcaacatcctctggggcgaccagttgatggtgctcttcagccgctacgtgctgaaggagagcccgggcgcggccatcgtcggcgaggtgaagtgcagctacacgctgtacgacgacatcgcgaagcgcggcggcaagcccatcatgtggaaggccgggcactcgctcatcaagtcgaagatgaaggagacgcaggcggagctggcaggagagatgagcggccacatcttcttcaagaaccgctacttcggcttcgacgatgccatctactccaccgcgcgcctgctggagattctcacgcacgagaaggcgaccatgtcggagctcctgtccgacgtgccgaagacgtacgccagcccggagctgcgcttcgacacgaaggaagagaagaagttcgagatggtgaagcgcgccacggagacgctgcgcgacgcgggccacgacatcatcgacgtggacggcgtgcgcgtgacgttccccgacggctggggcctcatccgtgcctccaacacgcagcccatcctggtgctgcgcttcgaggccaacacgcccgagcgcctcaaggaaatccaggccctcatcgagggcaccgtggagaaggtc

SEQ ID NO: 42833 - DNA, 1052 bp, Myxococcus xanthus
cgctcgccggacatcatcagcggctaccacctcgacaagcttgtcggcagcggaggcatgggggaggtccacaaggccacccagctctcgctaggccgcacggtggcggtgaagctcctcaatcccgagctggcgaaggacccgtccttcatcgcgcgcttccagaaggaagccgccgcgctcgccgccctgagccatccccacatcgtctccatcgtcgacaaggggaagacggacaccacgtactacctggtgatggagttcgtggacggcccgtcgctgcgggagctgattcgcgagccgcagttggacgtcatgggcgccctgcggcgcatgctgcagatctgccgcgccatcgagtacgcgcacggccgcggcgtcatccaccgggacctgaagccggagaacatcctgctggaccagcaggccggcggcatcgccaaggtgtcggacttcggcctggcgtcattcctggaggatgccagtccctcctcgcgctacgcgctcacgtccacgcacgtgtccatgggcacgctgtcgtacatggcgcccgagcagcgcgtggacgcgaagagcgcggacgcgcgcgcggacatcttctcgctgggcgtcatcctctacgagtggctcacgggcgaggtgccgctgggcacgttcgacccgccgtcgcggcgcaagccggggctggactcgcggctggacgccatcgtcacgcggtgcctcaagccggacccggaggaccgctacccctccgtcaccacgctcatcgcggacctggagctgctcgtcccgggcagcctgccgtcactggcgccggtgaagctgacgcacctccagcgcgtccgccagggtgtgcgcaaggtggtgcgcatggccctgcaggccgcggccgtgctgctggtggtggcggcgctgctccgtgctgggccgggagtggctgcgcagcggggagaagcccgtgccgccgcagcccggcgccgcgctgaacgcggacctgggcccgccatcgccccggtccatgcccggccggctggagacaggctccgagaagc

SEQ ID NO: 42834 - DNA, 606 bp, Myxococcus xanthus
atgctcgacctggacgcgctcgacttcgcgaagggcaacggactggtgacggtcgtcacgcaggacgcgagcaccggtgacgtgttgatggtggcgcatgccgaccgggaagccctggagcgcacgctggccacgggggagatgcactaccggtcgcgcacgcgcggcccgtggcacaagggcgccaccagtggaaacgtccagcgcgtggtggcgctccgcgccgactgtgacggtgacgcggtgctcgcgcgcgtggcgaaggcgggccctgcgtgtcacctggggacgaagacctgcttcggcccgggccgttgggatgcactgagcgcgctggatgacacgctcgctcggcgcgccgcaccagcggagcggcccgatgatgcgcctcccagctacacacgccgcctgctggaggaccgcaacctgcgcttgaagaagctgggcgaggaggccgcggagttggtgacggcgtgcgcggacgtggacccgtcacgcgccgcggaggaagcggcggacgtgctctaccacgtgctcgtcgcggtccggcccctgggcctctcgctcgacgacgtgaaggcagtcctcgccaggcgcgcttcgcgc

SEQ ID NO: 42835 - DNA, 1341 bp, Myxococcus xanthus
ggctccatccttggcatcgacttcgggaccaccaacaccgccgcggccttcttcgacaaggccggcaagcttcgtgtcgttccggtgacggacaagagcgtcacgctgccctccgtcgtctggttccacgcggcggacaaggccatcgttggccacgccgcgcgccggcaaatcattgacgaccctcgccacaccgtcttcggcgccaagcgcttcctgggccgccgcttccagtccgagtacgtcacccagcacaaggacaagtacgccttcgggctcgtcgaggccgaggacggctacacggccgtgacgatgtacgggaagcagacgtcgctgacggacgtggcgcacctcatcatcaagcagattcacacgttggcgaaccacgccgccggcacgcccttccgcgagtgcgtgctcaccgtgcccgcgcacgccagcagtcgccagcgcgcggcggtgcgccatgccgcggagcaggccggcctccaggtgcgcgccatcatcaacgagcccaccgccgccgcgctctactacgccaacctgcgcaaccccgagcagacggtgatggtgttcgacctgggcggcggcaccttcgacgccaccctgctcgcggtgcagaacaaggtggtgaaggtgctggccaccggcggtgatgccttcctgggcggcgccaacttcgacgagcgcatcgtggagatgctggtgaacgacttccagcagaagcacggcatcgacctgcgcgggaacaaggtggtgatgcagcggctcgtcttcgccgctgagtccgcgaagatggcgctgagccagcgcgacgccacggtgctccgcgtgccgtgcatcgcccagaaggacggcggcttcatcgacttcgactacacgctcacccgcaagcgcctggaggagatggccttccagctcatcgagcgcaccgcatccgcctgcgacgacgtgctagagcgcgcgaagctgaaggcagaccagattgacgagctggtcctcgtcggcggccagacgcgcatgcccgccatccgccagcgcttctcccacttcaagcgcatgtcctccgacaaggaggtcaacccggagctcggcgtcgcggtgggcgcggccatcctcggccggaacctggcgcgcggcatcaccggcctggcggacgtggtgcccatgcccatcagcatcatggtccccggcggcgcgcagcacgaggtcatccccgccaacacccccgtgcccgcgacgaagtccgtgacgatggagctgccgatgattcccgggccgctctccatcgccctcttcgaggcgctggacaccaccaccgtggaccgcgagctgctgggc

SEQ ID NO: 42836 - DNA, 852 bp, Myxococcus xanthus
ctgctgaagattgctctgcccaacaaaggccgcctctcggacgaagtacgggagttgttcaatgacgcgggcctggaggtgcgggcccggggtgagcgcgcgctcaccgcgtcattgggcggagagttcgaggccatcttcgtccgcgcccaggacatcccggagttcgtggcggacggcgccgcgcatgcgggtgtcaccggttgggacctggtgtgtgagtccggacgtgagctggacctgctgatggacctggagttcggcaggtgtcgcctggtggtggcggcgcgggaggagggcggcttcgcctcgccggaagacgtgaaggagggcatgcgggtcgcgtcctgcttcccccggctgacgcaggagttcttcgccaggcgcgggcagcgggtggcggtggtaccagtatcgggcgcggcggagattgcgccccatctgggcatcgcggacatcgtcgtggacctgacgtccaccggctccacgctgaagatgaatggcctgcgcgaggtcggcacggtgctggagtccagcgcgcggctggtggcgtgcaagggcaatccggtggacacccagcagaagctggacgagctgaagcaggcgctgggctcggtgttggcggcgcgcgacaagcgctacctgatggccaacgtgccgaaggattcgctcatccgggtgcgcgaagtcctcccgggcctcaatggtcccaccgtggtggacgtgctggacggtggtgacttcgtggccgtgcacgcggtggtgccggcgaagaccatctaccgcaccatcaacgcgctgaaggcactgggctgcgagggcatcctcgtcacccgcattgaaaggttgatg

SEQ ID NO: 42837 - DNA, 804 bp, Myxococcus xanthus
atgattcgcaccgtcatcaccggcatcaccggccgcatgggcagcacgttgcttcgcctggcgctcgactcgggagacctgcgggtggtgggaggcacggcgcggccgggcagtgcctcggtgggccaggacgccggggtggcgacgcggctgggcccggtggacgtgacggtggtggacagcctggagcgcgcgctggacgccgcgcaggcggacgtcgtcatcgacttcaccagcgcggagctgagcgtggcgcacgcgaaggtgtgtgccgcgcgcggcgtggccctggtggtgggctccaccggcttcacgccggaggcgtccgcggcgctggcggagagcgcgaaggcggtgcccatcgtcgccgcgccgaacatgtcggtgggcgtcaacctggtcatccgcatggcggcggagctggcgcgggtgctggggccgggcttcgacgtggaggtgctggaggcgcaccaccgcatgaagaaggacgcgcccagcggcaccgcgctgcggctggcggaagtgctgacggaggccctggggcgcacccaggaggacctcaccttcgcgaggcatgggcagattggcgcgcggcccgcgcgcgagattggtgtgcagacgctgcggggcggcgacgtggtgggcgagcacaccgtgtacttcctgggtgagggcgagcgcatcgagctcacgcaccgcgccaccaaccgagaccagttcgctgctggcgcgctgagggccgcgcgctgggtggcggggcgcgcgcctggtctccatgacatggccgacgtgctcggcttccag

SEQ ID NO: 42838 - DNA, 889 bp, Myxococcus xanthus
gccggcatgaagaccttcgaaggctccatgacggcgctggccactccgtttcgcaacggagcgctcgatgagcccgcataccgggcgctggtccgccagcagattgaagggggcaccagcgtgctggtccccatgggcaccaccggcgaggccgtgacgatgacggctactgagctgggcccgtgcggtcaaggtggtggtgtacaaggcgaagggccgcgtgacggtggtgggtggctccggctccactagctcggcggagaccatcgacggcgtgcccagcgtgcgctacgcgggcgcggacggcacgctcatcgtcacgccctactacaacaagcccacgcaggagggcttgctggagcactaccgcgcggtggccaaggcgcacccgggcttccccatcatcgcctacaacgtgccgggccggacgggcgtggacctgctgcccgacaccgtgctgcggctgtgtgacatccccgaggtggtggcgctcaaggaggccactggcagcatgcctcgggccatcgacatcctggagaagtgcggcgaccggatgacgctcttgtccggtgacgacttcaccgtgctgcccttcatcgcttgcggcggcaagggcgtcatctccgtgtcgtccaacgtggcgccgcggatgatggcggacctggtggcggcggcgcgcgcggggaatatcgcggtggcgcgcgacctccaggtgcggatgaacgagttgcaccgcctgctcttcatcgaatccaaccccacgcccgtgaagtggggattgcacgtgatgggattgttcgggcccgaagtgcggttgcccctggtgcagatgaccgagcccaacgccgcgaagcttcgcgacaccctgcgccagctgggcctgctcacg

SEQ ID NO: 42839 - DNA, 1191 bp, Myxococcus xanthus
cacgcggcggatgtgccgctggcggccatcgccgagtccgtgggcacgcccatttacgtgtactccaccgccacgctcacccggcacatccgggtggtgacggaggccttcggagaccggccgcacctcatctgttactcggtgaaggccaactcgaacctggccatcctccggctcatcgccgagcggggcggcgggttcgacatcgtctccggcggcgagctggcccgggtgcggcatgtgggcggggacgccgggaagacggtgttcgctggcgtgggaaagacgcacgaggagatggaggcggcgctggccgcgggcatcctcctcttcaacgtggagagcgccgaggagctggaggcgctggacgccgtgggccgccgcctggggcgccgcgcgccattcgccctgcgcgtgaatccggacgtggatgcgcgcacgcaccgttacatctccaccggcctgaagacgtcgaagttcggagtgccgttcgaggaggcggtggccctctacgcgcgcgcgaagaagatgaagggcctgctggccgccgggttggattgccacatcggctcgcagctcacccagacggcgcccattcgcgcggccttgtccaaggtggcgggcctgtattccgcgctcaaggaaaagggccatccgctggcgtacctggacgtgggcggcgggctgggcatcacctatctggacgagacgccgccgtctccggaggagtacgcccgcaccgtgctggccgcggcgggtgccaccggggccacgctcatcctggagccgggccgggcgctggtgggcaacgcgggcgtgttgctcacgcgcgtgctgtaccggaagaagacgccagcgcggcacttcgtggtggtggacgcgggcatgaatgacttgctgcgccccgcgctctacgaggcgcaccacggccttcagcccctggtgaagcggcggggcaaggcggtggaggtagacgtggtggggccggtgtgtgaatccaccgacgtgctggcgaaggcacggcccctggtgcttccgcaagcaggcgagttgttcgctttcatgagcgcgggcgcgtacggcatgagtatgtcgtccacttataactcccggccacgcccggccgaggtgctggtggacggtgcggcgtggcgcgtggtccgggagcgggagcgcgtcgaggatctctgg

SEQ ID NO: 42840 - DNA, 2214 bp, Myxococcus xanthus
ctgattgccaaagagttgcaggccagcttccgcaccgccctggacgaggcgcggaagatgcgccacgagtacctgacgctggaacacctgctcctggcgctcaccacggacgcgcgcacgcgcgaagtcctcaaggggtgcggcgccaacgtgaagcaactccaggagcgcctggtctccttgatgcaggagacctttgaacgcctgacacaaggggtggaccccgagccgcagcagaccatcggcgtggagcgggtgctccaccgcgccgccatgcacgcgctgtccgccgagcagaagctcatcgacggtggggacgtgctggtggccctcttccgcgaggacgagagccacgcgctctacctgctccagcaggagggcgtcacccggttggatttgctcaactacatctcccacggcgtcaccaaggacggcgagggtgaaggtgagggcgaggagagcgccggccacgccacccccgcgggcgacgacgacgagggcgagtccccgaagaagagcccactcgaggcctacacggtgcagctcaacatcgaggccaaggaggggcgcatcgacccgctcatcggccgcgagaaggagctggagcgcaccatccaggtgctctgccgccgccggaagaacaacccgctctatgtgggtgaggcgggcgtgggcaagacggccatcgccgaagggctggcgctgcacatccacgaaggccgcgtgccggaggtcctgaaggacgccatcgtctactcgctggacatgggcgcgctgctcgcgggcaccaagttccgcggccagttcgaggagcggctcaagggcgtgctcaaggccctgaaggagcagcagaacgccatcctcttcatcgacgaaatccacaccatcgtcggcgcgggcgccaccagtggcggctccatggacgcgtccaacctgctcaagcccgcgctggccagcgggcggctgcgctgcatcggctcgacgacgtaccaggagtacaagtccgccttcgagcgggaccgggccctgtcacgccgcttccagaagattgaggtgggtgagccctccgtcgaggacaccatcctcatcctggaggggctgaagagccgctacgaggagcaccacggggtgaagtaccaacccgaggccatccgcgcggcggcggagctgtccgccaaacacatcaacgaccggttcctgccggacaaggccatcgacgtcatcgacgagacgggctcggccgagcggctcaagccggagggccagcgctccaacaccgtcagcggcgcggacgtggaggccgtcgtcgcgaagatggcgcgcatccccgccaagagcgtgtccgccagcgagggcgtgcagctccagaatctggagaaggagctccaaggcgtcatctacggacaggactcggccatcaaggacctggtcagcgccatcatgctggcgcgctccggactgcgcgcgccggagaagcccattggttcgttcctcttctccggccccacgggcgtgggcaagacggagctggccaagcaactggcgcagtcgctgggcgtggagttcctgcgctacgacatgagcgagtactcggagaagcacacggtgagccggctcatcggcgcgccgccgggctacgtcggcttcgaccagggcggcctgctcacggacgccgtgcgcaagcacccctactcggtggtggtgctggatgaaatcgagaaggcccacccggacctcttcaacatcctgctccaggtcatggaccacgcgacgctgacggacaacaacggccgcaaggccgacttccgcaacatcgtcctcatcctcaccaccaacgcgggcgcccaggagatgagcaccaaggccattggcttcggggacctcgcgaagccggtggacgccacccgcgcgaagaaggcgattgagcgcaccttcacgccggaattccgcaaccgcctggacgggtggattctcttctccggcctcccgcccgaggtcatcctcaaggtcgtggacaaggaagtgcgcctgctccagaagatgctggacgagaagaaggtgaagctggcgctgacgcccgccgcccgcgcgtggctggccgagcacggctatgacccggccttcggcgcgcggcccatggcccggctggtggacaactcgctgaagaagccgctcgcccaggcgctcctcttcggggacctgaagaatggcggc

SEQ ID NO: 42841 - DNA, 1497 bp, Myxococcus xanthus
atcatcggcatcgacctcggcacgaccaactcgtgcgcggcgatcgtcgaggacagcgggaacgtcaagctcatcccctacaagggcggcgagtacaccatcccctcgatcttcgcgatcgacgacaaggggaacgaactcatcggctacgaggccaagcgccagtggcagctcaacccgcgcaacaccgtctacggttccaagcggctggtgggccgaggcttcggcagcgaagtcgtcgacacgatgaagcaggtcgtggcgtacaacatgcgccccggcaagcagagcgacgtcatcctggacgtggggaagaaggagttcgccctccaggagatcagcgccaagatcctggggaagatccgcgaggtcgcctccaactacctgaagatgcccatcaagcgggcggtggtgacggtgccggcctacttcaacgaccggcagcgccagtcggtgaaggacgcgggcaagctcatcgacctggaagtggtgcgcatcatcaacgagcccaccgcggcggcgctggcctacggcgtgggcaaggggctgaaggagaaggtcgtcatctacgacctgggcggcggcaccttcgacgtctccatcatcgagatccgtgaccgcgtcttcgaggtgaaggccaccggcggtgacgtcttcctgggcggcatcgacttcgacaacgccatcatccaccacgtcctcaaggacttcgcggcgaagacgggcctcgacctcgccacggacccggtggcgatgcagcgcatcaaggacctggccgagcgcacgaagatcgacctgtccgcgcgcgaggaggtccccttcaacatccccttcatcacgatgacgtcccagggccagcccctgaacatcgagatgaagttcagccggaagatgctggagcagctcaccaaccagctcgtggaccgcaccctgcagatggtggcgcgcgtgctggtggactcgggactgtccaccaaggacgtcgacgaggtcatgctcgtgggcggccagacgcgcatgcccatcgtccaggaccggctcaccaagttcttcggcaagccgcccagcaagggcgtgcacccggacgaggccgtggcgattggcgccgcgctctacgcgcactcgctccaggacgacaccaacctgcgcatccagctcctggacgtgattcccatggccattggcctggagaaggcgggcggcgccttccacaccgtcttcccgcgcaacgcgtccatccccaatgccaagcaattgctggccaccaccagcatggacaaccagaccgagctcgccgtgcgcatcttccagggcgacaacgagctggtggcccgcaacgacatgctgggcgagttcaccttctccggcatccagcccggccgcgccggccccgcgctcgtggagatcaccttcgacgcgaacgtggaaggcatcctcaccatgcgcgcccgcgacccggtgtccggtcgcgagatgaagaccacggtgcgcgtcagc

SEQ ID NO: 42842 - DNA, 930 bp, Myxococcus xanthus
ccgcacatcgtcaccctgacgctcaacccgaccatcgacgtggctacgtccgtgccggaagtcacgccggagcacaagctgcgctgtggccccgtgcgcagggacccgggtgggggcggcatcaacgtggcgcgcgtggtgcgtgagctgggcggtgaggccatcgccgtctacacgcggggcggggccaccgggagccagttggaggagctcctggaggagaagggcctgctgcgccgctccgtgccgttgcaggacgccacccgggagagcttcacggtggcggaaggcacgggcgcgcgtgagtatcgcttcatcctgccagggcccacgctgtccgagcgcgagtggcagcgctgcctcgacgcactggaggacgtggccgtgggcgcgacctacatcgtcgccagcggcagcctggcgcccggcgtaccggaggacttctatgcccgtgtggcccggctggggaagcgcctggccgtgcgcgtggtggtggacaccaacggtccgccgctgcgggccgcgctggaagagggcgtgttcatggccaagcccaaccgccgcgagctgcgggacctgagcggcgcgtcggtggaagacttcgccacccaggccgccgcggcgcgcgagctggtggcccagggccgcgccgaagtgctggcggtgtccatgggcgcggacggcgcgctggtgacgacgcgcaccgcccagttccgggcgacgccgcccccggtgcggacgtacagctcggtgggcgcgggggacagctttgtcgcggggatgacgcttgcgctcgcgcggggccagtccaccgaggacgcgctgcgctggggcatcgcctccgggacggccgcgctgctcacccaggggacggacctgtgttaccgggcggacgtggagcggctcttcacccaggtgaaggcggagccg

SEQ ID NO: 42843 - DNA, 432 bp, Myxococcus xanthus
ctgtccgccatcgtcgccatggcggcgaaccgtgtcatcggcgcgggcaaccagctcccgtggcggctgcccgcggacctcgcgcgcttcaagcgcatcaccatgggccacaccctggtgatggggcgcaagacgtacgagtccatcggccgcccgctgccgggccgcaccttcatcgtcgtcacccgccagcgtgacttcgcgcccccgggcgtccaggtggcgcactccgtggacgaagcgctctccctggcaaaggccagtggcgactcggaggtcttcatcgccggaggcgcggacctctacgcccagacgatggaccgcgtgcagcgcatctacctcacgcacatcgcccggaacttccctggcgacacctggttccccgacgtggacctgtccggttggacatgcgtcgaagagcaagcacatccc

SEQ ID NO: 42844 - DNA, 1467 bp, Myxococcus xanthus
ggtgtcgtcatcggcatcgacctggggacgacgaactcgtgcgcggcctacgtccgcaacggcaagccgggcgtgctgcccagccgcgagggccacaacacggtgccctccatcatcgccgtcaacacgcgcggcaagctggtggtgggccaccccgccaaggggcagatgctcaccaatccgcgccagacggtgtacggcgccaagcggctggtgggccggcccttcgcgtccccggtggtggagcagctcaaggaccgcttccactatgagatcgcggccagtgagaatggcgacgcgggcgtgaagctgggcgaggacgtctacacgctccaacaaatctccgcgctcatcctccgggaggtccgggaggtggcgcagaaccagttgggccatcaggtgtcccgcgcggtcgtcaccgttcccgcctactacaacgacaaccagcgccaggcggtgcgcgaggccgggaagctggcgggcctgtacatcgagcgcatcctcaacgagcccacctcggcggcgctggcctatggcttcggccgcaagctgaaccagcgcgtgctcgtctatgacctgggcggtggcacgttcgacgcgtcggtgctggagctgaacgacaacgtctacgaggtcatctccaccggcggcgacacgttcctgggcggcatcgacttcgactcctcccttgtcacgtacctcctggacgagttccagaagaccacgggccgcgcgttccaaggggaccgggtggccctgcagcgcatcaacgacgcggccgagcgcgccaagtgcgcgctgtcggagcgttcggaggtgcgggtgcacgtcgcgttcgtgacgatgatcgacagcaagccgtgcgacctggacgtcatgctctcgcggcagaagctggtggagctgacggaggggttggtggatcgcaccctccaggtctgcgaggaggtcctccgcgcgaagaaggtgacgccgcaggacatcgacgaggtcatcctcgtcggtgggcagagccgcttcccgctggtgcacgagaagatcacgaagttcttcggcaagccgcccagcaagggcgtgcacccggacgaggccgtggcgctgggcgcggcgctgctggcccacagcctggggcagttggaaggcgtggtgctcatcgacgtgctgcccatggccattggcgtgggcctgcctggtggccgcttcaaggcggtgatggagcgcaacacgtcgctgccgtcgacgaagagctacaccctggccacgcaccgcgacggccagacggagctggagctcacggtgttccagggcgactccgacaaggccgctgacaacgagtacctgggcacgctgaagctggagggcctgccgaagctcccgcgtggcgccgtgcaggtgaacgtcaccttcgaggtcagcaacgagtcgctgctgaaggtcaccgcgcgcgaggcctcgtcgggccgcgag

SEQ ID NO: 42845 - DNA, 1143 bp, Myxococcus xanthus
atccggctcgccctcactttcgacgacgtcctgctggtcccgggcgagagctcggtcgtccccaaggacgtcgacctgacgacccggctcactcgcaatctccgtctcaacatccccctcctgtcggcggccatggacaccgtcacggagtcccggaccgccatcgccatggcccaggagggcggcattggtgtcatccacaagaacatgacgcccgagcagcaggcgctcgaggtcctcaaggtcaagaagttcgaaagcggcatggtggtggaccccgtcaccatcgaaccggaggccccgctgggccgcgcgctggagctgatgcgccttcacggcgtgtccggcatcccggtggtgaagggccagcgactggtgggcatcgtcaccagccgcgacgtgcgcttcgagaccaacttcacccagacggtggagtcgatgatgacgcgcaagctcgtcaccggccgcgaaggcatcacgcaggaagatgcgcagaagctgctgcacgagcaccgcatcgagaagctcctcgtcgtcaatgacgccttcgagctcaagggcctcatcaccatcaaggacatcgagaagcgccgcacgcaccccaacgcggccaaggacggcatgggccgcctgctgtgcgccgccgccgtgggtgtgtccgcggaccgcgaggcccgcgtggaggcgctcatcaaggccggcgtggacgtcatcgtcgtggacaccgcgcacggtcactccaccgcggtgctggatggcgtgcgcgacacccggaagaacttccagggcttcgagctcatcgccggcaacgtcgccaccgccgaggccacccgcgcgctcatccaggccggcgtggacgcggtgaaggtgggcatcggccccggctccatctgcaccacccgcgtggtggccggcgtgggcgtgccccaggtgacggccgtggatgactgcgtccgcgaggcccagaagcacgacgtgcccatcatctccgacggcggcatcaagtactcgggcgacatcgtcaaggcgctggccgcgggcgccaacacggtgatggtcggctcgctcttcgcaggcaccgaggagtccccgggcgacgtcatcctgtaccagggccgcagctacaagagctaccgcggcatg

SEQ ID NO: 42846 - DNA, 1692 bp, Myxococcus xanthus
ggcatcggcgcctctcccggcgtggcggtggggcacgccttcatcctggaccgcaaacgcatccgcacacccaagctgcggctggcggaggcggaggtcgagcccgagcggatgcggatgaagacagccattgacctgtccgaccgccagctcgccgagctgaaagaacagattacgcgcaccgagggcagcgaccacgccctcatcctcgaggcgcaccggttgatgctccacgaccccatgctcgtggacgaggtgaaccggctcatcatcgaggaccgcatcaacgccgagtgggccgtccggcgcgtggcgcgcaaaatcaagcacctgttcgacaacatccccgacgagtacttccgcgagcgccgctcggacgtggactacgtcgcggaccgaatcatccgcaacctgatggggcaggtggtggatgaggaagtggaagtccccgcggaggccatcgtcgtcgcgcatgacttgtctccggcggacgcggcgctgatggcgcgcagcggccgggtgggcggcttcgtgacggacctgggcggccagacgagccacaccgccattgtcgcccgcgcgcgggagacgcccgcggtggtgggcgccgggcgggccagcgaacagatttcgccgggcgacctggtggccatggatggcatccggggcgtggtgctggtgaacccctcggacgagcagctcgccgtcttccgcgaggagcagcgccgctaccaggagagcgagcggctggccctggcgaccaaggacctgcccgccgtcagcaccgacggcttccagattcgcctcaacggcaacatcgaattcctggaggaaatcccctcgctgctggcgcacggcgcggagggcattggcctgtaccgcaccgagttcatgttcctggaccggaagacggcgcccaccgaggaggagcactaccgcgcctaccgccaggtgttggaggccatgggcgggcgccccgtcaccatccgcacgttggatttgggcggcgacaaggtgccgggcaagacgaagcacgagaaggaacccaatccggccatgggcctgcgggccatccggtactgcctgtccaaccgggagctgttccgcacgcagttgcgcgccctgttgcgcgccagcgtgcacggcaacttgcggctgatgttccccctcatctgcggggtgagtgagctgcgtgaggcccgcagcgagctggaggcctgccgcacggagctgggccgcgcgggtgtccccgtgggcaagcgcttccccgtgggcatcatggtggagacgcccagcgcggccaccatcgccgaccggctggcccaggaggcggacttcttctcggtggggaccaacgacctcatccagtactcgctggccatcgaccgccagaaccgtgaggtcgcctacctctaccggcctctccacctgtccgtgctccggcaactgcgcggcatcatcgacgcgggccgggcggccaacatccccgtgtccatgtgtggggaaatggcgggagatccgctctacacgctggtgctgctggcgctgggcttcgacgagctgtccatgacgtcggggcagattccggtggtgaagcgcttcctgcgccgggtgagccgcgtggacgccatggagttgctgcagaacgccatggagctgaccacggcggaggaaatcgagcgctacgtgcgc

SEQ ID NO: 42847 - DNA, 876 bp, Myxococcus xanthus
acttgcccgtgggggcttgcacgagcatgaatgcccgggcccatgaacaaacgcgatttggagcctggaatcatcaccgacctggccggaaggaccacgtacggtgattatctgcagctcgaccgggtcttgtcggcgcaggtgacgcgctcgcaaccccctcaccacgacgagctgttgttcatcatgcagcaccaaacaagcgagctgtggatgaagctgctcatccactagctgggcgcctgcatgcgttacgtgcaggcggaccggctggaggcgtagttcaagaaattcgcgcgcgtggcgcacatccaaccgatgctcttcaaacagtggagcgagttggagactctcacgccgaacgagtacctggagttccgcgacacgctgggcagtttctctggcttccagagctttcagtaccgtgcggtggagttcctgctgggcaacaaggacgcgcaggcgttgatgcccttccgccacgtccccgccatccatggcgagctggagcggctgttcgaatcccccagcctgtatgacgagttcctgcgccacctgtcgcgcatggggcatccggtgccgcagagccacgtgcagcgtgactggcgcaagccctacgagaagagcccggaggtggtggaggtgttccggcgcatctaccaggacgccgaggcgcactgggatgcgtatgagatgtgcgagaagctggtggacaccgaggagcgtttccagctctggcgctaccgccacatgatgacggtgatgcgcatcatcggcttcaagcaaggcacgggcggctcctcgggtgtgggcttcctgcgcaaggcgttggacctgcgcttcttcccggagctgtgggacgtgcgcacggagctg

SEQ ID NO: 42848 - DNA, 234 bp, Myxococcus xanthus
ggcgccacgctggtggatgtccgcacgcccgaggagttcgcctccggtcacctgcccggcgcggtgaacatcccggtggatgaactggcacggcggttcggagagcttggctcgctgcagacgcccctggttgtctactgccgcagtggcgcacgcagcggccgtgccgagcgcctgttgaaggagcaggggttccaggacgtcttcaatctcggccccatgtcgacgtggccg

SEQ ID NO: 42849 - DNA, 1134 bp, Myxococcus xanthus
tacaagctcgacaacggcttgaaggtggtcctctcgcgcgacagctcggcgcccaaggccgtcgtcgccgtctattacaacatcggcttccgcatcgagccgaaggaccgcaccgggttcgcgcacctgttcgagcacatgatgttccagggctcgacgaacctcgggaagatggagttcatccgcctcatccagaagaacggcggcgtgctcaacggctccacccgcttcgacttcaccaactactttgaagtcatcccctccaacgcgctggagcccatcctctgggctgaggccgaccgcatgcgcgggctcgacgtgacggaggagaacctgaagaaccagcagggcgtggtgacgaacgaggtgaaggtcaacgtcctcaaccagccttatggcggcttcccgtggctggacatgccgcaggtggcgaacaccaactggtacaacgcccacaacttctacggcgacttgaaggacctggaggccgcctcgctggaggacgtgcgcgccttcttcaagacgtactacgcgcccagcaacgccgcgctggtcatcgtcggtgacttcgagccggagcaggtgaagggctggattcagaagtacttcgggccgctgcccaccgtggcgcagccgtcgaagccggacatctccgagccccgccagacgaaggagaagcgccacgacaagcaggacaagctggcgcagcgtccggcgctcgcggtgggctaccacatgcccgacgtgggcacgcccgagtacttcgccatggcgctggtcgacgaggtcctcctgcaaggcaacgatagcgcgctctaccagcagctcgtgcagaagaagggcctgacgggcgaggtctccggcggggtgaaccagctgggcaaccactggaactacaacggccccatgcagtggaccgcgtacctgttccatgacgcggacacgacgacggagaccctcctcgcggagatcgacggcgtggtggcgcagctgcagaatcagcccatcgacgcggcgacgctggagcgggcgcgggtgaaggcgcgctcggggctgtacgggcagttggagggcttcctcggcttcggccgcgcggacctgctggcgtccttcgcgctcttcttcgacgacccg

SEQ ID NO: 42850 - DNA, 975 bp, Myxococcus xanthus
ctcggccacttccatcctcccaaccttctgaccaacgccttcttcgaggagctggggctggagaccagcgatgcgtggatagtggaccgcgtgggcatccgcacgcggcacacggtgctgccgctggactacctgcgggagacgcgcaatcgcgacgtgcgcgcggcgcaggaggcggcgctcttcagcaacgcggagacgggacgccgcgcggcgctgatggcgctggagcgcgcggggctgaagccgtccgacatcgggttggtggtggcgggcggatgcagtcccgacgagtgcattcccgccgagtccaaccgggtggcgcagttgctgaacatccatgcgccggcggtggacctgcagagcgcttgctcgtccttctgcatgcagctgcacttcctggcgggcatgcggccggagcggctgccggactacgtgctggtggtcaacatggacaactccacgcgtgtagtggactacacggaccgctccagcgcggtgctgtggggagacggcgcgtccgcggccatcctgtcgccgcgcgtgccgggacgctggcagctcacggagacgctgctggccggagacccctcgggcgcggacaaggtgcgcgtgccgcgcatggggcacttcacccagaacggcggcgaggtgcagaagttcgccatccgccgcgcgggggagacgttccaggccctgcgcacgcgcttcatggagcgtcacccggacaagggcgcgggggccgtctccttcatcgggcaccaggccaacctgcgcatgctggaggccgtgcagcggcggtgtgaggtgccggacgcgcggcacttcttcaacgtgcacacccgggggaacaccggcgccgcgggcgcgcccggcgtcctgagcgagcactgggacgaccccgccgtgggagacgcggtggtgctgagcgtcgtgggcagcggcctgacgtgggccggcgccttgctggagcgc

SEQ ID NO: 42851 - DNA, 726 bp, Myxococcus xanthus
atggatttcggactgaagggtagacgcgcgctggtgatgggcgcgtccgcggggctgggttacgccatcgcggaggcgttggtgaaggaaggcgccacggtggccatctgctcgcgcggtggcgagaagctggagcgcgcggcgaaggcgctgggcgcggcgctcgcggtcccgtgcgatttgacgcagccccaagccgcgaaggcgctggtggagactgtcaccgcgaagctgggcggcgttgatgtcctcgtggtgaacacgggcgggccaccgtcaggtggcttcgaatccctgacggcagagcagtggcagctcggcttccagagcctgtggatggcctcggtggatggcatccacccggtgctcccggggataaaggagcgccagtggggccgcatcgtcctggtgacgtcgctggcggcgcgcgaggcgatgaacaacctgaccatctccaacggcctgcgcgcgggcctgctcgggttggtgaagacggtgagcaacgaggtggcgcagcacggcgtcacgctgaacgcggtgctgccgggctaccacgccaccgagcgcatgcagcagctcgggctgacggacgagaaggtggcgccgcagattcccgcgcggcggctgggccgcccggaggagctggccgcgctcacggcgttcctcgcctccgagcaggcgtcctacatcaccgggcagtccatcgcggtggacggcggcgcgcag

SEQ ID NO: 42852 - DNA, 1590 bp, Myxococcus xanthus
ttccctggtgtcatcggccggacggatgaggagtcctcgcctgcctggcccgcgccgctgcgcgcgaagccgggggcacccaacgtcctcttcatcgtcctggacgacacgggcttcggtcagctcggttgctatggctcgcccatccgcacgcccaacctggaccggttggcgaagggcgggctgctctacaacaacatgcacaccaccgcgctctgctcgcccacgcgctcgtgcatcctcaccggccgcaaccaccactccaatggcatggcggccatcaccgaaatctccgtgggctaccccggccgcaacggcaccatccccttcgagaatggcttcctctccgagatgctggccgggcacggctacaacacctactgcgtgggcaagtggcacctcacacccgcggagcagacgagcgccgcggggccctactcacgctggcccctgggccgcggcttcgagcggtattacggcttcctcgggggcgacacgcaccagtactaccccgacctcgttcacgacaatcatcaggtccggccgccgaagacgcccgaggagggctatcacctgacggaggacctggtggaccgggccatcggcttcatcgccgacgccaagcaggtggcgcccgacaagcccttcttcctctacttctgcaccggcgccatgcatgcgccccaccatgtcccccgggaatgggcggaccgctacaagggccagttcgacgacggttgggatgcctaccgcgagaaggtcttccggcgtcagctcgagacaggcgtgctgccgccgggcacccggttgtcgcggcatgacccggacgtgcaggactgggacagcctgtctccggaggaacggcggctctacgcgcggatgatggaggtgttcgcgggcttcctggagcacacggaccaccacatcggccggctcatccagtcactggaggcgagcggggagttggagaacacgctcatcatggtcatctccgacaatggcgccagtccggagggcggcctgcatggctccgtcaatgagctgaagttcttcaacaacgcgccggagtcgctggagcagaacctggcggcgctggacgagctgggcggaccgcgccacttcaaccactatccctggggctgggcctgggcgggcaatacgcccttcaaacggtggaagcgcgagacgtaccggggaggtaccacggaccccttcatcgtccactggccccgaggcatccaggcgcggggcgagattcgctcgcagtactgccacgccatcgacatggtgcccacggtgctggactgcctgggcatcgatccgcccacggagcttcgcggcgtcacacagtcacccatcgaaggcgtcagcttcaagtactccttccaagacgcggacgcggagagccggcaccacacgcagtacttcgagatgttcagccaccgggccctgtaccacgacggatggcgggcggtgtgcccgttccccggaccgtccttcacggagtcgcacgagccgttcggcatgctgaagctcaccgaggccagactgcgcgagttcgatacggagggctgggagctgtaccacgtg

SEQ ID NO: 42853 - DNA, 375 bp, Myxococcus xanthus
aacatccccggcgacctgaagtacacccgtgagcacgagtgggcccgcgtccagggcacctcggtggtggtgggcgtcacgcagcacgcgcaggagtccctgggcgacgtggtctacgtggagctgcccaaggtgggctccacggtgacggagggcaagcagttcggcgtcatcgagtccaccaaggcggtgtcggagctgtactcgccgctgacgggcaaggtggtgaaggtgaacgacgggctgtcggacaacccctccaccgtgaacaccgacccctacggtgcgggctggattgtggaaatcgagccctcggaccccaagcaggtggacggactcatggacgccgccgcgtacaccgccctgctccagaac

SEQ ID NO: 42854 - DNA, 1017 bp, Myxococcus xanthus
ctggcccgagcggcccgcaacatcgccctggcgcacgcgccgcagaagccgcaatgggtggaggtcgaaaccgagcccggtgtgctcgtgggccggcggccggatccgctgggccgcgtgggggtgtatgcaccgggaggccgcgcggtgtaccccagcagcgtactgatgggggtggtgcccgcgaaggtagcgggcgtgggcgaggtcatcgtgtgctcgccgccggggcccgatggattgccacaccccagcgtgctggcggcggcatctctggcgggcgcggaccgagtcttctcgctgggcggcgctggcgcggtggcggccatggcccatggcacggaaagcgtgccgcgcgtggaccgcatcgtggggccgggcaatgcctatgtggccgaggccaagctgcaggtggtgggcgcggtggcgattgaagcacccgcgggccccagtgaaatcctggtcgtggccgacgacacggcgaaccctgccgcggtggcgcgggagatgctggctcaggcggagcatgacccagaggcggcttgtgtcacgctggcgctgggggacgcgctggcggacgccatcgccgcggaggtggagcggcaggccgagcgcgcgaagcggtgggagatcgtcacgtcggccctgggctctcgcggcgcggtgctgacggtggcgtccctggaggaagcctggcccttcgtggcggactttgctccggagcatctgctcatcgccaccgcgtcgccgcgggaggacctggggcaggtgcgcaacgcgggcaccgtcttcctgggtgagcgctcgtcggtggcctacggcgattacatgaccggctccaaccacgtgttgcccacggcggggttggcgcgggcgtactcgggactcaacctgctcgacttctaccggtggaccacctaccagcgcgtcgcgcccacggcggcggcgtctcttgcggaggacgtggggcggctggccgacagtgaaggtctcttcgcgcacgcggacgccgcgcgc

SEQ ID NO: 42855 - DNA, 987 bp, Myxococcus xanthus
gccatgattcccaggcgggcttcgtatcgggacattccgctgtacgcgccttcgacgcggccgtgccgggtggacctgagtgacaacaccaacctctttggcgttccgccctccgtggagcgggttcttgccaccaccgtgtcccgcgtaccgcgttatccgcggggttatgccccggacctgcgccgggcgctggctgcgtccattggagcggcgcccgacgagataacgacgggctgtggctcggatgatgtcatcgactcggcgctgcgcgccttcttggagcccggggacacgctggcctatcaggacccgaccttcgtcatggtgccgttgttcgccaaggtgaacggactcgagggcgtgccggtgccgttgaagccggacttcgatgtggatgcggacgcactgctcggcacgggggcgaaggtcatcttcctgtgctcgcccaacaaccccacaggcaccgcgctgtcgcgggcggcggtggagcgtgttgtcgaggacgcacctggcatcgtcatcatcgatgaggcctatgcggacttcgcgccggggaaggacttcctcgacctggcgcgacggcggtcgaatgtcctggtgacgcgcaccttctccaaggccttcgggctggcggggctgagagtcgggtggggcgtcggagcgcccgaactggtggcggagctcgagaaggctcgcggaccctacaagctcaccagtgtcgcggaggccgtggccgtctcggtgctgaagggtgacgcggactgggtgcgagcccgtgcggaggaagccgtcgcctgtcgcgagcggctgcgcggcgagttggtgtcgttgggtctgacgcctctgccatcggaagccaacttcctgatggtgccgctgccgggcgcgttggcggtcgcggagcggatgcgagagcgggacgtgaatgtgcgggcgttccaggcgctgacgggcgtgggcgacgcgctccgaatcggtgtgggg

SEQ ID NO: 42856 - DNA, 525 bp, Myxococcus xanthus
cgcgggatgaccactgtcattcgggagacgaaggagacgcaggtccgggtggagctggcgccgggcaagggcgtcacgaacgtggacacggggttgaagttcttcgaccacatgctggccaccttcgcgcgctacgcggggctggacctctcgctgcatgcgcggggggacctcacgcaccatgtgatggaggacgtggccatcacgctgggcacggcggtgcagcaggtgattccagccacggccgcgcgtttcgccgagcgcaccattcccatggacgacgcgctggtgcaggcctgtctggatgcaggggggcgcttttattaccagggcccgttgaagaaccggctctacgagcactggatgcgctcgttcagcgagcacgcccgggtgacgttgcacctgcgggtgctgcgcggaaaggacagccaccacgcgacagaggcgtccttcaaggcgctggggctggcgctgcgggatgccatggtggactccggctcggtgttcagcatgaagggctccgtg

SEQ ID NO: 42857 - DNA, 1740 bp, Myxococcus xanthus
gatgccgcgaagccgcagcggcgccaggcgccaccaccggggctcgcggaagccagccggtgtctcaatgaggaagcacgcgcgggtttgctggagcgcgcctgggaacgggacctggaggtgtcccggctcgcggaggccgtcacctcgcgcacccgtgccagcgtgctcctggtaggcccgtcgtccgtgggcaagacggccctggttcatgaactcgtgcaacgcgcggaggcggccaccacgggttcgccgcttcacgggttggaggtcttcagctcctccggaggccgcatcatggcgggcatgcgctacctggggcagtggcaggagcgcgtgaagcacatggtggaggccctgcgtgttcgccaggccgtgctgcacctcgacagcctgtcggagctgctgtccctgggtagcggcgacacggggctggatgtggcgcgtcagttgctccccgcattggaaagtggcgaggtctcactcgtcctggaggcaacaccggaggacgtggcccgcgcggagcggacccacgcagcgttcctgcaatcgctccggcacatcgccgtggcgcccctttcggcccaggccgcacgcaacgcgcttcagcaggcctcgcatcgggtgggccgcgctcgcaaggtgcgcttcacgcccgacgcgctggaccgcgctggcgaactcacggagcgcttcggctcgggcccttcgcccggaggcgcggtgtccctgctgcgcgccgccagcacggagcccggcgcggccggagaagtgaacgccgcttcggtgacgcgcgccttctgcactcggacggggtacccgctcgaactggtggactccgccatccggttggacccggatgccctgctccgccgcttccgcgagcgcgtggtgggccaggacgaggccaccctcctcctgcgcaatctggtcgtcacgctgaaaacaggcctggcggacccctcgcgtccgctgggcgccttcctgctgctgggtcccaccggcgtgggcaagacggagtcggcgctcgcgctggcggagtacctgtttggcgacgtggcccggctggcgcgcttcgacatggcggagtacgccgcgccaggcagcgccacccggctggtgggagaagcgggaggccaacaaggcagcctggcgcggcgcgtccgcgagcagcccttcggcgtggtgctgctggacgaaatcgagaaagcggacgcgggcgtccatgacctgctgttgcaggtgctcggcgaaggccggctcacggatgccaccggccgcaccgtcagcttccgcaacaccgtggtgctgctcaccagcaacctgggcgcggacagcgcggggcgctcgctgggtttcggggagcgcggccccctggagcgggcggcgcactacctgggggccgcggcggccttcttccggccggagttgctgaaccggttggaccgggtggtgccctaccgcgcgctcacggaggacgtcattcaatcactcgcccggcgcacgttggaggcggccctctctcgcgaggggctcagtcgccggggcgtgaaggtgaccttcgacgaggacgtggtgaagcacctggcgcgcaccggcttcgacgcacgctatggggccaggcctctcaagcgcgccgtggagcaacaggtggtcgcgcccctggcgcggtggttggcggctcaggccaccagcgctccgccccaggtggtgctccgcgtggaagctgaggggcggatt

SEQ ID NO: 42858 - DNA, 1338 bp, Myxococcus xanthus
cagaagctgctcatcgccaaccggggagagattgcccgccgcatcggcgtggtggcccggggcatggggctcaagacggtcgccgtctattcggacgcggacgctgagctgcccttcgtgaaggaggccgacgaggcggtgcgcatcggccccgcgccggccaaggacagctacctcaataccgccgccatcctggaagccgcgaagcagacgggtgcgcaggccatccacccgggctacggcttcctgtcggagaacggcgagttcgcccaggcctgcgcggacgcggggctcatcttcgtgggaccgccgccggaggccatggcgcggatgaaggacaagagccaggcccgaaagttggtgtccgccgcgggggtccccgtggtgcccggcagcgagggcgtggtgcccgacgtggccagcgcgctggcggaggccgagcgcatcggctacccggtgctcgtcaaggcggccagcggcggcggcggcattggcatggcggtggccaggaacgccgcggagatggagaaggtctaccgccagtgcacggaccgggcgaaggccgccttcggcaaggaaggcgtgtacgtggagcgctacttcccggcgccccggcacatcgaggtccagattctgggggaccagcacggccacctcatccactgtctggagcgggaatgttccatccagcggcgccaccagaaggtggtggaggaagccccctccgtgctgttcgcggacgggcgcaacccggagctggcgcagaagctcttcacggccgcggtggccgcggcgaaggcctttggttacgccaacgccggcacggtggagttcctctactcggacggtgaggtctacttcatcgagatgaacgcccgcctccaggtggagcacccggtgacggagctgaccacggggctggacctcatcggctggcagctgcgcatcgccgcgggcgagcgcctcacggtgaagcaggaggacgtgaagcggcgcggggcggcgctggagttccgcatctacgccgaggacccggtgaagttcttcccgtctcccgggccgctgaaggtgttccagccgcccacgggcgagggcgtccggctggacgcgggctacggcgagggcaacaccgtcacgccgaactacgacccgatgattgccaagctcatcgtcaccggtgagacgcgggcgcaggcgattgagcgctccgtgacggcgctccagtcgttccgcatcgaaggcatcaagacgaacatcccgctccacctgcgcatcgtgcaggatgcggccttccaggccggcgagctggacacgaacttcctggagcaccacgccaag

SEQ ID NO: 42859 - DNA, 795 bp, Myxococcus xanthus
ggcctggagaagcagtgggcggaggtcggcatcgccgagcgcctgctgctggtggacctgtcctccgacttccggctggaccacccgggccgctacgcgggcgcgtacggccggccccacccgtccccggagctgctgggcaccttcacctacggcctcaccgagtggaagcgcgacgcggtgaagacggcgaagcgcatcgccaacccgggctgcttcgccacggcggtgcagttggcgctcctgcccatcgcctccacgccgggcttggggctgctcgcggtgtccggcgtcacgggctcgtccggctccggctcgctgcccggtgagggcacgcaccacccgacgcgtgcgcaagacttccgcgcgtacaagccgctggagcaccagcacgaggccgaggtggaggtcatgctggtcgcccacggcgcgcagcggcaccggttggccttcgtcccgcactcggcgcccatggtgcgcggcatcttcgccaccgtgcagttcgagtggccggagcacggcggcgcggtggtgacggcgtcgctgatggagaagtaccgccgctactacgagggctcgaagttcgtgcgcatcgtcgagggtacgccgcgcatcgctgcggtggccggcagcaacttctgcgacatcgcggtggccaccaagggccgctcggtggccgtcatggcggcgctcgacaacctggtgaagggcatggccggccaggcggtgcagaacttcaacgtcgcgctggggctgccggaagacacggcgctgcgccaggccgcctgctacccg

SEQ ID NO: 42860 - DNA, 738 bp, Myxococcus xanthus
ttcaaggacaaggtcgtgctcgtgacgggtggctcgcgcggcatcggccgggcgtgcgcggtggccttcgccaaggcgggggcctccaccgtggtcatcagctatgcgggcaacgaggcggcggcccaggagacggtggccctgctccaggcggagggcgccaaggcggaggccatccgcttcgacgtgtccgacagcgccgcctgcgccagcgccgtggacggcatcgtcaagggccacggccggctggacgtgctcgtcaacaacgcgggcgtcgcggtggacggcctggtgatgcgggtgaaggacgaggactgggacaagcagttggacaccaacctcaagggcgccttctcgctcatccgcgccgtcagccggcccatgatgaagcagaagggcggcgccatcatcaacatcacctccgtggtgggggagatgggcaacggcggtcaggcggcctactcggcgtccaaggcggggctcatcggcctgaccaagtccgtggcgcgcgagctgtccagccggaacatccgcgtcaacgccgtgtcccccggcttcatcgggacggacatgacgcatcagatcaatgacgagatgcgccagaagatgctggagggcatccccctgggtcggttgggcaatccggaggaggtcgccggcgccgtgctcttcctggcgggggacgccgcgtcctacatcaccggcgaggtcctgaaggtcaacggcggaatgtacatg

SEQ ID NO: 42861 - DNA, 918 bp, Myxococcus xanthus
atgtcgaaggtcgcgttcgtgttccccgggcaaggcagccaggccgtggggatgggcaaggacctgtatgagaagttccccgaggcccgggccgtgttcgacgcggttgatgccgccctgggggagaagctctccaccctctgtttcgagggcccggacgaggcgctgaagctcacggccaacacccagccggccatcctcacggtgtcgctggcggcgcacgcggtgttcgcgaagcggggaccggcgccgtccttcgtggcggggcactcgctgggcgagtactcggcgctggtggcggcgggcgccatggacctgggcgacgcggtccgggtggtgcgcgcgcgcggcaccttcatgcaggaggcggtgcccgcgggcgtgggcgccatggccgcggtgctgggcctggttccggagaaggtgaaggcaccctgtgacgcggcggccgaggggcaggtggtgtcgccggcgaactacaactcgcccgagcagacggtcatcgccggtgacgcggcggccgtggagcgcgccggggtgaagtgcaaggaggccggcgccaagcgcgtgatgcccctgccggtatccgcccccttccactgcgcgctgatggcgccggtgcagccccggctggcggaggtgctgggcggcatccaggtgtccgcgccgtccgtgccggtggtgaccaacgtggaggcccgtcccaacgcggacgcgtcgcgggtggtgccgctgctcctggagcaggtgagctcgccggtgcgctggattgagtgcgtggaggcgctgaaggccgaaggcgtcacccgcatcatcgagctggggccgggcaaggtgctggtgggcctggtcaagcgcatcaccaaggacatcgagctgttcaacgtcgaggactccgcgagcctggacaaggcgctc

SEQ ID NO: 42862 - DNA, 1331 bp, Myxococcus xanthus
ccgagcgccgcgcctctcgttgacagcgcgacctttccccctggacgtgcttcatggatttccgagctcaactcgactcgccgctcttcacccacttcatctcccattacgcgcagccgacgggacctgacctgctgggtcggacggaacccttcttcgagtggcaggagtcgcggcggcaggcgggcctgtggccgtactcgcgaagcctggaggcggcaccgaaggcggagtgtggtgtccgcagtgagacgggggcggtgcgccaggggctgaacttcggttcgcaggattacttgtcgctgtccacgcacccggcggtggtggaggcggcccagcgggccatccaggactacgggttgcacagcgcgggctcggcgatgctggggggcaatacgacgccgtcgctgatgctggagaaggcgctcgcggagcacctgcagacgccgcacgtggcgttgttctccaccggctggggcgcgggcttcggcgtcatcgctgggctggtgcgtcccgatgaccacgtggtgctcgacgcgctgtcgcacgcgtgcctccagcagggcgccgccgccgcgacgacgaacgtgagccgcgtgccgcacctcaacaaccgcgccatgcggcgcaagcttcaggagattcgcgcccgcgacacgcagaacgcggtgctcgtcgtcaccgagggcctgttctccatggactcggacgtgccgcggatcgaagagctccagtccatctgccgtgagtacggcgcgacgctgctggtggacgtggcccatgacctgggcgcgatggggccccgggggacgggcagcctgggcgtgcagggcctgctggggaaggtggacctggtggtgggcgccttctccaagacgttcgcgagcaatggcggcttcgtggccacgcgctcgccggcggtgcgccagttcatccgcatcatgggcgggccccacatcttctccaacgcgctgctgcccatgcaggcggcggtggtgctggagtcgctgcgcatcgtccgctcggaagagggcgacgcgctgcgcgcgaaggcgcgggagaacatcctggcgctgcgcggagccttcgaggcgcggggcgtgacgtgcctgggcgagccgtccaacgtcgtccccgtgcaggtgggcgacgcgaaggtggcgcggctggcctcgaagaaggtgttcgaccgcgacatcttcgccaacctggtggagtacccggccgttcgcttgcgcgagacgcgcttccgcatgcaggtgatggcgtcccacacgctggagcaggtccagcgggccgccgacggggtgtgcgacgccatcgaggaggcc

SEQ ID NO: 42863 - DNA, 1941 bp, Myxococcus xanthus
atggcggcttcgaagcatgagattcactcggtcctgacagaagcacgcgtctttccgccgccagaggcgttcgcccggcgcgcgcacatccggagcatggagcagtaccagcagctctgggacgaagccgcgaaggaccctgacaagtattggggcgaccgcgcccgcgaggagctgtactggaaggcgcccttccagacggtgctcgactggaagccgccgcacgcgcggtggttcgtcgagggcaagacgaacctagcctacaactgtctggaccggcacctggccacccgcaaggacaagcccgccatcctcttcgagggggagcccggcgaccgccgcagcctcacgtacggcgagctgtccaccgaggtgaacaagctggccaacgcgctcaagtcgctgggcgttcggaagggtgaccgggtgggaatctacctgcccatggtgcccgaggccgcggtggccatgctggcgtgcgctcgcattggcgcggtgcactcggtggtgttcggcggcttctccgcggaggcgctccacgagcgcatgaacgacgcgggcgcgaaggtgctgctcaccgcggacggcggttggcgcaagggcgcggtggtgccgctcctgaagaacgtggaggcggcgctgccgcacatgcccaccatggagaaggtggtggtgctccgccgcacgggcagcacgctggcgctgtccgggcccaagctggtggcgtgggacacgctggtgagcgggcagtccgcggaatgtgaaccggagtgggtggagagcgagcacccgctgttcatcctctacacgtcgggctccactggaaagcccaagggcgtgctgcacaccacgggcggctacgcggtgaatacgtcgctcaccacgcgctgggtgttcgacctgcgcgaagacgacgtctactggtgcaccgccgacgtgggctgggtgacgggccactcctacgtcgtctacggcccgttgatgaacggcgtcaccaccatcctctacgaaggcgcgcccacccagccggggccggaccgcttctgggacatcatcgagcggtacaaggccaccatcctctacaccgcgcccaccgccatccgcgccttcatgcggctgggcgaggagcccgtgcgcaagcacgacttgtcctcgctgcgtctgttgggcagcgtgggcgagcccatcaaccccgaggcgtggatgtggtaccgcgacgtcatcggcggggggcgctgccccgtggtggacacgtggtggcagacagagacgggctgcatcatggtgtcgccgctcccgggcgccacgccgacgaagcccggctcggccacgctgccgctgcccggcatccacgcggagattctggaccgcgagggcaacacggttccgcgagggcagggcggactgctcttcgtcacgcgtccctggccctccatgttgcgcacggtgtacggcgacccggaccgctacgtgcgcacgtacttcaacgagctgcccggcatgtacttcaccggcgacggcgcgcgcacggatgcggaggggtacatctggctgatgggccgcgtggatgacgtggtcaacgtcgccggccaccgtctgggcaccgcggaggtggagagcgcgctggtggcgcatgaaaccgtcgcggaggccgccgtggtgggccgtccggacgacttgaagggcaccgcgctggtggccttcgtcaccctgaagcagggccacacgccgtccgacgcgctgaagaagacgctggccgcccacgtgggccgcgagattggcgccatcgcccgcccggatgaaatccgcttcgcggaggcgctgccgaagacgcgctcggggaagatcatgcgccggctgctgcgcgacgtggccgcgggcaatcaggcctccggggacaccaccaccctggaggacctcaacgtcctggccgcgctgagg

SEQ ID NO: 42864 - DNA, 1131 bp, Myxococcus xanthus
tgggcccgggaggacctggaggccctgtccgagcgcggcctgcgccgctacctggagcccctggactctccccaggggcccgtggtgcgcgtggggggcgagacgctcgtcaacttctcgtccaatgactacctggggctggccgcgtcacccaccgtgcgtgccgcggcgctggccgccgtggagcgctacggcgtgggcaccggtgccagccggttggtggtgggcgacaccgccgcgcatcaccggttggaaacgcggctggccgccttcgagcgcgcggaggccgtgcgcctgttcaacagcggctacgccgccaacaccggcatcatccccgcgctggtggggtcggaggacgccgtcttctccgatgccctcaaccacgcctcgctcgtggatggctgccggctgtcacgcgcccgcgtctgcgtctatccgcacgcggacgtggaggcgctcacgcgcgccctggcggagacgcccgcgcgccgcaagctggtggtgacggacaccgtcttctccatggacggagacgtggccccgctgcgcgacatcgtcgccgcgtgccgggcccacggcgccgcgctgatggtggacgaagcgcatgccaccggcgtgctaggcgcacgtggagcgggcctctgcgatgagctggggttggaaagcgaggtggacctgcgcatgggcacgctgagcaaggcgctgggcgtcatgggcgcgtacgtggcgacctcacgcgaggtggcggacctgctggtatcccgcgcgcggcccttcgtcttctccaccgcgctgcccgcgcacctgtgcgccgccgccgaggccgccgtggacgccgtggagggcgacccggacctgcgcgagcggctgtggcgcaacatccgtcgcttcgcggacggcctgcgcggcttgggcgtgcgcgccgagcctcgcagcgccgtgttccccctcatcctcggcgagcccgagcgggcgctggacgccgcgcgccgtctgcgcgaggcgggcgtgctggtgaaggccatccgtccgcccaccgtttacgagggcaccaaccgcctggggttttgcctgtccgcttcccactccgtgggccacgtggacctggcgctggaggctttgcgcagcgtg

SEQ ID NO: 42865 - DNA, 1743 bp, Myxococcus xanthus
cgtcccatccagaaggtcctctgcgccaaccgcggtgagattgccattcgcgtcttccgcgcgtgcaacgagttgggcatccgcaccgtcgccatctacagcgacgaggaccgcacccacgagcaccgccacaaggccgacgaggcgtacctcgtgggccggggcaagcggcccgtggaggcctacctgggcatcgacgaaatcctcgacgtggccgtgaaggcgggcgtggacgccatccaccccggctacggcttcctgtcggagaacgccgccttcgcggaggcgtgtgagcggcgtggcatccgcttcatcggcccgcgctcggacgtggtccgcaccatgggcgacaaggtcgccgccaagcacctggccgacgcgtgcggcgtcccggtggttcccggcatcaccctggagggcgacgacgcgcacgtgctggagcaggcccgtgccttcttcgcgaagcagggtggccccatcctggtgaaggcggcccatggcggcggcggccgaggcatgcgcgtggtgcgcgaggcgaaggcgctggaggatgcgctggcctccgcgcgttcggaggcgaagagcgccttcggttcgtcgtcggtgttcctggagcgcttcctggagcacgtgcgccacatcgaggtacagctactgggagatttgcacggcaacatcgtccacctgcacgaacgggactgctccgtgcagcggcgccatcagaaggtcattgagattgcccccgcgcccaatctggccccggcggtgaaggaggccatctgcgacgcggcggtgcggctggcgcgcaaggccggctacaccagcgctggcaccgccgagttcctggtggcgggtgacgccttctacttcatcgagtgcaatgcccgcctccaggtggagcacaccgtcaccgagcaggtgacgggcgtggacctggtgcagagccagcttcgcatcgcggagggcttccggctggacgcgccggaggtgggcatctcccggcaggaggacgtggtgccccggggctacgcggtgcaactgcgcgtcaccaccgaggaccctgccaaccagttcatgcccgacgcgggcgtcatcaccgcctggcgcgcggccacgggcttcggcatccggctggacggctccaacggctacaccaacgccgtcatctccccctactacgactccatgctggtgaaggtcatcgcctacgcgcccacgttccagggcgcggtgatgaagggccagcgcgcgctgcgcgagttccgcatccgcggcgtgaagacgaacctgcccttcctggagaacgtgctcgcccaccccgccttccagcagggagagacgtacacgcgcttcatcgacgagacgccggtgctgttccagttggagccccgcagggacagggccaccaagctgctccagtacctgggcgacgtcatcgtcaacgggcaccccaccatcaagaaggaccagcggctcaagcccacgcagttcctggagccgcggctgccgaagacgccttctggcccggtgcctcggggcaccgcgcacatcctggcggagaagggcccgcgcggactggcggactgtgtgctggcccagaaacgcgtgctgctgacggacaccaccatgcgggacgcgcaccagtccctgctggccacgcgcatgcgcacgcgagacatccctcgcgtggccccggccaccgcccacctggccctcgagctgttcagcctgaagagctggggc

SEQ ID NO: 42866 - DNA, 1521 bp, Myxococcus xanthus
atggaaatccgcgccgacgagatcagcagaatcatccgggagcagatcaaggactacgggaagaaggtcaccgtcgctgagacgggtaccgtgctgtccgtcggtgacggtatcgcgcgcatctacggcctcgagggcgcgctcgccggtgagctcgtggagttcgccaacggcgtgcagggcctcgtcctcaacctggaagaggacaacgtcggcgtcgccatcatgggtgacttccaggccatccgcgagggtgacacggtcaagcgcacccagcagattgcctccgtgccggtgggcaaggagctgctcggccgcgtggtggacccgctcggcaagccgctggacggcaagggccccatcgccgccaccgagacgcgccgcctggaagtgaaggcgcccggcatcgtgtcccgcaagagcgtgcacgagcccctgcagacgggcatcaaggcgctggacgcgctggtgccggtgggtcgtggtcagcgcgagctcatcatcggtgaccgtcagacgggcaagacggccgtcgccatcgacaccatcatcaaccagaagggcctgaacgtttactgcatctacgtggccatcggccagaagcagtcgacggtggcccaggtggtggagaagctgaaccgctacggcgccatggagtacaccacggtggtggcgtccaacgcctccgacccggcccccatgcagttcttcgcgccgtacgccggcgtggccatgggcgagtacttccgcgacaacaagatgcacgcgctcatcgtgtacgacgacctgtccaagcaggccgtggcgtaccgccagctgtcgctgctgctccgccgtccgccgggacgcgaggcctaccccggcgacgtgttctacgtgcacagccgcctgctggagcgcgccgccaagctgtccgacgaggagggcgccggttcgctcaccgcgctccccatcatcgagacgcaggccggtgacgtgtcggcgtacatcccgacgaacgtcatctccatcaccgacgggcagatcttcctcgagacggacctcttcttcgccggcgtccgcccggccatcaacgtgggcctctccgtgtcccgcgtcggttcggccgcgcagatcaaggccatgaagcaggtcgccggcaccatgaagctggagctcgcgcagtaccgcgagctggccgccttcgcccagttcggctccgacctcgacaaggccacccaggagacgctggcgcgcggcgcccgcatggtggagctgctcaagcagggccagtacgagcccatgcccgtcgagaagcaggtcatgcagatctacgccgccaccaaccgcgacgaccccaagaagcgcggctggattcgcgacatcccgacggccgacgtggtgcgctggatgcgtgagttcctggagttcgccgacggcaagcacccgaacgtcgccaaggacctggcgtcgaagcgtgagctgaccgccgacatcaagacggcgctgagcaaggccatcaccgagttcaacgaggtcttc

SEQ ID NO: 42867 - DNA, 1377 bp, Myxococcus xanthus
atgaatgtcctcttcatctcctcggaggtggccccgttctccaagacggggggcctgggggacgtggccggggccctccccgccgcgcttgcctcgctgggccatgacgtcaaggtcatcaccccgcgctaccgcgacctgcgaggcgcggagcggctggagcccacaggccagtccctgctactgcgcttccccttcggcgagctgtcgggccccatcctctccgcccgcgtgtcggagcggctggaggtgctcttcctggagaacgcgttcctcttcggcaaccgccacggcctctacggagacgcggggggcgccttcgccgacaatcaccggcgcttcgcctatctcagcgtgggcgcgctccaggcggcgcagcggctgcgcttcatcccggacatcatccacgccaacgactggcagacggggctggtgccggtggcgctgcggcgcggcttccagacggggccgctggcgcacgcgaagagcgtcttcaccatccacaacctggcctaccaggggcagttccccaaggacgtgatgggggacctggcgctgccctgggacttgttcaccgcccatgacgggctggagttccacgacacggtgaacttcctgaaggcggggctcgtcttctccgacgcgctcaccaccgtgtcccccacctacgcacgggaaatccagacgccggagcagggctacgggctggacggcctgctgcgccaccgcgcgcaccggctccacggcatcctcaacggcgtggacacgcacgagtggaacccggaggacgacgccttcctcccggcccgctacggactgaaggacctgtccggcaaggccgtgtgcaagcgcgagctactggcccgcttcgggctggaggacggccccgcgccggtgttcggcttcgtcagccggctggcgtggcagaagggcatggacctgctgctggaggccctgccggccgcgctccacgcggacatccgcgtcgtcggcgtgggcagtggcgaagggcctctggaggaagggctgctcgcgttgcagtcccgttacccgaagcaggtgggcgtgcacatcggcttcgaccccgggctctcccacctggtggaggcgggggcggacttcttcctcatgcccagtcgctacgagccgtgcggcctgaaccagatgtattcgctgcgctacggcacggtgcccatcgtccgggccaccggcgggttggtggacacggtggagggagggctggacggaaacggcatcctcttcgaggccttccacaagtccgccctgctggcggccatccgccgcgccctggccctctatgcggacccgtcgcgcctggatgagttccgccgccggggcatggagaaggacttctcc

SEQ ID NO: 42868 - DNA, 837 bp, Myxococcus xanthus
atgggcatcaagaagtacaagccgactagcgccgcccgccgtctgatgacggtgtccgacttcgcggacatcaccaaggactcgcccgagaagagcctcaccgagccgctcaagcgctccggtggtcgcaacgtccacgggcacatcacccgccggcaccagggcggcggccacaagcgccgctaccgcgtcatcgacttcaagcgccgggacaaggatggcgtccccgcgaaggtcgtggccgtcgagtacgaccccaaccgcaccgccaacatcgccctgctgcactacgcggacggcgagaagcgctacatcctcgctccggtgggtctgagcgtgggtgacacggtgttcgccggcgaaggcgcggacatccggcctggcaacagcctgccgctgcagaacatcccggtgggtacggtcatccacaacgtggagctgaagccgggccgtggcgcccaggtcatccgctccgccggcacgtccggacagctgatggcgaaggaggaccgttacgcgcaggtgcgtatgccctccggcaccgtccgcaaggtcctcatcgagtgccgcgccaccgtgggccaggtcggcaacatcgagcatgaaatcatccgtatcggcaaggcgggtaagagccgctggctgggcattcgccccaccgtccgcggtctggcgatgaacccggtcgaccacccgcacggcggtggtgaaggcaagtccggtcagggtaacccgcaccctgtgtccccctggggcaagaagaccaagggtctcaccacgcgcaccaacaagcgcactgacaagttcatcgtgtccggccgccgccagggcgcgcgc

SEQ ID NO: 42869 - DNA, 1326 bp, Myxococcus xanthus
gcactctcccccctgtgaaatctccgccccatggccaaggacacgctgacgatcaccgacaatcggaccgggaagacctacgaggtcccgatcgagaacggctgtattcgcaccaatgctctccgccagatcaaaacgggcgacgatgactttgggttgatgggctacgatccggcgttcctcaataccgccaactgcaagagcgccatcaccttcatcgacggagacaagggcatcctggagtaccggggctaccccatcgagcagctcgcggagaagtcgagcttcctcgaggtcgcctacctcctgctgaacggtgagcttccctccgagaaggagctgcagcagttcaaccacctcgtcacgcaccacacctacgtgcacgagaacgtgaagagcttcatggacgggttccgctacgacgcgcaccccatgtccatggtgagctccacggtggcggcgctgtccagcttctaccccgacgcgaagaacatcaaggacccgctgagccgccgcatccagatcacgcggctcatcgcgaagatgcccaccatcgccgcgttctcctaccggcacacgatgggcctgccgtacatctacccggacaacgacctgtcctacgtcgccaacttcctggcgatgatcaagcgcatcggcacgtcgacctacaaggtccacccggtgctcgagcgcgcgctcgacatcctcttcatcctgcacgcggaccacgagcagaactgctccaccacgtccgtgcgcacggtgggctcgtccgaggtggatccgtactcggcggtcagcgcgggcatcggcgccctctacggcccgctgcacggcggcgccaacgaggcggtgctccgcatgctccgcgacatcggccacgtctccaagatcccggagttcatcaagtcggtgaagagcggcgagggtgagaagaagctgatgggcttcggtcaccgcgtctacaagtcctacgatccgcgcgccaaggtcatcaagcgcgtggccgacgaggtcttcgaggtgacgggcaagaacccgctgctggagatcgccgtcgagctggagcgcatcgcgctcgaggacgagtacttcgtgaagcggaagctgtacccgaacgtcgacttctactcgggcctcatctacgaggcgatgggcttccaggtcgagatgttcccggtgctcttcgccatcccccgcacggtgggctggtgcgcgcagtgggaggagatggtgacggacaacgagcagaagattgcccgtccgcgccaggtgttcacgggcgccccgcgccgcgactacgtccccatggacaagcgcgccgtc

SEQ ID NO: 42870 - DNA, 1704 bp, Myxococcus xanthus
ggcgcctatgcgcccacctcgtggtttgaatatgcgcaacgggtgcggcgcttcgccctggggttgcacgcgctgggggtcggtgcgggccagccggtgggcatcctgagcttcaaccgcgaggagtggcacgtcgccgatctggcggccatcgccatggggggcgtccctgtcggtctctacaccaccagcgccccggagcagctggagtacatcctggggcactgcgaggccacgctcctggtggtggagaacgagaggcacctgcgcaccgccctggccctgcgcgagcggttgcccaagctgcgccacgtggtcgtcatcgacgcgcccacggtgctcccggagggcgtgctgcgttacgcggacgtcatggccctgggcaccggcgccgacgagaagccctactgggacagcgtccacgccctgaagccggaggccatgggcacgctcatctacacctccggcaccaccggccaccccaagggggtgatgctcagccaccacaacctggtgtggacggcgaagcagctcacggactcggtgacgttcggccagcccgccgcgtcctcgctcgtgtcgtatctgccgctgtcgcacatcgccgagcagatcatctccctctacagccccttgctgaacggggtgcaggtgtacttcgcggcgtcggtggacacgatgccgcagagcctgcgggaggtgcgcccctcgttctttttcggcgtgccgcgcgtgtgggagaagttcaaggcgaaggcggaggaggggctggcctcgcagccgccctcgaagcgccgggtggtggcctgggcgcgccgggtggcctcggagcggcatgagcgggtgatgcgccaccagagcgtcccgatgacgctggaggcccagtatctgctcgccaggcggctcgtgtttgccccgctgaaggagcgcatcggcatggagcgggtgtccttcttcgccacggcggcggcgcctgtcggccgggaggtgctggacttcttcgcctccatcgacatggtcatccacgaggtgtggggcatgacggaggtgacgggccccggcacggtgagcaccgagtcccacacgcggctggggtccgtgggccgggcaatgatgggggtggagctgcgcatcgcggacgacggcgagctgctggtgcgcggcggcaacgtctgcatggggtactacaagaacccggaggccaccgccgagctgctggcggacgggtggctgcactctggtgacgtgggccaactggacgcggacggctacgtccagatcaccggccgcaagaaggacatcatcgtcacctcgggcgggaagaagacgtctccctccaacatcgaggagctgctgacggccctgcccggtgtggggcatgcggtggtgctgggcgagcgccgcaacttcctggtggccttgctgaccttggacgtggagaaggcgcgggccctggccaaggcgcaggggtggccggaggacgcggctcggctcgcggaggacgcccgtctgcgccagttcctccaggagcgcgtggagcgcgacgtgaatccgaagctgtcccgcttcgagaccatcaagcgcttcgcggtgctgccgaaggacttctccgtggagggcggtgagctgacgccgaagctgagcgtgcgccgcaacgtggtggcggagaagtacgccggcctcgtggagtcgctctacgacgag

SEQ ID NO: 42871 - DNA, 603 bp, Myxococcus xanthus
cgtcacttttcgatgattcgcacgttcgtgctcgctgacttcgtgacgctgggcaacggcttcgcgggcgcgggcgccatcctctccgccatgcagtacctggcttccggggacgtgggctggctgtgggtggccttcggcctgatgccggtggcgttggtgatggacgtcatggacgggcgcatcgcgcgctggcgcttcaagaagtcgccgctgggcgcggacctggactcactggcggacgtcatctccttcggcatggcgccggcggcgctggccttcgcggtggggatgcgcggctccctggacgtggcggcgctcctctacttcgtggcgtgcggcatcagccggctggcgcgcttcaacgtcacgtcggcggacctgtcggacgagacagggaaggtgaagtacttcgagggcacccccattcccaccagcctggcgctggtgatggtgatggccgcggcgacgtgggcggggcgcatcggtccggacctgtggggtggtgagtggcgcctgggaccgttggtccttcacccgttggcgctgatgtatgtggccagcggaagtgcgatgatcagcaagacattgcgcattccgaag

SEQ ID NO: 42872 - DNA, 1213 bp, Myxococcus xanthus
gtgctctccgggtccaaccacctgcaccacccacgctacgtgggccaccaggtgacggcccccgtgccgctggccgccctgtgcgacgcggtgtcttccctgctcaacaacggcatggccgtgtacgagatgggccccgtctccaccgccatggagcgcaacgtcctgcgctggatggccgcgcggctcggcctgcccgaaacaaccgacggcgtgctcacctccggcggttccctgggcaacctgaccgccctgctcgccgcgcggcaggccaaggccggctacgacgcgtggaacggcggcgcccacgccgggccccgcccctcaccgtgctgaccgcccagacgacgcactacagcctcgcccgcgccacccgcgtcatgggctttggcgaaggcggcgtgacgcccgtcccggtggacgaacacttccgcctgcgccccgaggcactcgacgccgcgctcgagtccgccacgcgcgctgggcgcaagcccatcgccgtggtggccaacgccggctccaccgccaccggcgccttcgacccactggaacccgtggccgacttctgcgagcgccatgacctgtggttccacgtcgacggcgcacacggcgcctccgccgtcctcagccccgcccaccggcacctcgtgcgcggcatcgaccgggcggactccgtggtgtgggacgcccacaaggggctgctgatgcccgcgctggtaacggccgtcctcttccgcgacggcgcccgctccttcgagtccttctcacaggaggccagctacatcttccacggcgacgcggagcgcccctggagcgacgtggccctgcgcaccctggagtgcaccaaggagatgatggccctcaaggtgtacgcctgcctcgccgtgctgggcacccggctcttctccgacgcggtgacggagtcctacgagcaggcccaccgcttcgcccagcgcctctcagccgccagcgacttcgaggtggccgtgccgcccgagtgcaacatcctctgctcgcgccacacgcccgcgcacgtccccggcgagcagtgggacaccctccacacgaagctgagcgagcgactggggactcgcggagatttctacctggtgcatgacaaagctgcacccgtgacgtctatctccgtgtcaccctcatcaacccgctcaccaccgacgcggacctggacgccctcatggacgcgctccgggcc

SEQ ID NO: 42873 - DNA, 1864 bp, Myxococcus xanthus
gagaaggaagacaccgcgcccgaaacgccagagcagcgggagcaacgccgcaaccggcggcgcctcaccctggtggagctccgggccgtggcgcgcaacctgagccacggtgcgcgagacggcacgctggaacgttgcttcggccgggaggcgctggttcgcgagctcgtagaggcgctcgaaggccgcgaaggctccgcgctggtgctggtgggtccacctggcgcgggcaagacggccctgattcatgaagcggtgagccggctcaccgcccggcaggacgccgcgggcgtgcgtcgcgacgtgtggcgcgtggacggcaaccagttcatcgccgggatgatgtacgtgggccagtgggaggcccgcgcgcggggcgtggtgaaggagctgatggaggtcggcgacctgctctacgtggacgacctggcctcgctcgtctacgcgggccgcacgcgcaatgagcgcaccaacgtcgcgcagttcctggagccccacatggcccggggcgagctcaccgtgctcgccgagtccacgcccgagcgcttcgagcgcgtgcgggaagaagcccccaccctcgcctcgctcttccgggtcatccatgtccccgcgctggatgcgcgtgccacgctgcccgcgctcctcggcaccgtgcgcgacctggaggcggaaggcacggacagcgcggtccagctctcgccgctggcgctggagaccctgctctcattgcaggagcgcttcgtgtcgcacgaggcgttcccgggcaaggccgtccgtctgctccgccgcgtcatggcccgacagggcgtcagcacctcgggcacccggcgcttttcgtcgggggacgtcatcgacgcgatgcgggagcagacgggcctaccggatttcatcctgggaagcgcccagccgaagaagcgcgaagcgctgacgtgggagatgcagcggcaggtagcgggccagcccgaagccgtggaagccgtggtggacgccatcctcacgttgcagtccgcgctccagccgtccgacaagcccctggccacctacctcttcgtgggccccacgggcgtgggcaagacggagacggcgaaggcgctcgcgcggacgctcttcggcggagagcagcggctcatccgtttcgacatgagtgagtacatggagaagcacaccgtgagccggctggtgggcgcgccgccgggctatgtcggctacgaggagggcgggcagctcaccgaggccgtgcggcggcggccctactccgtggtgctgtttgacgaggtggagaaggcccatccccgacgtgttcgacgccctcctccagttccttggtgagggacggctcacggacgcgcagggcacggtggtgaacttcaagaacaccgtcatcatcggcaccagcaacctgggctcgcacctcatccaggagtccaccgcgcgcaaggaaccgcaggagcgcatgcgggagcgcgtcatgggcgtgctcaaggggcacttcccgcccgagttcctcaaccgcatcgacgagacggtggtcttcgagccgctcaaccgcgcgcagctgcgcgccatcgtggacctgatgctggagaagacgcgccgcctgctgcacggccagggcattgacctggaggtgacgcccgcggcgctggaagcgctggtggacaagggatgggacccaaccttcggcgcgcgtccgctgcggcgtgaaatccagcgcgccatcgaggcgccactcgcggagaagctcatctcgggcgacatccatgagaacagccgcgtgagagcggacttcaaggacggaaaattccggttcgacgaagtggaggccgctgaggcggaagtcgcgcaggctgaagcgagtgccgtt

SEQ ID NO: 42874 - DNA, 1008 bp, Myxococcus xanthus
attgcggtcatccctggtgatggcattggaatcgaagtaacccgagaggtcatgcgcatcctgcaagtgctcgacgcggaaatgcggctcgggctctcactggaggcgtttgactttggcgcggagcgcttcctgaggacaggggtggggctgcccccgggccagatggatgtcttccgcaccgagttcgatgccatcctcctgggcgcgatgggggacccgcgcgtgccagacaatgcgcatgcgagggaaatcctgctgggcctgcgcttcgggctcgacctctacgtcaatttccggccctgctctccgctggcggagcgcctctccccgctcaagggcaagggaccgcaagagattgacatgacaatcttccgcgagaacacggagggcatctacggcgccatcggcgggagcttcaagcggggcacactcgacgaggtcgccattgccgaggaaatccatacccgcaagggggtggagcgaatcatccgcgccgcgttcaagtgggccagcgcccatggcaagcggcacgtagcgctgggggacaagtccaatgccattgccgcccacggcctctggctgcggacctttcgtgaggtcgccgccgaatacccgcagattgaggcgcggcactactacgtggatgccttggcgctccagatggtgacacggccggagtccctccaggtcatcgtgacgaccaatctcttcggcgacattctgacggacctgggcgcggccctgagcggtgggcttggcgttgcgccctccgccaacctcaatccggactccacgccgctcttcgaacccgtgcatggctcggcacccgagctcaccggcaaggggctggccaaccccgcggccatggtgctgagcgcggccctgatgctcgagcacctcggtcaggctggggccgcccggcgtctgagcacggccgttcagcagacggtggcggagggccagtgcacgcgcgacgtggggggaacgctctccacgacggaggcg

SEQ ID NO: 42875 - DNA, 750 bp, Myxococcus xanthus
gtcgagatcaacgatgagacgctccgggatgggatgcaggcgacggccgtcaccagccccacggtggaagagaagcgcggcctgctcgagttgatgcaacacatcggggtgagcgcggtgagcctcggtatgcccgcggcggggccgtgggcgctcgaggaggtcgtgacgctggcgcgccacatccgggaggaggcgctgcggctcgagcccaactgtgcggcgcggacgctgcacagcgacatcgtccccattgtcgaggcggtgcagcgggcggggcagcccatcgtggtgcatacgttcattggctcgtcccccctacgccagtgcgctgaggcatgggacctggacttcattctgcgttcctcgacggcggccatcgacttcgccgtgcgtcaggggctggaggtcgcgttcatcaccgaggacaccacccgctccacgccggagacgctcgagctcctcttccgcgccgcggtggagcatggcgcttcccggctggtgctctgcgacaccgtggggcatgcgacgccagccggaacccgcgccctggtgcggtggacacgggacctggtggagcggctcggcagtccggtgaaggtcgagtggcatggtcacaacgaccgagggttggcgttgatcaacgcgctcgtggccctggaggcgggagcgacgcgagtccatggttgtgggctgggaatcggcgagcgcacgggcaatgcccccgtggagttgctgctgctcaatctc

SEQ ID NO: 42876 - DNA, 492 bp, Myxococcus xanthus
ctgaatgcccggctccgggacgtaccggacttccccaagcccggcatcgtcttcaaggacatcacccccgtgctggcggacccgcgcctgttcggccgcgtcatcgacgccatgtcggcgcccttccggggccagcacgtcacgaaggtggtgggcgtggaggcccgaggcttcctgctgggcgcccccatcgcgctggcgctcaacgcgggcttcgtgccggcgcgcaagcctgggaagctgcctcaccgctcggtggtggagcgctactcgctggagtacggctctgacggcgtggagatgcacgaggacgccatcctccagggggagcgggtgctcgtcgtggatgacgtgctggccacgggaggcacggcggaggccaccgtgaggctcgtgtcccggctcggcggcgagttggtgggcttctgcttcctcctcagcctggacttcctcgaaggccccaaccgcctcgggcgcgagcgcgtgacgacg

SEQ ID NO: 42877 - DNA, 1725 bp, Myxococcus xanthus
ctgtcacgcatcggctcgccctcggacgtccgcgcacttcccgaggaggcactgccgctcctgtgccaggaactgcgcgaggacatcatctccatctgcggccgcgtggggggccacctgggggcctccctgggcgcggtggagctcatcgtcgcgctgcaccgcgtgttccattcgccgcaagacgcgctgctgttcgacgtggggcaccagacgtacgcgcacaagctcctcacgggccggcgtgaccgcatgcacacgctgcggcacgcgggcggcatcgcgccgttcctggacccgcgggagagtcctcacgacgcgctgctggctgggcattcatgcacggcggtgtccgcggcgctgggcgtgctggagggccggcggcagcaggggcaccggggccacgtggtggcggtgttgggcgacggcggcctcacggggggccttacatttgaagggctcaacaacgcgggggggagctccctgccgttggtcgtcgtcctcaacgacaaccagatgtccatcagcgccaacgtgggggccatccccgcgctgctgcgcacccgcgaggcgcgcgacttcttcgaaggcctgggcttcacctacctgggcccggtggatgggcacgacctgcctgcgctgattcgcgcgctgcgggaggcccgtgcctcgtcgcggccggtggtggtgcacgcgctgacgctgaaggggaagggcttcccgccagcggaggccgacacgcagacgcgtggacatgccatgggcccgtatgagtggcgggacggcaagctggtgcgctcgcgcggtggccagcggaccttcagcgaagccttcgcggcggtgctcgaggacgcgatggcccgggacccacgagtggtggcggtgacgcccgcgatgttggagggctcggcgctcaacgcgctcaaggcgcgcttcccggaccgggtgcacgacgtgggcatcgcggaacagcacgccgtcaccttcagcgcggggctggcctcggccggcgcgcggccggtgtgctgcatctattcgaccttcctccagcgcgcgtacgaccagatcatccacgacgtgtgcctgccgggcctgcccgtcgtcttcgccgtggaccgcgcggggctggtgggcgcggatggtgcgacgcaccagggcacctacgacgtggcgtccctgcgcccgctgccggacctgcacctgtggtcgcccatggtgggggaggacctggcgcctatgctggacactgccctggcggcgccgcacgcctccgtcatccgcttcccacgcggcacgctgccgcccctgcccgaaggactgggcgcgggcgaggcaccgctgcggggggctcgctggctgcttcgcgcggagcagccccggctgacgctggtgacgttggggcctttgggcatcgccgcgctggaggccgcgcggggcgagcccggctggagcgtgctggatgcgcgctgcgcttcgcctctggatgaggccgccttgctggaggccggccggtccggtcatgtcgtggtggccgaggagggcactacgcgcggcgggttgggcagcgcggtgctggagctcttcgcggcgcacgggctgatggcccgcgtccggttgatgggcatgcccgatgcgttcgttccccatggggacgcgcgggtccagcgcgcggagcaggggctggacgcggagggtctgcggcgcgcgggcctcgcgctgctggca

SEQ ID NO: 42878 - DNA, 861 bp, Myxococcus xanthus
acgtttcaactgaactcctttctggccgctcagcaggcgcgcgtcgaggccctgctgaacgagcgcgtggcgcggctcgggccttccgggacgccgccgcagctcgcggaggccatgcgctactccctgctggccggcggcaagcgcctgcgcccggtgctctgcctggccttcgcggacctcgtggcgcgcggaagcgccgtatcggcggtggcgggcgacgcggcgtgcgcgctggagtacgtgcacacgtactcgctggtgcatgacgacctgccggcgatggacaacgacgactaccgccggggccggctcaccaaccacaaggtgtacggcgaggccatggccatcctggcgggtgacgcgctgttgacggaggccttcacgctggtggccagtgggccggagagcatgcgcgccgcgctgtgccgggagctggcggtggcctcgggcgcggcgggcatggtgggcgggcaggtgctggacaccgccgaggaccggccgtccgcgctggactacctcatccggatgcaccgcatgaagacgggcgccctcatccgggccgcgtgccgcatgggcgtgctggccagcggtggagacgcggacgcattggcgcgcgcggacacctacggtgacgcggtggggctggccttccagattgccgatgacgtgctggacgtgacggccacggcggcggagctgggcaagcccgcgggcgcggacgccgcggccgggcgcttcaccttcccggcggtggtgggcctggaggcgtcgcggacgctggcggaccagaaggtggccgaggccatcgcggccgtacgccctctggaaggcgaggacgggccgctggcggcgttggcg

SEQ ID NO: 42879 - DNA, 1212 bp, Myxococcus xanthus
ctacccaacgggcttaccgtcgtcttcgaggagcagcacgccgccaaggtcgcggccttccaggtctgggtcaaggccgggagcgccgacgagcggccggaccaggcagggcttgcccacctgcacgagcacatgctcttcaagggcaccgagcgccgcggccccggtgaggtcgcccgggacgtggagtcccatggcggcgaaatcaacgcctggacctcctacgaccagaccgtctaccacatcgtcatcgccagccagttcgcccggatgggcctggacatcctgggcgatgcggtgcgccggtcggccttccacgcaggcgagctgtcgcgcgaaatcgaggtggtgtgcgaggaaatcaagcgcagccaggacacgccgtcccgccgtgcctcgcgtgacctcttctccaccgcctaccaggtgcacccctaccggctgcccgtcatcggcaccgacgagagcgtgcgcagcttcacgcgggagaaggtgctggagttctaccaccgccactacacgcccaagaacctggtgctgtcggtggcgggagacttgcgcgaggcggagctgcgcgagtgggtggacgacatcttcggcggcgactggggccggccgtatgagggccgggtagcgcgcgccccggagcccgtggccgcgggccggcgcatcctgctgcgcccggacgaggtgaaggaggcctacctccacctggccttcgggattccccaggcggaccacgaggacgtgcccgcgctggacgtgctggcgatgattgccggccagggagacgcgtcccggctggtgcgcgaggtgaagcgccgccacaacctggtcaacgacatccacaccttcgcgtatacgcccacggacccgggcctcttctccgcgtcgatgacgctccagcccgccaacgccgtccgggcgctggaggaggcggcgcgagggctggccacgctgcgcgccacgccggtgacggcggaggagctggccacggccaaggcgctggtggaagcggaggccgtgtaccagcgcgagacggtgcagggcgtggcccggaagatgggcttctaccagtccggcatgggcagcctggaggcggaggcccgctactacgaggccgtgcgcaacctcacgcccgagcacctgcgcgccgccgccgagcgctacctgcgcttcgaccgcgccgtcgtcaccggcctgctgccggag

SEQ ID NO: 42880 - DNA, 1386 bp, Myxococcus xanthus
gtgcgcgaggcgctggccgccgttctggctccggagcagctgcgcgtggatgacgccgcgctggccgcctacgcccgtgacgagtccgacagtggcgtccatgcgcccgacctcgtcgtcttccccgcggacacgcggcaggtgtcggaggtcttcaaggcgtgcgcggtgcacggcgtgcccttcaccccctgtggcgcgcgcagcggcaagagcggcggctcgctgcccttgcacgggggggtggcggtgagcctggagcggatgaaccgcatcctctccatctcccccgaggacctcaccgcggtggtgcagcccggcgtcatcaccggcgacctgatgaaggccgtggaagcggtagggctcttctatccaccggacccgaactcctgggaggtgtgcacgctgggcggcaacgtggcggagaacgccggcgggcctcgggcactcaaatacggtgtcacgcgcgactacgtcatcggactggagtgggtgctcccggacggcgaggtggtgcgggtgggccggcgcaccatcaagggtgtggcgggttatgacctggtgggcctcttcgtcggctcggagggcacgctgggggtcgccaccgaaatcaccgtccagctcatcccgctgccgcgcgaggtgctgacggccctggtggtttttccgtccgtgctgcacgccgcgcgcgcggtgtccgccgtgctggccgcgggcatcctcccgcgttgcctggagctcatcgatgacgtggccctgcgggctgtggacggccgcggcttccagttccctccgggcgcgggctccgctgtcatcgtcgaggtggacggcaacggccgcgagggcttgctcgctgagctgtctcagttgggtgacatctgtgccagccagggcgccaccgagacgctggtggcccaggatgcctcccagcgcgagaagctctgggccgcgcgcagggtgatttccccagccctccgggccctcaagcctcacaagatttccgaggacatcgtcgtgccccgctcgaagattccggaggtcatcgagcgcttgaaggccatgggcgcggagctggggctcaccgtggccacgtatggccatgcgggcgacgggaacctgcacgccaacatcctctacgagggcgcccaccaacggccgctggtggaggaggccctgcggcgcatgctggtgatgaccgtggaactgggcggaaccatcacaggcgagcacggtgtggggcacgcgaagcgggaatatctttcgctggagcagtcccccgcgctcatcgacctgcagcgcaggctcaaggccttcttcgatccatcagggttgctcaacccttcgaaaatcttccccgcgctcatgcgttcttgattcgtggccgac

SEQ ID NO: 42881 - DNA, 906 bp, Myxococcus xanthus
acccagcgccgcatccccgtcgtcaacctgtcccattaccgcacgggcacaccccaggagcgcgcccgcttcgtgcaggtgttcggcgacggcatcaaggagttcggcttcgtcacggtggaaggccacggcatcgacgacggcctcatccggcgcacgtacacggacgtggagcgcttcttcgccctgcccgaggccaccaaggcccagtacgcccaggcggggcacggcggccagcgcggctacatcggctacggtcaggagcacgcgaagaaccgccaggtgggagacctgaaggagttctggcacgtgggccgcgagctcccacctgaccacaagtaccacgcgctctatggccccaacgtgtggcccaccgaggtgtccaccttccgcgagcacacgctgtcgctcttcaacgcgctggatggcgcggcgggcgtcatgctccaggcgctggccgagtacttcggcgtggcgcgcgacaccttcagcggcatggccacggacggcaactccgtgctgcggctcatccactacccgccgctgaaggagcgcttcatccccgggggcgtgcgcgccgccgagcatgaggacatcaacctcatcaccctcctctgcgagggcacggcgtccggcctggagctgctcacccgcgacggggagtggctgccggtggacacactgcgcggacagattgtcgtcgactcgggcgacatgctcagccgcgtgacgaacgaaatcatccccgccactacgcaccgggtggtgaacccgcgcagcaaggaagaggacacggtgcgctactcgatgcccttcttcgtccatccctacgcggactgcgtgctccaggcgctgccctgcacccagacggcggacaccccggcgcgccacgcgcccagcaccgta

SEQ ID NO: 42882 - DNA, 612 bp, Myxococcus xanthus
cctttgcgtatcgtctcgctcgcgccccggcggagtggaggcttcatcgcggggacggagcggggcctggccttctacgagccccggagcgcgcggctggagcggctgctggatccggagcctgaacacccccacaaccgctgcaatgacgggaaggtggacccacaaggccgattctgggtgggcaccatggatgaccacgaggaggcgcccaccggcgggctctaccggttcgacgcccagggacacctcgctcgaatcgatgagggctacaccgtgacgaacggccccgccttcagccccgatgggcggaccctctacgtgaatgactcgccccggcgcgtcacctacgccttcgacctgagcccggacggcgcggcctctcgtcgccgggagttcctccgcttcgacgagccccacggcttccccgacggaatgacggccgacgcggagggcggattgtggattgccttctatggagggggctgcgtgcgccgcttctctccggacggcgcgtggctggccgagtaccggctgcccgtggcgaagacgaccagtgtcgccttcgccggggacgcgttggaccggctgttcgtcaccaccgggcgagat

SEQ ID NO: 42883 - DNA, 756 bp, Myxococcus xanthus
aacttcgaggcggcgattacgccgaagacgaagatggtgtgggtggagtcccccaccaacccgatgctcaagctcatcgacctggcgcgcatcgccgaggtcgccaagaagcggaacatcctctccgtcgccgacaacacgttcatgacgccgtacttccagcgcccgctggacctcggcttcgacgtggtggcgcactccaccaccaagtacatcaacggccacagcgacgtggtgggcggcttcgtctgcaccagccgtgaggacgtggcagagaagatgtacttcctccagaacgcggtgggcggcgtgtccggcgccttcgacagcttcatggtactgcgcggcgtgaagacgctgcacgtgcgcatggaccgccacgcctccaacgcgatgaaggtggcgcagttcctggcgtcccacccgaaggtgaagaaggtcacctacccgggtctggaggcgcacccgcagcacgcgctggcgaagcagcagatgtccggctttggcggcatggtgaccttcgacatccaggggggcctggaggccgcccgcaccttcctcaagacggtgaaggtgttcgcctgcgccgagtcgctcggcggcgtcgagtccctcatcgagcacccggccatcatgacccacgcctccattcccaaggagacgcgcgagcagctcggcatcaccgacggcttcatccgcctgtcggtgggcatcgaggacgcgcgggacctggtggacgacctgtcccaggcgctc

SEQ ID NO: 42884 - DNA, 1056 bp, Myxococcus xanthus
atggcgaacatggcacaggccatccgcatggccctgcactacgccgaggagcacctgggcgtcaccgacatcttcggcgaggacgtgggcgcccccctgggcggcgtcttcacctgcacgcagggcctgaagacgacgtggaactctcccctggacgagcgcggcatcatcggcgcggccatgggcatcgccatggccggcggacggccggtggcggagatccagttctgcgactacgtctacaacaccatcgacctgctgaagctggcgggcaacaccagctggtccaccttcggtgactggaacctgcccatggtggtgcgcacgccggtgggcagcggcatccgcgggtccatctacctctggcactcgttcgacgcgacgatgacccacatcgccgggtggaaggtggtcatgccctccacgccgctggacgcgtacgggctgctcatcaccgcgtgccaggagaagaaccccgtcatgttcctggagcccaaggcgctcctgcgcgtgaagggcgaggagcggattccgggcgagccggaggatgaccgcgcgctgtcgaagctcatcgacgcgccgctgggagaccgctcccagtggaagccgcagtggcccacgggcctggaggcgtacgcggtgcccttcggcaagggcaagatcgtgcgcgagggcacgcagctcaccgtggtgagctacggccgcaccctgcccctgtgcacgaaggccgcggagacgctggccgcggacggaatcagcgcggaggtcatcgacctgcgctcgctgtggccgtacgactgggagctcatcaaggcctccgtccagaagacgggccgcgtcctcttcgtcaacgaggacaccgaagtgacgaacttcggcgagcacctggtgcgccgcacggtggaggagctgttctactcgctgctggccccgccgcggctgctggccggcaagttcctgccgggcatcggcctggcggacgcgctggagatggcgtcggtgccgcaactgggtgacatcaccaccgccatccggtcgctcgcgggcgagcagccg

SEQ ID NO: 42885 - DNA, 1080 bp, Myxococcus xanthus
atgagacttggagtcctgaccggcggtggcgactgccccggcctcaacgcactcattcgcggcctcgtgaagcgaggcacgcacgaattcggctacgagttcgtgggcatcgagaacggctacatggggctggtggagccagggctcgcccacccgctcaccgaggaggacacccgcggcatcctccccaagggcggcaccatcctgggcacgtccaacaaggccaaccccttcagctacgcgacccgtgaggatgggcactgggtggagcgggacgtgtccgatcaggtcctgctccgctgcgaggagctgggcctggacgggctcatcgccgtgggcggcgacgggacgctgtccatcgcccaccggctcgtggagaaggggctcaaggtcgtcggctgtccgaagaccatcgacaacgacctgtccgggacggatcagaccttcggcttcgacaccgcgcggctcatcgtcaccgaggcgctcgaccgcctgcactccaccgccgaggcccacgaccgggtgatggtcgtggagatcatgggccgccacgccggcttcctcaccctggagagcggcatcgccgggggcgcggacgtcatcctgattccggagattccgtacagcgtggagtccgtggtggagaagatccgccgccgctccacccgccgtcgcagcttctccatcatcgccatctccgaaggcgcgttcccccagggcggcgagctggccgtgctggacacggcggaggccattcccggccggggcgtggtgcggctcggcggctcggggaaggcgctggcggacctgctggcccggcacatcgaggcggagattcgcgtgacggtgctgggccacctccagcgcgggggcagccccagcgcggcggaccgggtactggccactcgctacggctgcaaggtgctggacctggtgagcgcgggccagtgggaccacatggtggccctgcgtgcgggcgaaatcatcgcggtccccttgagcgagtcgcgcaaggagcgccgcgtggatccggcgggtgagctggtgcgcttcaccaagagcatgggcatcagcttcggg

SEQ ID NO: 42886 - DNA, 435 bp, Myxococcus xanthus
atggctatcgagcgtacgctgtccatcatcaagccggacggcctggagaagggcgtcatcgggaagatcatcagccgcttcgaggagaaggggctgaagccggtcgccatccgcctgcagcacctgtcccaggcgcaggccgagggcttctacgcggtccacaaggcccggcccttcttcaaggacctggtgcagttcatgatctccggcccggtggtcctgatggtgctggaaggtgagaacgcggtcctggccaaccgggacatcatgggcgccaccaaccccgcgcaggcggccgagggcaccatccgcaaggacttcgccaccagcatcgacaagaacacggtgcacggctccgacagcctggagaacgcgaagatcgagatcgcgtacttcttccgggagacggagatccactcctacccgtaccagaag

SEQ ID NO: 42887 - DNA, 876 bp, Myxococcus xanthus
atggccatcctcgtcaacgaaaacacgaaggtcctctgccagggcatcaccggctcggcgggctcgttccacgcgaagcagatgctcgagtacggcacgaagctcgttgccggcgtgactccgggcaagggcggcaccacgttcgaaggcaaggtccccgtgttcaacacggtggccgaggcggtgaaggagacgggcgcgaacacgtccgtggtcttcgtgccgccccccttcgccgctgactccatcatggaggctgcggacgcgggcgtggccctcatcatcgtcatcaccgagggcatcccggtcaacgacatggtgcgcgccaagcgctacctgcagggcaagccgggcatccggctggtcggccccaactgtccgggcgtcatcaccccgggcgcgctgtgcaagatcggcatcatgccgggccacatccacaagccgggccgcatcggcgtggtgtcccgctccggcacgctgacctacgaggccgtgcaccagctcacccagctgggcctgggccagtccaccgccgtgggcatcggcggtgacccggtcaacggcacggacttcgtggacgtgctgaagctcttcaacgcggacccggacaccgacgccgtcatcatgattggcgaaatcggcggtgacgccgaggagcgcggcgccgagtacgtggcgcgcgagttcaccaagcccatcgccgggttcatcgcgggccagtccgcgcccccgggcaagcgcatgggccacgccggcgccatcatctccggcggcaagggcacggcgaccgagaagatcaaggccatggaggccgcgggcatcctgatggccgccagccccgccgagctgggcaccacccttcaggaggccctcaag

SEQ ID NO: 42888 - DNA, 1155 bp, Myxococcus xanthus
atgaagatccacgagtaccagggcaaggaaatcttccggaagtacggcgtgcccacgccgaagggcatcctcgccgtttccgccaacgacgcggaggccgccgcgaaggagctcggcacttctgtggtcgtcgtgaaggcccagatccacgcaggtggccgtggcaagggcggcggcgtgaagctggccaagagccccgcggaagccaaggagctggccaagcagatgcttggcatgaagctcaagaccatccagaccgggccggaaggccagacggtccacaaggtctacatcgaagaaggtctcgccattggccaggagctgtacctgggcgtgacgctggaccgcgccaccagccgcatcaccttcatggcctcccgcgagggcggcgtggagattgaagaggtggcggagaagcacccggagaagatcctccgcgagtcggtggacccggccgtgggcttccaggacttccagggccgcaagctggccttcgggctgggcctgacgggccccacggtgaacaagttcacccaattctgctcggcgctgtaccggatgttcatggacacggacgcctcgctcgtggagatcaacccgctggtcatcctgaaggatggcggcgtggtggcgctcgacgcgaaggtgaccttcgacgagaacgcgctctaccggcacaaggacctgctggagtaccgcgacctggccgaagaggagccccgtgagatccaggccaaggagtgggatctggcctacatcgcgctggatggcaacatcggctgcatggtgaacggcgccggcctggcgatggccaccatggacaccatcaagctggtgggcggcagtccggccaacttcctggacgtgggcggcggcgccaacaaggagaaggtcaccgcggccttcaagctcatcctggcggacccggccgtgaaggcggtgctggtcaacatctttggcggcatcatgaagtgcgacgtcatcgccgagggcatcatcgccgcggcgaaggaggtccagctcaaggttccgctcgtggtgcggctggaaggcaccaacgttgagaagggcaaggagctgctgagcaactccggcctcgccatcaccccggcggacaacctgcgtcaggcggcggagaaggccgtcgctgcggtg

SEQ ID NO: 42889 - DNA, 723 bp, Myxococcus xanthus
aagaccatcaccttccgcatctggcggcaggatgatcccgcgaagccaggccacttcgatgagttcaaggttccctatgcgaagggcgccaacgtcatctcgtgcctgatggagatccagcgcaaccccgtcaccgtggagggcaagcgcgtggccccggtgatctgggacgccgcatgtctggaagaggtctgtggcagctgcgccatgaacatcaacggccgcgtgcgcatggcctgctcggcgctgatcgacaagctggagcagccgatcacgctggagcccatgagcaagttccccgtggtgcgtgacctcacggtgaaccgcgaccgcatgttcgacgcgctcaagcgcatcaagggctgggtgcccatcgacggcacgcacaacctggggccggggccgcgccaggcgcccgtggaccagtcggtgatgtacgtgctgtccacgtgcatcacctgcggcagctgcctggaggcgtgcccccaggtgacgcaggagaacgacttcgtgggcgcggcggccatcagccaggcccgcctgttcaacatgaaccccacgggcaagatgaactccgaggagcgcgtgcgctcgctcatggggcccggcggcatccaggactgcggcaaggcgcagaactgcgtgaaggtctgcccgaaggagattccgctcgtcacgtccatcgcggtgatgaaccgcgaggtgaccaagctcaccatcaag

SEQ ID NO: 42890 - DNA, 1857 bp, Myxococcus xanthus
gtggtgggcggcggcctcgccgggctgatgacgacgatcaagctcgcggaggcgggccaccaggtggatgtgctctcgctcgtcccggtgaagcgttcccactccgtttgtgcccagggcggcatcaacggcgcggtgaacaccaagggcgaaggcgaccacccggatatccacgtgaaggacacgctgcgcggcggcgacttcctcgcggagcaggtttcggtgaagggcatgtgtcatgccgcgcccggcatcatctacctgttggaccgcatgggcgtgacgttcaaccgcacgccggaaggtctgttggacttccgccgcttcggcggcacgctgcaccaccgcacggccttcgccggcgccaccaccggccagcagctgctctacgcgctggacgagcaggtccgccgctatgaggccgagggcaaggtcaccaagtacgagtactgggagtggctcggcacggtgaaggacgacagcgggcgctgcatcggcagcgtggccgtcgacctgcgcaccatggagatccgcaccttcccggccgaggccgtctgcctggccacgggtggtccgggcatcgtcttcggacgctccaccaactccatcatcaacaccggcaccgccgcgggccgcgcctacatggagggcgcgcactacgccaacggtgagttcatccaggtgcacccgacgtcgattccgggcgaggacaagctccgcctgatgagcgagtcggtgcgtggcgagggcggccgcgtctgggtgccccgcaagaagggcgacacgcgggcgcctcagcagatcccggaggcggagcgctggtacttcctggaagagaagtaccccaagtacaagaacctggtgccgcgcgacgtggccacccgcgagatcttcatggtctgccgcgagctgggcatgggcatcaacggccgggacggcgtgtacctggacgtcacgcacatccccgcgccggtgctggacgccaagatcaagggcgtcatggagatctacgagaagttcgtcggtgacgacccgcgcaaggtgcccatggtcatcttcccgggcatgcactactccatgggcggcctgtacgtgaacttcgaggccgacccgaagacgcagacgccggccgagggcagcccgaagaaccagtccaccaccatccccggcctctacgccgcgggcgaggcggactacgccttccacggcgcgaaccgcctgggcgccaactcgctgctgtcgtgcatctactccggcatgatcggcggcccggccatggtctccttcgccaagagccagggcaccagcgccgcggcgatgccggagaagcacttccaggccgcccggcagtactggcaggaccgtttcgccaccatgctcaagatgagtggcacggagaacccgtacgggctcgccaaggagctgggcgacaccatgacggagaactgcaccgtcgtgcgctacaacgaccgtctgaagaagacgatcgagaagatccgcgagctcaaggagcgctggaagaacgtcaacgtgctggacacgggcaatgtggccaaccgcgcgctgtcgtacaccaaccagctgtggaacatgttcgagctgggcgaggtcatcgcgaccagcgcgctgctccgcgacgagagccgcggcgcccactacaagccggacttctcgctgcccgaaccgaagacgaaggacccgacgcaggacccggagtggatgagcctgtggcgtgcgcgccacgagaagtgggcgaagacgaccgtcgcgacgtacagcgaggccggcccgaagatccactacgaggacatccctacgcccgtgctggaccccgagccgcgctggtacgcctgagac

SEQ ID NO: 42891 - DNA, 1856 bp, Myxococcus xanthus
atcggcatcgacctgggcacgtcattctcgtgcgtggcggttgtccaggacggccagcccaccgtcatccccaacgagtggggagagacgactcacgcctcctgcgtctcgttcctcgaggatggctcggtcctggtcggtaacgcggccaagaagaacatcatcaccaaccccgagcagaccgtctattccgccaagcgcctcatcggccgctactacttctccgacgaggtgaagaaggcgcaggcggtgatgccgtaccgcatcgtcgagggcgacaacaactcggtgcgcatcgcgatgaacgagcactcctattcgctcccggagatcagcgcgctggtgctcaaggagctgaaggcggtggcggagacgtacctgggccaggaggtgaccaaggccgtggtcaccgtgcccgcgtacttcaacgacaaccagcgccaggccaccaaggacgcgggccgcatcgccggcatggaggtgctgcgcatcctcaacgagcccaccgccgcggcgctcgcgtacggcttcgggcgtgacgtcaaccagcgcgtggtggtctacgacctgggcggcggcaccttcgacgtctccatcctggagattggcaaggacgtcttcgaggtgctggccaccgctggcgacacgtacctgggcggcgacgacttcgacgaccgcatcatgacgtggctggcggatgacttcctggcccgcacgcgcctggacgtgcggcagaacaagttctgcctgcagatgctcaaggaggccgcggagaaggcgaagatcgacgtgggccagacgggctccgcggagattctctgccagggcatctgccaggacgccgacggcaacgtcatggacctgcgtgggcagctcaaccaggaccagttcaaccgcatggtgatggacctggtgcagcgcaccttcaaggtgtgcgacgaggcgctgcagagcgcgcgcctgacggctgcagacatcgacgcggtcatcctcgtgggcgggccgacgcggctgcccatcatccgcaattcggtgaagcactacttccagaaggaaccgctggaaggcatcaacccggaccaggtcgtggccatgggcgcggcgctccagtcgcacgcgctgctggacagcaagacgcagacgttcctggtggacgtcacgccgctgtcgctgcgcatcggcacggtgggtgggtacaccgagaagatcatcgacaagaacacgccggttcccatcgaccgctcgaagacgttcaccaccagccgcgacggccaggagaaggtgaagattcgcgtgtaccagggcgagtccaaccgcgccgacgagtgcgagatgctcggcgagttcgagttcgcgggcttccgcatcggctaccgcggcgaggtgaagattgaggtcaccttcgaaatcaacacggatggtctggtgcacgtgtccgcgtgcgacacggcgacgggtcagaagacgtcgacctccatcaccctgtcctccggcatgagcgaggccgatatccagcagtccatccaggccaaccggaacattcggcttgctggccacaacagcgacgacctgcccgccgcggcgcagtaaggccgcgactcgaccacgccgatgtccgagccttcagaccccagcgccggcaaaccgccgggagcaacgcccgggacaccggccacgcccgcccggccggcagtcccgcgcgtgacggccgccgtccccggccccgtcacgcccgggacgattccgtcgtcgcccgccgccagcgcgccgactccgccgcctcggccccagggaacacctctcgcacgtcccaccggcgtgacgcccccggtgccgccccgggccacgacgacggg

SEQ ID NO: 42892 - DNA, 1146 bp, Myxococcus xanthus
gatcccctctggtacaagaaagcccttatctacgagctgcacctgcgtgccttccatgactccaatggcgacggccacggggacatccccggtctgattgagaagcttccgtacctccaggacctgggcatcaactgcctctggttgctgccccactacccttcgccgctgcgcgacgatggctacgacatcgcggacttctacggggtccacccggactacggcacgctcgcggacttccagcgactggtggatgaggcgcacaagcgcgacatccgcgtcatcaccgagctggtggtgaaccacaccagtgaccagcacccctggttccaggaagcgcgcagcgaccccaacagccccaagcgcaactggtacgtctggagcgacaccgacgaacagtacaagggcgcgcgcatcatcttcctggacacggagcgctccaactggacgtgggacccggtggccaagcagtacttctggcaccgcttcttcagccaccagccggacctcaactacgacaaccccgaagtgcaggaagccatgctggacgtcatgcgcttctggctcaacatgggcgtggacgggttccgctgcgacgcagtgccctacctcttcgagcgcgaaggcaccaactgcgagaaccttccggagacgcacgccttcctcaagcgcctgcggaagaccatcgactccgaatacaaggggaagatgctgctggcggaggcgaaccagtggcccgccgacgtgcgcgtgtacttcggcgacggcgacgagttccacatgggcttccacttcccggtgatgccccgcctctacatggcggtgcgccgcgaggaccgcacgcccatcgtcgaaatcatgcagcagacgccggacatcccggacaactgccagtgggccatcttcctgcgcaaccatgacgagctgacgctggagatggtgacggacgaggaccgggactacatgtaccgggaatacgccaccgacccgcgcatgcgcatcaacctgggcatccgccgccggctggcgccgctgatggacaacggccgccggcgcatcgagctgatgcacagcctgctcttcaccctgcccggcacgcccgtcctctattacggcgacgagattggcatgggcgacaacatctac

SEQ ID NO: 42893 - DNA, 806 bp, Myxococcus xanthus
gcgtcaccgagcgtgcgcgcgtcgcgcgtgaaatcgagcaggcctgtcgcgacagcggcttcttctacgtgacgggccacggcgtgtccggcgaggtgctcgcgcggctggagcgggagagccaccgcttctttgcgctgccccgggtggcgaaggaggccatcgccatgtcgatgggcggtgtcgcgtggcgaggctggtttccactcgggggggagctgacctcggggcgcccggaccggaaggaggggttgtatctgggcacggagctcggaagcgagcatccgcgcgtaaaggccggctggccgttgcacggcgccaacctgtggcccgcggaggtgccggagctgcgcgcggcggtgctcgactacgtggcggcctgcacgcgcgccgcgcatgcgctgatggagggcatggcgctgagcctgggcctggacgcggactacttccggcggcactacacggcggacccgacggtgctcttccgcatcttccattaccccgcggagccccagcacgaggaggtgagctggggcgtgggcgagcacaccgactacgggctgctcacgctgctggcccaggacgacaacggcgggttgcaggtgaagacgccgcgcggctgggtggaggtaccgccgctgcccgggacgctggtgtgcaacatcggcgacatgctcgaccggatgacaggcgggtggtaccgctccacgccgcaccgggtgaagaacgtgagcggcaaggacaggctgtccttcccactcttcttcgacccggacttcgccgccgaggtccaccccctgccacgc

SEQ ID NO: 42894 - DNA, 690 bp, Myxococcus xanthus
gcctcggccctgctcgccgaagccgctgaagtgaaggacgcccccgcgcaggacctcctcgcctggaccgagcgccgcttcggtgcgcgcgcggccatcgcctccagcttcggcgtggaggacatggtcctcatcgacctggcgcgccagcatgcgcccagcctgcgcctcttcacgctcgacaccggacgcctgcccccggagacgtacgaactcatggaggtggtgcgtaagcgctacggcgtcaccgtggagacgtacttccccgagcgcgcgcgcgtggaggcgttggagtccacgaacggctacttctccttccgccagagcctagaggcacgcaaggcgtgctgcgccatccgcaaggtggagcccctgtcgcgcgcgctcgcgggtcaacaggcgtgggtgacgggattgcgccgtgagcagtccgtcacccgcaccgacgtggcgacgttagaggtggacagcgcgcatgggctgctcaagctcaacccgctggccacgtggagcagccgggacatctgggcctacgtccgggcgaagagcgtgccctacaacgcgctccatgaccgtggctacccgtccatcggctgtgcgccctgcacgcgcgcggtgaaaccctacgaggacgagcgcgcgggccgctggtggtgggagtccgcggagaaccgcgagtgcggcctccac

SEQ ID NO: 42895 - DNA, 1092 bp, Myxococcus xanthus
tgctactgctcctccgacaaggattgcagtacgggtgagagctgccgcagcggcgtctgtcggaccgttccacctggctcgggcgcgtgttcctcctccctggactgccccgggtcccagatctgcatcaacagcgtctgctcgcagttctgctcgcgtgactccgactgcggttcgggccagcggtgcgacaagaactactgcgttgggaacggcgggacgcgcccggacgcgggttctgatggcgggacgcgcccggattcggggacggacggtgggacgcgcccagacgctggctccgacggtgggacgcgcccggatgcgggcgtggacgggggggctcctcagcagtgccgggtgaacatggattgcggtgcggggaactactgcatcaacaaccagtgcatccgcggctgctatgacgattcctggtgcgacgccaaggacacctgcgtgagcggcctgtgccgtccgcgcccggtggacccgaacacctgctccaccgcggcggactgctccggcgggaaggactgcgtggatggccagtgccgcgcggcttgcgactccaccacccagtgcccggacgactacagctgccagattggctactgcatgcccattccggatgggggccagtgccgcgccaactgcgagtgccccgccggccaggtctgcttcaatggcaagtgcaagtcgccgcagccggacccgggccagacgtgcgtggccaactgtgactgcccctcgggtgacgtctgcaccaacggttactgccgtccgccggccccgccgccggacgcgggcacgggcacggcctgccaggccaactgcgactgcccgtcgggcgaggtctgctccaacggccagtgcaaggtgccgccgcctcctccggtgcaggatgccgggacgtccaccccggtgtgccgcgccaactgcgagtgcccgtccggtcaggtctgcacggacggcgtctgcaagcccgtcaacacgggcagcggcaacagctgtcacgccacctgcgagtgccccgccggcgagcgctgcatcgacaacgtctgctggctgtagtcgggacggacgccagcgtcaggg

SEQ ID NO: 42896 - DNA, 1254 bp, Myxococcus xanthus
gccacgacgagcgccctcacgcttcccacgttgcacgaaagcaccacgtccagtggcctgaaggtcatcgccgccgagcgcgggcccctgcccatggtgtccgtgcggctggtgattcgcgcgggcagcgccaccgacccggatggcaagcacggcctggcggacttcaccgcccggttgctgcgccggggcacccgcctgctgaacgcgcaggccatcgacgaagcggtggagttcgtcggtgccagcctgggcgtgggtgtgagtgaagacacgctgtcggtggccctcaccacaccgtccgagcacttcgtacagatgctcgacatcctgggccagttggtgcgcgagcccacgttcccgcagtccgaagtggacgatgcgcgcgagcgcgagctggcgcagttcgccaatgacctggacgacccgtccatcatcgccgaccgcgccatggtccgcgcgctctggggcaaccacccctacggccacgacgtgggcggttcgtcgaagagcgtgaagaccttcacgcgcgatgacgtggtgcgcttccaccaggagcgcatgggccccaaggtgtccatgctcatcgtggtgggcgcggtggatccgcagcgtgtggctgccgcggcggaagacgccttcgctgattggacgggaggaccggatgcgcccgtggccattcccgcgccggagcgcattgccctgggtgggcgggtcatcatcgtggacaagccggaccagacgcagtcgcaggttcggctgggcggccccggcatgcgcatgggccacgaggactatttcccggccacggcgatgaacatcgccctgggcggtggattcacctcgcgcctgatgaacgagattcgcgtcaaccgcggcctcacgtacggcgtcagctcgtggttcgactcgatgaacgcggccggcgtcttcgcgctgtccaccttcacgaagacggagtccacgcgcgaaatcatcgacgtggcgctggcggagattggcggcgtccgggagaaggggctcaagccccgcgagctggcggatgcccaggcctacctcgccggcctgtacccgctgcggacggagacgaacgagtccattgccggaagcatcgccgaggcccgcctgcacgggctgggggatgactgggtggagcggttccgggaccggctgcgcgcggtgacgccgaagcaagtcgtggccgccgcgaagaaatactgcttcgcgcaggcgcccgccgtggtggtgctgggc

SEQ ID NO: 42897 - DNA, 1176 bp, Myxococcus xanthus
ctcatcgtccagaagtacggcggtacctctgtaggtgacgtggcccgcatcaagagcgtggcgctgcgctgcctggccgcccaggaggcggggcatgacgtggtcgtcgtcgtgtccgccatgtccggcgagacgaaccggctgatgaaactggtggcgcaaatcaccgaccggccggacgagcgcgagcaggacgtggtcgtcgccaccggtgagcaggtctccatcggcctgctggccatggccatccacgcccagcaggggaaggcgaccagcttcctcggccaacaggtgcgcatcgtcaccgacagcaccttcgccaaagcgcgaatcaagagcatcgacgcgcagcccatccgcgccgcgctggcccggggccacatcgtcgtggtggcgggcttccagggcgtggacgagtccggcagcgtcaccacgctgggccgtggcggatccgacaccaccgccgtggccctggccgccgcgctgaacgcggacgcctgtgaaatctacacggacgtggacggcgtctacacctccgaccccaacatggttccgtccgcgcgcaagctggaccgcatcacctacgaggagatgctggagctggccagcgtgggcgccaaggtgttgcagatccgctcggtcgagttcgccatgaagtacaaagtgccgctgtgggtgaagtcgtccttcaccgatgaccccggcaccctcgtgtgtgaggaggacagttccatggaggatgtgctggtccgcggcgtcgcgtatgaccgcaacgaggcgaagatcacggtgtgcggtgtgccggacgtcgcgggcgccgcggcgaagatcttcggaccgctcgatgagaagcacatcgtggtggacctcatcgtgcagaacccgtccaaggacggacgcacggacgtgaccttcaccgtgggcaaggcggacttccttaccgcgcaggaagtggtgcggaaggtcgccgaggagattggcgcgtccggtatcgagacggacggggacatcgcgaaggtgtccatcgtgggtgtgggcatgcgcaatcactcgggtgtggcggcgcggatgttccgggcgctgtccgccgagggcatcaacatccagatgatctccacgtcggagatcaaggtgtcctgcgtggtccaggccaagtacacggagctggccgtgcgc

SEQ ID NO: 42898 - DNA, 1503 bp, Myxococcus xanthus
atcctcatcgacggtgacaccctgaagctcgaggaaatcctccaggtggctcgcaacgaggccaccgtggagctgtcgcccgacgccgccacccgcgtgcgggcctcgcgcgccctggtggaccgcgtcgccgccggagacacgcccgcctacggcatcaacaccggctttggcacgttggccgaggtccgcatcgacaagaaggacctgcgcgacctccagcgcaacctcatcctctcccacgcgtgtggcgtcggcacgcccctcccccttccggaagcgcgggcgctcctgctgctccgctgcaacgtgctcgccaagggctactccggcatccgcatggagacgctggccctggcgctggacatgctgaaccgggacgtcgtgcccgtggtccccgagcggggcagcgtgggcgcctccggggatctcgccccgctggcgcacctggcgctcgtcttcatcggcgaaggtgaagccttctatcagggccagcggatgcccgcgaagcaggcgctggagcgcgccggcctgcaaccggtggtgttggaggccaaggagggcctcgccctggtgaacggcacacaggccatgtgcgcggtgggcaccctgctccagcttcgcgcggagtccctggcggacatcgccgacgtcgcgggcgccatgacgctggaggggctgctgggaagccacaagcccttcattcctgagattcacgacgtccgcgcgcacccgggccagaaggacgtcgcggcgcacctgcggcgcatcctggtggacagcgagctggtggagtcgcacgtcaactgcagcaaggtgcaggacccctactccctgcgctgcatgccgcaggtgcacggcgcggcgcgcgagggcatcgcgttctcccggcgcatcctggaggtggaggtcaacagcgcgacggacaacccgctcgtgttcgcggacacggagcgcatcgtgtcgggcggcaacttccacggccagcccatctccctggccatggacgtggtggcgatggcgctgacgcaactgtcgtccatcagcgagcggcgcgtggagcagctcgtgaacccgtcgctgtccaacctgccggcgttcctggcgaagaactccgggttgaactccggcttcatgatcgcgcaggtgaccagcgccgcgctggtggccgagtcccgcgtgctgagccaccccgcgtccgtggattcgattccgtcatccgcgggccgagaggaccacgtgtccatgggcatgacggcggcgctcaagggccgtcaggtcagcgacttcgcccgttcgtgcctcgcgattgaaatcctggtggcggcgcaggccctggacttccgcctgccgctgaagcccggcaagggcgccctcgcggcgtacgagctggtgcgctcgaaggtcccccacatggacaaggaccgcgagctgcaccgggacatcgaggcggtgagccagctcgtcgactctggcgagctgctcgcggcggtgcgctccgcc

SEQ ID NO: 42899 - DNA, 771 bp, Myxococcus xanthus
gcggtgttccgcagcagggcgctggagagtctcctgggctgggtgggcttcagcccgttcctggtgacccccgggaactggcgggcgtggcacgtccaggcacaccacagcgcggcgaacgtcctggttcgagatccggacatcctgccgcgtcagagcgagtggcggacccagtggttcgcgaaggtgttccacgcgatgtccccgggctcgggctcgttgctgagcttcgtcagcttcagcttcttcttcaccgcccagggacaggccttcctctggcaccacagccggctgccgcagttcaagcatgtgcacatgcatcgaacgcgggagcgcgtcctcacggtgctcgtgatggtggggtggggcgcggtgggctggtggatggggcccatgggggcgctctatgcgctcatccttccgctcctcatcggcaacatcaccttgatgatctacatcgccaccaaccattggctgctggccgcgcacgaggagtcggacaaccccttcgtgaacacggccagcgtggcgacgcatccggtgatggactggctgcactacaacttcagccaccaccaggagcaccacatcttcccggccatgagcccgaagttcgcgccgctgcttcgcaagcacctgcgcgatctcaaccccgaagcgtcacaggtgtacccgcacctgcacgcgctccggatgctgtaccggcgcccggcgctctatgccgaggacggacagacgctcatggcaccggaggggacgcctgcgattgcc

SEQ ID NO: 42900 - DNA, 741 bp, Myxococcus xanthus
gattcgctccccatgaagaaagtgctcgtcctcggcgccaccagcgccattgcccaggcgacggtgcggctcctggccgcgcgcggggcctcgctgtacctcactggccgcaacgcggcgaacctcgacgcggtgacgaaggacgccgccacgcgtggcgcggcgaaggtcgcgtcgcaggtggtggacctgaacgacttcgacacccacgaggcgctggtggaggccgcgtacacggcgctggacgggctggacggcgtggtgctggcgcacggcgtgctgggtgaccaggcggaggcgcagcgctcgtgggcggcgacggaggcggtgctgcgcaccaacttcctgagcgcggtgtcgctgctcacagtgctggccaaccgcttcgaggcgcagaaggccggcacgctggtggtgatttcgtcggtggcgggtgaccgcggccggcagagcaactacgtgtacggcgcgtcgaagggcgcgctcaacgtcttcctccagggcctgcgcaaccggctggcgaaatccaatgtcgcggtggtgacagtgaagccgggcttcgtcgacacgccgatgacggcgcacctgccgaagaacaagctgttcgcctcaccggagaaggtggcgcgcggactgctgagcgccgcggactcgaggaagaacgaagtctacgtgcccggcatctgggcgctcatcatgctcatcatccggacgattccggagaccgtgttcaagcgcatg

SEQ ID NO: 42901 - DNA, 2446 bp, Myxococcus xanthus
gacgacagcgggctcgggcacgacgcggccagcttgcgccgttccttcctcgaccacgtccgctattcgcgcggaaagaactacgagtcgtccaccccccatgaccgcttcatggcgctgtcgctcgcggtgcgtgacaggctggcagaccggtgggtgaagacgtcgcgcacgtattacgaaaaggacgtcaagcgcgcctattacctgtccgccgagtacctgctgggtcgggccctgggcaacaacctgctgaacctggggatgtacgaagcggcctccgagtcgatgcaggaggtgggagttgacctcaccaacctgctggagatggagccggacgcgggcctgggcaacggcggcctgggccgcctggccgcgtgtttcatggagtcgctggccacactggcctaccccggcatggggtacggcatccgctacgagttcggcatcttcacgcaggacatcgtcgacgggtaccaggtggagcgcgccgacgagtggctcaagttcggcaacccgtgggaaatcgtccggccggagaaggcggtgccggtgcgcttcttcgggcgcgtggagcaccaccagggcccggatggccgtcccgtggcgcgctgggtgggcggcaagacggtggtgggcgttccgtatgacacgcccatcgccggctaccacaacaacaccgtcaacacgctgcggctgtggcaggcgcgcgcctccgaggagttcgacctgctgctgttcaacgcgggcgactacgagcgctcggtggtggagaagaacgactcggaggtcatctccaaggtcctctaccccaacgacgcgttccaggccggcaaggagctgcggctcaagcagcagtacttcttcgtcgcgtgctccatcgcggacatcgtccggcgctatctgaagaaccacacggacttcaaggacttctcccgcaaggcagccatccagctcaacgacacgcacccggccattggcgtggcggagctgatgcgcgtgctggtggacgagaagcgcctgctctgggacgaggcgtggacgattacccaggagacgttcggctacaccaaccacacgctgctggccgaggcgatggagaagtggccggcgacgctcttcgagcggctgctgccccgccacctggaaatcatctacgaaatcaactcgcgcttcctgcggcaggtgcagattcgctacccgtacgaccaggagaagatgcagcggatgagcctggtggaggaaggggccgagaagaagattcgcatggcccacctcgccgtcgtcggcagccacagcgtcaacggcgtggccgcgctgcacaccgacctgctgcgccgggacgtgctgacggacttcgcgtccatgaacccggagcggttcaacaacaagacgaacggcgtgacgccgcgccgctggctggcatggtgcaacccccgcctgtccaagctgattacgtcccgcatcggcgagggctgggtcacggacctggacaagctgacgaagctggaggcgcacgcggagaacccgaagttccagcaaggccttccgtgaggtgaagcgcgccaacaaggaagacctggcccggcacatccgtgacttgcgctgggtgcagctcaatccggacgccatcttcgacgtgcagatcaagcgcctgcacgagtacaagcgccagctcctcaacgcgctgcacatcgtggcgctgtggatgaaggcgcgcagggatccgtccaccatcatccacccgcgggcgttcatcttcggcgccaaggcggcgccgggctaccacctggcgaaactgaccatccggctcatcaacggcatcgccgaggtggtgaacagcgacgcgggcaccacgggcctgcaggtcgtgttcgcccccaactaccgggtgagcctggccgagcgcatcatccccgccgcggacgtgtccgagcagatctccaccgcgggcatggaggcgtccggcaccggcaacatgaagctgatgctcaacggcgcgctgacgctgggcacgctggacggcgccaacgtggagattcgcgacgcggtgggcgacgagaacttcttcctcttcggcctcacggcggacgaggtgattgctcgcaagcgcgagggctaccgcccgcgcgacgagtacaaccagcaccaggagctgcgcgaggcgctggacctgatttccaccggcttcttctcgccggaggacaagcaccttttcaagccgctggtggacagcctcctcgaggaggaccgctacctcatgctggcggacttcccgtcgtacatggcgaagcaagaggacgtcgcgcacgcctacaaggacgaggacggctgggcgcgcaagtgcatcatcaacgtggcgcgcggcggcatcttctcctcggaccggaccatcaagcagtacgccgaggagatctggcgcatccagcagacgccggtggatccg

SEQ ID NO: 42902 - DNA, 1086 bp, Myxococcus xanthus
atgcgaccgctcgtccccacccacgttgagacgctcaagccgtacgtgcccggcaagcccattgaagagaccgagcgtgagttcggcctcaagggcgtcatcaagctggcctcgaacgaaaacccactggggccctccccgcgcgccgtggaggccatgcggaacgtctctggcgcgacgcacctgtaccccgacgccacgtccttccacctggtgcgcaagctggccgcgcacgtggacgtgaagccggagcaggtggtgctgggcagcggctccaacgaactcatcgagctgctcatccgcaccttcaccacgccggaggatgaaatcctcctgtgccagggctccttctccgcgtaccgcatctccgcgcaggcccatgggcggcccttcgtggagatgcccatgcgcgagggcttcctgtacgacctggaggccatggcgaaggccatcaccccgcgcacgcggatggtgttcctggccaacccggacaaccccacgggcaccgcgttcagccgcgacgccctgacgcgcttcctggccgcggtgccgccggaggtgctggtggtgcacgacgaggcctactgcgagttcgtcgagtggcccgagtacaccagcgccgtgccgctggtcggccagcacccgaacctggtggcgctgcgcaccttcagcaagattcacgggctggcgggcgtgcgcctgggctatggcatcatgaatgcccggctggcggcgtacctgcaccgcacgcgcatgcccttcaacctgacggtgctggcccaggccgcgggtctggcggccctggaggacaccgagcacgtgcgccgcacgcgtgaggtgaaccgcgcgggtctggactacttcgccgcggagttgccgatgctgggcggcacgctcacgcacagccacgccaacttcgtgttcgtggacttcggccgtcccgcagtggcgctgtacgagcagctgctgcgcaagggcatcatcgtccggcccttcgcggggcaggggttcccgaaccacgtgcgcatctccgtgggcacgcccgcggagaacgcgcgctgcgtccaggtgctgaaagagatcctg

SEQ ID NO: 42903 - DNA, 660 bp, Myxococcus xanthus
atggtggaaaacgtcatcttcgacgtggatggaaccctggtggattcggtggacgagcacgccgaggcatggcggcgcgccttccttcacttcggccgggacatcccgttcgcgcacgtgcgcagccagattggcaagggcgccgaccagctcatccccgtcttcttcaatgacgaggaagtggagcgcttcggcaaggagctggacgaataccgcggcaagctgttcctggacgagttcctgccgaagggtgcgtcccttcccccgcgtacgggagctcttccagcggctgcgcgcgggcggcatccgcatcgtgctggcctccagcgcgaaagagcaggagctgaagcactacgtgaagctgtgcggcatcgaaggcctgttcgagacgaagacaagcgcggacgaggtggacaagagcaagccccacccggacatcttcgaggccgccctggcgcggctgggcaagccctctccggacgtgacggtcgtcgtgggcgacacgccctatgacgcgctcgccgccaacaagtcgagcctgccctccgtgggcgtgctcgcgggcggcttccctccggatgacctgcgcgccgcgggctgccgcacgctggtgaaggacccggcggcgctgctcgcgcgctacgaggcgtcccggcgcga

SEQ ID NO: 42904 - DNA, 2455 bp, Myxococcus xanthus
atgttcttcggacgtgacgacaagaaggaagcccagaagcggggtttgacggtcccgctcttgccccttcgggacatcatcgtgttcccgcacatggtggtgccgttgttcgtcggccgggagaagtccatcgcggcgttgaaggacgcgatggcgcacaaggggccggacgacaaggccgtcatcctgctggccgcgcagaagaaggccaagacgaacgaccctacccccgacgacatctttcacttcggtacgctgggccacgtcatccagctcctcccgctgcccgacggcacggtgaaggtgctggtggaaggcgtgcgccgcgccaaggtgaagaagttccaccccaacgacgccttcttcatggtcgaggtggaggaggtggaggagcagacggagaagacggtggagctggaggcgctcgttcgcagcgtccactccgtcttcgaggccttcgtcaagctcaacaagcgcatcccgcctgagatgctgatgcaggtggccagcatcgacgacccggcgcggctggccgacaccatcgtcgcgcacctctccctgaagctgaacgacaagcaggccctgctcgagacggagtccccggccaagcgcctggagaagctctacgagctgatgcagggtgagatcgagattctccaggtggagaagaagatccgcacgcgcgtcaagaagcagatggagaagacccagaaggagtactacctgaatgagcagatgcaggccattcagaaggagctgggtgagcgcgacgagttcaagaacgagattcaggagattgaagagaagctgaagaacaagcggatgagcaaggaggccacgctcaaggtcaagaaggagctgaagaagctccggatgatgagcccgatgagcgccgaggccaccgtcgtccgcaactacatcgactggatcatcagcctcccctggtacgacgagacgcaggaccgtctggacgtcactgaggcggagacggtgctcaacgaggaccactacggcttgaagaagccgaaggagcgcatcctcgagtacctggccgtgcagcaactggtgaagaagctcaagggccccgtgctgtgcttcgtcggtcctccgggcgtcggcaagacgtcgctggcgcgctccattgctcgggccaccggccgcaagttcgtgcgcctgtcgctgggcggcgttcgtgacgaggcggagattcgtggccaccggcgcacgtacatcggcgcgatgccgggcaagctcatccagtcgctgaagaaggcgggcagcaacaaccccgtcttcctgctcgatgaaatcgacaagatgtccacggacttccgtggcgatccgagcgcggcgctgctggaggtgctggaccccgagcagaaccacaccttcaacgaccactacctggacctcgactacgacctgtccaaggtgatgttcatctgcaccgcgaacacgatgcacaacatccccggtccgctgcaggaccgcatggaagtgattcgcatcgcggggtacacggagccggagaagctctccatcgcccgccgatacctcatcccgaaggagcaggaggccaacgggctgtcggacctcaaggtggacatctccgacccggcgctgcggaccatcatccaccgctacacgcgggagtcgggcgtgcgctcgctcgagcgtgagattggcggcgtgttccgcaagattgcccgcgacgtgctgaagaacggcaagcgggacatcgacgtggaccggaagatggccatgaagttcctgggcacgccccgctaccgttacggcatggcggaggccgaggatcaggtgggcatcgtcacgggcctggcgtggacggagctgggcggtgaaatcctcaccaccgaggccaccatcatgccgggcaagggcaagctcatcatcactggcaagctgggtgaggtgatgcaggagtccgcgcaggcggccatgtcctacgtgcgcagccgcgccgagcgcttcggcatcgaccgcaaggtgttcgagaactacgacatgcacgtgcacttgccggagggcgcgattccgaaggacgggtccgtccgccggcgtcaccatctgcaccgcactggtgagcgcgctcacccgcgtgctcatccgccgcgacgtggcgatgacgggtgaaatcaccctgcgtgggcgggtgctccccattggcggcttgaaggagaagacgctggccgcgcaccgggcgggcatcaagacggtcctcatcccgaaggcgaacaagaaggacctgaaggacatcccgctgaagattcgcaagcagctgcgcatcgtcccggtggagttcgtggacgacgtgctgcgcgaggcgctggtgctggagaagccggaggagttcggccgcaagccgacgacggacggcggcaagctgggtggcaccacggagctgccggcctcgccggccgtggccccggcctag

SEQ ID NO: 42905 - DNA, 1013 bp, Myxococcus xanthus
acgtacaggattgtctccctactgggacggggaggaatgggctcggtgtacctggcccaacacctgcggcttcccggcaagcaggtcgcggtcaaggtgctgcgtggcggcgaccacctgacgcccgaaatcttcgcgcgcttccgccgggaggcggagattgcctcgcggctgggccaccccaacatcgtcgaggtgctcgactacgacaccctggagaacggcaacccgttcctggtgctggagtacctgcgcggtgagagcctccaggagcgcctggcgcgcggacgcctgcccatggaggacgtggtctccttcacccggcagatgggctcggcgctccaggcggcgcacggcgcgggcgtcatccaccgcgacctcaagccagccaacgtgttcctggtgcccaccgactccggtggcgtggtgggcgagcgcgtgaagctgctcgacttcggcatctccaaggtcctcagctccacgacggtgcagacgcaggaggcgaccatcatcgggacgcctcagtacatgtcaccggagcaggcccaggggaagaaccgggacatcgacgcgcgcacggatgtcttcgcgctggggtgcatcgtctacgagatgatggccggcaaacccgtgttcggctcaggcagcctcgcccagatgatcttccgcgtcgtctatgagccgcccgaaccgctggccccgctctgtcccgaggccacgccggaggccatctccgcggtgatgcgcgcgctcgccaagggcgtggacgagcgctacccggacgtctcctccttcatcgaggacttgacgggcacgccgctgcactcgctgtccaccacggcgggcaatcagcccgccccgcgcccccaggccccggcgtccggaatcgcgctgccctccacggacccggcctcactctccgccaccgtcccgcccggaagcctgaaggtggcaccggacacgggccgcgagggcttcgattccacgatggcgcccggcaccggccagcaggg

SEQ ID NO: 42906 - DNA, 1916 bp, Myxococcus xanthus
atgtgcggcatcgtcggcgcggtttcccagcgcaacatcgttcccatcctcgtccagggcctgcagcgccttgagtaccgtggctatgactcctgcggcgtggccgtgcacgaggccagcatgggcaacaaccccatgggcggcctgcaccgcgcacgcagcacggcgcgcgtggccgagctgcaggcgcaggtcgatgccgaacatctgcagggcgcgaccggcatcgcccacacgcgctgggccacgcatggtgcgccggcggtgcacaacgcgcacccgcatttcagccacggccccaacgccgcgcctgccgagaccgaccgcgctggccgcgtcgcgctggtgcacaacggcatcatcgagaaccaccaggagctgcgccgcatgctgcaggcgcgtggctatgcgttctcgagccagaccgacaccgaggtcatcgcgcatctggtcgacagcctgtatgacggcgacctgttcgacgccgtgaaggcggccgtcgcgcaactgcacggggcctatgcgatcgcggtgatgcacaaggacgaaccgcaccgcgtggtcggcgcgcgcgccggatcgccgctggtgctgggcgtgggcgtgggcgagaacttcctcgcgagcgacgcgatggcgctggcgggcgtgaccgaccaggtcgtctatctgaaggagggcgatctcgtcgacctgcagcccggccgctactggctcgtcgatcacgacggccagcgattgagcgaggcacagcgccccgtgcgcaccgtacacgcacacagcggcgcggccgagctgggtccctaccgccactacatgcagaaggaaatcttcgagcagccacgtgcgatcgccgacacgctcgagggagtgcagggcatcgtgcccgagctgttcgacggccttgatgccgacggcaacacccgcacagccgcgtggcgcgtgttcaaggaaatcgactcggtgctgatcctcgcctgaggcaccagctaatacagcgcatgagcgtccaagaactggatggagtcctatcacgaagctcacagtgcaacgtggaagtcaccacagaataccgctaccgcaccagcgtgccgaacccgaagacgctggtagtcaccatcagtcaatccggcgaaacggcagacaccctggccgcgctgcgccatgcgcagagactgggcatgacgcacacgctcaccgtctgcaacgtggccaccagcgccatggtgcgcgaatgcgagctggcctacatcacgcgcgccggcgtcgagatcggcgtggcctccaccaaggcgttcaccacgcagttggcgggcctgttcctgctcacgctcgcgctcgcgcaatccaagggccacctgagccaggagcaggaagcgcaatacctcacctccatgcgccatctgcccgtcgcactgcaggccgtgctcgcactcgagccgcaggtcatcagctgggccgaagatttcgcgaagatggaaaatgcgctgttcctcgggcgcggcatccactacccgatcgcgctcgaaggcgcgctcaagctcaaggaaatcagctacatccacgccgaggcctaccccgcaggcgagctcaagcacggcccgctcgcgctggtcaccagcagcatgccggtggtcaccgtcgcgccgcacgacgagttgctcgaaaagctcaagaacaacatgcaggaagtgcgcgcgcgcggcggcgtgctctacgtgctggccgacggcgactcgcagatcgaaagcgaagacggcatccacgtgatccgcatgcccgagcactacggcgcgttgagcccgattttgcacgtcgtgccgctgcaactgctcgcctaccacacggccgtcgcacgcggcacggacgtggacaagccgcgcaatctggcgaagtctttgaccgtggagtgaggg

SEQ ID NO: 42907 - DNA, 906 bp, Myxococcus xanthus
ctgctccagttggaggggctcacgcgtcgcttcaaggggcgcacggccgtggatggcctgtccctgtcggtgcggccgggggagattctgggcctgctgggccccaatggcgctggcaagtccaccaccttccaggtgctggccgggctgctgtcccccgatgcgggcctcgttcgcttcgagggccgggagctgtcgctgagcgacccgtcgctgcgccggcagatgggcatcatcttccagcgcagcagcctggatgacctgctgaccgcgcgggagaacctgatgctcggcgcccggctgtatggcctgggcggagagcgggcccgcgaacgggtggaggcgatgctgtcgctcatcggcctggccgaccgtggcgacgaacgggtgtccacgtggtccggtggcatgcgccggcgcctggagctggcgcgggccctggtgcaccagccgcgcgtcctgctcatggacgagcccacacagggcctggatgaggcggccttccgtaccttctgggcacacctgaagcgcctgcgcgacagcgagggcctcacggtactgctcaccacgcaccgcgcggacgaggccgacgtctgtgaccggctggcggtgttggacgcgggcaagctggtggcgtgtgacacgccgcaggcgctggcctcgcgcatgggtggggacatcctctccgtggaggcgctcgagccggaggcgctggcgaccgagctgcgcgagcggctgaagctggacgcgaaggtggtggaggggcgggtgcaggtggaggccccgcggggccacgcgctggtgccccgattggtggaggccttccccgccgggcggctgacctccgtcgcgctgcgccggcccacgctggcggacgtgttcctccaattgacggggcgcgcgctg

SEQ ID NO: 42908 - DNA, 1338 bp, Myxococcus xanthus
aatcccttcaccggagacgtcgccgcttcggtcgagcccacgtcccccgtgaagctggacaccgtgctggagcgagcccgcgccgcgtcgcgcgcgctgcgcgccctgagcgtggcggagcgcgtgaagctggtgctgcgcgcgtgcgaggcgatggagaagaacgccgacgccatcgcacgggacatcacccggcagatgggcaagccgctgtcccaggcccggggtgaggtgggcggcatggcgggacgcctgcgccacatggccgccatcgccgaggaatccctcgcggacatcgtcctgccgcccaaggacggcttcgagcggagaatcgcgaaggagccgctgggcgtggtgctggacctgcccgcgtggaactaccctctcctcaccgcggtgaatgccatcgcgcccgccgtgctcgcgggcaacgcggtcatcgtgaagcactcgccgcgcacgcccctgtgcggtggccacttcgcgcgcgccttcgccgaaacaggcgcgcccgacggcgcggtgcaggccatcttcctggactacccggggacggagcagctcgtcggtgacgcgcgtgtggaccacgtcctcttcacgggctcggtgctcggcggccacaagatgcagacggccgcgcgcgagcgattcctccacatgggcctggagctgggaggcaacgacccggcctacgtcgcgccggactgtgacttcgacaagtcggtggagaacatcgtcgacggtgccatgtacaacgcggggcagagctgctgtgccgtggagcgggtgtacgtgcaccgctcgctgtacgagcgcttcgtcgccgccgcggagccactcgtgcgcgcctacgtgctgggcgacccggagtccgagcagacgacgatgggccccatcgcccagccctggcaccccgccgagttgcagtccttcgtccaggacgccacgaacctgggcgcacggctcgtcacgggtggccgcgcggcacaagtgggaggacggggccgcttcttcgaacccaccctgctccgcgacgtgagcccccaggcgcggctgatgcgtgaagagtccttcgggccgctgctgcccatcgcgccggtggactcggatgaggaggccctggcgctgatgaatgcctcgcggctgggcctcaccgcgagcgtgtggacgtccgaccgggagcgcgcggaccggctggcgcggcaactggaagcgggcaccgtctacatgaaccgctgtgacgcgctggaccccgctctgccatggagcggcgtgaaggactccggacgcggcgtgacgctgagcgcgctgggcttcgacgccctgacgcgacccaaa

SEQ ID NO: 42909 - DNA, 582 bp, Myxococcus xanthus
tcctcttctcgcggcatcctcttcgacctcgacggcacgctggtggactcgctgccggacatcatcgacagcttcctccacgccttcgggcacctggggcttccggcgccgacctacgagcaggtgcgtgcgctcatcggccatccgctggactggatgtacagccagttcgcgccggaccacgtccccgcgttgtgcgtggcctaccgtgagcactacccgctcaacttccaccggcgctcgcggccctatccgggcgtggtggaggtgctgcgcgcgctgcgcgagcggggctacctgctggcggtggccaccaccaagcgtcccgacatggcgcgcaagttcgtggacgccatgggcctgggcccgctgctccaccacgtccagggcacggatggctttccgcacaagcccgcgcccgacgtcatccaccacgcgctggcagccctgggcacgggcgggttgtggatggtgggggacaccgcgttggacttgcgcgcggggcaggccgcggggctgcggacctatgccgtcacctggggcacgcatccggtggacgtgctcgcgggcgcgtcaccggac

SEQ ID NO: 42910 - DNA, 759 bp, Myxococcus xanthus
aagaaccaagtcgtcgtcgtcaccggcgcgtccagtggcattggccgcgccaccgcgctggccctggcgaacaagggggcccacgtcgtcctggccgcccggcgcgaggagccgctggaggacctggctcgcgagtgccgggggctcggcgtccaggcccacgtcgtgcccacggacgtgtccgacgtggccgccgtgcagcacctagcggacgaggcgcgcaacgtcttcggccacttcgatgcgtggatcaacaacgcgggcgtctacctcatgggccgtctcgaagagacaccggatgacgccttccgacaggtgatggagacgaacttcttcggcactgtcagcggcgctcgcgccgccgtggcccagttccgccggcagggctacggcactctggtcaacgtctcctcgacctttggggcggtcgccgcgccgtatgtcagcgcctacgtggcctcgaagcacgccgtgcgcggcttctcggcgtctgtccgccaggaactgctcggcaccggcatcgacgtgtgtaccgtgctccccgcggccatcgacacgccgctgtggcaacacaccgccaactacaccggctggcgcatccgtcccgtggagcccgtctacacgccggagcgcgtcgcgcgcgccatcctccgggtcctccgcagccccaagcacgaggtcttcgtcggccccgccgctcggagcttcgccgccatgcacggcctgctgccccgcaccttcgagcgcaccatgaacggc

SEQ ID NO: 42911 - DNA, 858 bp, Myxococcus xanthus
tcggcctttggcgccggcaaggtcatcctgttgggtgagcacagcgtcgtgtacgggcacccggccctggccgggccgttgtcgcagggcgtgacggcgcgcgccgtgcccgcgaaggcgtgtcagctcgcgttgccctccacgctcagccgcccgcagcgggcgcagctcacggcggcgttcgcccgtgcggcggaggtgacgggcgcgccgccggtgaaggtgtcgctggaggcggacctgccgctggcggtgggcctgggaagctcggcggcgctgtcggtggcgtgcgcgcggttgctgctccaggcggcggggaaggtgcccacaccgaaggacgcggcgcgtgtggcgtgggcgatggagcaggagttccacggcacgccgtccggcgtggaccacaccaccagcgccgcggagcaactggtcctctactggcgcaagccgggggccgccaaggggacggggcaggtcgtggagagccccaggcccttgcacgtggtggtgacgctcgcgggtgagcgcagccccacgaagaagacggtgggcgcgctgcgggagcggcaggctcgctggccgtcgcgctacgagcgcctgttcgcggagattggacgggtgtcctcggagggcgcgaaggcggtggcggcgggagatttggaggcactgggcgacgcgatgaacgtcaaccagggcctgctcgcggcgctgggcctgtcgtcgccgccgttggaagagatggtctaccggttgcgggagctgggggcgctgggcgccaagctgaccggagctggtggagatggtggggccgtcattggcctgttcctggagcccaagcccgtggtgacgaagctcacccgg

SEQ ID NO: 42912 - DNA, 1047 bp, Myxococcus xanthus
aaagccacagctctggcgcatcccaacatcgccctggtgaagtactgggggaagcgggatgacgcgttgattctgccgcaccagtccagcctgtccctcacgctgtcaccgctgtcggtgacgaccacggtggagttcggcgccgcgagcgaccaggtggagctcaacgggcacaccgcgaagggcagcgagcgcgaccgcgtgctgcggcttctggagttggtgcgcgcccaggcgaaggccgacctgggccccgcgaaggtggtgtctcgcggggacttccccatggcggcggggttggccagcagcgcggcgggcttcgcggcgctggcggtggcgggacgcgcagcggcggggttgccgtcggagccccgcgcggccagcatcctggcgcgcatgggcagcggctcggcgtgccggagcgtgcagggtgggttctgcgagtggcagcgcggcgaacgtccggatggagaggacagcttcgcggtgcagcgcttcgacgcggcccactggccggacgtgcgcatggtggtggcgattctcgaccgcggcgagaaagaggtgaagtcgcgggacgggatgaagctcacggtggacaccagcccgtactacccggcgtgggtgaaggacgccgaggtggaggtcgtgcaggtgcgcgagcacatcgccaggcgcgacctgcaggccctgggtgagctgtgtgagcgcaacgcgtggcggatgcacgcgacgtcgttcgccgcgaatccgccgctgagctacatgagccccggcacgctggcgctcatcctgcacctgaaggagcagcgcaagaagggcatcccggtgtggttcacgctggacgcggggccaaacccggtgctgctgacggacgccgcgcacgaggtggccgcggaggcgctggcccgcgcgtgcggcgcgctggatgtgattcgctgcgtgcccggcggtgacgcggagctgaaggcggagcacctcttctgatggagcgcgccctctccgcgccggggaagctgttcctctccggggagtacgccgtgctgtggg

SEQ ID NO: 42913 - DNA, 300 bp, Myxococcus xanthus
caggaactctcggagaaggcccggcagctcgtcgctgaaggcgcggtgctgctggatgtgcgcacgccgcaggaatttcaggaagggcaccccgagcccgcccggaacatccccgtgcaggagctgccccgccggctggccgaggtgggcccgcccggcacgcccgtggtggtgtattgcgccgcgggtggccgcagcgcccaggccgtgcagttgctgcgcgccaacggcttcccggacgtcttcgacctcaaatccgtgaagaactggtagccaaccgggggcaggtgacacgggcgc

SEQ ID NO: 42914 - DNA, 2196 bp, Myxococcus xanthus
ctgcgcagcaccaacgaggagctccaggagaaggcgaagctgctctccgttcagaagacggaggtggagcgcaagaatggcgaggtggagcaggccaagctcgccctggaggagaaggccgaacagctgagcctcacgtccaagtacaagtccgagttcctggccaacatgagccacgagctgcgtacgccgctcaactcgctgctcatcctcagccagacgctcagtgacaacgtggatggcaacctcacgtcgcggcaggtggagttcgccaagacgattcacgcgtccggcgcggacctgctggagctcatcaacgacatcctcgacctgtcgaagattgaatccggcaccatggcggtggacgtgggtccgctgcgcttcggcgacttgcgcgagttcgtggaccgcaccttccggcaggtggcggacaaaaaggggttggagttccacatcggcctgggggattcactgcccggcgagctggagacggacgcgaagcgcctgcaacaggtgctcaagaacctgctgtccaacgccttcaagttcaccgagtccggctcggtgtcgctgcacatcggtctggcgaagggcggctggtctccggaccacgccatgttgtcctccgcgccctcggtggtcgccttcaccgtggcggacacaggcatcggcatcccgaaggacaagcatcaaatcatcttcgaggccttccagcaggcggatggctccaccgcccgcaagtacgggggcaccggcctgggcctgtccatcagccgtgaaatcgcgcgactgctcggcggcgaaatccggctggagagcgacgtgggcaggggcagcgccttcaccctctacctgccgctggccttcatggcggagcgtccgccggaggagcatgcgcgctgggactacaacccgctggccaccacggtgctccccgcgcccatcgcggagccagtctccgagtcgcgggtgtcttcgctgagccggatggacatcgacgatgaccggagctccatcctgcctggagacaaggtgctgctggccgtgacgcacctggcggaccatgccgcgcgcctgcgtgccgcggcgcagggcacgggcttcaagctgctggtgtctaccgaggtggaggacgcgctggacgccgtccgcaacacgcggccagcggccgtggcggtggacctggacctgccggagatggcgggctgggtggtgctggaccggctgaagcacgacgcgtccactcgcgcgctgccggtgtacacggtgtcggtggaggaccaccgcgagcgctcgctcaacctgggcgccattggccacctgcgcgcggcggcggacccggaggcggcggtggccgcgctggagtccctcaagcgcttcgtggagcgcaagggccgcgggctgctcgtggtggaggacgaccccgtccaccgccagacgctgacggagctcctgggcagtgatgacgtgcagacggtggcggtggggaccgcggcggaggccctggccgcgctggccgagcgccgcttcgactgcatggtgctggacctggggctgccggacatgcccggcacggagctcatccgccgcgtccatgaggcgcacggcgcgggcgggccgccgctcatcgtctacacgggccgcgagctgacgcgcgcccaggagacggagctgcggcgggtggccgaggccatcgtggtgaaggacgcgcagagcccggagcggctgctggaggagacgagcctgttcctccaccgctcgccctcggacctgaccgagcccaagcgccgcatgctggagaaggcgcgcgagaaggaccccttgctggtgaaccgcaaggtgctggtcgtggacgacgacgtgcgcaacatcttcgccctcaacaccgtgctggagcgctacggcatgaaggtggccttcgcggagagcgctcgcgagggactggaccagttggagaaggacgccgacatcgagctggtgctgatggacgtgatgatgccggagatggacggctaccaggccatgcgcgccatccgccgcatggagcgcttcgtccatctgcccatcctggccctcaccgccaaggccatgaagggggaccgggagaagtgcctggaggccggtgcgtccgactacatcaccaagccggtggacatcgagaagctgctcagcctgctgcgcgtgtggctgcacgcg

SEQ ID NO: 42915 - DNA, 1137 bp, Myxococcus xanthus
atggattttgaccttccagaaagccatcgcgccctccagtcctccatccgtgacttctgcgaacggcgggtgaagccgtatgcccgtgagtgggacaaggacgagacgttccccatggaagttgtccgggagctggggcagctcggggtgatgggcatgctcgtcgccgaggagttcggcggagcggccatggactcgctcgccgtggcggtggcggtggaagagatcgcccgctacgacggctcgctggcgctgacggtggccagccacaacggcctgggcaccagccacctgcgcgtcttcggttcggacgcgcagcgccagaagtacctgcccaagctggccacgggtgagtacctgggcgcatggggcctgacggagccggggtccggctcggacgcgtcgagcatgaagaccacggccatgcgcaagggcgacggctgggtactcaacggcgccaagatgttcatcacccagggcacggtgggtgacgtgttcgtggtgctggccgtcacctcgccgcagaagcggcagaagggcatcaccgccttcctgctggagaagggcctgccgggcttcagccagcgcgccatccacgggaagctgggcatgcgctcgtcggacacggccgagctcgtcctggagaacgtggaggtgccggactcggcgcgcgtgggtgagctggaccacggcttcatcgacacgatgaagatcctggaccgcggccgcatcaccatcggcgcgctggcggtgggtctgggccggggcgccctggaggagtccattggctactcgcgcgagcgcaccgcgttcggccagcccatcagcgagttccagggactgcgctggatgatggcggacatgaagacggagctggacgccgcccggctcctggtccaccgcgctgccaagctggccgacgaaggcaagccgtactcgcgcgaggcctccatggggaagctgttcgcctccgaggccgccatgcgggcttgcaacaaggccgtgcagatccacggtgggtacggttacacccgcgaattcccggtcgagcgctacctgcgcgacgccaagctgtgtgagatcggcgagggaaccagcgagatccagcgtacaatcatcgcccgggaaaccttcaaa

SEQ ID NO: 42916 - DNA, 1413 bp, Myxococcus xanthus
atgcaccacatgccgaggacaactggaatgaatgtcgccgtcgtgggaggtgggatttcggggttggccgtcgcgcatcatttgcgctcgcgcggtacggatgccgtgcttctggagtcctccgcccgacttggcggcgcggtgggcacgcatgcgctcgccggctacctggtggagcaggggcccaacagcttcctggaccgcgagcccgcaacgcgggcgctcgcggcggcgctgaatctggaggggcgaattcgcgccgcggacccggcggcgaagcgtcgctatgtctacacgcggggcagactccggtcggtaccggcctcgccgcccgcgtttctcgcatcggacattctgccgctcggcgcgcggttgcgcgtcgctggcgaactgttctcccgccgcgcgccggagggtgtggacgaatcgctggccgccttcggccgccgccacctgggacacagggcgacgcaggtgctgctcgacgcggtgcagacgggcatctacgcgggcgacgtggagcagctcagcgtcgcggccaccttccccatgctggtgaagatggagcgcgagcaccgcagcctcatcctgggcgccatccgcgcgcagaaggctcagcgccaggcggcgctccccgcgggaacggcgccgaagttgagcggcgcgctgagcacgttcgacggcggattgcaggtgctcatcgacgcgctcgccgcatcgttgggtgacgcggcgcacgtgggcgcgcgcgtggaggggctggcgcgcgaggacggcggttggaggctcatcatcgaggagcacggacgccgcgcggaactgtccgtggcccaggtggtactggcggcgcccgcgcatgccaccgcgaaattgctacgcccactggatgacgcgctcgccgccctggtggcgggtatcgcctatgcgcccatcgcggtggtgcacctgggcttcgacgcggggacacttccggcgccggatggctttgggttcctggtgccagcggaggagcagcggcggatgctgggcgccatccacgcgtccaccacctttcccttccgggccgagggcggacgcgtgctctattcctgcatggtggggggcgcgcgtcagccagggctggtggaacaggacgaggatgcattggcggcgctggcgcgcgaggaactgaaggcgctggcaggcgtgacggcgcgcccctccttcacgcgggtgttccgctggccgcttggcattccccagtacaacctgggacacctggagcgcgtggccgctatcgacgcggcgctgcaacgcttgcccggcctgcacctcatcgggaatgcgtacaagggcgtgggcctcaacgactgcatccgcaacgcggcgcaactcgcggacgccctggtcgcggggaacacctcccacgccccg

SEQ ID NO: 42917 - DNA, 822 bp, Myxococcus xanthus
acggcgaggctggacggaggcaaggtgctgcgctggagcctcctgcacgtgggagcgctggtcgggggcacctgtttcttctcgtggagcgcggtggcggtgttcgccgggatgaccgcggtgacgatgtgcctgggcgtgtcggtgggcctgcatcggggactcatccaccgggcctttcgtgcctcggcgcccgtggagcgcgcgttggcgctgctcggcaccctggccggcctgggcggccccatcgcgatgagccgcatgcatgacctgcgcgacttccaccagaaccagccggaagcggactgtcccccctacttcggctaccgcgagggcttcacgcgcgccatggcctacgccctcttccacacctggcacccgcgaagcggcgccgcggacgtgccagcggcgccccatgtcacgcaggacgtgttcttccgcgggctggagcgcgcgggcctgtggctccaggtgccgctcgccctggcgttgtacgcactgggcggggcgccctgggtggcctggggcatcctggtgcggctggcgctcacccaggacggcttctggtgcgtccattacgtgagccacgtggagggcgagcagccctacgaactgccgggctgcgccgaacagggacgcaacgccggctggctggcgctgctgagcatgggcgagtcgtggcacaacacccaccacgtctacccagcctcggcgcagatggggctcgggtggcggcagccggacccaggctggtgggccgtgcgcggactggccgcgctgcggctggtgcatgatgtgaagtcgctggcccacctgccgccg

SEQ ID NO: 42918 - DNA, 1170 bp, Myxococcus xanthus
gacgtcgtcatcgtgggcgcggcccgtacccccattggtgcctttcagggcgcgctcgccaagctgacggccccgcagctgggcgcgatcgcgatcaaggcggcgctggagcgcgcgggcgtgaagcccgaggccgttcaggaagtcatcctgggctgtgtgctcaccgcgggcgtgggccaggcgcccgctcgccaggcggccatcttcgccggcctgcccgagacggttcccgccaccacgctcaacaaggtctgtggctccggcctcaaggccgtcagcgcgggcgcgcaggccattgccctgggtgacgcggacgtcgtcgtcgtgggcggcatggagtccatgagcaacgcgccgtacatcagccacacgatgcgtggcggcgcgcgcatgggcaacgtggaattcaaggacgcgatgatccacgacggcctctgggacgtgtacggcaacgtccacatgggcatctgcgccgaggagtgcgccacgacgcaggacatcagccgctcgcagcaggacgagtacgcgctggagtccacgcgccgcgccatccaggcccagaaggaaggcctgttcaaggcggagatcgtcccggtccagattccgggcaagaagccggaggacgtcgtcaccgtctccgacgacgaggggccccgcaacgcgaagccggagaagattccgggcctgaagccggtgttcaagaaggacggcacggtgacggccgccaacgcgtcctccatcaacgacggcgccgcggcgctggtgctgatgagcgaggagcgcgcgaaggccgagggccgcgccatcctgggccgcatcacgggctacgcccaggcggcgcgcaagccggtggagttcaccatcgcgcccacggacgccatcaacaagctgctgaagaagcagggcatcagcgcgggtgacgtggacctctgggagatcaacgaggcgttcgcggtggtgtccatcgcgaacaaccggctgctcggcctggacgtgtcgaaagtgaacgtgcgcggcggcgcggtggcgctggggcacccgattggcgcgtccggcgcgcgcgtgctggtgacgctgctgcagacgatgcaggacctggacaagaagcgtggcgtcgcgtcgctctgcatcggcggcggcgagggcatcgcgctgatggtggagcgc

SEQ ID NO: 42919 - DNA, 819 bp, Myxococcus xanthus
atggatgggaaggtgtgcctcatcaccggggccaccggcggcatcggcctggaggccgccaaggcgctcgcgcgcatgggcgccacggtggtgctggtgggccgggacgcgggccgcaccgaggcggccgtggccgccgtgaaggaggccgcccccagcgcccaggtggactggctccgcgccgacctcgcctccctgaagtccgtgcgggagctggcgcagaccttccgctcccgctacccgcgcctggacgtgctgctcaacaacgcggggctcatcatcgaccggcggcaggtgacggaggacgggctggaggccaccatggccaccaaccacttcgcgcccttcctcctgacgaacctgctgctggacgtgatgaaggccaccggcccggcccgcatcatcaacgtctcgtccgatgcccacgccgcgggcaagctcgacttcgatgacctgcagagcgagcgcggcttcatcggcttccgcgtgtacggcacgtcgaagctggccaacatcctgttcacccgcgcgctggcgaagcggctggagggtacgcaggtgacgaccaacgccctgcaccccggcgtggtgcgcacgggcttcggtcacaacacccagggcttcttccgccacctcgtcaagctgggcgcggcgttcatgatttcggcggagaagggagcgcggacgtccgtgtatctggcgtcctcgcccgaagtggaggcagtgtccgggcagtacttctacaaatgccgtccgaagaagccgtcctccgccgcgcggaacgacgcgctcgcggagcggctctggcaggtgagcgag

SEQ ID NO: 42920 - DNA, 612 bp, Myxococcus xanthus
atgatcgacctctacacgttcgcgacgcccaacggacagaaggtatccatcgccctggaggagctgggcctccagtacaagacgcatgtggtggacatcaccaagggcgagcagttcaagcccgagttcctggacatcaaccccaacaacaagattccggccatcgtcgaccacgcgacgcaggaccaccgtccgctcaaggtcttcgagtccggcgccatcctcatctacctggcggagaagacgggccagctgctgccctccaaccagcgcggccgggcggaagtgatggagtggctgatgttccagatgggcggcgtggggcccatgttcggccagctctaccacttcgcccgcttcgcccccaagaaggtcccctacggcatcgagcgttatcacgccgagtcccggcggctcgtcggcgtgctcgacgggaagctgggctccggggattacgtcgcgggccgctactccatcgcggacatcgcgctgtatccctgggtggccggcgcccgcgcgagcttccccgagctgttccgggggaacagcaacgtcgtgcagtggctccaccgcgtgggcagccggcccgccgtggagcgcggcatgaaggtc

SEQ ID NO: 42921 - DNA, 2652 bp, Myxococcus xanthus
accgtggatcagccgctgcgccgggatgtccgcctgcttggccggctcctgggagaagtcctcgtcgaacaggaagggcaggcgctcttcgacctggaagaagaagtgcgccgcctcgccatccagcgccgccgaggccccgtggccggccggcgcgcggtggcggccgagctggcggaggtgctccaacgcctgccgctggaacgggccgagccggtgctgcgcgccttctccgtctacttccagttggtgaacctggcggagcagcaccaccgcatccgccgcgcccgcacccacgcggaggtcgcgtccgccaagccccagcgtggttcgctggaggctacgctgcaagtgctcaaggaagcgggcatccccgcggagcgcgtgcgcgaggccatgcgcaccatgcgcgtgacgctgacgctcaccgcgcaccccacgcaggccgtgcgccgcacgctgctggagaagctctaccgcatggcgggcctgctggaggagcgggaccgctgcgagctgacgccgcgcgagtcctcggtgaacctggcgctgctgcgcgaggaaatcaccctcctgtggcagacggacgagctgcgccgcgagcgccccaccgtgggtgacgaggtgaagaacgtcctctggtacgtggaggaggtgctcgccgacgagctgtccctgctccccgagctgctggactgggccttcgagcgcgcctacggcgagccgctggggccggtggacacgcccgtgcgcatccactcatgggtgggcggggacatggatggcaacccgctggtgacgcccgacgtgttcgcggacacgctgcgcgcgcaccgggcccgaggactgcgacggttgctgcttgacctggagcggttgggcgggcggctgtcccagtcggcgcgtcacgcgaagccgtccgaggagctgctgagctcggtggcgaaggacgcggaggagctgcccgacaccgagcgccgctacggtccccgtaccccgggcgagccgctgcggcacaagctgcgcttcatggaggagcggctgcaccgtgcgctccactacgtgacgcagcagcgcgccgggacgagcgtccccatgccgcagggcgcctaccgcacgccggaggccttgctggcggacctggacgtgctgggccgcgcgctggaggcgtcgaagggcacgcacgcgggacttcgcgacgtgcggcaggtccgggagcgggtgctcgcgctgggactgtcgttggcggagctggaggtgcgcgcgccggccgaggacgcggtgagcgcggcgggctcgttcaacgggggcccggcgccgacggaaggtggggcgcggctcctggaagtgctggcgcggctgaaggaggcccagtcggagtcgggtgagtccgcgtgccgcacgctcatcctcagcatggccagcaccgccgaggacgtgctcgcggccttccgctgcttgaagcacgcgggcctgtgggacgagaagcggggctgcgccacggcgaatgtggtgccgctgttcgagcagttgggcgcgctggactcgggcccggacgtgctgcgcacgctcttcgcggacgcggagtaccgcaagcacctggacgtgcgcggtggccaggaagtgatggtgggctacagcgactccggcaaggaggtggggctcctggcggccagcgcggcgctgtaccgcgcgcaggtggcgctcacggaggtgtctcgtgaggcgggcgtcccgctgcgactcttccacggccgcggcgagtccgtggcgcgtggcggtggtcccgcgcaggaggcgattctcgcgctgccgccgggcgcggtggcgggtggctacaaggcgacggagcagggcgaggcgctggaccacaagtacgcgcgcccggagctggcgcggcgcacggtggagctcatcctgggcggcgtgctgctgcacacgctggatgcgcagccgcgaccggagcccgaggccgagcgcaccttccgcaccgtgttcgacacgctggcggagacggggcgcaaggcgtatcgcgccctggtgtgggaggacccacggttcctggagttcttcaccgccgcgacgccggtggaggagattgcgtcgctgcccatcggctcgcgccccagcaagcgcagggcgggaggcctggacacgctgcgcgcgattccgtgggtcttcgcctggacgcaaaaccgggccatcctcccgggctggtacggcgtgggctcggcgctggaggccttctcgaaggaggagggtggggcggcgcagctcaagcgcatgtaccaggagtggcccttcttccgcgccgtcatcgacaacgtcaccatggtgctggcgaagtcggacatggccatcgccgggcgttacgcgtcgctggcgcctcccgccacccgttcgctgtggcggcgcatccagcaggagcaccggcgcacgcgcaggcaggtgaagcggctgacgggcgagtcgaagctgctcgacaacaacccgcagctccagcgcagcatctccctgcgcaacccctatgtggaccccatgtccttcctccaggtggagctgctcaagcgcaagcgcgagggccaggcggaggtggatcgtccactgttgctcacgctcaacggcatcgccgccggcatgcgcaacaccggg

SEQ ID NO: 42922 - DNA, 651 bp, Myxococcus xanthus
atcgaggtccagcacctcacgaagcgataccgagaccgggtggccgtggacgacctcaccttccaggtcgaggcgggtgagattctcgggttcctgggccccaacggggcgggcaagtccaccaccatgaaaatcctcaccggcttcctcccgccgtcggagggggtggtccgcgtcgggggctatgacgtggaggcccagccgctcgaggtgaagcgccgcatcggctacctgccggagatgccgccgctctatgtggagatgacggtgcgaggctatctgcgcttcgtcgcctcgttgaaggggctgtcggggagcgccctcaaggccgagttggagcgggtggccgcactcatgggcgtgacgcacgtcatggaccgcgtcatccagaacctgtccaagggctacaagcagcgtgtgggaattgcccaggcgctgctcggctccccgccggtgctcatcctggacgaacccaccgaaggcctggaccccgcacagcgcgccgagctgcgcgccctcatcaagggcctggccggcaagcacaccgtcatcctctccacgcacatcctcccggaggtcacgatgacgtgccagaaggtgctcatcatccaccagggaaagatggccgcgtacgacgacatctcccaactg

SEQ ID NO: 42923 - DNA, 2649 bp, Myxococcus xanthus
attgcctccctgacccccatgatgcgccagtacatggaggtgaaggcgctccacccggactcgctgctgttcttccggttgggtgacttctacgagatgttcttcgaggacgcggtgaaggcctcggagatcctccagatcacgctcaccgcgaggtccaagggcgcggacaaggtgcccatgtgtggggtgccctatcatgccgcgcggcgctacatcggccggctcgtgtcggaagggctgaaggtcgccatctgcgaacaggtggaggagccgggcaacgggccgggcatcgtccgccgggaagtcacgcgggtgattaccccgggcatggtgctggacgaagaggtgctggagccgcaggccagcaacttcctggccgccgtgtcctggaacgacaagggctggggcgcggcgctgctggaggcgtccaccggcgagttcatggccctggaggccccgggcatcgcggagctggcggagtcgctgtcgcgcgtggagccccgtgaactgctggtgccggacgggaagcgggacgcgccggaggtggcgcagctgctcgcccggctggtacgcacgccggcggtagcggagggcgaggccgcgtcattcgaacccacgcgggcggcgggctacctgcgcagccatttcgcggtgcagtcgctgtccgcattcgggctggatgacgcgcccctggccgcgggcgccgcgggcgctgcgctgcgctacctgaaggacacgcagaagacggcggcggcgcacgtggaccggctgagccggcaggagcgcggcggcaacctcctcatggatgagtcctcccgggccaacctggaggtactgcgctcgctgcgggacggtgggcgcaagggctcgctgctgggcgtgttggacaagacggtgacgagcctgggcgcgcgcaagctggcgcggtggctggcgtctccgctgggctccctgccggaaatccacgcgcggctggacgcggtggaggagctgtccgggcgcagcgtgtggcgcgaggagctcgctggcatcctcaaggaagtaggagacctggagcggctgtgcggccggctgtcgctgggcgcgggcaatgcacgggacttgcgcgcgctgggcttgtcgctggcgcagcttccccgggtggtggcggtgctggcgcggtgtgagtccccgctgctcaagtccctgacggggcccctttccgcgctgccggagctggcggagctgctgtcgcgcgccgtggcggaagagccgccggtgacgctgaaggacggcggcatgattcgcgccggcttccacgcggagctggacaagctggtggcgctgtccacgtccggaaaggacctgctgcttcagatcgagcagcgggagaaggagcgcaccggcatctcctcgctgaaggtccgctacaacaaggtcttcggctactacctggaggtgacgaagtcgaacctcgaccgggtgcccaaggattacatccgcaagcagacaacggtgaactccgagcgcttcgtcaccccggagctgaaggagtacgaggagcaggtgctcaccgccgaggagcggcggtgcgcgctggaaattcagctcttcgaggagctgcgcgcgcaggtggtgtcggcggcgccgcgcatccggtccgccgcggaggcggtggccactggggacgcgctgctgtccttcgcgcggtgcgcggcggagtacggctacacgcggccggaggtggacgcgtccgtggcgctcagcatcaccgccgggcggcacccggtggtggagcgcatgctgggggcgggggattcgttcgttcccaacgacgtccgcctggatccggcggaggacgcgcagctgatggtgattaccggtccgaacatggccggcaagagcacggtgatgcggcaggtcgcgctgacggcgctgatggcgcaggcgggctcgttcgttccggcgaaggcggcgcgcatcggcctgtgcgatcgcatcttcacgcgcgtgggcgcggcggacaacctggcgcgcggtcagtccaccttcatggtggagatgacggagaccagccacatcctccaccacgccacgaacaagagcctcatcatcctggatgagattggacgtggcacgtccaccttcgacgggctctccatcgcctgggcggtggcggagcacctgcacgacacggtgggggctcgcgcgctgttcgccacgcactaccacgagctggtggacctggcccgcgagcggccccgggtgaagaacctgtgcgtcgccgtgaaggagcagaacggcaaggtcatcttcctgcgcaagctggtgccgggtggggccagccgctcctatggcatcgaggtggcgaagctggcgggcctgcctccggaggtcgtggggcgcgcgcgtgagttgctccagaacctggagtccggggagctggatgacgcgggccggccccgggtggccgtgcggcagccccagggcggccggcgtggggcttcgaccgggcagcttggactgttcggcatggagccggcgcagggtggcaccggggtgacgcccgcgcagcagaaggcgctggacgcgttgaagggggcgagcatcgaccggatgacgcccctggacgcgctcaacctgctggcgaagctccagcgcgagctg

SEQ ID NO: 42924 - DNA, 855 bp, Myxococcus xanthus
ctctggactggtgtcctccccgccatcaccacccccttcaacacggacctgtccgtcgaccacggcacggtgcgctcacacgtgcgctggctggtgtcgcagggatgcactggcatcatcccctgcggctcactgggcgagggcgcgacgctgagccaggaggagaaggccgcggtgatgcgcacgtgcgtggacgcggtgaaggtgcccgtcatcccgggcatcgccgccctgtccacggcggaggccgtgcagctggctcgcgccgcggaggaggcgggctgcgccgggctgatggtgttgcccccgtatgtctattccagcgactggcgcgagatgaaggcccacatctccgccgtcctgcgcgccacgaagctgccgtgcctgctctacaacaaccccgtcgcctacaagacggacttcacccccgcccatctcgcggagctggccgccgagcatgacaacgcggtcgccgtgaaggagtcctccaccgacgcccgtcgcgtcaccgccatccgcgccctcctgggagaccggctggccgtgggcgtgggcgtggacgactgcctcgtcgagggcgtggacgcgggcgcgcgcttctgggtggcggggctggtcaatgcgttccccgccgagtccgtgcgactgttcgagctggccctcgccggaaagaagcaggccgcgttcgagctgtaccgctggttcctgccgctcttgcgcctggacaccgtcaccaagttcatccagctcatcaagctggtccagcaggaagtcggctggggccacgagcgggtgcgtgggcctcggctggagctggcgggtgccgagcgcgaggagtgcctgcgcgtgctgcgc

SEQ ID NO: 42925 - DNA, 1008 bp, Myxococcus xanthus
atggctacccggattgccatcaatggttttggccgcatcggtcgctgcatcctccgcgcggtgctcagccgcaaggaagacctcgagattgtcgccatcaacgacctcgacaagcccgcggcgctggcgcacctgttcaagtacgactccgtgcaccgcacctggccgggtgaggtgaaggcgacggagaagggcatcgtggtggacggcaaggagatcaccgtcaccgcggagaaggacccgacggcgctgccctggaagagcctgaacgtggacgtggtgctggagtgcaccggccgcttcaccgcgcgcgacgcggcggagaagcacctgaaggcgggcgcgaagaaggtcatcatctccgccccggccaagggcccggacatcaccatcgcttacggcatcaaccacaacgagtacgacccggccaagcaccacgtcatctcgaacgcctcgtgcaccaccaactgcctggcgcccatcgccaaggtgctggtggacaacttcggcatcgagaagggcctgatgaccacggtccacagctacaccaacgaccagcgcatcctggacctcacccacgaggacatgcgccgcgcccgcgccgccgcgctctccatgattcccaccagcaccggcgccgcgaaggccattggtgaggtgattccgcagctcaagggcaagatgcacggcctggccgtccgcgtgccgaccccgaacgtgtccctggtggacctgacggtgaacaccgagaagaaggtcaccgccgaggccgtcatcgaggccttccgcaaggccgccgaaggcccgctcaagggcgtgctggagttcagcgacgcgcagacggtgtcggtggactacaacggcaacccgcactcggccatcttcgactccaccaactgcttcgtgatgggcgacaacctgctcaaggtcatggcctggtacgacaacgagtggggcttctccaaccgcatggtggacacggcgaagttcctcgtctccaagggcgtc

SEQ ID NO: 42926 - DNA, 1947 bp, Myxococcus xanthus
atcgatgatctgcagctgaccgggaagcgcgtcttcatccgcgtggacttcaacgtcccgatggaaggacggcgcgtgaccgacgacacccgcatccgcgaggcgatgcccaccatccggcgcgcgctcgaaatgggcgggaaggtcatcctggcctcccacctcggccgccccaagggaccggacccgaagctgtcgctggagcctgtcgccgtgcggctcgccgagctgctcggcggcaagcacgaagtcatcctcaccgacgactgcgtcggtgacggcgtgaagaagcaggtgaaggagctcaaggacggccaggtggtcgtcctggagaacctccgcttccacaaggaagaggaggccaacgacgagacgttcgcccgcgagctggcggcgctggcggacgtctatgtcaacgacgccttcggcaccgcccaccgcgcccacgcgtccaccgcgggcatggtgcccttcgtgaaggagaaggcggccggcttcctgatgcggaaggaaatcgagtacctgggcaaggtgctcaagaacccggacaagcccttcgtggccatcctgggtggctcgaaggtgagcgacaaaatcaaggtcatcgagagcctgctgcccaaggtggacgcgctgctcgtcggtggcgccatggcgtacaccttcctgaaggcgcagggcgtcgaggtgggcaagtcccgcgtcgagggcgacaagctgtcgctggccacgcgtctgctggaggctgcgcaccggttcaagacgcagctggtcctgccggtggaccacatcgtgggcaccgagcccacggagaacagccccgccacggagacgccggacaacgcgattccgccggacatgatgggcctggacatcggtcccaagacgcgcgccatcttcgcgcagcacatccgcgatgcgaggacggtggtgtggaacgggcccatgggcctgttcgaggtccccaagttcgccgagggcactcgctccgtcgccgcggccatggccatcaacacgcaggccaccaccgtcatcggcggcggggacagcgcggcggccgtggagcagatgggcttcgcggacaagatgagccatgtgtccactggtggaggggcgtccttggaattcctggaaggacgcgacttgccgggcatcaaggcgctggagacgcggtaggctccgcgtccgacacaccacacacccctgggggacaccatggccaccgcgcgtcgtcggaagatcgttgctggcaactggaagatgaacaagtcggtaccggaggcgctggccctggtgcgcgacctgcgagggcaggtggcttccctgggggacaccgtggaggtggtggtggcgccgccgttcgtggcgctgcagccgctgcatgtcgcgctggaaggcgcgccgctggcgctggcggcgcagaattgtcactgggagtcctcgggcgccttcacgggtgagatttccgcgccgatgctggccgagctggggtgcgcctacgtcatcgtggggcactccgagcgccggcagctcttcggggacacggacgagcaggtgaacaagcgggcgaaggcggtccgcgcggcggggatgacgcccatcatctgcgtgggcgagacactggccgagcgcgaggcgaaccagacgctggcggtggtggagcgtcaggtgcgcggggcgctggagggcttcggggccaaggaggtggcgggtttcgtgctggcctacgagccggtgtgggccattgggacggggcgcaacgccacggcggcgcaggcgcaggaggtccacgcggcgatccgggggctggtcgagcgcctgtatgacggggagacggccgggcgggtgcgcatccagtacggcggcagcgtgaagccggacaacgccgcggaattgctgggccagccggacgttgacggggcgcttgtcgggggcgcgagcctgaag

SEQ ID NO: 42927 - DNA, 822 bp, Myxococcus xanthus
gtgattgccagcgcggtccgcacgcccttcacccgcgcgcacaagggagagttcaaggacacccggccggataccctggccgctgtcgccatcaaggaggccgttgcccaggtcccgggcctgaagccggaggacatcggtgacgtcgtcctgggctgtgccatgccggaggccgagcagggcatgaacgtggcccgcgtggccacgctgctggcgggcctgcccgtcacggtgcccgcgatgaccatcaaccggttctgttcctccggttcgcaggccatcgcccaggtggcccaggccatccaggcggggatgtacgacgtgggcatcggtggtggcaccgagtccatgacgatggtccccatgggcggcaacaaggcgagcgccaaccccgaggccatggagcgcctgccggagatctacacctccatgggcgccacggcggagaacatcgcgtcgcgctacggcgtgtcgcgtgaggactcggacaagttcgccgccgagagccagcgccgtgccgccaccgcgcgcgagcagggcaagttcaaggaggagatcgtccccgtcaccacgacgtactacgacgacgacggcgtggcgcagaacgtcaccgtcacggtggacaccatcctccgcccggagaccacgcaggagggcctggccaagctgcgcccggccttcaaccccaagggcgtggtgacggctggtaacgcgtcgccgctgacggacggcgccgccgccgcggtggtgatgagtgaggccaaggcgaaggagctgggcgtcaagccgctgggctacttcatcgacgccgcggtggcgggc

SEQ ID NO: 42928 - DNA, 1721 bp, Myxococcus xanthus
ccatggctcgcctcgacccgcactcgtacaacgacagcacgcagcctgagacggaaaccctggactggagggcccgcgtcgatttcaagacgcagcggctgcacgcggaggtcacccacaccctcaaggaagcctcggccgggccgctggacctggatacccgggatttggaaatccgtgacgtcatcgacgccgcgggtcgtcccttgccctacatcctctccccttccgagccgattctcggcagccggctgcgcatcgagctgccggtgggactgcggcaattcaccgtgcgctaccgcacggcgccgcacgccagcgcgctccagtggctgacgccctcccagacggccggggggaagcaccccttcctctacagccagtgccaggccatccacgcccgaagcgtggtgccgctccaggacacgccgcgcatccgcatccgctacaccgcgtcgctgcggattcccaaggcgctcaaggccgtcatggccgccagcttcctgcggcgcgaggagcatggcgtggaggcggaggagcactacgagatgccccagccggtgcctccgtacctgctggccttcgcggtgggcagcctggcgccgaaggagctggggccgcgctcgcgcgtgtgggcggagccggagctgctggaggacgcggcggaggagttctccggcgtggacgacatgctgcgcgccgccgagtcgctcttcgggccctatgactgggagcgcttcgacctgctcaccatgccgccatcgttcccctacggcggcatggagaacccgcgcctgacgttcctcacgcccacgctcatcaccggagacaagagcctggtcaacgtggtggcgcacgagttggcgcactcgtggacgggcaacctggtgacgaacgcctccgcggagcacttctggctcaacgagggcttcaccgtcttcgccgagcgccgcatcctggaggtcctggagggtccggaagtgtcggcgctgcacggcgcgctgggccgccgcgcgctggactccgcgctgcagcacttccgcgcgcacccgcagctgacgtcgctgcgcacccacctggccggcgtggacccggacgaggccttctcccagattccctacgagaagggctacctgctgctgcgcgccatggaggacgcggccgggcggcccgccttcgacgagttcctccgccgctacctggccacctaccgcttccgcgcgctcaccaccgaggagttcgtcgccttcgcggagaaggaactgcccggcgtgctgaccaaggtggacgcggaggcatacctgcaccggcccggcgtgccccccggggcgccgtcaccgcgctccctgcggctggaggccatggacgcgctgcgcggcaaggtgcccacgccggagcaggcgaaggactggacgccggccgagtggcagctctacctggagtcactgccctgggacattccacgggacgtcatccagcaactcgacgcgcgcttcagcctcaccgagagccgcaactcggaggtgctggtggcgtggctggtggtggcgctgcgcgcggactgggagccggccgtggctcgcaccgagacgttcctcggcgaggtgggccggatgaagtacctcaagccgctgtacggggtgctctccgcgtcgcatgcgcaccggagtctggcgcgcgcgctcttcaagaagcacggggagcgctaccaccccatcgcc

SEQ ID NO: 42929 - DNA, 1503 bp, Myxococcus xanthus
tggtccaatctggagcgccgaatccgggcgctcgttcccgaggcgttcgacccgacgggccgagtgctcaacctcatcgcgggtgaatgggggcatcccggaaaggggaagccctacctgtccccggttgacggcaccgtcctgggccgcctgcccatgattgatgcgaacaccgcgcgcgtcgccgcgagcgccgccgccgcggaggcacggacctgggcccaccaggacctcgatgcgcgcaaggagcgcgtcacccagtgcctgtccctgctgcgtgagcagcgcgagctgttggctctcatcctggcctgggagattggcaagccggtgccacaggctcgcgtcagcgtggaccgctgtatctctggcgtggagtggtacgtctcccaaatcgagcccatggtggagggccgccgtccgctggggctcatctccaacatcgcttcatggaactacccactgtcggtgctggtccacgcggtgctggtccaggtgctcgcgggcaacagcgccatcgccaagacgcccacggatggtggtctctactcgctgacgctctgcatggggctcgcgcgccgctgcgggctgcctgtgtcgctcatcagtggctcgggcggacagctcagcgacgcgctggtgcgcaatccggagatcgcctgcctgtccttcgtgggcggcaaggcgaacgggcgggacatcgccgccagcctctatgaccgcaacaagcgctacatgctggagatggaaggggtgaatgcctacggcatctggcacttcagcgactgggacgggctggcgaagcagctcaagaagggcttcgagtacggcaagcagcgctgcaccgcgtacccgcgcttcgtcgtggagcggagcctgatgccgcgcttcctggagacgtacctgcccgtcgtctccgccctgaaggtggggcacccgctgctggcggagtcaccggatggcgagcctcccgcgctcgacttcggcccgctcatcaacagccagaaggtcgaggagcttcacggccatatgagtgaggcagagggccgcggcgccgtgcccctcttcgccgggcggctggacgcggagcgcttcctgccggaccaggacgtctccgcgtacctggccccgcacgcgctgctgcacgtgccgcgcaactgcaagctctaccacggcgagcccttcggccccgtggacacgctggtcgtcgtggacagcgaggaggagctcatcgcggagatgaacgtgtccaacggctcgctggtcgcctccatcgcctgcgacgagcccgacacgtgcaagcgcgtctccaccgagctgcgggccttcaaggtcggccacaacgggccgcgctcgcgcggagaccgggacgaggtcttcggcggcatcggtggttcgtggaaggggtgcttcgtgggcggcaagtacctggtccaggccgtcaccgagggcgaacccggcgagcggctgcacggcaacttccacgactacacgcagctcccc

SEQ ID NO: 42930 - DNA, 1419 bp, Myxococcus xanthus
ctggctgaacgttatccgtactacctggccaaccggccccggcagcccaacgcggagctggccgtcacccacaagtactcgggcgaggtcgtgacgcacgtcgcggtcgcggacgccgcggctgtcgaggaagccatcgccgccgccgtgcgcgccgccgagcccatgcggaagctggcgccgtacgcgcggcaggcggtgctcgaacactgcgtgcgccgcttccgcgaacgcgcggaggagctggccctggcgctctgcatcgaagcaggcaagccgctgcgcgacgcgcgaggagaggtggaccggctcatcgacaccttcaaggccgccgccgaggaggccgtgcgcggcgggggcgaggtgctgaacctggaggtgtcgaagcgcgccgcgggctaccggggtttcacccagcgcgtgccggtggggccgtgctcgttcatcaccccgttcaacttcccgctcaacctggtggcgcacaaggtggcgccggccatcgccgcgggctgcccgttcatcctcaagccttcggaccgcacgccggtgagcgcgctcatcatggcggagatcctggcggagacggagctgcccgagggggcattctccgtgctgcccgtgcggctggaggacatcgggccgctcatcgaggacgaccggctgaagctgctctcgttcacgggctcggagaaggtgggctgggagctgaaggcgcgggcgggccggaagaaggtggtgctggagctgggcggcaacgcggcgtgcgtggtggacgaggcgccgggcgcgccgctggacttcatcgcggaccgggtggcgcagggggccttcttccaggcagggcagagctgcatctcggtgcagcgcgtgctggtccatgcgtcgctgtacgacgcgctccgggagaagctcgtcgaacgggcgaaggctttgcggccgggtcatccgtcggacgaggccacgacgctggggcccatgattgacgagcccgcggcgcggcgcctggagggctggattcagcaagccgtacagcgtggagcgcgggtcctcgcgggtggcggacggcggggctcggtgctcgatgccacggtgttggagggggttccagaggatgcatcgctgagcagcgaggaggccttcggtccggtcgtcctgctccagccctttgacagcttcgacgaggctctggcccaggtgaacagcgggcgcttcggactccaggcgggcctcttcacgcaggacctgtcgcgggcgatgaaggcgtgggacgaactggaggtgggcggagtcgtcgtgggcgatgtgccgagcttccgcgtcgacaccatgccctacgggggcgtgaagggctcaggcatcggccgcgagggcgtgaagtacgccatcgaggacatgacggagcttcggctgctggtgctg

SEQ ID NO: 42931 - DNA, 1284 bp, Myxococcus xanthus
gacaaggcgcacgtctggcatccctacacggcgatggaggcctacatcgcggagacggatccgctggtggtggtgcgctcggaaggggcgtacctccatgacgcggacggcacgcgctatctggacgccaacggctcctggtgggtgtccacgctgggccaccgtcacccgcgcttgatgcgcgcgctcgccgagcaggccgccgcactcccacacgtctccctggcgggcatcacccacgagccggcggccttgctggcgtcggagctggcggccatcgcccccggctcggaccgccccggccttccctcatccgagcggctgtcccgcgtcttctattccgacaacggcagcacggcggtggaggtggccatcaagatggcggcccagtactgggcgcagaatggccagccgcgccgcacccgcttcatcacgctgtcgggggcattccacggcgagacgatgggcgccaccagcgtggggggcgttcccctgttccgggaggtcttcggcccgctgctcttcgacgtggtgcacgtcccctctccagcggaggaggggggctgggcgcgcgccttcgagcaagtccagtccaccctgcgggcgcacccggaggtgattgcgggcgtcattttggagccggtgctgcagggcgcggcgggcatggtgatgtactcgccagacttcgtccgggcggtacgtgaggccacgagcgaggtggataccttcctcatcgccgacgaggtcttcacggggctggggcgcacgggcgcacgcttcgcggtggacctggcgggcgtggtgccggacatgctgtgtctggcgaaggccctctcgggaggaatcctgccgtttggcgccaccctggcctcggagcgcgtcttctccggcttcctcggggcgtcgaaccgggcgctgtattacgggcactcgtactgtgggaacccgttgggcgccgccatcgcccgggaagtgctggccgtctaccgggacgaggatgtgatggggcaggtggctcgaaaggccccccgcgtgaaagccgccttcgagcggatggccgcctcgattccgggcctggttcgcccccgcgccgtgggaatggtaggcgcggtggacctgggcggtggtggttacctcgctcggggagggtggcgagtgtacgaggccgcgcgtcgccgagggctctacctgcggcccatgggagacaccgtgtacatcgcgccggcactgactatctctgacgaggcgctcgaggagctgctgtccggagtggaagcgtcactc

SEQ ID NO: 42932 - DNA, 1215 bp, Myxococcus xanthus
ttcgagcccagtgagcgagccaaggactacctggagcgcgtgaagcgcttcatgagcgagcacatcctgccggcggaggcccgctatcacgaagagctccgagccaccgcccagggcggcgactggaagacgtggcgcgtgccccccgtcatggaggaactgaaggccctggcgaagacccagggtctgtggaacctgttcctccccgacgagaagctcggcgccgggctcagcacgctggagtacgcccccatcgccgaggagaccggtcgcagcttcatcgcccccgaggtcttcaactgcagcgccccggacaccggcaacatggaggtgctctggaagtacggctccgaggcgcagcaggagcgctggctgaagccgctgctggccggagacatccgctcggtgttctgcatgacggagccggatgtggcctcgtcggatgccaccaacatggcggccaccgccatcgtcgacggcgacgaggtcgtcctcaatggcagcaagtggtggtccagcgggctggggcaccccaacgcgaaggtggtcatcttcatggcccgcacgcccgacaccggaggggaccgccatcaccagcactccatggtgctggtgccactggacgcgccgggcgtgagcatccgccgaatgcttcccgtgtacggcgactacgacgcgccccacggccacggtgaggtccacttcgacaacgtgcgcgtgccgcgagacaacgtcatcgccggaccggggatgggcttcgagattgcccagggccggctcggaccggggcgcatccaccactgcatgcgctgcatcggcgcggcggagcggtccctggagctgatgattgaccggggcatgaagcgcacggccttcgggaaaccgctcctcaacctgggtggaaaccgcgagaaggtggcggaggcgcgcatcgccatcgaccaggcgcggctcttgacgctctacgcggcctggaagatggaccaggtgggggcgctcggagccatgacggagatttccgccatcaaggtcgtcgcgccaagtgtcctccagaaggtggtggatgacgccatccagcttcacggcggcgcgggcgtatcccaagatacgccgctggcgggcttcttcgcccaggcgcgcagtctgcgcctcgcggatggcccggacgaagtgcacaagggtctcatcgcccgcatcgagctgtcgaagcggggc

SEQ ID NO: 42933 - DNA, 699 bp, Myxococcus xanthus
atcaccggtggtgccagcggacttggcaaggccatcgccgtgcgcttcgctcgcgccggctggaaggtctgcatcggcgacgtcaacgacacccgcggcgaggaggccttgaaggagctctccgcgctggcgccccaggcccattacctgcgctgtgacgtgcggcgcgaggaggacctgcgcgaggccctggactggctcacggcccagtggggcggcgtggacgtggtcatcaacaacgccggtgtcgcgcaggcgggcgccatcgaggacgtgtcgattgatgactggcagtggatcatcgacatcaacctgctgggcgtcgtgcgtggatgcaaggtgttcacgcctgccttcaagaagcagggccacggccacatcgtcaacgtggcgtccatggcgggcctgctcgatgtgccgctgatgagcagctacaacgcgaccaaggccgccgtcgtgtcgctgtccgagacgctgcacaacgagctggcggagtacggcatcggcgtcagcgtcgtgtgcccgtccttcttcaagacgaacctgggtgactcgctgcgcaccacggacccgaggctgggggccaccatggcgcggctgctggagcgctccgccatcaccgcggatgacatcgccaacgacgtgttcgacgcggtggctgagcgcggcttctacgtcctgccccatgcggatggccgc

SEQ ID NO: 42934 - DNA, 1788 bp, Myxococcus xanthus
gcggtgggcatcgacctgggcacgacgaactcgctggtggcggcggtggtgaaggaccagcccgtctgcgtcccagtggacgaaggcgacgcgctgttcctcccctccgtggtgcactacgcgaaggacggcggtgtggtggtgggcgcccgggctcggaagctggcgtccgagcacgccaccgacaccatcgcctccgtgaagcgcttcatggggcgcagcccagacgacgcggagacgcgcaagctggggcactacaagttcgcgcccggcgccaaggtggtgcgcttcgacgtggcgggcggcacgccggtcacgcccatcgaagtctccggtgaggtgctgcgcgccctcaagcgccgcgcggaagcgcacttctccaccaaggtggagcaggccgtcatcaccgtgcccgcctacttcgacgacgcccagcggcaggccaccaaggacgcgggccggctggccgggctggaggtgctgcggctgctcaacgagcccaccgccgccgcgctggcctacggtctggacaagggcagccagggcaccttcgtcgtctacgatttgggcggcggcaccttcgacatctccatcctcaagctggtggacggtgtgttcgaggtgaagtccaccggcggcgactccgcgctgggtggcgatgacttcgaccgggcgattgcccagcgcgtgctggagacgctgggcgcgtccgaggcgccggctcccgccctggtagcggaggtgctggcggcctcgcgcaaggccaaggaagcgctcaccgacgcggcttcggtggagttctccgcgggcgggcagacgcactcagtgaagcgcgaggacttcgacgcctgggttcagcccttcgtgcagaagacgggcacggtgtgccggcgggcgatgaaggacgcgggcgtgacggccggggagctggacggcgtcatcctggtcggcggcgccacgcgcgtgccggcggtgcgccgctacgtggcggagctgttcggccgtgagccgctgggcgacatcgacccggaccaggtggtggcgctgggcgccgcggtgctggccaacctgctcaccacggcggaccggcaggacgacgtgctgctgctggacgtgattcccctctccctgggtttggagacgatgggcggcatcgtggagaagctgattcagcgcaactccaccatccccaccaccgcgggccaggtgttcaccaccttcaaggatgggcagacgggcctggacgtccacgtgctccagggcgagcgcgagctggtggaggacaaccgcagcctggcgcgcttcaccctgtccggcattccgcccatggccgctggcatggcccgggtggaggtccgcttccaggtggacgccgacggcatcctctccgtcagcgcgcaggagcagagcaccggcgtcagccagtcgattaccgtgaagcccagccacggcctcacggacgaggagattgagcagatgctgctcgactccatcgactacgccgaggacgacatccaggcccggcaggtccgcgagcagcgggtggacgccgagcgcgtcctggccgaggcggaccggcagttgggcgagcacggctcgctgctccaggagggggagcgcgccaccattgattccgccatcgcccgcgtgcgcgagctgatgaagggcgaggaccacctgaagctgaaggaggccgtgcacgcgctggacgaggcgtcccgccccttcatcgaacgggtgatgaatcaggccatcacccaggtggtggctggccactccgtggaggac

SEQ ID NO: 42935 - DNA, 1494 bp, Myxococcus xanthus
agcggtgaacgacgcgcaatcgtgattggcagtggtttcggcggattggccgcggccatccggctggcggcgcgtgggtggcgcgtcacggtgctcgagcggatggacagcccgggcgggcgggcgaacgccttccagcaggacggcttcacgttcgacgcgggccccacggtgattacgtgtccgcacctgctggaggagctgtgggcgctagggggacaacgcatggcggaccacgtggagctacggcccgtggcgccgctgtaccggatgcggttcccggatggctccacgttcgactaccacacggaccgcgaggcgatgcgccagtccgtgcggcgactgtctccccgggatgaggcgggattcctggcgctgtgcgcccgcgtggagcggatgtacgaggcgggcattgggcccctgatgagcacgccggtgccggacgtgctgagtctggcgcccttcacccccgcgttggtgcgggacgaggcgttccggtccatgttcggcctggtgtcgaagcacatccgggacgagcggttgcagcaggcgttgagcttccatccgctgctcatcgtcggcagtcccttcccgaccgcgagcgcggtgtacacgtcgattcaattcgtggagcggcgctggggggcgttcttcccggtgggcggcaccggggcgctggttcggggtctggtggaactgctggagtccctgggcggcgaggtccgttacggcagcgaggtgactgagattgcgttggaggggcggaaggcgacgggcgtgaggctcggggacggtacggggctggcggcggacgtggtggtgtcgaacgcggacgcggcgtggacgtaccggtacctggttccggggcatgttcggaagcactggacggacgagcgcatcaaccgggctcggtactcgatgagcgcgttcctctggtacttcgggacgcggcgtcagtacccggaggtcgcgcaccacacgctgctgttcggcaaggacttccgggggatgttctcaggactggaaggccctggacagccgtcagcggaccccttgctctatctccacaggcccacggcgacagacgcggcgctggctccgtcagggcatgatgctttctatgtattggctccggttccgcacctggggacaggggcggaatggaagcagcgggccgaggctttccgacgagagttggaggcgcgactgtcgcggaccgtcttgccagggctgggttcggagttgatgacgtctcggatggcgacgccggagtatttccgtgacgaactgcgatcctttaaaggggccgcattcagcttcgcgccgacgctttggcagaccacgttccttcgggcacaggcccggagcgaggacgttgactgcctctacatggttggagcaggaacgcaccctggagcggggctccctgccgtgctgtgctctgccaagatcgtggacacagtcattccgccgacgtagcgctgttcacgtgag

SEQ ID NO: 42936 - DNA, 777 bp, Myxococcus xanthus
cagctcttgcgcgccacacgcgaggaggacggcgcctcggtcatcctcaaggtccccgacgcggcgcggctcccctccgccaccacgcggcttcgccatgagtgggagctgacgaacgccctgagtctcgacggcgtcctgcggcccctggcgtgggccgaagcgcgggacggcgcgcccgtgctcatcctggaaggcttcggtgatgcgacgctggcccaacgcctgtcacaagggcgcgtggagccgcgcgccgcatgccgtatcgcgctgtcgttggcgcgcgccctgggtgccatccacgagcagggcatcctccaccgggacttgaaccccagcagcatcctcgtgggaacggatggcgagtccgtgaagctcactggattcacccttgccacgcgcaggccccgcgccgaggtcgctccgctcgcccccgagcggttggagggcacgctcgaatacctctcgcccgaaggcacgggacgcacccaccgcagcgtggactcgcgcggcgacttctattccatgggcgtggtgctctacgagctgctcaccggacgccgccccttcgcggacacggatgcgctgggcctcatccacgcccacgtcgccctcaccccggctccgcccgtcaccgtcgagcccgggctcccccagcccctctccgacatcgccctcaagctcctcgccaagtcccccgaggaccgctaccagagcgcctatgggctcgtggcggacctccagcgatgcctgagtgccctggaggccccggggccc

SEQ ID NO: 42937 - DNA, 1230 bp, Myxococcus xanthus
ttcgaattcaagctccccgaccttggtgaaggcgtgatggagggtgagctggtgaagtggcacgtgaaggcaggggattccgtcaaggaagaccaggtgctcgccgaggtgatgacggacaaggccaccgtcaccgttcccgctcccaaggcgggccgtgtcgtgaagacgcatggcaatgaaggcgacatggcgaaggtgcaccagctcctcgtcaccctggaggtggagggcgctgcgccggcgcaggccggtggtcattccgaggccagcgcgccagcggcggcgcccgtggcgggtggccatgtcggtggtgcgcctgcctcggcgtccaaggtgctggccacgccggtgacgcggcggatggcgcgcgagcacgggctggacctggcgtcgattgccggcacggggccacagggccgcgtgacgaaggcggatgtggtggcggcgctggagggtggcgagaagaacgtcgtcgcggctccggccgagcagaaggcgcgtcccgcggctcctgccgtcagctcgggcgcggcggacgagcgcgttccgcttcggggcctgcgcaagaagatcgcggagaagatggtgcggtcgaagttcacggcgccgcacttcgcctttgtcgaggaagtggacgccacggagctggtggccctgcgcgcgcggctgaacgcgcagttggcggcggccggtgagaacatcaagctcaactacctgccgttcatcatcaaggcgacggtggcggcgctgaagaagttcccgcacctgaacgcgaacttcgacgaggcgtcgcaggagctggtggtccgcggcgagttcaacatcggcatggcggcggcgacgccggacggcctcaccgtggcggtggtgaagagcgcggaccggctgacgctggccgagctggcgcgtgagacggcccgcctgggcgccgccgcgcgtgaccgcaagctgaagatggaggagctgacgggcggcaccttcaccatcagctcgctggggcagagcggcggcctgttcgccacgcccatcatcaaccaccctgaagtgggcatcctgggcgtgcaccgcctgaagaagcgcccggcggtggtgggggaccaggtcgtcgtgcgcgacatgatgaacctgtcgctgtcgtgcgaccaccgcgtcatcgacggctcggtggcggcggatttcacgtacgaaatcatcaagtacctggagaagccggacctgctgttcctg

SEQ ID NO: 42938 - DNA, 1709 bp, Myxococcus xanthus
caagtcgtgcgggccacgggcaagctccgcaacttgaaaaccgggtggtggcggaccagccaccaggcaacatcggcatcgggcacacccgctgggcgacccacgggcgtccctccgacgagaacgcgcacccgcacacgtacaaggacgtggcggtggtgcacaacggcatcatcgaaaaccacctgtcgctcaaggagcagttgcgctcgcgtgggcacgtcttctcctcggagacggactcggaggtgttcgcgcacctcatctccgaagagctggagcgcgggctggagctgccggacgcggtgcgcgcggccattgcccaggtgaagggcacctacgcgctggccgtgctgacggccagcgaccccagccgcatcgtctgcaccaaggacgcctcgcccatggtgctgggcctgggccaggggcagaacttcctggccagcgacgtgccggcgctgctcgagcacacgcgcgacttcgtctacatggaagagggtgacctggccgtcatcaccgcggcggccgtggacatcttcaaccgccagggccagaaggtgaaccggcccacccgccgcatcgactggacgccgatgatggcggagaagggcggccacaagcacttcatgcacaaggaaatctgggagcagccccgcgccgtcgcggacacgctgcgcggccggatgctcctgtcggaaggcgacgtccacttcgagggctggaacctgtcggcggagaaggtccgctcgctgaccaagatcaccatcctcgcgtgcggcacgtcgtggcactccggtgtcgcgggcaagcacatgattgagtcgctggcgcgcctgccggtcgaggtggagctggcgagcgagttccgctaccgcgaccccatcgtcgacggcacgcacctggccatcgccatcagccagtcgggcgagacggcggacacgctggcggccttcaaggaggccaaggcccgcggcgccacggccatggccatctgcaacgtcattggcagcgcgatgacgcgcgaggccgacttctccgtgctcaccaacgcgggcccggagattggcgtggcgtccaccaaggcgttcaccacgcagctggtggccttgttcctgctggccgtcaagctgggccgcatgcgtggcaccctgtccgtgccggcggcgcaggagcacctgacgcagctcacgaaggtgccgaagatgattgaggacgtcctcaagtgcgagccggccgtgacgcgcgtgtcgcgtgagtacatggactcgcaggacttcctcttcctcggccgcggccccatgcacccggtggcgctggagggcgcgctcaagctgaaggaaatctcgtacatccacgcggagggctacgcgggcggtgagatgaagcacggccccatcgcgctcatcgacgagaagatgccggtggtggtcatcgcgccgaagcagccgcacgtcgcgtacgagaaaatcatcggcaacatcgaggaggtccgcgcgcgcggtggcaaggtgattgccatcatcgacgaggacgacgagcacgtggccacgctggccgaccaggtcatccggattccagcggcttgcgcgctgctggcgccggtggtggccaccatccccctgcagctgctcgcctaccacgtggcggacctgcgcgggaacgacgtggaccagccgcgcaacctggccaagagcgtgacggtggagtag

SEQ ID NO: 42939 - DNA, 4659 bp, Myxococcus xanthus
ctgagctacgccgggttggatttgcgagcccggcgcattggcgcggcactccaggccctggcgcgagcgggcgagcgggcggtgctcctctatccaccgggcctagagtacgtcgcgggtttcttcggctgtttgtatgccgggttggtcgccgtcccagcctatccgccggacccgatgcggctggagaggacgttgcctcggctgcgcgccatcattcgggatgcgcgcgcgagcgtcgtgctcaccacctccttcatccaggagatgggggaggggctcttcgaaggcgcccccgagctcgccgcgctccgctgggtggccaccgacgcgttgcccgaggggactgaggcggggtggcgccgtccggagccttcgcgggacacgttggccttccttcaatacacgtccggctccacgggggatccgaagggcgtgcagctcagccatgggaacctgctgcacaacctggggctgatctcccacgcgttccaggtccgctcggacagcgtgggcgtcatctggctgccgccgtaccatgacatgggcctgattggcggcatcctccagccgctctacgcgggcttcccggtggcgctgatgtcgccgctcgcgttccttcgccgcccacggttctggttggagtcactgtcccgcttcggtggcaccatcagcggcggcccgtgcttcgccttcgacctgtgcgtgaggaaggtgcctcccgcggagcgtgaagggttggacctgcgtcgctgggagctggccttctgtggggccgagcccatccgcccggaagtcatgacccgcttctcggaagccttcgcgcccgtgggcttccagcgcgaggcgctctatccctgctatgggctcgcggaaggcacgctgatcgcctcgggtgggcgcaagggcgaaggtgtcctcacgcggatgtgggacgcccaggcgttggagcggaacgaggcgctggcggccgaggacggccctggggcgcgcccgctggtggggtgcggccagacgctgcctgagcagacgctgctcgtcgtggacccggagacgcgtcgcgcttgcccgcccgagcgggtgggggagatctgggtctctggtcccagcgtggcccacggctactgggagcggcccgaggagagcgaggccgcgttcggggcacgattggcggattcggacagcggcccccggttcctgcggacgggagacctgggcctgctgaaggacggcgagctgttcgtcgtgggtcggcgcaaggacctcatcatcctccgcggccgcaacctgcatccgcaggacctggagctgacgctggagcgcagccattcggcgctgcggcccggttgtggcgcggcgttctccatcgacgtgggcggcgaggagcggctcgcggtgatgtacgaggtggactcgcgcaagccgtggaccgccgaggacgtggtgggcgcagtccgccggggtctggcggagacgcacgaggtccagctccacacgctcgtcctcatcgagccaggcgcgctgccgaagacgtccagcgggaagattcagcggcgtgcttgccgggctgaattgctcgcggggacggctcgggcgctgctgacctggagcgagtcggaagcagacgcgccccaggccaaggctcccgcgcctgacatcaccgcgtcccagccgctcaccgtggaggcacttgaggcgtggttgctggcgcggatcgcctcgcggcttcgcgtccgtccggaggagctggcgacggatgcgcccatcacttcctttggtctggactcactgggcgccgtggagttggcgaacgacgtcgagaccctgggcgtggtccttcgcatggaggtccttcttcaggggccgacggtgggggcgctcgcgctgaccctcttcgcggcgcgtggggcgtccactggcgccgagctgacgcggggcgaggagaggacgcccgcgccgctctcctccgcgcagcaaagactgtggctgttcgagcaattggcgcagggaagcgccgcgtatcacctgccggcggcggtacggctcaccggtgcactggatgatgtggcgctggagcatgccttcgctgcaatcgttcagcgccacgcggcactccgggcgacgttccgcgacgaagatggcacgccgtcgcaggtgacctcgtcggtgccggtgtcatcacttcgccgggtggacctccgcgacgtcccggtggatgcccgcgaggaggccgcgcttcgtctggcccacgaggaagcgcgggcgccgttcgacctcgagcgcggtccgctgctccgggccacgctgtttcaattggacgcgcacgagcacctgctggtcgtggtgatgcaccacatcgcctcggatggtgcctcgttcgccatcctggcccgtgagctgagcgcgctgtacgcgggtgatgtttcgctgccgccgttggcctttcagtacccagacttcgcgcgctggcgccgcgaggtcgaggcggacggcgccctggccacgtcgctcgactggtggaaggcgcggctggcagggggggccgcggcgctggaactgcccgcggatcggtctcgaccgcccatgccatcctatcgcggtggccgcgtggcggtgcggttcccggaggcgctgacggctcggctggaggcgttgggccggagcgaaggcgccacgttgttcatgacgttgctggcggctttcgaggtgctgctcgcgcgtcattcggggcaggcggacttctgcgtcggaacggccgtcaatgggcgtgagcgggcgggactcgaagggttgatggggtgctttctcgacctgatcgtcctgcgcgcgtccgtgtctggctcatcacgtttccgcgaactgttgggacagacgcgggaaggcgtgctggcggcctttgcccaccggggcgtttctttcgagcggctggtcgacgcggtccaacccacgagggacccctcgcgcgcacccttgttccaggtgctgttcgtgctccagccggagcccggcgcgggactggcgctgcccggcctggagtctcgccgcgtggaggtggacccgggggccacgccctacgatttgacgctgtcgctggcccgagggccggagggactgggagggtggctcgagtacgccacggacctgtttgatgcggacaccgccgcgcgactggtggcgcggctgggcgtgcttctggaatccattgtcgcggaccctgaccagcgcctcgccatgctgccgctgttgcctgaggcagagcagcggcaggtgctggtcgactggaatgacacgcgggcggagttcccggaggcgtgcatccatgcgctcgtggagttgcaggcgcagcgcactccggacgccgttgccgtggtgtgtggcgacggggtcctcacgtaccgtgagctgaaccaacgagccaacgccgtggcatggaggctgcgcgagcagggcgttggacctgagtgcatcgtgggcctcttcgccgaccgctccgcggacctggtcgtgggcctgctgggcatcttcaaggcgggcggtgcgtacctgccgctggacccgtcgtatcccgaggctcggctcgcgctgatgctggaggactctggcgcctcggtggtgctcgcgcaccggcatctggcgggcgcgcttccgttcggcgataggaccgtggttccgctggatgtggctggcgaggccgacgccgcgccaccgggagccgtggggcccgacaacctggcctatgtgctctacacgtccggctccaccggcaagcccaagggcgtggccgtcccacagcgagccgtcgtccgcctggtccggaacacccactacgtccacctggggccggacgagacgctgctccagttcgcgccgctcgccttcgatgcgtccaccttcgaggtctggggggccctgctcaacggcgcccgcctcgccatccatccccccaccacgccgtcgctcgaagagctgggaagcttcatcgcccgccaaggagtgaccaccgtgtggctcaccgcgggcctgttccatcaggtggtggaccacgcgctcgagtccctggcgtccgtgcgacagctcctcgcgggaggcgacgtgctctcccccgcgcacgtgcgacgcgtggtggagcggtacccgggctgccgggtcatcaacggctacggccccactgaaaacaccaccttcacctgctgccacaccgtgtcgccggacgagccgctcgtgaacgccgtgcccattggccgccccatctccaacacgcgcattcatgtgctcaacgcggcactggagccggttcccgtgggcgcgcctggcgagctgtgcgcgggcggtgacggtctcgcgctcggctacctcaacgaccccgcgctgacggcgcagcgtttcatcccagacccgttcagccccgtgccgggcgcacgcctgtaccgcacgggggaccggtgccacgtcctgccggatggggcgggtcgaattcctcgggcgccgtggatgaacaggtcaagctccgcggcttccggattgagccaggggaaatcgaggcggccctcgcgctccatcccaccgtgcacgaagcgcgggtcatggcccgggaggacggccccggagagaagcaactcgtcgcctacctcgtcgccaggccgtcccgggaactcccgc

SEQ ID NO: 42940 - DNA, 1502 bp, Myxococcus xanthus
ggtcgggtccgcccgctccgccggagccggacgaggacgaccgcttcgtggaggccaagctgacacaggctcgcgcttacatggagcagtacctgaacacccggaagtagaggcggcaaacagggtcgccccgtgctagacgggccccatgcccaagatccgcaaagtgctcgtcgccaatcgcggcgagatcgccatccgggtgatgcgcacgtgcaaggaactcggcatcgccacggtggcggtgtactcggaggcggaccgctccgccctgcatgtgcgcacggccgaccaggccatcttcgtggggcccccgccttcgcgtgagagctacctggtgcagcagcgcatcctcgacgccgcgaagcaggctggcgcggatgccatccaccccggctacggcttcctctccgaaaacgccgccttcgtccgcgcctgtgaggccgaaggcctgacgttcatcgggccgcccgcctccgccatggactccatgggcgagaagacgcgtgcccgcgcgaacatgatcaaggcgggcgtgcccgtggtgcccggtaccaccgagcccatcccctccgtggaggaagcgcgcgcctacgtggagaagattggcttccccgtcatgctcaagggccgcgggcggcggcggtggcaagggcatgcgcaaggtggagcgcatggaggacttcgagtcctcgtggcgcgccgccaagagcgaggccctcaacgccttcggcaacgacgccgtctacatcgagaagtacctggagaagccacaccacgtggagatccaggtcttcgcggaccagtacggcaacaccatccacctgaacgagcgcgagtgctcggcgcagcgccggcaccagaaggtggtggaggagacgcccagccccatcctcacgccggagctgcgcgcgaagatgggcgaggtcgcggtgaaggcggccaaggccgtcaactacgtgggcgccgggacggtggagttcctggtggacgtgcaccgcaacttctacttcctggagatgaacacccgcctccaggtggagcacccggtgacggagtgggtgacgggcctggacctggtggccatgcagatcaaggccgccgagggcgagaagctcggcctcaccgaagcccccacgccgcgcggtcattcgattgaggtccgcgtgtacgcggaggacccgagccgcaacttcatgcccagcccgggcaagattacgtacctgcgcgtgccgggtggaccgaacgtgcgtgacgattcgggcgtgttccccgggtacacggtgcccaacgtctacgacccgatgatttccaagctgtccgtgtgggcccccacgcggcgcgaggccatcgcccgcacgcagcgcgcgctgtccgagtacgtggtgaagggcatcaccaccaacatccgctacctgaaggcgattctggcgcaccccgagttcatcgagggcgactacgacaccagcttcctcacccgccagcacgatgcgctgctgggc

SEQ ID NO: 42941 - DNA, 1722 bp, Myxococcus xanthus
gcgctggacctggacagctgggagccacgccgccgcaccgcgcatcgaggcccgggtgagccgcccgcgaagccgccgcctacgcccaccctggacagcgtcggcgtggcctggcaccggctcgcgcaggaaggacagctcgacgcggcctacgagcaggatgcgctcgtcgccctgctccggacccggctcgcggccaaggacgccgaaccggtggtcctggtggggccttcgggcgtgggcaagacgtcggtgctccacgcgctcgcccagtcgctgcgcgcccccaccgccaccgaggccgagcgcgcccgcccgttctacttcctcgacggaagccggctcatcgcgggcgagggcttcttcggagactggcagcagcaggtgctgcgcgccttccgtgaggccaccgaggcccgggccctgctgtccctgggccatgccgtggagctcctcgacgcgggcaagagcgcccacagtgaccagaacgtggcccaactgctgctcccgctcctcgcggcgcgtgacgtggccgtcatggccgaggccacggaggagacctgggcccaggtggagcagcgcaacaccagcttcgcccggctcttctcggtggtgcgcgtcgcggagcccacgcccgatgcgctcggccgcatcgtcgccaaggtggcggaggacgacgccttggccgccgcgatgcaggtccagcccgacgcgctcgacgaggcgcgcttcctgtgccgccgcttcctgccctacggtgcccaggtgggcaacaccgtggccttcgtgcgccggctgctggcgtcctgtgcccaagcctcgcgcacctccgtcacccgactggaggccacccgccaattcgcctcggagtccggcatccccgagcacctgctccgggacgaccagccgctggcgtccgcacacgtgcgcgacttcctggcctcgcgagtgatggggcaggacgccgccgtggagcgcgcagcctcggtggtatccgtcctcaaggccggcatgtcggacgtgcggcgcccgctgggggtgctgctcttcgtgggccccaccggcgtgggcaagacggagctgtccaaggcgctggcggagctactcttcggtgcgaaggagcgcatggtccgcctggacatgggtgagtacgccggtccggacgccctgctgcggttgatgggagacggggagacgccgggctacctcacctcggcggtgcgccggcagcccttctgcgtggtgctgctggacgaggtggagaaggcccaccccgccgttcacgatgcgctgctgggcgtcttgggcgaaggccgcctcaccgatgcctccgggcgcttcacggacttccgcaacgccctcatcatcctcaccagcaacctgggcgcggacaccctgcgcgcccgcgtgggcttcgatgcgtcgggcggtgccccggacatggcctccctgcgcgcgcactacctctccgaggtgcagcgcttcttccggccggagatgttcaaccgcatggacgacgtggtcgtcttctcgccgctgtccgccccgctgctgcgccggttggtggtccgcgagcttgaagccgtatgccgccgtccaggcctctcgctccacgatgccctgctggaggtcacccccgccgcccaggactggctggccctgagaggcttcgacgcgcggtatggtgcccgccccttgaagcgcgcgctggagcgcgagctg

SEQ ID NO: 42942 - DNA, 762 bp, Myxococcus xanthus
ggaaaaacggtggtcgtcacgggcgcctcggcgggcattggcgaggcgctggcggtggtgctggccggacgcggcgccaacctggtgctggcggcgcgaaatgaggaagcgctccagcgggtgaaggcccggtgcgagtcggccggcgggcgcgcggtggtagtgcccaccgatgtaggtgacgcggaggcctgccgccacctggtggagcgggcggtggaggcctttggcggcgtcgacgtgctggtcaacaacgcgggcgtgacgatggacgcgcgcgtggacgaggtgaaggacctgtccctcttcgaccggctgatgcgcatcaactacctgggcgcggtgtactgcacccaccacgccctgccccacctcaaggcgcggcgcggactggtggtggccgtgtcgtccctcacgggcaagacgggcgtgcccaaccgcagcggctacgcggccagcaagcacgccatgcacggcttcttcgactcgctgcgcatcgagctgcgcggcaccggtgtggacgtgacggtggtgtgccccggcttcgtcgccaccaacatccgcgacagcgcgctgggcgcggacggccagcccgtgcggcagagcaagcacgacgagagcgcgggcaacatggacgtggacacctgcgtggccatcatcctgcgcgccatggagcgccgcgagcgcgaggtggtgatgaccaccaaggcccgcgtcgcccagttcctcaagctggtggccccgggcgtggtggaccgcatc

SEQ ID NO: 42943 - DNA, 2148 bp, Myxococcus xanthus
ccccaggtccacttccgcacctgcaacctctgcgaggccatgtgcggcctgcgcatcgagctggacgccggacgcatcacctccatccggggcgacgcggaggaccccttcagccggggccacgtctgtcccaaggccctggcgctggaggacctgcaccaggacccggaccggctgcgcggccccatgcgccgcaccgccagcggttgggagcccgtctcctgggacgacgcattggatgagaccgcgcgccgcctgcatgccatccaacgggagcacggccgtgacgcggtgggcgcatatctgggcaaccccaacgtccacaacctgggcaacatgctgttcggtccggagctgctgcgcacgctgcgctcgcgcaaccgcttctccgcgacgtccgtggaccagctgccgcaccagctcaccgcctacctcatgttcggccaccagctgatggtgccgattcccgacatcgaccacaccggctacatgctcgtgctgggcgccaatcccctggcgtccaatggcagcttgatgacggcgcccgacgtgcgcgcccgcctgcgtgccatccagcagcgcggcggccgcatcgtcgtcatggacccgcgccgcacggagacggcggccatcgccgacacgcacgtcttcatccggccgggcaccgatgcgctcgcgctgctcgccctgctgcacgtggcggtggtggagcacgcgccgcgcctggggccgctggatgccttcaccgacggcctggagaccgtgtgcgcgctggcccgggactttcctccggagaaggtctcaccgcacacgggcgtgcccgcgcacaccctgcgccgcatcgcccgggacttcctctccgcgcgagccgccgtgtgttacggccgcatgggcgtgtccacccaatccttcggcgcgctctgccaatggctcatcaccgtgctcaacgtggtgagcggcaacctggaccggcgcggcggcgccatgttcaccctgcccgcgttcgacgtcgtcggaggtccacgggccctggccgtgggccgcggcggcttcggccgctggaagagccgcgtgcgagggcttcccgagttcgcgggggagttgcccacggcggcgatggcggaggagatgctcacgccgggcccaggccgcatccgcgcgctgctcaccgtcgcgggcaaccccgcgctgtccacgcctgatggcgctcggatggaacaggcgctcgcgggcctggacttcatggtgagcatcgacccgtacctcaacgagacgacgcgccacgcgcacctcatcctcccgccggtgtcaccgctggagcgcagccactacgacatcgccttccacgcgctggcggtgcgcaacaccgcgaagtactcgcccgccctcttcgagcccgggccgggcagccgccaggactggcagattctgctcgccctccagcaccggctgctgacgctgcgcaagggccgcccctccgtgcgcgccacgctcaagtaccaggccctgtcccgtctgggtccggagcgagtgctggacctgggcctgcggctggggccctacggcgcgcgcttccacccggcgaagcagggcctcaccctggagaagctgcgccagtcgccccacggcatcgacctggggccgctccagtcctgcctgccccagcgcctccagacgaaggaccgccgcatccacctggcgccggagctgctggtggcggacgtgcgacgcctgcaagcagccttcccccaggacaccgtccccgagcagcacagtggcgagctgctgctcatcggccggcggcacctgcgcgacaacaactcctggatgcacaacgtaccgggcctgctgaagggcaagccgcgctgcacgttgatgatgcacccggaggacgcggcccggcgggcgctcgccgacggcatggaggccaccgtcacctcgcgcgtgggcacagtgacggtgcccatccacgtgacggacgaggtgatgcccggtgtggtgagcctgccccacggttacggacatggccgccagggcacccggctcgccgtggccaccgcccacgcgggcgccagccacaacgacctcacggacgcgcaggccgtggacgcgctctgcggcaacgccgccttcagcggcacgccggtg

SEQ ID NO: 42944 - DNA, 1455 bp, Myxococcus xanthus
ccgtcccggggtgacgcgggccgcttcacctaccgcgcgatgaacacgcgcgccaccgcgttgggcggctggctgcgtgacgtggccggcgtgcagaagggcgaccgggtgggcatcgtggcccacaacggcgtggagtacctggacgcgctgttcgcctgcgcgaagattggcgccgtcttcgtccccttcaactggcgcctgcacgccgccgagctggcggacctggtgcgctccatccgtcccggcgtgctcttcttcggcgacgacttccgcgacaccgtggcggatgtccgcgagcgcctgggcggtggcccccggctggtgtccctggagtcgcaaggcctgccgggcgcggacgcctacgcggcgacgctggcccacgtgccgggctcgccggtgacgcaggacgcggtgtccgaagaggacatcctctgcctcatcttcaccggcgggacgacggggcgctcgaagggcgcgcgcgtcagctaccgcatggtggcgtggaacaccctcaacacgttggtccacgaggtgcggcccggcgacgtcacggtgacgcacacgcccatgttccacacgggcgggttgctcgtgtacacgctgccgctgctcaccgtgggcggcaccgtcgtcctcatgcgccggtgggagccggaggcgctgctggacctcatcccccgggagaaggtgacgctcttcttcgcggtgcccacgcagtaccagcagctcctggagtcgccgcgcttcaagacgacggacttctcctccgtgcgcttcatgaccagcggcggcgcggcgctgccggtgccgctcatccaggcgtggcaggcggtgcacccggtgcccttcaagcagggcttcggtatgacggagttcggcccgggcctcttcagcatgggaccggagtacgcggtgtcgaaggcgggctccattggccggcccaactacttcatcgccgcgaagctggtggatgacgacggccgggaagtccccacgggcgaggtgggtgagctgctcctcaagggcccctccatgtgctccggctactttgaagacgaggccgccacgcgcgaggcgattgacgcggaagggtggctgcacaccggcgacctggcgcgcgtggatgcggacggcttcttcaccatcgccgggcgcaagaaggacatgttcatctccggcggagaaaacatctacccgctggagctggagtccgcgctgtatgagcaccccgcggtggcgcaatgcgccgtggtgggtgtgcccgacgcgaagtggggcgaggttggccgcgccttcgtggtgctgaagccggatgggaaggtttcggcggaggcgctgttggagcacctgcggggacgcgtggcgcgtttcaaggtgcccaagcgcgtggagctgatggagcgcctgcctatctccgcggccggaaagattctcaagcgtgagcttcgcgac

SEQ ID NO: 42945 - DNA, 978 bp, Myxococcus xanthus
gcccagattctctccactggccgctacgtccccgagaaggtcctcaccaacgctgacgtcgagaagattctcggtgagaaggtggatgagtggctccagcagaacgtgggcattcgcgaacgccacatgatggcggatgaccaggccacctccgacctctgcgtgggcgccgcccgccaggcgctggagcgcgcgggcacgaagccggaggaactggacctcatcatcatcgccaccgataccccggactatctcagccccgccacggcctccgtggtgcaggcgaagctgggcgcggtgaacgccggcacctacgacctcaactgcgcgtgcgcgggctgggtgacggcgctggacgtgggctcgaagacgattgccgcggatgacagctaccagcgcatcctcgtcgtgggcgcctacggcatgtcgcgctacatcaactggaaggacaagaagaccgccaccctgttcgcggacggcgcgggcgcggtcgtgctgggcgcgggtgacacgcccggcttcatgggcgcgaagctgctggccaacggcgagtaccacgacgcgctgggtgtctacaccggcggtacgaaccgcccggccaccgcggagtcgctggagctcacgggcggcaagcccgcggtgcagttcgtccgcaagttcccggcgacgttcaacaccgagcgctggcccatgctgctggaccagctcctcaagcggcagaacctgaagctggacgacgtgaagcagttcgtcttcacgcagctcaacctgcgcaccatcgaagccaccatgaagatcctgggccagccgatggagaaggcccactacaccatggacaagtggggctacaccggttcggcctgcatcccgatgacgctggatgacgcggtggtgcagggcaaggtgcagcgcggcgacctggtggccctgtgtgccagcggcggcgggctcgccatggcctccgccctctaccgctgg

SEQ ID NO: 42946 - DNA, 738 bp, Myxococcus xanthus
atgcagctcaaggacctgaagatcatcgtcacgggcggcgcccagggcatgggcgctcacttcgcgcagcgcctgcacgaggcgggcgcccaggtggccgtgggtgacgtggccgaggagcgcctcgccgcgctgcccgccggcatccaccgccgcaagctggacgtgtcctccgaggaggacatcgtctccttcgtgaactgggcgcagggcgccatgggcggcctcaacgggctcatcaacaacgcgggcatcctccgtgacgcgctgctggtgaagaaggaccggaccaccggcgaggtgaagaagctgtccaccgcggactggaacgccgtcatcggcgtcaacctcacgggcgccacgctgatggtgcgcgaggtggtggcgaaggtcgccgagtccggccagaagggcggcgtggtcgtcaacatgtcgtccattgcccgccacggcaaccgcggtcagtccaactacgtgtccgcgaaggcggcactggcggccaacaccgtcacctggtcgcgcgagttcagccccttcggcgtgcgcgtgggcgcggtggccccgggcatgattgagacgccgatgacgcagggcatgaaccagaaggcccgcgacgcgctggtctccaacatccccgtgggccgcatcggcgtgcccgaggacatctggctcgccgtgaagttcatcctggagtgcgactacttcaacggccgcaccatcgacgtggacggcggcctc

SEQ ID NO: 42947 - DNA, 1611 bp, Myxococcus xanthus
ggccgcatgatggatttcccgctcacgctgagccacttgatggagcgcgcacggacattctacccgcgctcggaaatcgtcagccgcaacccggacaagtcgctgcaccgctacacgtacgcggacttctacgcgcgcacgtgccggctggccaacgcgctgacgcggctgggcgtgaaggcgggggaccgggtggccacgctgagctggaatcactaccggcacctggaggtgtattacggcgtgccgtgcatgggcgcggtggtgcacacgctcaacctgcgcttgcaccccaatgacctgggctacatcgcgcggcacgcggaagactccgtggtggtggtggaccgctcgctgctgccgctgttcgagaagttcaaggacgcggtgcccagcatccgccacgtcatcgtggtgccggacgcgggccccgcgccggaggggacgctcgactacgaagcactgctggcggccgagtccccggacttcgactttccccagctcgatgagaactccgcgtcgatgctctgctacacgtcgggcaccacgggcaatccgaagggcgtgctctacagccaccgctccaccgtgctgcacgccctggcgtgttgcatgacggacgtgacgggcatgcgcgaggcggacgcggtgatgccggtggtgcccatgttccacgccgccgcgtggggcctggccttcgacgccgtcctcaccggcgcgaagctggtgcttcccgggccgcacctggacccgccctccctgctggacttgatggcggcggagaaggtcaccctggcgggcggcgtgcccaccatctggattggaatcctcgcgttgctggaccaggcaccgaacaagtgggacctgagcagcatgcggtccatgctgattggtggctcggcggcgcctccgtcgctgattgagggcttccagcagcggcatggattggaagtggttcacgcgtggggcatgacggagatgagccccgtcggaacgatggcgaaggtcaaggggccgctgcggcaggcggcgcatgaggcgaagtcctcggcgcgggcgtcacaggggttcgcgctgcctttcgtggagacgcgcgtcgccagcgacgacggcacgctgctgccctgggatggggagacgatgggcgaactggaggtccgggggccctgggtcgcgtcgtcctacttcagcgatgagggcgcggaccgctacacgaaggacggctggttcaagacgggcgacgtggtgaccatcgactcgcacggttacgtgcgcatctgcgaccgcagcaaggacgtcatcaagtcgggcggtgagtggatctcctccgtggcgctggagaacgcgctgatggcgcacccggccgtgctggaggcggccgtcttcgccgggaaacatccgaagtgggatgagcgcccgctggccgcggtggcactgaaggaggggcagcaggtcacgaaggaggagctgaccgcgcacctggcgggccagttcgcgaagatgtggctgccggatgactatgtcttcgtcccgcaggtgccgcggacgtccaccggcaagttcctcaagacgaagctgcgtgaggactacggcgaccacctgctgaagaat

SEQ ID NO: 42948 - DNA, 1035 bp, Myxococcus xanthus
atgaaagtcgccgtgctcaccggcgggggtgactgccccggcctgaacgccgtcatccgcgccgtcgtccgccgcgccaacgcccacggcttcgagatgatgggcctccgagatggttggaaggggttgttggaggacaaccacttccgcctcacgcgtgaaaccacgtccggaatcctccaccggggcggaaccatcctcggcacctcgcgcgtcaacccgttcaaggtcgaaaacgggctggagcgcgtcaagcgcgccatcgaacgcaacggcatccacgccgtcatcgccattggtggcgaaggcacgctgtcggccgccacgcgcatgtcgcaggaaggactgcgcatcgtcggtgtgccgaagaccatcgacaacgacatcaacgccacggacttcaccttcggcttcgacacggccgtcgccatcgccaccgaggccattgaccggctgcactccaccgcggagtcgcacaagcgcgtcatcgtctgcgaggtgatgggccgtcacgtgggctggattgccacctacgcgggcatcgctggcggcgcggacgtcatcctggtgccggagattcccgccgacctcgcgaaggtggccgagcacatccagcgccgccacgcgggcgggcgcaccttctccattgtcgtggtggcggagggtacgcgcatcaagctgtcggcggaccagcaggagcagctcgtcaccagcggcgcactggacgaggcaggcaggccgcggctcggtggcgtgggcaccatcctggcgcacgaaatcgagcggcgcaccggcttcgagacgcgcgtgtccgtgctgggccacatccaacgcggcggcgcccccaccgcgcatgaccgcgtgctcgccacccgctacggcgtccacgcctgcgacatggtggcccgcggcgagttcgggaagatggccgcgctgcgaggcaacgacatcatcagcgtggacctggcggacgccacccgcgagctcaagcgcgtcccgcaggagttcttcgaagtcgcccaggtcttcttcggc

SEQ ID NO: 42949 - DNA, 1854 bp, Myxococcus xanthus
taccagcgcctctaccagcgcagcatccagcagcccgaggccttctggagtgagatggctgaacagctcacctggttccacaagccagacgccatcatggacctggacgccgaacaggtggacttctcctggttcggcggcggcaagctcaacgcggcctacaactgcatcgaccggcacgccacggagcgccccggcaaggtcgccatcatctgggcgaagaacgagccgggcgagtacgaatccatcacctaccgcgacctccagcaccacgtgggccgcgtggccaacgtgctgaaggcgcacggcgtgcgcaagggcgaccgcgtctgtatctacctgcccatggtgccggagctggcctacaccatgctcgcgtgcgcgcgcatcggcgcggtgcactccgtggtgttcgccggcttctcatcggaggccctgcgcgagcggattctcgactccggcgccaaggtgctcatcaccgccaacgaagggccgcgcggcccgaagttcgtgcccaccaaggccatcgcggacgaggccgtggagggcctgtccctggtggagtccatcctcgtggtgcgccgcacgggcaaggaagtgcccatgctcgccggccgcgactactggctggacgcggagatggcgaagcaccgcggcgtctgtcccgcggagtggatggactccgaggatccgctcttcatcctctacacctccggctccacggggaagcccaagggcgtgctgcacaccaccggcggctatctcgtctacgcggccaccacgttccgctacgtcttcgacatccagccggaggacgtctacttctgtgcggcggacctgggctgggtcaccggacacagctacatcctctacgggccgctgatgaacggcaccaccacggtgatgttcgagtccacgcccaccttcccggacgcagggcggctgtggcgcgtggtggacgacctcaaggccaccatcctctacaccgcgcccaccgcgctgcgctcgctcatcaaggagggtgacgcgtgggtgaagaagtcctcgcgccagtcgctgcgcctcctgggcagcgtgggcgagcccatcaacccggaggtgtggcgctggtaccacgacgtcgtgggcgaaggccgctgcccggtggtggacacgtggtggcagacggagacgggcggcatcctgattgccccgctgccgggggccacgcccaccaagccgggctccgccaccctgcccttcttcggcgtggagccggtgctggtggacgacgagggccgcgtcatcgaaggcaacggcgtcagcggcaacctgtgtctggcgcgctcgtggccgggacaggctcgcacgctgtatggccaccaccagcgcttcaaggagacgtactacgcgcgcttccccaacctgtacttcaccggtgacgggtgccgccgcgacgaggatgggtactactggattaccggccgcgtggacgacgtgctcaacgtctccgggcaccgcctgggcaccgccgaggtggagagcgcgctggtggcccatgaggccgtcgccgaggccgcggtggtgggcttcccgcacgacctcaagggcacgggcgtatgcgcgttcgtcacggtgaagccggactggcaggagtccgcctccgagcagatggtgggcgcgctcaaggagcaggttcggcatgtcattggccccatcgccacgccggaccgggtggtgctggtcaacggcctgccgaagacgcgctccgggaagattctgcgccgcatgctccgcaagattgcctcgggcgaggtggagaacctgggtgacgccagcaccctggcggacccgtcggtgctcgacgaactcctc

SEQ ID NO: 42950 - DNA, 3390 bp, Myxococcus xanthus
cggggccgtggcgctcgcgcgtccaccccgcgtggccagggacgcggcggccatccgctgcaacccctgctcgccgcgcttcgttcggtgcacggcggagacttctccgtgcggctcccgggcggcggcgccgacccggtgatggaggagatcgccagtgccttcaacgccgtggtgtcgctcaacgccaccctgacgcaggaagtggtccgcgtggagcgcgtggtcggccgcgagggccgcatgggcgagcgcgtgtcgctgggcgacgtgcgcggcgattgggcccacagcatcaactccatcaattcgctcatcggcgacctggtgcagcccaccacggaggtggcgcgcgtgctggtggccgtggcgcagggcgacctcacccagaagatggcgttggagattgatggccagcccgtcaagggcgagttcctccgcatcggcactaccgtcaacgcgatgctggaccagctcaactcgttcgccgccgaggtgacgcgcgtggcgcgcgaggtgggcagcgacggcaagctgggcggtcaggccgaagtgcgcggcgtgtccggcgtgtggaaggacctcacggacaacgtgaacctgatggccaacaacctcacggcccaggtgcgcaacatcgccgaggtgtccacggcggtggccaacggcgacctgtccaagaaaatcaccgtggacgcgcgcggcgaggtcttcgagctcaagagcaccatcaacacgatggtggaccagctcaacggcttcgcctccgaagtgacgcgcgtggcgcgcgaagtcggcaccgaaggcaagctgggcggtcaggccgcggtgcctggcgtgtccggcacgtggaaggacctcacggacaacgtgaacttcatggcctccaacctcaccacgcaggtgcggggcatcgtgaaggtggtgacggccgtcgccaacggcgacctcacccagaagttgatggtgccgtcgcagggtgagattgccgcgctgggcgccacgctcaacgcgatgacggacaccctcaacgtcttcgcgcagcaggtgaccagcgtcgcgcgcacggtgggcgtggaaggcaagctgggcgcccaggcccaggtgcccggcgccgccgggacgtggaaggacctcacggacaacgtgaacctgatggccaacaacctcacggcccaggtgcgcaacatcggcgaggtgacgacggccgtcgccaagggcgacctgtccaagaaaatcaccgtcgacgtgcgcggcgaggtgctggagctcaaggacaccatcaacacgatggtggaccagctccgcgccttcgcctccgaggtgacgcgcgtggcccgcgaggtgggcaccgacggaaagctgggcggccaggccgacgtgaagggcgtggggggcgtgtggaaggacctcacggacaacgtgaactacatggcctccaacctcaccacgcaggtgcgcaacatcgcgctggtgacgacgtcggtggccaatggcgacctgtccaagaagattacggtcgacgcgcgcggcgaaatcctggagctgaagaacaccatcaacacgatggtggaccagctcaacagcttcgcctcggaagtgacgcgcgtggcgcgcgaggtcggcacccacggcaagctgggtggccaggccgaggtgcgcggcgtgtccggcacctggaaggacctcacggacaacgtgaacgtcatggccgtgaacctcaccacccaggtgcgcggcatcgccaaggtggtgacggcggtggccaacggtgacctcacccagcgcctgaagatggaggccaagggcgaggtggccgagctggccgacaccatcaacgcgatgacgcagacgctgtccatcttcgcgcagcaggtgacggacgtggcgcgcacggtgggcgtggaaggcaagctgggcgcccaggcggtggtgccgggcgtggcgggcacgtggaaggacctcaccaacaacgtgaacctgcttgccaacaacctcaccgaccaggtccgcaacatcgccgaagtcaccacggctgtcgccaagggtgacctgtcccgcaagattaccgtcgacgccaagggcgaggtgctggagctgaagagcaccatcaacacgatggtggaccagctcaacagcttcgccgcggaggtgacgcgcgtcgcgaaggaagtcggcaccgaagggaagctgggcggccaggccgaagtgcgcggcgtgtccggcgtgtggaaggacctcacggacaacgtgaacttcatggccgtcaacctcaccacgcaggtgcggggcatcgtgcgcgtggtgacggcggtggccaacggcgacctgaaccagaagctgacgatggatgccaagggcgagattgccgcgctcgccgacaccatcaacgcgatgacgcagacgctgtccatcttcgcgcagcaggtgacggacgtggcacgcacggtgggcgtggaaggcaagctgggcgcccaggcggaagtgccgggcgtggcgggcacctggaaggacctcaccaacaacgtgaacctgctcgccaacaacctcacggcgcaggtgcgaaacatcgccgaggtcaccacggccgtggccaatggtgacctgtccaagaaaatcacggtcgacgccaagggagaggtgctggagctcaagagcaccatcaacacgatggtggaccagctccgcgccttcgccgccgaggtgacgcgcgtcgcgaaggaagtcggcaccgagggcaagctgggcggtcaggccgacgtgaaggacctgtccggcgtgtggaaggacctcacggacaacgtgaacgtgctggccggaaacctcacggaccaggtgcgaaacatcgccaaggtgaccacggccgtcgccaacggcgacctgtcgcagaaaatcaccgtctccgtgaagggcgaggtgctggagctgaagaacaccatcaacaccatggtggaccagctccgtgccttcgcctccgaggtgacgcgcgtcgcgaaggaagtcggcaccgaaggcaagctgggcggtcaggccgcggtgcccggcgtcgccggcacctggaaggacctcacggacaacgtgaacgtgctggccggaaacctcacggaccaggtgcgcaacatcgccaaggtgacgacggccgtcgccaacggcgacttgtcacagaaaatctccgtggaggcccggggcgaaatcctggaactgaagagcaccatcaacacgatggtggaccagctccgcgccttcgccgccgaggtgacgcgcgtcgcgaaggaagtggggacggacggaaagctgggcggccaggccgcggtgcccggggtcgccggtacatggaaagacctcacggacaacgtgaacagcatggcctccaacctcaccgcgcaggtg

SEQ ID NO: 42951 - DNA, 339 bp, Myxococcus xanthus
aatggcatgcagcccagtgtctgcacggacgtcaatgaatgcacgaatggcactgcgcagtgttcggtgaatgcgatttgcacgaacacgccgggaagttacacctgcacctgcagaccgggctactggggaaatggttggacgtgcagtgacatcgacgagtgctcgaacgggactgccgcgtgcaatcccagccaggtgtgtgtcaacacgccgggtggctatgagtgcgtgggtggctcctgtccggctccccgggtgcagtgtggcgcgcagtgcgtggatgtgtcgtcggacgtgaacaactgcggcgcctgcggcgttgtctgtccggcggcg

SEQ ID NO: 42952 - DNA, 708 bp, Myxococcus xanthus
gccgtgacgcgcgcggagctcagccgcttcctgtccaaggccgtcgccgacgcggtgatcgccggtgagacggaagacctggcgcagagccggctggcggaggtgagctgcctcttcgcggacatccgcgggttcaccaccatctcggagaacgattctccgcaagaggtggtagacatgctcaacgcattcttcaccgccatggccggggtggtgttccgccacgaggggaacctggacaagttcattggggactgtgtcatggccgtctgggggccgccgctgtcgcacccggacgatgccgcccgcgcgcttcgggctgccttggagatgcaggacgccgtgcatgagctgaaccgccgccgcgtggccgcgggcaagcagcccatcgaggtcggcatcggggtgaacaccgggcaggccgttgtcggctacatgggcagcgccgagcgccacgagttcaccgccattggcgacacggtgaacacggcctcgcgcctgtgtggcatggcgaagagcggtgaggtcctggcctccgagtctacggtgcgcagggcgggcgccggcttcgacgtggaggggctgccggccctccaggtgaagggcaaggagaaggccgtgccgacctaccgcgtccacgggctggagtacaccaccgccgcttcctcctcacgccgcgcatgagtccgacgacgcaggcctgcccca

SEQ ID NO: 42953 - DNA, 2639 bp, Myxococcus xanthus
tgctcgtcctctgcctcggcgcctgtgcgggctcgcggccccagcccgctcccactcggtctgcccccgctcgccccgtcacgcaggccgtgacgcccgagaaggaggcccccgtcctcaccccgccgggactgcggctgtctccggccgtgcggcccgtgcggcagacggtgacgctggagctggacccgcggcggaagatgttcagcgggacgacggacatcgaaatcgagctgccccaggccacgcacgaggtgtggctgcacggggaggagctctccgtgaaggacgcggccttcatcgtggcgggcgcgcgggtcaagacgtccacgctgcccatcggcgacatgctcgtcttcctcccgcgtgaggcggtgggccccggcaccgtcatcctgcgcgtggcgtacacgggccgggcgcgtgcccgggagagctcaggcgtctaccgcgaacaggacgcggggcgctggtacacgatgacccagttccagccgctggccgctcggcgcgccttcccctgcttcgacgagcccgccttcaagattccctggcggctcaccctgcgcgtgcgcgaggaggacggcgccttcgccaattcaccggtggaggccgagacgcacggcccggatggatggaagacggtgcgcttccagacaacgcccccgctgccctcgtacctggtcgccttcgcggtgggcccctttcaagccgtggacgcgggcgtcgcgggccaacaccgcgtgccggtgcggatgctggtgccgcagggccgcgccgcggaagcggcctgggccgcgcaggccacgcccccgctgctggagcacttggagacgtggttcggcacgtcctacccctacgcgaagctggacgtgctggccctgcccggcacgcaagggggcgccatggagcaccccggcctcatcaccttcagcgccccgctcatgctgggccccgtggagggggactccctgtggcgccagcgctacttcgcgctgacgcaggcgcacgagctcgcgcatcagtggttcggcaacctcgtgacgcccgcgtggtgggacgacctctggctcaacgagtccttcgcggactggctcgcctacaaagtcgtgacgcagtggaagcccgaatggcgcggtgacgtgcgccgcgtggaagcgcgaggtgatgccctggtggaggaccggctcgtcagcgcgcgcagtgtccggcagcccatcgaagcgccgggagacgtccactccgccttcgacggcatcacctacaacaagggcgccgcggtgctggccatgttcgagtcctgggtgggccccgacgccttccagcaaggcgtgcggcactacctggacacccacgcgaggggcaccgccaccaccgcggacttcttcgaagccctcacccaagccaccggcaaggacgtggcgcccgccttctcctccttcctggaccagccaggcgcgccgcgcgtcgccatgacgctggagtgccccaaggagggaccgccccggctgaccctggagcagcggcgctatctccctctgggctcgccgggcggacgcggggaagaacaggcgtggcaggtgccggtgtgcgtgcgctacgccgccgggggcacggagggccgcgcctgcacggtgctctcggagtccacgggcacgctgtccctggatggcgcgaagtcctgcccggactgggtccaccccaacgcggaaggccgcggctactaccacgcgctgctgcgcggtgatgcgatggagcggctgacgcggcaggggggccgggggctcagcatcgccgagcgccgcgtcctgctggatgacgccgaggccctggtggccagtggcgagctggacgtggcccaggccctgacactggccacgcgcctgctgcgagcggacgacccggacctcgtcatgggcgcggcggccctggtcgccagcgtgcgggatgacttcgtcccgcgagccgcgtggccaaaccgcgcgcgcttcgtccgtggcctctttggcggtcaggctcgccagttgggcttcgttccgcgcccgggcgaaagcgacgacgtgcgcatgctgcggccccggctggtgtggatggtggcccagtcaggcgaggacgtcctcctgcgaacggaggccgggaagctcgcgctgcgctggctggacgaccggcgctccctgtccatggacgcggcgcagggcgtgctgggcgccgcttcggcctcgggggatgccgttctccaccagggcatgctcgaagccctgcgcaccaccacggagagccgtgagcgcgacgtgctcttcaccgccatgggaggctttcaggattccgcgctcgccagcgccagccgggccctgctgctggcgccggacgtggacacgcgtgaggccctgcccatcctcttccggcagttggaggagcagcccacccgcgcgggtgcgttcgacttcctgcgcgagcacttcgagacgctccgggagcggctgccgcgggacatcgcgccctggctgctgggcaccggcggattcttctgcgacgccgaacaccgcgcgcggttcgcggacttcttcgcgccctacgcgcccaccttcgaagggggtgagcgcgccctggcgcaggcgctggaacgcgtggacctgtgc

SEQ ID NO: 42954 - DNA, 1326 bp, Myxococcus xanthus
taccccctgctcacctcgctgggccgaaacctgagccaggccgcccacgagggccgcctggacccggtggtgggccgcgcgcgcgaggtcgaggaggtcatcgacatcctgggcaagcggcgcaccaacaacccctgcctgctgggcgagcctggcgtgggcaagacggcggtggtggagggcgtggcgcagcgcctgctcgagctgcgtgggtcgctgtcggagaaggtgctggtggagctggacatggccacgctggtggccggcacgcagctgcgcggctcgttctccgagaagctcaacacgctgacggaagaggtccgccgctccaacggccgcgtggtggtcttgatcgacaaagtccacacgctgctgggcgcggtctccacgggtgacagcccgaactactccgccaaccagatgaacacggccatggcccgcggtgagttcccctgcctatgcgccaccacacacgacgagtaccggaagttgatgaccaccgacccggccctggagcgctgattcacccccgcggtggtgaacgaaccctgcgtaccggagacggcggagatcctccgcggcatcatcggccgctacgaggagcaccacgggctgcgctacacgcccgaggcgctggaggccgcgacgtccctggccagccgctacgtgacggaccgcttcatgccggacaaggccatctccgtggtggacctggcgggcagccgctgccaccgcgagggccgcgacgtggtggagcccgccgacgtggcgcgcgtggtggccaagctcgcgggcgtccccgaggagcgcctgctgatgaacgactcgtcgcgtctgctccggctggagcaggacctggcggagcgcgtcatcgggcactcggaggcagtcacgcgcatcgcccgggtcatccgccgcaactacgcgggcttcgcgtcgcgccgccccatgggcagcttcctcttcctgggccccacgggcgtgggcaagacggagatggcccgcgcgctggcggacgtgctgttcggcagccgcgactcgctggtgcgcctggacatgagcgagatgtccgaacagcacggcgtctcgcgcctcatcggctcgcccgccggctacgtgggcttcggtgagggcggacagctcacggagcccgtgcgccgccggccctcgtcggtggtggtgctggacgaaatcgagaaggcgcaccgcgaggtgcagatgctcctcctccaggtcctggaggaaggccgcctgacggacggcaaggggcgccacatcgacttctccaacaccgtcatcgtcatgacgacgaacctgggtgcggag

SEQ ID NO: 42955 - DNA, 1284 bp, Myxococcus xanthus
atgccgaacgtcgtcgtcatcggagcgcagtggggagatgaggggaagggcaaggtcgttgacctgctcaccgagcacgcccaggtcgtcgtccgcttccagggcggcaacaacgcgggccacacgctggtggtgggtgggcagaagacagtcctccacctgattccctcgggtatcctccaccctgggaagacgtgtgtgattggcaacggagtggtggtggatcctgccgtcctcgtcggggagattgacgcgctgaaggtgcgcggcttcctcaaggacgacgcgcagctcctcatctccgacaatgcccacgtcatcttcccgtggcacaagctgctggacagcttccgcgagaaggcgcgcggcggcagcgccattggcaccacgggccggggcattggccccgcgtacgaggacaaggtggcccgtcgcggcatccgcgtgcgggacctgctcaacgcggaccggctgcgcacgcgcatcgaggcccggctgccggcggcgctggacgagctgaaggacctgtgcgcgcaggcgggcgacccggtgccgcagctcgaggtgccgcagatactggcggagttcaccggcctgggcgagcggctcaagcccttcgtccacgacgcctcgctctatctgtccggtcaggtgcgccgcggcgcccgcatcctcttcgagggcgcgcagggcacgctgctggacgtggaccacggcacctatcccttcgtgacgtcctccaactgcgtggcgggcaacgcggcggtgggctcgggcctggggcccacggccatcgacaaggtgatgggcatcagcaaggcctacaccacgcgcgtgggcggcggtccgttccccacggagctgcacgacgccatcggcgaccagttgcgcaagatgggcgacgagttcggcacgaccacgggtcggccccgtcgctgcgggtggctggacggcgtggtgctgcgctacgcctcgcgcgtcaatggcctgtggggcatggccctcaccaagctggacgtgctcagcggcctcaagacgctgcagatctgcaccgcgtacgagctggacggccagaaggtgatggagctgcccggcgactacgaggacctggcgcgcgtcaagcccatctacgagacgctccagggctgggacgagcagatcgccggcgtgcggaccttcgacgagctgccggagaacgccaagcgctacgtgcgccgggtggaggaggtcagcggcgtccccgtggtgtgcgtctccgtgggcgctgaccgcggtgagacggtg

SEQ ID NO: 42956 - DNA, 1377 bp, Myxococcus xanthus
tcccgactcctactcgtctcgaatcgacttcctgtcaccgtcaaggtggagaaggacactgtctccgtggtccgcagcgcgggaggcctggccaccggccttcgccgtccgcacgaacgctcgggggggctgtggattggctggcccggggacgtctcccgcttgtcggaaagccaacgcgcccgcgtggacgcccagctcgcggagctgcgctgcgtgccgctgacgctgtccgccagcgaggtgagccgctactacgaaggctattccaaccgcgtcctgtggccgctgtgccactacatgctggagcgcattccgcgccaggaccgcgattgggaggtgtaccgcaaggtcaacgagcgcttcgcggacctggtggcgaagcactacgagcccggggacaccatctgggtccacgactatcagctcatgctggtgcctggcatgttgcgccagcggttgcccggcgcgcgcatcggctacttccaccacatcccgtttccgtcgtcggaaatcttcagcacgctgccgcgtcggcgtgagctgctgaaggggctgctgggcgcggacctcatcggcttccacacggtgagctacgtgcggcacttctccggagcgctgctgcggcacctcgggctggacacggacatcgaccgcatcatctgggaggggcgcgacgtgcgcgtgggcgccttccccatgggcatcgacgcgcaggccttcgaatcgattgcgagcgagcccggcatgcaggaggaggtggcgaacttgcgccggtcctccgaaggacagcgcatcctgttgggcatcgaccggctggactacaccaagggcattccgcggcgcctcctggcggtgcagcgcgtgctggagcgcacgcccgcgtggcgtggccgcctgcgtttcatccaggtgacggtacccagccggacccaggtggaggcgtacgccaactaccgcgagctggtgaacgagctggtggggcgcatcaatgggctctacgggacggtgcacaacgtgcccgtgcactacctctaccgctcattcaacgaaggcaagctcgtggggttgtcccggggcgcgaatgtgatgctcgtcaccccggtgcgggacggtatgaacctggtggcgaaggagttctgcacggcgcgtccggacgacgacggcgtgctggtgctcagcgagttcgcgggcgccgcagcggagctggggggcgcgctcatcgtcaacccctacgacgtggacgccatggcggacgccatcgagaaagcgctggggatggcggaggaggagcgccgcacgcgcatgcacacgctgcgcaagcaggtgaagtcgcgggacgtgcattggtggacgtcctccttcctcgaccggctc

SEQ ID NO: 42957 - DNA, 1221 bp, Myxococcus xanthus
cgtgttaaggcttcctcgcgcatgagcttcactacgtaccgggacgtgctgccctccgggctgcgcgtcgtcactatcgagacgccccacctccacaccgccctgctcgccgtctacgtgcggacgggcagccgccacgagacgctcgtcagcaatggcgtcagccactacctggagcacctcttcttccgcggcagcgagggctggccggacaccgtgaagatgaacgcggcggtggaggaggtcggcggcaacctcaacggcgtcaccacccgggaccacgggtactactacacgcccatccaccccgcgcacctgcgcgtgggcctggacatcatcggcgacatgctcacccgtccccgcctcaccgacatggaggtggagcggcagatcatcctcgaggagatgctcgacgaggtggacgagaagggccgggacatcgacctggacaacctgtccaagcacctgctcttccccggacacccgctggccctgaagatcgccggcacgcgcgagtccgtcacgaacatgacccacacgcagattctggagcacttcgcccagcactacgtcgcggggaacatcgtcgtcaccgccgccggccgggtgaagcactcggaagtcctggagatgaccgagcgagccttcgcccggctcccgcgcggcccgtccagcgtcgaggcgccgccgcccctcactccgcccggcccgcgcctgcacttcgtcagccatgacgagtcgcagacggagttccgcctcaacttccgcggcgtccccgagcagcacgaggactaccccgcgctgcagatcatccgccgcgtgttggatgacggcctgtcctcacgactgccgttcgaaatcgtggagaagcgcggcctggcgtactccgtgagcgcgtcgctggacgcgtaccacgacgcggggctcctcgagatcgaggccgccagcgctccggagaaggccgcgacggtcatcaccgaggccttccgcgtgctgtccacgctctgtgagaacgaggtgggcgaagaggagctggcgcgcgccaagcgccggcaccgcatgctgctggagttctcccaggactcgccgggcgagctgtccggctggttcggcggcacggagctgttccgcacgccggagtcgtttggccaccgcgccgacctggtggactcgcagtccgccgcgcgcgtgcgcgaggtggcccggcgctacttcaaccgg

SEQ ID NO: 42958 - DNA, 1512 bp, Myxococcus xanthus
tacgccgcccccaatcagcccggctccaaggtgcagttcaagccccgctaccagaacttcattggcgggcgctgggtcgaacccacgcgtggtcagtacttcgagaacatcagccccgtgacgggcaagcccttctgtgaagtggcccgctccacggccgaggacatcgagaaggcgctggatgcggcccacgcggcccggctctcctggggccgcacctcgccgaccgcccgagcgaacatcctcaacaagatcgccgaccggatggagcagaaccgggagatgctcgcggtcgccgagacgtgggacaacggcaagcccgtgcgtgagacgctggccgcggacatcccgctggccatcgaccacttccgttatttcgccgggtgtatccgcgcgcaggaaggcggggtgagcgagctggaccacgacaccgtcgcctaccacttccatgagccgctgggcgtcgtggggcagatcatcccctggaacttcccgctcctgatggcggcctggaagctggccccggcgctggcggcgggcaactgcgtggtcctcaagcccgcggagcagacgccctccagcatcctgctgtggaccgagctcatccaggacctgctgcccgaaggtgtgctcaacgtcgtcaacggcttcggcgtcgaggcgggcaagccgctggccagcagcccgcgcatcgcgaaggtggccttcaccggcgagacgagcacgggccggctcatcatgcagtacgccagtgagaacctcatccccgtcacgctggaactgggcggcaagagccccaacatcttcttcgaggatgtgatggcgcaggacgacgacttcttcgacaagtcgttggaaggcttcgccatgttcgcgctcaaccagggcgaggtctgcacctgcccgtcgcgctccctcatcagcgagcgcatctacagccagttcatggagaaggcgctcgaccgcgtccgcaaggtgaagccgggcaacccgctggacaccgacaccatggtcggcgcccaggcgtccaacgaccagttggagaagatcctcagctacatcgacatcggcaagaaggagggcgccaaggtcctcatcggcggcgagcgcgtggcgctgtccggggacctgaaggacggctactacgtggcgcccaccgtgttccagggccacaaccgcatgcgcgtcttccaggaggagattttcggccccgtggtgagcgtggcgaccttcaaggacttcgacgacgccatccgccaggccaacgacacactgtacggcctgggcgccggcgtgtggacgcgtgacgggaacaccgcctaccgcgcggggcgcgccatcgaggctggccgcgtgtggaccaactgctaccacatctaccccgcgcacgcggcgttcggcggctacaagcagtccggcatcgggcgggagaaccaccggaagatgctggaccactaccagcagacgaagaacctgctggtcagctacagccccaaggccatgggcttcttc

SEQ ID NO: 42959 - DNA, 966 bp, Myxococcus xanthus
tcgaagcgagggctgctgctcgtcaacctggggacgccggatgctccgcagacggggcccgtgcgccgctacctgcgcgagttcctcaatgacccgcgcgtcatcgacatccacccgctggggcgctgggcgctgctcaacttcatcatccttccgatgcgtccggcgaagagcgcggaggcgtaccgcaaaatctggatgaaggagggctcgccgctgctcgtgtacagccaggccctggcggcccaggtggccgagcggctggcgggggagtacgaggtggtgctggccatgcggtatggctcgccctccatccccgacggcatcgcggcgctcaaggcgcgcggcgtgtcggagttcaccgtgctgccgctgtacccgcaggaggccgcgtcctccaccgcgtcctcgctggcgcgcacctatgaggtgctggcccagtcgtgggacgtgcccttcgtgcgcgcggtgccggccttcttcgagcacccaggcttcctggatgccttcacggccgtggcgcggccggtgattgacgacgcgcgcgccgactacgtcctcttcagcttccatggcctgccggagcggcacatgcgcaagagcgaccccacggggacgcactgcctgtccaccgcctcgtgctgcgacgccatgacggacgccaaccgccactgctaccgcgcgcagagctacgcgacggcgcgggggctggcccagcggctgggcctgccggcggaggggtggagcgtgtccttccagtcgcggctgggccgcacgccgtgggtgaagccgtacacggacgtggtgttgccggagctggcgaagaagggcgtgaagcgcctggcggtgatgtgcccggccttcgtggcggactgcctggagacgctggaggagattggcctccgcgcgcgggagcagttcctggaggcgggaggggagtcgctgacgttggtcccctccctcaac

SEQ ID NO: 42960 - DNA, 2103 bp, Myxococcus xanthus
ccagggaagccgtatcccctgggcgccacgttcgatgggcagggtgtcaacttcgccgttttcagcgagcacgcgaagaaggtcgaggtctgtctcttcgatccggaggaccccgcgaaggagacgcgccgctttcccttgctggagacgacgcaccaggtgtggcacggctacgtgcctggcctggccgcgggcgccctctacggactgcgcgtgcacgggccctacgagccgaagaaggggctgcgcttcaacccccacaagctgttggtggacccgtatgcccgggccatccacggccaggtggactaccaggcccccatctacgcctatacgccgggcaccaaggaggacgacctcgcgttcgacacgcgcgatgacgcggccgccgtgcccaagggcgtggtgatgggcgcggacaccttcgactgggagggagataccccgcctggcgtgccgtggcacgacacgctcatctatgaagtccacgtgaagggcttcacccagctgcacccgcgcgtcccggaggcgctgcggggcacctacgcggggctggcgcacccggccagcatcgagcacctgaagaaggtgggcgtcaccgcggtggagctgctgcccatccagcacatcgtcgacgagcctttcctcatccagcgcgagaaggtcaattactggggctacaacacgctggggttcttcgcgccggacgcgcgctacagcggctcgggttcgctgggcgggcaggtggacgagttcaagcgcatggtgaagcagctgcaccgcgctggcatcgaggtgctgctcgacgtcgtctacaaccacacctgcgaaggcaaccagctgggccccacgctgtccttcaagggcgtggacaacgcggcgtactaccggctcacggagaaggacccgcgctactacctggacgtcaccgggtgcgggaactcgtggaacgccacgcacccgtacgcgctgaagctcgtcgccgactccctgcgctattgggtggaggagatgcatgtggacgggttccgcttcgacctggccaccacgctgggaagagacaggcacggctacgacacccgcgccgccttcttccaaatcatccaccaggacccggtgctcagccgggtgaagctcatctccgaaccctgggacgtgggcgactttggctaccaggtgggcaacttcccggtgctgtggagcgagtggaacggcaagtaccgcgacaccatccgccgctactggaagggcgatgaccggcaggcggcggagattggctaccgcctcaccggcagctcggacctgttctcactgtccggccgcaagcccgcagcgagcgtgaacttcgtcaccgcgcacgacggcttcacgctgcacgacctcgtcacgtacaacgacaagcacaacgaggcgaacggtgaggagaaccgcgacggcgccaacgacaaccactcctggaactgcggggtggagggcgagacgaccgacgccgaaatcaacgccctgcgcgaacagcagaagcgcaacttcctggcgacgctcttcctgtcccagggcgtgcccatgctggtggccggcgacgagatgggccgcacgcagaagggcaacaacaacgcctactgccaggacaacgagctgtcgtgggtggactgggagctgaacgacacgcagcgcgcgctgctggacttcacctgcgccctgaccaagctgcggcgtgagcagccggtgctgcacaagcggcgcttcttccgcggcgcccatatgtgggacagcgagctgaaggacctggcgtggttccggcccgatggccaggagatgcgcaaggacgactgggagaagccctacgtgcgctccctgggattcctgctgggcggtgacgccatcaccgcgccggacgatgaagggaaccggattgtgggggacaccatcctggtgctgatgaacgcccaccacgagcccatcaccttcaggctgcctgctgtcgaatggggcgcggactgggagctggtggtggacacggcgttggcgggggagtcgcttcgcacgcatacgccggcggggggcaccgtgcaggtggtgggccgctccctggcggtgctgcgc

SEQ ID NO: 42961 - DNA, 549 bp, Myxococcus xanthus
gtggagggcctggagaaggcgtacggcgaggtgaaggccgtgcaggggctcaccttcgaggtggcgcccggcgaggtgctcgggttggtggggcccaacggcgcggggaagacgtccacgttgcggtgcctggcgggcatcctgccgcccagctcgggccgcatcctggtcgcgggatatgacttgtcgcggacgccggtggacgcgaagcgcgcgctggccttcctgccggacgagccgcgcttctttgaatacctcacggtgtgggagcacctgaacttcacggcgcggctctacggcgtggaggactgggaggagcggggccgcgcgctgctggaggagatggagctgacgggcaaggagaagtccctgccgggcgagctgtcgcgaggcatgaagcagaagctgtccatcgcctgtggcttcctgcattcgccaaagctcatcctcctggacgagccactcgccggcctggaccccatcggcattcggcggatgaaggcgtcgttgcggcgccgggcggaggagggcacggccctggtgttgtcc

SEQ ID NO: 42962 - DNA, 3213 bp, Myxococcus xanthus
atgcccaagcgtaccgatatccgcaaggttctggtgattggctcgggtccgattgtcatcgggcaagccgtcgagttcgactactccggtacacaagccatcaaggcactccgggatgaaggcgtggaggtggtgctgctcaacagcaaccccgccaccgtgatgacggaccctgagttcgcgcatcgcacctacatcgaaccgattacggtggaggcggcggagcgcatcctcgcctcggagcgaccggactcactccttcccaccatgggtggccagactgcgctcaacctcgccaaggcgctggcggagcagggcatcctggagaagtacggcgtgcgcctcatcggcgcgtccctggacgccatcaacaaggccgaggaccgccagctcttcaaggcggccatgcagaagattggcgtggccctgcccaagagcggctacgcgacgacgctggaccaggcgatgagcctggtggaggacatcggcttcccggccatcatccgcccgtccttcacgctgggtggcaccggcggtggcatcgcgtacaaccgcgaggagttcgagaccatctgccgctcgggcctgaaggccagccccaccaccaccatcctggtggaggagagcgtgctgggctggaaggagtacgaactcgaggtggtccgcgacacggcggacaacgtcatcatcgtctgctccattgaaaacctggaccccatgggcgtgcacaccggtgactccatcaccgtggcgcccgcgcagacgctgacggaccgcgagtaccagcggatgcggcaggcgtcgctggccatcatccgggagattggcgtcgaaacgggtggctccaacatccagttcggcatcaacccgaaggacggccgcatggtcgtcatcgagatgaacccgcgcgtgtcgcgctccagcgcgctggcgtcgaaggcgacgggctaccccatcgcgaagatcgccgcgaagctggcgctgggctacacgctggatgagctgcgcaacgacatcacccgcgacacgccggcctccttcgagccgacgctggactacgtggtggtgaaggtgccgcgcttcaacttcgagaagttcccgcacgcggaccggacgctgaccacgagcatgcgctcggtgggcgaggtgatggccattggccgcaccttcccggaggcgtacatgaaggcgctgcgctccatggagctgggccgcgtgggcctggagtccccggagctgccggcggagaaggaggagcgggagaaggtgctgcgcgaggcgctgcgcatccctcgcccggagcgtccctggttcgtggcccaggccttccgcgaaggcatgacggtggaggacgtgcacgcgctctccgccatcgacccctggttccttcgctacatccagatgctggtgaacgaggcgcagtcgctccaggagtacgggcggctggaccagcttccggacgaggtgctccggcaggccaaggcgcacggcttctccgacaagtatctgggccggctgctcggctacccggcggaagaggtgcgggcgcaccggcacgcgcgcaacatccggcccgtctacaagcgggtggacacctgcgccgcggagttcgaggcgtacacgccctacctgtactccacctacgaggaggaggacgaggcgccgcccacggaccggcagaaggtgctcatcctgggcagcggccccatccgcatcggccagggcatcgagttcgactacgcgtgcgtccacgccgccttcgcgctgcgcgaggccgggtacgagacggtgatggtcaactgcaacccggagacggtgtccaccgactatgacacgtcggaccgcctctacttcgagccgttgaccatcgaggatgtgctcgaggtgtcccagcgcgagaagccggtgggcgccatcgtccagtttggcggccagacgccgctgcgcatctccgtgccgctggagaaggcgggcctgcccatcctgggcacgtcgccggacgccatcgaccgcgcggaggaccgggagcgcttcgccgcgctcatcgagaagctgggcctgaagcagccggagaacggcgtcgcgcgcagccacgcggaggccttcaaggtggccgagcgcattggctaccccgtcatggtgcggccctcctacgtgctgggcggccgggccatggagaccgtctacgacgtggccagcctggagcggtacatgcgcgaggcggtgagcgcatcgcccgagcacccggtgctcatcgaccgcttcctgaaggaagccatcgaggtggacctggacctggtggcggaccgcaccggcgcggtgatgattggcggcgtgctggagcacatccaggaggcgggcgtgcactccggtgacgccgcggccacgctgccgccgcactcgctgtcgccggacctggtggagcggatgaaggaccaggccatcgccctggcgcgcgagttgggcgtggtgggcctgatgaacgtgcagttcgccatccaggggaagaccatctacatcctggaagtgaatccgcgcgcgagccgcacggtgcccttcatctccaaggccaccggcgtggcgatggcgaagatcgccgcgctctgcatggtgggcaagacgctcaaggagctgggcgtcacgcaggagccggagttcaagcacgtggcggtgaaggagagcgtgttccccttcgcgcgcttcgcgggcgtggacgtcatcctcgggccggagatgaagtccaccggcgaagtgatgggcctggcgaacgactacgcgtccgccttcgccaagagccagctcgccgcgggcgtgaagctgcccaagagcggcaaggtgttcatctccgtcaaggatgacgacaagccggcggtggtggacctggcgcggcgcctgcggagcatgggcttctccctcgtggtcacctccggtacgcacacctacctggcgacgaagggcatcgaggcgcaggtggtgcagaaggtgacggagggccgcccgaacatcgtcgacaagattgtcgacggcgaaatcgtgctggtcatcaacaccaccttcggcaagcaggagatcgccgacagcttctccatccgccgcgagtcgctgatgcactcggtgccgtactacacgacggtgcagccggcgcggatggcggtgggcgcgctggagtcgctcaagtgcacggaactggaagtgaagccgctccaggagtac

SEQ ID NO: 42963 - DNA, 609 bp, Myxococcus xanthus
gactacctgtcgcggcacggcatcaaggacgcgcgagtcctggaggccatcgctcggctgaaccgcgcggacttcgtgccggaggacctgcgcgaagaggcgagcgcggactcgccgctgcccatcgggcatgggcagaccatcagccagccctacgtcgtggcgctgatgacggaggcgctccagctccagggggacgagcgcgtcctcgaaatcggcaccggctcgggctaccagacggcgctgctgtccctgctgtgcagagaggtctactccgtggaaatcgtccccgagctggcccaatcggcgcgagaggtgttggggcggcagggcttcgaaaacgtctcgttccgggaaggagacggctcactgggctggccggaccaggcgcccttcgacgccatcctcgccgccgcggcgccaccagacgttccgcttcagctcctttcacagctcaagccgggcgggcgcatgatcattccggtggggccaagggggggcacccagcaactgttgcgcatccagcgagccctccggcccggagaggtgccccaggtggagtccctgctgtcggttcgcttcgttcccatgacggggcagccgctctcg

SEQ ID NO: 42964 - DNA, 1008 bp, Myxococcus xanthus
agtgtcatcggctccggctccttcggtaccgccctggcgaacgtgctcgcggtcaattgcgaggaggttcgtctgtggggtcgtgagtcctccgtggtggaggccatcaacacccagcacgaaaaccccacctacctgaagggcatccccatctcggagcgcgtgcgcgccacgaatgacctccaggaggcgctcgtgggctcggagttggtggtgctggccacgcccagccacgccacgcgcgaggtggtggcgaaggcccaggcgtacctgccgcgccatgtccccatcgttacggtgtcgaagggcatcgagaacgggacgctgctgacgatgacggagctcctggaggactgcctgccggaggagttccacccgtacctcgcggtgctgtccggccccagcttcgccaaggagctggcgcggcgcatgcccacggtggtgaccatcgcctcccactgggacaaggtggcgctgcgctgccagaaggcgctgcagacggagacgttccgcagctacacctccacggacgtggtgggcgtgcagtacggcggcgcgctgaagaacgtcatcgcgattgccgctggcatggcggacggcctaggcatgggccacaacgcgcgcgcggccatcatcacccgcggcctggcggagattacgcgcctggcggtgcgcaagggcgccaacccgctgacgctctccggtctgtccggcatgggcgacctggtgctgacgtgcaccggcgagctgagccgcaaccggcacgtggggatggagctgggcaagggccgcaagctgccggacatcctcgcggacatgaaggaagtggccgaaggtgtgaagacggcccgcagtgcgcacgaactggagctcaagacgggcgtggagctgcccatctgccaccaggtgtacctgattgcccacgagggcaagagcgcgcgcacggcggtggtggacctgatgacgcgccatccgaagtcggagctggcgggcgtctgagcggccttc

SEQ ID NO: 42965 - DNA, 1923 bp, Myxococcus xanthus
ctctcgaagctcaatcctccgcagcgcgaggccgtggtgaccctggagggaccgctcctcgtgctggcaggcgcaggcagcggcaagactcgcgtcatcacccaccgcatcgtccacctgctcaacgagcggccgggcctcatcatggcccgcaacatcctggcggtgaccttcaccaacaaggccgccacggagatgaaggagcgcctggtccacatggcgggacctcgggcgcagggcgtgctggtgtgcaccttccacgcctttggcgcggagatgctccgcgaggacatccaccggctggggtggcccaagaagttcgccatcgccgacatgggcgaccagctggccaacatccggcgcgcgatgcgcgagcacaaaatcgacgaccgctcgttcgacgcgcgcaaggtgctcaacctcatctccaaggcgaagaactccggcaaggcgccggagcccaagccggaggggattggggatgattacgacctcatcacccacatggtgtacccggactatcagctgtcgctgaaggcgcaggggtcggtggacttcgacgacctgctgctgctgcccgcgcgcctcctgcgcgagcacccggacctctacgagaagtacaccaagcgcttccgctacctgctggtggacgagttccaggacaccaacaccgcgcagttggaactgctgaagctgctggcgggccgctcccgcaacgtgtgcgcggtgggtgacgacgaccagtgcatctattcgtggcggggcgcggaggtgcgcaacatcctcgacttcgaccgcctcttcccgggagggaaggaggtccggttggagcagaactaccgctccgtccagacggtcctggacgcggccaacgccgtcatcgccaagaaccccgagcgcaaggccaagcagatgtggaccgaccgcacggggggaacgaaggtgaaggtggtgacgtgtcccaatgacgaagaggaggcccgcttcgtcgcgcacgaaatccagaagcacatggccctgggcatctccgcggacgacatcgccgtgctctaccggaccaacggccagtcccgccccatcgaggagacgctgcgggagaagaacatcggctacgaggtggtgggcggcagcgagttcttcgaccggcgcgaggtgaaggacgtcatcgcgtacttcaaggtcatcgtgaacaagctggacgaaatctcgctccttcgcatcgtcaacgtgccctcgcgcggcattggcgacgtgacgatggagcgcctgaacgtccacgcgcggggcgagggcgtcacgctgtggacggtgatgaagaaggccaccgactacgaggacctgccgcccggggccggggcccgggtgatggacttcgtggacctggtggagcgctaccgcgccgcgtacgagcacggccagttggccaacgtgacgcgcaagctgctggaggagattggctttcgcgaggccacccgcgcccacgccaccagcgccaccgccgcggacaagaagctcaagggcgtggacggcgtgctcaactcgctggagaacttcgaaaagcgcgagggccccaaggcgagcctgccgacgtacctcaaccgcctgagcctggacacccggcaggaggaagaggaggtgccgggcgccaaccgccgcgtcaccttgatgacggtgcacgcctccaagggcctggaataccggctcgtcttcttcatcggtatggaggaggacctgatgccccacggaggcatgcagggcgaggcgcagaacctcgaggaggagcggcgcctctgctacgtgggcatcacccgcgccaaggaggtcctctacctcacccgcgcggccacccgcgtgaagcgcggcaaggaggtgccccgcacgccctcgcgcttcctggaggacctgccgccggaggtgattgag

SEQ ID NO: 42966 - DNA, 1962 bp, Myxococcus xanthus
tccctgctggccgtgctggcggagaagccctcggtggcgcgcgacatcgcgcgggtgctgggggcgaacgagcgcggtgagggctggctgcgcggcaatggctacgtggtgacgtgggccatcgggcacctggtgggcctggcgcagccccatgagattcgcgcggactggaagaagtggagccgcgcgctgctgcccatgctcccggcggactggccgctggtcgtctccaaggagacgcgcagccagttcgaggtggtgaagcaggtgctcaacgcgccggaggtgtcctcggtggtgtgcgcaacggacgcggggcgcgagggcgagcttatcttccggtacatctacgacgcggcgaagtgccgcaagccggtacagcggctgtgggtgtcgtcgctgacggagcgggccatccaggacggcttccgccggctcgcggacggccgtgaatacgaagcgctggccgccgcggccatggggcgcagccgggcggactggctggtggggatgaacctgtcgcgcctgtacacgctggcgcacgggggccatggagagatgctgagcgtgggccgggtgcagacgcccacgctggccatggtggtggagcgcgagttggccatccgcgacttcgtgccgcgtgactacctggagctcgtggccaccttcgcgcccagggcgaagggggttccgccggacgcgctgtacaagggcacgtggttccgctcggggccggatggcaagcccgtggcgcccccgggcttcgagggcgtgcgcgaggcgcggcggctggatgcgaacggcgtggaggcgcaggccatcatcgaccgggtgcgcgccgggcgggccatcatcgaatcgctggagtcggaggagaagaggatggcgcctccgctcctctacgacttgacggagttgcagcggcacgccaaccggctccatggcttcagcgcgcagcgcacgctggaggtggcgcaggcgctctacgagaagcacaagctgttgagctatccgcgcaccgccagccggcacctgtcacgcaccgtggcggacacgctgccggaggtggtgaacgccattcgcgggccctacgaggaggacctggccgtcggtacgggggctcgggcgctgggcaagcgctatgtggatgacgcgaaggtgacggaccaccacgccatcatccccacgcccacggcgccgggcggggtgcggctgtctccggacgagcagcgcgtctatgacctggtgtgccggcgtctgctccaggcgtggcacgaggaccacgtctggcgggtcaccacggtcatcaccgcggtgacgtcggcaggggcgccgcccgtggtggaccgcttccagagcacgggcacccaggtggagcaggtgggctggaaggtgctggacattggcggcggacagaaggcgccgcggctgaagtcggaggggcgcaagggcgaggacgcggagcgggagccggaggacgagccccagacgctgccgtcggggttggcgcgcgcgcagccgcagtccgtggaggacgtggaggcggtgaagaagcgcacgcgtccgcctccccgcttcacggatgcgacgctgctgacggccatggagtcggcggggcgggcgttggatgagaaggagctcgcggacgcgatgcgcgagacgggcctggggactcccgccacccgcgcggccatcatcgaggtgctgctggaccgcgagtacctgcgccgccggggcaaggtgatggaggccacggagaagggcatccatctcatccaggtggtgcacccggatgtgaagacgccggccatgacgggccagtgggaggcgtggctccagcgcatcgagcgcggcgaaggccagctcgatgagttcatccgtggcatcgaggcgtatgtcatcgaggtggtgggccatggcgccaccgcgccgcaacggcctccgcgcaacgaggtgttgggg

SEQ ID NO: 42967 - DNA, 945 bp, Myxococcus xanthus
aagcgcgcactcattacgggcatcacggggcaggacggcagctatctcgcggagctgctcctttcgaagggctacgaggtgcacggcatggtgcgccgctcgtcggaggagaagttcgagcgcatccagcacctgcacgggaagattcagcttcaccagggcgacttgctggaccagttctcgctcgcggcgttgctcaacctgacgaagcccgacgaggtctacaacttggcggcgcagtccttcgtccccaccagttggaaccagccggtgctcacgggtgagttcaccgcgctgggcgtgacgaagatgctggaggccatccgccacacccgcccggaggcgcgcttctaccaggcgtcgtccagcgagatgttcggcaaggtgctggaagttccgcagacggaggacacgcccttctatccgcgcagcccgtacggtgtggccaaggcctacggccaccacatcacggtgaactaccgcgagtccttcaacctgttcgcggtgagcggcatcctcttcaaccacgagtcgccgcgccggggcctggagttcgtcacgcgcaaggtcacctacaacgtggcgcgcatcaagctgggcctccaggagaagctgcccatgggcaacctggacgccaagcgtgactggggcttcgcgggcgactacgtggacgccatgtggcggatgctccagcagccgcaggccgaggactacgtggtggccaccaacgagacgcacaccgtgcgcgagctggtggagattgccttcgcgcgcgtgggcctggactgggagaagcacgtcttcatcgacccggccttcgtgcgccccgccgaggtggacctgctcatcggtgacccggccaaggcgaagacgaagctgggctgggagcccaaggtccgcttcaaggagctggtggagatgatggtggacgcggacctggagcgc

SEQ ID NO: 42968 - DNA, 1542 bp, Myxococcus xanthus
atcaccctggtgggcatcaacgacttccacggacaggtggagcctcatcgcacgccactgaaggacggccaggtggtggaggagggcggcgccgccacgctcgcggcctacgtggcgcggctgcgcgcggccaacccggggggcgtggttctgctggacgcgggcgacatgttccagggcacgttgccttccaacctcacggaaggggccgtcgtcatcgacgtgtacaaccacctgggagtggacgcggccgccattggcaaccacgagttcgactatggccctgtggggccgggttccatggcgcagcggcccggggatgatgcgctgggtgcgctcaaggcgcgcatcggccaggcgcgattccccatgttgtcggcgaacctccgcgacgcttccaccggcgcgcgccccgcctggacgggcaatgacggcacgtacctgatgaaggtcaagggcgtgaaggtgggcatcatcgggctctccacggaggacacccccaaggtcaccaatcccgccaacgtgtcgtccctgcgcttcctgcccctggcgcccgccgcgctggaagcgtcccgttccctgcgcgcgcgcggcgcggaggtggtggtggtggtggcgcatgcgggaggcaagtgcgcggacttgagcaacccccgcgacacgtcgagctgcgacgagggcgacgcggagattctgtcgatgctgaagcgcctgccgccaggcacggtcgacgccatcgtggcgggacacacccaccagacgatgggccacttcttcgcccaggtgcccatcatcgagacgacggggctggcgcgctccctgggcgtggtggagctgttcgtggacccggacagtcgccgcatcctgcccgaacgctcccgcatccaggccgccattcccctctgtgcgaaggtggacgccacccagggaacgtgtgacggccgccgcctgcggaacgagccccaggtgcgcctggagcccgcgtcgttcatggcggagccggtggtgcccgacgcgcaggtggcgccgctgctggcgccagcgctggagctggcacgggaggcgcagaatcgccagttggggctcgtggcggccacgcccctggcccgcggctacacggaggagggcgtgctgggcaatctggtggcggacgtgctgcgtgcgtcggccaatgcggacgtggggctgatgaacccgggcggcgtccgggccgacctggccgcggggccgctcaccttcggtcaggtgttcgaggtgctgcccttcgacaacacggtggccgtggccaccctgacgggccccgagctgtcgcggttgctgcacctggcctatggcaacgacatgggctccgtcttcgccgtctccggcctcgaggtgacgctggagcgctgcccggggcctgggcggctctcgggagtggccctcgccggcggtcagccgctcgtggtggactcccgcaagatgtaccgggtggccctcccggactttctggcgcgaggcggtgacgggcttgagcccctcttgagcaccgtgccaccggag

SEQ ID NO: 42969 - DNA, 939 bp, Myxococcus xanthus
cgcatcctgggcacagccagtgtccttcccggccccgccgtgacgaccgcggagctgtgcgcgcgcgtgggacgaaacgccgcggaggtggcacggaagacaggcatcctcacccgccacttcgcaccaccggggacgaaggccgcggacgtggcggcgcaggcgctgcggggcgcgctggacgcggcgggactggaggcccgagccctgcgccgaatcctctgcgtcacctccatgggcggcgacgtcaccacgcccgccaccgccaaccgcgtggcagcggcgctgggcctgtcgggaagttgcgacgcgatggacctgagcaacgcctgcatgggcttcctgagcgccttcgacctggcggcgcgctcggtggccacggggctggggccggtgggcatcgtgtccgtggagctgctgtcgcgcaccaccacgcccgaggagccccgcccctacctggtgctgggcgacgccgccgccgccgccgtgatgggcgcgggccgttcgggagaaggcgtcctgggcgtggccctgggcaatgacggcacgctgcccacggacgtcgtgctggagaacccgacggccaccggcaagctggagcggatgcgcttcctgacgcccagccaggagatgacccgcgtcgcgctggacgcgctggtacgggcggcgcgcgcggcgttggacgaggccggcgtgacccttcacgacgtcgagtgggtgctcacgcaccagccgaacggcagcatgttggaggccatcctccaggcgctggaggtgtcaccggaacggagcgtgcgcgtggtggacacggtgggcagcgtgggctcggcctcgctgggcaccagcctggaccggctgctgcgcacgcgtccagtgaagccagggcaccgcatcctcctggtgggcgtgggcgcgggcgtggcccacggcgcggtgctg

SEQ ID NO: 42970 - DNA, 759 bp, Myxococcus xanthus
gcgctcatcctgggagcttcgtctggcacgggcgcggccatcgcggaggcggtgactcgaaagcccgggttgaatgtctttggtgtccaccggggccggtacgcggaaggtgccgtgcagttggagcagcggattcgggacgccggtggacgcggtgtgctgtggcaggcggatgcgtcttcaccggaggccgcggaggcgggcgtggcggcgctgcgggaggtcgccgggcctcggagcgtgaagctcttcgtgcattcgattgcgggtgcctcggtggggcgattcctgtccgagggcgaggaccggctgcacgcgcggcgcatccgccggaccttcgacacgatggcgcactcgttcgtcttctgggtgcaggccctggtgaatgaagacatgttggcgccggaggcccggcttctcggtctgcagaatccgctggatgagacgcacctggggaacacagggctcatcagcgcgtcgaaggcggcgctggagatgtacgtgcgctacctggccatggagctgggaccgcgaggacaccgcgtcaacctgctgaagttcggcacggtgatgacgcccgcgctaaagcacgtgtactcgcccggggccctggcccgcctggaggcggcccacgcgaggatgaatcccgcgggacgcatgggcaccgtggaggacgtggcccgcttcgtcacggtgctcgccggtgaggaggcgggctggttcaacggagccaccatcgacttcaccggtgggatgacg

SEQ ID NO: 42971 - DNA, 1332 bp, Myxococcus xanthus
gacatcggcggctacgccaaggtgaagcagcggctccagcaggagattctggacgtcctggcgcacaaggacacgctgagcgacccggaggcggtgaagcgcgtggaggcgctgttgccgcgcgggatgattttctggggccctcccggcactggcaagacgctgttcgccaaggccatggcctcgtcgctgggcgcggccgtccaggtggtgagtgggcccgagctcaagagccgctgggtaggcgagagcgaggagaacctccggcagatcttcgtccgcgcgcggcaggcggcgcccagcatcatcgtcttcgacgaattggactccttcgcgtcggcgcgtggcacgtacacgggctcgggcgtggagcactccatggtgaaccagctcctcacggagatggacggcttccgcaaggaggagctggtcttcgtggtgggcaccaccaacttcgtggagtccctggaccccgcgctgctgcgcccgggccgcttcgagttccagctctgcatcccctaccccaacagcgcggaccggcgcgccatcctgtccatctacaaccagaagctgggcctggagatgacggagcgcgcgctggactacgcggtgaagcgcacgggtgaccgcgtggaaggcactggcacgcgcttctctggcgaccacatccaggccctgtgccgggcactcgcacgtcggcggttgcgcgaaggcgcccagggccccaccgaggcggtggacgtggagcgcgccctcacggagttcctggaccggccggagctcacgcccatggaggagcgcgtcgtggccacacacgaggcggggcacgcggtatgcgcgctcttctgtgagcacgcgcccgccatcgaccgcatcagcatccggggtgacctggcgggctcgctggggcacgtgcagtacgcggacccggcgcaccggtacgtcgtcacgcgaggccagttgctggacagcatctgcatgctcttcggcggccgggaggcggaggcgctgctcctggatgacctctccctgggcagcgcacatgacctggagcgcgccacggagattgcgcgcgagttggtggaggacctgggcatgggcggagacggcgtgcccgtgcggcgctttgatgcaccgggacggcaggcggaccggcatgccctgtccgacgcgacgcgaagcacgctggaggccgcgattcaggaagtcctggccgtccaacgggcccgggcccgcgatatcctccagcgcgagaaggagcgggtcgtggccctgagagatttgctcatcgaacgcaaggtgttggaccgcgaggccttcacccatctggtg
